United States Patent 7,868,149 (PLANT GENOME SEQUENCE AND USES THEREOF) - sequence listing, part 33

SEQ ID NO: 16729 - DNA, 672 bp, Oryza sativa
tgattcgattgggatgcatggtttgttgatttcgttgagttgagttcttttcttgatgtacttgcaatggggtagaaggctagatttgcctggccagcgtcagttgtcgagattggtttggcttaggacattgtcggagatatgggcccgagggtatgcaaagtgaggggaagttaccttcacatccagccgcgtggctctacagcctggccctacccccgcacctcgcgagtcacagaggcggccggggggcctcggggtgccacgtcatgcccctcaggccctcgcgctgcccctccccgaggccctcgcccaactaccatgtggtggggggagcaagcggggaggagacccaggctgaacggccatcaatgcgcggcgccccaactgtccctcaccgcgtttaatgcggtaagggcggacgtgcggtgccgcctgactgacccacgtcaatcgggtgtgaccagtctgtgaccggcctgttgtcggccacgtccgattggacgggtggccgtgcccccacgtcgcctctgtatccggcggagtggaggtaggtatgtcccgtcccattggggcgtcatccggggttccctccacgcgaggaggactgccacaagtcttcactcatttaagagggaatgatagggctgtcccccgtggcaagcggggggc

SEQ ID NO: 16730 - DNA, 946 bp, Oryza sativa
gcaggagcccttttacggcatcctcccgtgaactcggagccagagacccccgtccagcgatggttggacgacgtggccaacttggtcaccactgcctagcggcagctggccgcaggtggccggcccaccaccactagtacgtcgcgtacccccaccaccctctcctcgtcagcaaggaggagggcccgtcggtcggccacggcctcgaggcggtccacggccccaacgtcgtcaggggcctcaggaagtcggaggcatcacgatggcctctacggggagcaggatgcttaagcgacgccgggacgagcgccgtgctgcccgcatgggagaaggcgcctccttgttcggagtgccgcattcctcctcgcgaggcggtccgccccccacgttcacccctggagggactagttgtagggccttcgttgcgagtcttgggaatgtccggtggcccccgaagtttcgccccaacctcacggagaagtataatggcagcatcaatccctccgagttcctccatatctataccacaatcatcgtggcagcatcggggggggggggacgaccgggtcatggcgaattatttccccatggctcttaagggtcaagcgcgcggctagctgatgacccagccccctgactccatccactcctgggaggacctgtgccagcagttcattacaaacttccaggtcacgtacccccacccaggagaggaggcggacctgcatgctgtgcagcggaaggacgatgagtccctctgctcgtatatacagcgcttctgccaggtccgcaacactattacgtgcattccggcccacgcggtcgtttatgcgtttcggaacggcgtgcggcacaaccgcatgctgaagaaaattgcctccaacgagcccaagaccatcaccgagctcttcgaactagcagacaaggtggctcggaagaaggaggt

SEQ ID NO: 16731 - DNA, 860 bp, Oryza sativa
actctgagatacacaaccggatactagtattcatattcatgttcgcatatctgaaaaacgaaaacgtgaaccatttcaattctcactgccatgtttggctcgaatctctcgacttgatctgcacgttcatgctcattcaggatgcaggaggaggaagcaaagcatcctgtgcaacacggcaacgccggatccgtgcaaaaccaaacaaaaagcatccatccatccatccatccatggcagatttggcaggcctgcacagagcagagcagtaaaaaagaaaggagagtgcagtcaaaagctctcctctcctttcctgaacgggaaggcacagaaggcgtaggacagtcggaaggccaccacatctgcatgccattctcgtcattctcattctccctccaccgtggggcccacccatcacccctaacctaaccgccgtcgattcagggaggtggacggccaggatggaggcggcgcctcccacgacgcgcgtggtgcaggttcagagcagcagcagcagcaggtgtggcctccacattattaattcctcctctcctctcctctccttcctataagagagaggaggtggaagaaagcaaagcttagagagggagagagagacgacgtgctcatcgatctggttttggttggaaggaggcgcttcaggtcgttgctctccatctctctctgtgtgtgtatcctcttgttgttgttgttgttggtttcttggatcttgccagagaatcttgcttcgtttttgctttcacgcggatggtggtggattatctcctccctcgtcgtcgccgtttttttctttctgggtgaatttgtttctgcgttgcacgcgtatgatatagctatag

SEQ ID NO: 16732 - DNA, 663 bp, Oryza sativa
caagagttttttttatccatgtttaaggtgatatttgatacttatttattatccttttaggtctttcactgctttgggcagtacttctgcttgcattacgaggcctgtccaacttggagtggctccggtttacatggccttcctccgttttatgggcgacgaaaatgatgccaggaactatagttatagccttgaggttggcgcgaatggccggaagatgatatgggagggcactccccgcagcataagggacagccaccggaaggttagggacagccatgacggcctcataattcagcggaacatggctctgttcttctcaggcggagagaggaaagagttgaaattgcgggtcaccggccgaatctggaaggaacagcagaatcctgactcgggagcctgcattccaaacctattcagctgaactgaaataacaagagagaaggattcggattcggattcggtttaggtgtatattgggtgatgcgtgtggtgcacctgtgcccgcttctgtaatttgtttgtgttgcttccacttttcttccacgtagccgctgtggcctgccctaaattagttagggctgacgtgtgaggaccatgaaaaaaaaatacggcttgagctctgtgggttctgattgatcacatgataagaaatttctcgat

SEQ ID NO: 16733 - DNA, 672 bp, Oryza sativa
agcccatatgtccacataggagaaaaccccggaaaaaggagtcgaagcacctctcttcacagtgcgggcacgcgtagtgtagctttaggtggaccccatcaattattttcctgaggccgaccccaccacgacgtttctcttcatcttcccggatcaatctctcctgcaccaaaccaacctccgctccttcccctctctctcttcctctccctccctgaactggcacatgacatcaactcccctccccctactctcctcgtcagggtggaatttgtggacgtgggtgcctccctccccttaccgtgacggacacttggtgacgacgaacttggcgctcccggtggctcaaatcgagagctggcgtgggcggcgaggtcccggtggctcggatcaaggggcggcgcggccaacgagctccaggcggctcagatcaagaggcgcggccaacgagctttccggccccacgccgcttttcctccgccgcaccatttctccctcctccccatccgacggcgcatcgatgcagacagagctggacgggagcaatgattctagcgcgggaacaaagatgcagagcgagggagcagaggattgaagctacgacctccacagcgcaacgcgaggtgattccctgtgtcacgcgtcctcctttcgacgagaaaactcattgcc

SEQ ID NO: 16734 - DNA, 671 bp, Oryza sativa
aaaattaggagatctccctcatctccagtgtattcccatcaaccgcttgaagttaagcggcgtggtgaactggcgttctccgtcgtaaaatgcagctgctgccagcttagcggccttctccgtggggtgccccacgtcccagaaccagtactccctccggttcccacacggtgctccgaactgctcattgcagggccctatgcagcacacagcatcagtgttcgtaaaccctgtgtacatacgatgacgaactaacattaggaatgcatcatcattaagaagaaatgcatgaagtaaattgtgacggttcacgaataatctgacagattttgtcaagtaattaaataccattagccgacgggttcatgaaggtggcattggagaagccgtagaaatcggcgacagagtagcggaggccggggagggaggagctcagcccggccatgagagaccccaatccgtcgttgaactccctcgcgagggcgttcatccggtcgtcgcaaccgccgacggggctgtggctgtgcggctgctccgtcaccgccggcgcgcacccgatcggcggggcgttgacgacgccgaacctcctcgcgcccagggcgtgcagtggccggacgacgagctcgccgtaggaggcgacgaggtgcgggatgtcggtctcgttgtcgggc

SEQ ID NO: 16735 - DNA, 566 bp, Oryza sativa
gggtgcttgcgctcacacctcccgccgtggcttcaaggccatgagacgtgagcttctggctgcagtcccgactcacgaggcaacacgaaaggcgcgctggttggaggtgaagctcaccttcgaccagagcgaccatccgacagtgctcgctcggggagggaagttggccctcgtggtctccccgaccatccacaacatcaagatgaagcgtgtcctggtcgacaggagggctagcctcagcatcatctccccggctgcctttgacacgctcaaggcccaagggatgaagctccagccgtcactgccgatcatcggcataacctcggggcacacgtggcctctgggtcacgttgagctcccggtaaccttcggcgactccactaacttccgcaccaagcggatcgacttcgatgtggcggacctcaatctgccctacaacgcggtcttgggcagacctgctttggtgaagttcatggccgccacccactacgcctaactccagatgaagatgccgggccccagcggccccatcaccgtcttcggcgatgtcagggtcgctctcgcct

SEQ ID NO: 16736 - DNA, 883 bp, Oryza sativa
aaactgcgccactacttccaagcgcatcgggtttccgtcgtgatgtcttaccctctcacccaaatcttgcacaaccgagaaggtactgggcgggtccaaaagtgggccatcgagctcgctgagttcgaccttcacttcgaaccacggcacgcgataaaaagccaggttctggctgatttcatcacggagtggaccccggtggacgaccctgttgcatacaatgccccccccctcctcggagatggaggagacccaaacgccaacattcgcgccgggcactgggttatgcacttcgacggctccctcaaccttcaaggtgcaggggccggagtcacgcttacctcgccaagcggggacgtcctccagtacgtcgttcggctcgatttccgagccacgaacaatatggcggaatacaaaggactcctagcgggattgagggcggcggccggaatgggcatccgccgcctcctggtcctaggcgattcccagctggtcataaatcaagtctccaaggagtaccagtgcaccgacccgcaaatggacgcttacgtccgcgaagtgcgacgtatggaatgccacttcgacgggctcaagctccggcacgtaacccgacgcgacaacgcagtcgctgacgagttgtcacacatcgcatcagcacgagccccactctccccggggaccttcgaggaaaggctcgcacaaccgtcgttgcggttggacccccccccccccccgagggacccggcgccacggtctctgccccaatccccgacgacccatgggcctcggggcccaagggggtcggtcccgaccctcctagtcaggttgtttggatgactgacatccaggcatatctcgacgataatactcttcctgaggatcg

SEQ ID NO: 16737 - DNA, 2177 bp, Oryza sativa
ggtggcacggatactgatgatggcaaggcacctaatgctggcaatagtcctcaagagctggatccagagagggcaaagctgcatgcagaagcccctgtgctgccatggagctctgttttggatcgttggggttctaacagggatgcacttgtaaaccaaaggggacttgagctcgagagccattggggaagggtggataatgatgctgttatacctgctgcaaagattgcagaattaaatgttcatagttcaatatatagagaagatccagttgagattctaccatgccttgcacctctgaagaaaggaggcctttgccagagaagagatctcaagatatgcccgtttcatgggcctattgttccacgagatgccgaaggaaatccaattcatcagagtgatggccattgtgatgcagaaggaaatccagttgggcagactgatggccattatgatgcagcagtaagtcctattgatccgaatgaagacagttctgatgtaagagaaaatatgattatgccagatggaagcagtgatggtgaatgtatttatgagtcctctccttcaagaacggcaaacataaataatgacattagcgacagcgatgtaggtcatgacctcggtaaaattacagtggagcagttggcgagacaggcagtgcagaatgtccggaaaagagacagggatgacaaaaaagctctggaaaaagcccaacgagcgagaattcgtcagcataatcaagatgttttgcgggaagcggctcttgcttcaacctcgcgctcagcggcagactatgacctcccttcgccagcagtgtctcgacgggacgccgaggtaagacaaagggaccaacactggcatcgatgctgaagaagaaagttacttccaaagatagaattgcagagaggcttctgaatgctcgagctagggatgcgacaataagagaagtttcacatactgaagatatgagctacagagaagcattcccaaatcaatggtagtataagaagcctaatttttgctgaataggttggtgaatcgtcatgataagagtgaatcaataattctttctgcgcgcagttttcagttaaccacatgtcttcttgagttgcccagatacaagtaaaattgtaggttttcattgtgaagtttagtttttgtacagtacagtagattgaataagtttcttttatttcttttgcatgttcattttccctttgtaaacatgtatatgtaccactccatacttgctggattaataactatatacgctgaggctgcagttcaaattgtgttattttatctgagtaatattgtggattaattaatattgcggttttatatggttcaagacttcaagttgctggtgcaactcgtgacctcaggttttacagaaaaaacaaggaccgaccgttgtgcataatagatgtaacatgttattttcacccatacatgttagcatatattcgctacttcctctaaaaaaaaaaaatttgatggctaaaatgtggcaaattttacgaaaacggttttttttcgggccgagagaagaacagaaacccgtttggaaagaataggaagggtttttgtgatcaatcagcacacctatctttaaaagcatacaaagagaatttccgttctcagggcactatgccttggatggaacagcgcaaaagaacgatgaacctttgcacatactcactccgcttcataatgtaaaactttcaggcattgccaaggttttttttgtcacatgtatataacatagttgctaacacattggacaatgttattatttttcacacattactaacctaattagtacatagttatatacacattcacttacagaaatacacatatacacagtgtggtaagtacatcacatggttcagatcgataaacagaaattacctgtgttcagaacgattagaaacgctcttatctgaaccaggcacacgtaaccaaagctaagaacttgcagagatttccattccagagagccgcttatgcctcgaatggaatttaacaaacacaaatctagcaaaagcaatatacacctgcacatcatcatcacatacacaaattaacctaccaaactggacacacacacacacacacacacacacacacacacacacacacacacacacacacatatatatatatatatatat

SEQ ID NO: 16738 - DNA, 809 bp, Oryza sativa
tgatcttcaagactccaactcgtactcggtttgtagcccatctccgactcggattacacgtaggcgcgcgcctatttatagctgctgccctgcccgtctccttactccattagcttgctagcgcgcggcacaagagcagtaagcgaggcgcgcatggcggcgcgcgcggcgacaccggcctgagcaaggtcaggcgctactggcccgggagggcgccggactgggcgtgggcgggcgccgctgtcgctcacgacgaggacgacgcacgtctcgtctcgacgcttgacgagatcaagcacgtggaggaggaggcgctgaggtcgccgcgccgccgccgccgccgtgtacggcagcctcccgagatcgtctcggcggcgccggcggttgactgctggcatgagcccgatcagatcgaggaggaagaagaagatgacgatgatgcccgggaggagcgcagagcgaggataagggagagggcgctgctcctgaggcagcatgaggaggagcagcttcttcttcatcatcatcaccagcggcatcaggaggatgaggcggcgtctgagtccgacgagacggcggcggaatcggactcggacgacgagcagatggccgtcgtctacatggccgcgcccctgttcgtccccaagtcacagcgcgacaccatccggctcagggaggaagaacagcatcggcagcgccggcggcttgagctggagctggacaagaagaggctcgaggacaggaaggctcagacgaggcggatcctgctccaagagatcatcaaagaagagctcctcgccgccaccaca

SEQ ID NO: 16739 - DNA, 588 bp, Oryza sativa
agtcatcctcctcagacattcatgtataaggtccatgtcaggggtgcaatccctcttggcgatcaaaaccttccctttctgcgacatttttttaaaaagaaaaggtaaaggggaatagattctcatggccatgatgaacttccaagcctcctgttcatttcctggaacgaacctgtccagcgatgcattatgattactggcaatatattgcccggacactgatcatgcgcagttactactgttattgcatctttcccaggggaggttaagcagcaagcatgtgttcaaagatctcatcattttatgtcgaaaaagtcctgatcatttggaaaaaggaaaatcattgaaagaaactggccgccatacctggtctggtaaatgacgacggtacccgtttcttggtctctttgtaaagttgataataaccatatttttttttctaggggtaatctcttgtacagtatggttggtccacgcccgcctgctattctggtaaacctgtaggcacgctcacccgaccacagctctcgtgggtgagcaatgtgccggtgacataccataaaagaatagaagagagaccttcgcttg

SEQ ID NO: 16740 - DNA, 373 bp, Oryza sativa
tcaatttttttttaataagataagtggtcaaacactataaacaaaaactcaaaatctcttatattatgggacggagggagtatcattttgtgatttggtcaatggtgatgataaggagcgaggagtatgatcatcacatagcaaagctacaatacgttttccttcttctctctctaggcatctcgttggcgttcgccgaagcagccgcggaaaaggataggtaccgtaccaacccgcccccacaagcaagaaacactccgctactctccagggcggacggcgacctcccccaaaaatccacagatatttcctacgcacccccggcttctcttccccgcacgaaacccccacctcctcctccccaccatgtccg

SEQ ID NO: 16741 - DNA, 1488 bp, Oryza sativa
  unsure (1)..(1488): unsure at all n locations
gaagggtttctcatccagctcgcccattctcttgagtccgatggtgctacgagggcctaacagttctgataagccctacaaaacatacgcacaaactcaggtctcagccacaatcatagtataataagattgaatctgaaatgagtccaaataaacacaaatgaaaatatcttcagactctgtcaagcagtagaaaggaaagatcagcatatcatcacattacagaaatcagcgctttcttggcatcttgcagttcatcatttgtcttcctttctttgataatgnnnnnnnnnnnnnnnnnnnnnnnnnnnnnnatctcctcaatcttctcatttagttcctcagtcagctcgtcagtacgtttcttcacatcaacaccctctccctccatgtgttggaccaccagcagtcttcctctaagttgttgtatttccagttccagcttttgcttttcatccaattgcttttctaactgcaggattttgttcagagcaatctccttctctttctgtgagatttttacaagccagagtaaattccagagcatgagaaattaaaagaatcttgcataagattaataattggaaacaagagtgcagaccttgtgtttctcaacaagctttagcacatttttatcagacttctgttgctcgattctagccatgtggatggagtcgttttgctcagagttctgtaggggaaatcagtaagacaaacagtcagataagatattctaacaaagatcatcgtaaccagactgtaaatgcggagctaacaggaagtgtaatatagatacatgacaagtatacagaaatcctgtcacccctagaaagattgtcatagctgttcctgaagatagaactctgaagaggaaatgcaaatgctaaacagtaacataaagcaaagagagcaaagctgtggttacattcatacctttttcatctcactctccaattttcttctttctatgtcagtttgagcaacaaacttgcttagttgcttggatctcctctcgatggcattctctttatcatccaactgtttcctcagctgatcagtctcttcaaatattttctgtgaatgttcacgagcagcagattgcatatttcgcatttctgtaacagcaataaaatgaaacaacacaatagatattattattctggcaaattggcaataaaagtagacaacaacatagcaatcatatgcccatggcatgagaattattcatatgaacagtttgtagtatgtaccttcattgtaacttttgtgcagcaagtcagtttcttccattgccttttaacagagagaatcatttgattgcatctgcattccagttccaccaaatacttgctcttagctgtaatctggtgtgacaagttagctatgagagtctcaggcttgcgagacgtgtcattttccacaccagacacggtcgtcatatcaccatttgctgacaaaaacctaccaactgggtcactagattagtag

SEQ ID NO: 16742 - DNA, 977 bp, Oryza sativa
agcctgctgcatcagcatagtcgttcttgagaagattggccaaggccatgtggtttgccttcacctttggagcgcgattggatgcgccaaccccaatggcatgctgaagtagctcgttgtaacggtagtcctgcttcttcttccccagacagaatgggcatctgaacttttcattgcctagactcaccaccggcttcccagacttgaggtccatgtagcacttgtcagcatagtcatcaatatctgcatcacttagctctgactcgtcggaggtgaaatccatggcagacctgagtgacacggaaatattcaggtgagaacattgcattgagctcgaaaacagcactggatgcacctttgttacaaccacagttaaaaaaaaatcaagcaaggatgtagtaagtgtgcatatggcattgttcagaacatcagaggaccacacagaacaacagggcaatggtcattcatgattagaataggaattacgattgcatttcaatttgcatttgcatgacacaacattagacagtgttacagattctctaacactaaatgtgcttcagtagaagaattgaaataagtcagcagcaaaataattatgaaacaagcaacacaaaatcctacagttttgaaataactcactgatgtgtgttcattttgcaatctacttcttttttttagcaagaagggcagatcccctcccatttccattaaagaaaccagcacagaacatttcaggaaccactacactcagaacaagtacaggaaaagtatataacctgagaagacctgataggcaatgccatccccatttgcacccctgaactagcctaagcaacaatccagtaaagttccagcaaacaaaactactgccaatgaacagaggtgatgcaatctattgcaattgcatcagaaacagccctatagaagcgaaactcgaaatatctacacagtccaagtataaatgtataatcaag

SEQ ID NO: 16743 - DNA, 752 bp, Oryza sativa
tacctcaccgcctttccccaacatgtcgctcgtcgttgagagattgctcgattggcccagacggttcgccagcacccgcgtggaggcggccgctctgatcgacaccaagaacctcaccgcgcatctcatgtagatctcggcaataaccatcatgtcctgcgagggaagtaaggcagaggtccatgatagctccaccgccgatgcctattgtcggaagaagaccaggagaagggagaagaagatgagaagggagaagaagatgagggcaaaacaaacattttacatagtttttctctcatcaattgggtggatattgtatttttatgcgctcggtgtcctatggcaaattaccacgctttcgaagtgtcattaggaaaaaatcacattcttacgacgtctaccagcaaagataataagtttttaagtgtcatgtagcaaattttgcattttgattcaacaatatgtagtttacatgtttccactatatatatggtttgcaatatatattttgccagattatgaacttatgtgagacgtgtgtggtaccagtagtgtaattattgatgttctacttgttttcaaggatgagatatgtacctctagaatatatatttatggagttatgcgctttttgaggaccggagtctagttaattatatacatagtcaatgtttcatttagaatcttcaggctttctagttttacctttaggacctcgcaagagtaacattataggggaaaacactattatg

SEQ ID NO: 16744 - DNA, 425 bp, Oryza sativa
ggatcagtgctatagcggaccttacggtggcggatcaggccatcgcaggctcggtggaggtggatccgccagccaccgagccgcccactatcgccgatcgctccctcagcgtgatgctgtgcctggtgccgctcaccgcctgtctcgtccagtgaggtgagagaggagatgaggtgagagagtggagaggaaataatgaggagagaaggtgagagagaggagtggataaggatgaaaaattttgaagtgtcgagagggaaatgaggatgtaactcagactttagacagatccttaagaagcccgtctacaaaaatatattttcgcatgcagccccttaagaggtctgcctgcaaaaataggcttatttttacgtgcggacccttaagaggtccgcctataaaaatcgattttttatatggtcctc

SEQ ID NO: 16745 - DNA, 690 bp, Oryza sativa
  unsure (1)..(690): unsure at all n locations
gagcgtaccccggcactggaggagtgggcgcccatgctagaccagcgctagacgactttggccgcccacgatagaacggcggccgaggcggagtcctccctccacctccgtgaggaggccgctgccgagcgcaaccggaccaccctcgccgcagagcttttggtggctcgttgcgcggaggagctgcggcttcgagaggaggcgtgccgggaacggaacgccgtgcttgccgtacgcgaggctgaggtgaaccgccgcgaggtggcggcacgccggctgggcgagcaactcgcgaagcgcgaggaggccgttgcgggcgcgaagctcggcatctggaaagcgcccgcgctgagcgcgcggcgatggcggcgagggcttccgagctggaggccgcgagaaagagctggtggcaggcgggcagcccagcggcgcggagttggtaagccaactcaccgcggctcaaagcactctcgccgacctgnggcgcctggtgcaggaccaagccggggagatcgtggccctccgcctcaccaacgagattagacctggccaactctccgacgccgtcgaacagctggagcgcgcgggatgcggggtaggcatcttcgtgcgccaggacaggaagctcccgcctacacagccggcacttgcgttccggctggacgggatggcggcagatttggagaggct

SEQ ID NO: 16746 - DNA, 240 bp, Oryza sativa
catcaagggaggaggaggaggagacccgtaccggcgacgacgatgcggtcgcaggaggacttgatggtctggaactgcgcgaggtagttcgccatcgccaccgcgcccggccttcacctcacgcagcctgcgctccgtcccctactgctccatgcggggtaccactcgccccgccgccgccgccggtgaggggttcgcccgaaagaggcggcgcgcggcgggggggggggggaagaaata

SEQ ID NO: 16747 - DNA, 694 bp, Oryza sativa
  unsure (1)..(694): unsure at all n locations
tatgcagnagttcatacgcctcctccgcgcgttccgggcgctggagcggatcgacctctccgcctgcgcctacctcgacgacgccttcctcgccgtcgcgctctgcggcgcggatctcgacggggtgcgccgggtctggctcgcccgcgccagcggcgtcgggtggcgcggcctcaacgcgctcgtgggggggtgcccaaggctggaggccgactacctgtcgcactgcgtcggtgccggcgaccgcgaggccgccgcgctggccgcggtgacggggctgagggaattgagcctagagaagtgcctcggcgtgacggacatggggctcgccaaggtggtggtcgggtgcccgaggctggagaagctgagcctcacgtggtgccgcgagatctccgacatcgggattgatttgctctacaagaagtgacacgagctccggagcctcgacatctcctaccttaaggtatactatactcttaccatatgagctaatgaaaagtggtctttgctttatatgctggtaaggcctcttcttgttgataggctgattttagttagcactaggaatgatatgcgacagcacggagacaaataatgccgtgaagtgtgacttggatagttcgttgcgggctgattctgacatgagaaaatgacagtcatcggagcttgggcgtactgatagataactcctgtt

SEQ ID NO: 16748 - DNA, 635 bp, Oryza sativa
aataaataatggtgcctgactgacatcatgggtgtgaaacttgcaggagatgatacagtcgtttctgtcaaacttggcaaatatgaagtataccttgaaagtgcttagactagatggtcttgaagtctcatcatatgttcttccggccattggtggttgtaatagcttggtcgagattggccttagcaaatgcaatggcgtgacacatgaagcaatctcttctcttgtaactcaatgcagccacttaagggttattcttctcacatcctgtaacctccataccaacaatgcccttgattcaatacctcacatctgtaagatggttgaccatctccgttaggaatcttgttcttccataatccaaaagggcctgcaccagattgaaccctccggccccaatctaaaggagatagacctcactgactgtggagtgaatcatgcaggtttgtgtcacctcttgttgcttcatttgcacattttcattacaagccttctttttatttgagcaatatcatgtacaaccaatcacttgttttgcagcattgcagcacttggacaagtgctttgtacagcttgtactaaaattaggcctgtgctcaagtatttctcacaaaggtcttgctttaatcatgatg

SEQ ID NO: 16749 - DNA, 619 bp, Oryza sativa
gtgcagtagttcatcaatctgcataaagcaggcatctcttcggattacataatggaaggttcactccttgacctgtatgtgaaatgtggagatgttgaaactgcccttgagatcttcaattcgagtgattggactaacgtagcactttggaacctgatgcttgtggcatttgcgcacatcaacgatctaacacaggcttttgagctattctgtcaaatgccagctgcaagtatactccctaaccaatttacgtacccatgcattttaaggacttgcacttgcactagataaattgaccttggcgagcagatccattgattgagcgtcaacactggcttctagtacgctttgtctggtcgtgcaggaacggtgaatttctattgctaatatatggggctcgaaaaggcaagacatgttattgaaatgcttcaacataaagacgtggcttcatgacttccatgaatgctggatatgagcgacatgattgctctaacgaccctcttgcagcttttaaagagatgcagaaatgtcttatttgggcagattacatacgactagccagtgctataagtggctgagatggaatccatgctatgaagcaaggcttgcataatcatgc

SEQ ID NO: 16750 - DNA, 8618 bp, Oryza sativa
gaccggtgatgccgaggcgcgaacgggcggcggcggcaccctaggagagagcatagaggggttagggaagggaaggcgaccatggcggcttgaattgccggccggagacggaggggagagagggtctcaccggcgcgcgaggagaaaagggctccggcggtgattcgcggcaatgaagcggcggccgaggtgcgggcgggctcggtgagcgcgacagcggcgactgcgtggcgcggcggtggctatagtggcggcggcgcgtggccggagacggcggtaggcggcggcgcaaggggcgagcggcgcggcgacaataggaagcacgggagggcgcggcgagtgcgaaaaacgagagaggaagacgcggggagcgatttataggtgcgggagggggcggacgtgcccggggaggtggccgatttggccggcgatgtgggggagtggggaggaagagagagagagagagggattcaaatcccccaccacttgcgggcgcgcgcgcgcgggatatgtgggggggggagagcggcgacgtgggcgcgaggtgcgggcgcggagagggacggaaaaggcggtcggcgtggggaggtggggcgccggcggttggggctcggctccaaccggctagaggaggaagacgaccgacaggtgggccccacctgtcggcgcccgaaggatagagggagggagggagaacttcggggaggggaaaggggaacgggccggcccacaaggggaggccgagcgcgggcgacgggtggactgggccgacggcccaagaagaggaaaaaggaggaaaaaggaaaaacaaaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtccttctctcgctggtttcgaggatacgagtcggcttctccatatacgtcaagtcttcctggattttgatttgatccggacttgcctgttcctcaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaacttccctttggtttggaaacggtgtactcctctgagcggagtgacacgaagatacacataatcccctgtttcgaaagcgagctcccttcggcggttgtctgcatagcttttctgccgagactgcgcgattctcaatctttccctgacagctctgactttctcttctgcctcatttaaaacttctgtaccaaacaactggcgttcccctgtctgatcccagaagagcggagtacgacaccttcgtccatacagtgcttcaaatggtgccatctgcagactagcttggtaactgttgttgtacgagaactcagcatacggtaagcttttgtcccatgctccaccaaagtcaagcgcacatgctctcaacatatcctctagtatttgattgactcgctcagtctggccatctgtttgtggatggtaagcagtgctgaaattcaaccgggttcctaattcttcttgtaatttctgccagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaatcctgctggcctttggtgttctgcctttactcgttgacagacgtcacagagtgctacgaattcagctatttcccttctcatgctgacccaccagaacttttctttgagttcttggtacattttggtactgccgggatgaatggaatattgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggctgtgcctctagggcagccacgaatccgtgctcaactataccaaggttcaaatgttccaaatcacgttgtacctcacagcatagttcctctacccatgcgacgttgcagtaactcttcctgctcaaggcatctgctaccacattagccttgccgggatgatagtgtattcccatatcataatctttaattagctccaaccatcttcgctgtcggggattcagatcaggttgggtgaagatgtactttagacttttgtgatctgtatatacctcacaacggttactgatgagatagtgccgccaaatctttaaagcatgaacgactgcggccaattccagatcgtgcgtcgggtagttgccttcatggggacgcaactgccgtgaagcataaaaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacaacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgataacctgatcgcaggtctatcttagagaacacagtagctcctttcagctgatcgaacagatcatcaatccttggcaaagggtacttgttcttaatagtgacctcattgagtgcgcggtagtcaacgcacatcctcttggttttgtctttcttctccacaaagataaccggagcaccccaaggcgacgtgctcggacggatgtatcccttctgtaactgttcatcgacttgcttcttgacttccgccaactcgctggctcccattctgtaaggcctcttgtggatcggtgcagttccagttaccaagtctatccggaactcgatatccctttttggtggcattgttgtcagatcatccggaaaaacctctggatactctctgactataggaatatcctctagtttcttagtggttttctccactgctacctcttgttcttcaccagcagcctggtttaaactaatccctggcttctgcggcactggagactggaagattaccacctctccttttgcattggtcaacttgatggtgcggctggcgcaatcaatcactcctctgtgccttgccaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggctttgggcactttccaaccgtgtgtccgggtttgttacaattgaagcagagttcgggtttttctcccaacctcttgggctgttctggcagagctggctgaactgattgagctggaatctttagtgaactcggagtagggttgaggctgtgctgctcactgttgttgtgactatcactatggtgggtcttattgaagctacccgggtggtagggacggtgctgtcggataatcatggtggaaggtccaccgtgacgtcccatcgtgtaacgaggcttctgacacttcccctggggagtcctgaactgggctgccttcctcttacggttcattttgttacactgctcctcttgacgaatagccttgtccacaagcttctcaaagtcctcatagtctctagagatcaactggttggtcaattcatcatcaagaccagacataaacttctcctgcttctcggcatcggttcgcacgtcctcaggggcgtagcgcgcgaggcggttgaactcatgcaaatactctataactgttctggttccttgttgcagggaacggaactctctcttcttttgtcccacaattccctcgggaacctgtgctttattgaaactatgacgaaactctgtccaagtaacctctgccccagccggacgggtcaccatgtagttgtcccaccaaatagaagcgggaccttgtagctggtgtgtagcaaaagcaaccttctcctgctcgttgcattgcaaaagattcagcttcttctcaatggcatgaagccagtcgtgggcctcgattgggttggtggtgcttgagaaagtgggcggcttgacacgaagaaattctaacagtttggactgaggaggtggaggaccaaactgcaggttctgctgctgcagctgtgcttgctgctgcacctgctgcatcacctgatggtactgttgctgcatctgttgcatcatcattgtcattatctgagtctgattgtccaacacctgagcaattgttgggttctcgggcggtggggacggactgttgtcagatgcaccgttggcacgtgctccattgatcggctcttcgctgccactggcgttgttcgagtcgcgtgaaccattccttatctccatctgaaggggataggtagaaatatgggaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactgtcgaataaactccaactaaaatttttctaaagccctagactgagctaatttttttttttttaaaaaaaaaaaaaatccgatccgaaagaacgaccaagatttttcccgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaggcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcataaccatgcacccacagcccaccattcagtgtattttaattaactaacaccattgcggtggcaccaatctaaagctataccaatagacaaagtctatgtaataaggtgatccccatttgtgtgctagttgaactaagcatggctaagcatttcctaaaccaacatctagtcattttgatacccaagttatcaatggcataaggtaaacaataaatggctgagtattaggacccatcccacatgacattgtaaaaggatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaatctacgcgacaaacaaagcacacaagcaaaacaggctataagactactgaagcaggaaacaaaactatttttaatggattctttgcatttttcttgatttactgagacttgaatggacttaaacggagctcggatgaattacttatgaattttagaagataaactgtgtttttactaataaagaaaagtccttaattaattattgcgcaatattgccccagggctgacgtcatccaagggggggggggggcggcgccgacatgcgggccccactggcagcggcacaaggggagagggagggggcggctggcaggtgggccccaccaggcggtggctcaaaggggaggcgagggaggcgccggccgggctcggctcggcctcaaagccgaccggcggccatggcgaccggcggcgacacgcgcggtcaccggcggtgaccggcggcgcgggagacggcggcggccagtgcgaaggcggcggcggcggccgaagatgacggcacacgcgcggagggcggcggcgctcatgggagggagggaaggaaggaggaggagaggggattcctcaccggcgaacacggcggccggcgcgaaggaagaaaacggcggcgacgaccggtgatgccgaggcgcgaacgggcggcggcggcaccctaggagagagcatagaggggttagggaagggaaggcgaccatggcggcttgaattgccggccggagaccggagggatagagggtctt

SEQ ID NO: 16751 - DNA, 716 bp, Oryza sativa
agtctatagagatcaactggttggtcaattcatcatcaagaccagacataaacttctcctgcttctaggcatcggttcgcacgtcataaggggcgtagcgcgcgaggcggttaaactcatgcaaatactctataactgttttggttcacccgtgttattagtctgtagtttatcctctactctggaaatgaatcaataatataagattagccgatcgttctgcagtttttgtgtttgctgccaaaacaggtatcaactgatgaacaagaaaaacaatattatggttcaaatactcaaagttatactcacagttgtgatgtatggacgtcaacgttgtggaatatttttttcccacctatttgatactgactggttgtcaattgttactgcacgtcagtgttgaggaatttttattcctacctattttcttctatcgtgctagactttgatgaagtgttgttactggatgtcaattcttgacagccaaatgttatcataagtcctaactaatcttaactctcccaagtaaatacaagaaaacatcaagcacttacaaatttaagtacaagtaaatgcaagaaaacatcaagcacttacaaatttaagtacaatcttccagcctttgttgtgaattgtgatagattctcacaaaaataatttgaacagacgggatcttggaaaaacatatagctcacgacaggaataataacaatggt

SEQ ID NO: 16752 - DNA, 4712 bp, Oryza sativa
agttggaatgggaagtttactttgatttggtaaaagagtctcagtttagatctctagaggtgtttgcatcaaagttagttcgtaccgtagaaaatttggatctaaacaaatctcattcttatcattacgttgagaagaattttgtgacatattattctcgtcgtggagggggtgcaagtaagagtgagttggtacgagaagacttggagggtgaaggagagaagaagagacctttgcttggaaatgatttatgggaggcaggaccatcaaagagacattgcggtactgatgatgtggatgcagcgagggtgatgaaaagggagttagtacaagaggggcttgatctaagtgaacatttgtcggcgagtgttcattggtcgtcgtacggagtcaaccctgaatacccgacagaagtagcaggccaatatgtgaatccagatgattacttttatgtcgaattgagtggtggtcacgattctgtctcagtagaagtcaatagagatgatgttgacgaggaggcaagtgttgagcaatatgatggtgaatttgctgaagactctgatgatgaccgtccattccctccacttactaataatgacaaggtagcattagaggaatgtcgtgcgtttgaaaaggtgtgtgggaggaagcccgacattcctgagtttagggacctaacacatgcccatggtgcactagtagatggcggcatcaacctagatcagttgccagaaccattcccgttggatggtctcagaaagggtttagagttcccatccatggtcgcattgaagctatggctccaggagtacgccatcatgcaccatcgtccataccgggttgttaattctgccgcaaataggaggtacactgttaaatgtgaaaacccacggtgcaaatggaaggtccatgcaactaagaggtctagtggcacgtggaggatatcacgggtaggtaaggaacatagttgtgctactgccgaaggttcagggagccaccggcaactgacatcaaagttcatagcaaataggttatgcaatgccataaaactgcaacctacactctctgcttctgcgttagctttgtatatatttgaggttttccagtatagggtgaagtatggcaaggcttggagggcacgagaggaggctatgaagctcatttacggtgaatggggtgaagcgtatgtccgtttgcccactttgctgcaagccattaagcagaggaatcccaggatggtctaccatatcgatactcatcctgatagggatgtcaacgttgatggagtgaccaaaaaaatttttatgcgtgcattctggtgctttggtccttccattgaggcttttaaacattgtaggccagtactagctatagatgcaaccttcctaactgggaaatacgggggggccttgatgactgcattatcagctgatgcggaggaccaacttgtacctttagcttttgccttggtggagaaagagaattcacgagactggtgctggtttatcgatcttgtccgacgggttgtggttgggccgcatagggaggtttgtattatctcagatcgacatgctggtataatgaatgccatgatgactcctgttccaggattgccatcggttcaccaccggtggtacatgaggcacttcagtgctaatttccacaaggccggtgcggacaagcatcagacaaaagagctcctaaggatatgtcagattgacgagaagtggatatttgagagggatgttgaggcactaaggcagcgtattcccgaaggtcctcgtaaatggcttgaagatgagttgttggataaagataagtggtctcgtgcatacgatagaaatgaccgccggtggggttacatgacaaccaacatggccgaacagttcaatagcgtgctagttggtgttcgtaagcttccagtgacggccatcgtatcatttacgttcatgaagtgtaatgactactttgtgaacagacatgatgaagctttgaagcgagtccagttagggcagcgttggtccaccaaggttgacagtaagatgaaggtgcaagaaagtaaggcgaacaaacacactgcaaggtgtttcgataagcagaaaaagacatacgaggtcacagagaggggtggtataacgcgtggtggtgttagattcggcgcaagagccttcaaagttgaaggtgaggggaactcatgttcttgccaaaggccattgctctaccatatgccttgctcacatcttatacacgtttatctgattcatgcaattgataaggaatctcccaaccgaatgccgtatcagttctcttcaagagccgttgtgaacacatgggcaagtcgctttgagccatacctcgaccccacacagtggccatcgtacgatggtgaagaatttgttgctgacccaaatttgaagattaaaacaagagggaagaggagatcgaaacgattcaagaacgaaatggactcaggtctgggtggttctggaaagaaaccaccttcatgcgttcaacttgatgctgcgccggtgcaaaatagatgctcgttgtgtcaccaggagggtcacaagaaaactaagtgtcctaagcgtccaaaaaagaagaagtccaaaaaaaatttaagtgttagggaggtaaatattttgttttcctactcatgttctcgcattcattttcttttaatatatgtcacattggtaactaacggtgaatttattactttttcatgtaggatggccgaggagggacaaccgccgacttacccagccttggaggcgtactacgaggcccgtcatcgcggggctgcgatcgaggcggggagggtatgaatcggcattgattcacttgtgcataagtatcggtagcgtgtatttgacattatattaactaattgatttacaattgctaatgcaggtacttcaaccgctccgagtcagagctcatgcccccccagtgttcgacgataggtacatcccgtacctaagggctgccgggttgctcggggtggccttggtcgtgagcagaggaatgccagtgttcaacgctcctgcgttgacagcacttgtggacagatggaggcctgagacacacagcttccacctccccagtggtgagatgaccatcactctacaggatgtggctatgatcttggccctcccattacgggggcatgccgtgacgggcaagacagatactcctggatggcatgcacaagtgcagcagctgtttggcattcccctgaacattgagcaggggcaaggggggaagaagaagcagaatggaatacccctgtcttggctgagtcagaacttctcacatcttgacgacgatgctgagccatggcgtgttgagtgttatgcccgtgcatacatcttgcacttgttgggaggggttctgtttcctgatgctgggggtgacattgcttcggcgatatggattcctttggtcgccaaccttggtgatctgggccgtttcagttgggggtcagcagtgttagtgtgcacatatagacagctctgtgaggcctgttgtcgtcaggcaccatcatccaacatgagtggttgtgtgctattgattcagatgtggatgtggttaagactaccggttggaaggcctaagtggaggcaaagcttcactccttggccctacaatgagccagacatggagaagacagtggcctacctttttgagagtactgccactgcacatgctcaccgggatgtggcatacaagcattatgtcaatgagatggactgcttgcagcctcaacatgtaagtacttccaatatcacttctagttagacatttacttctttaattgagatactaaccaacgacatctcttcaacttttgcagattgagtggttaccataccacacaaatgaggcttcaagcctgaccctgaactcgatgtgcaatcgagactctgactatttcatgtaccagtgcccattgatttgtttctgggcagttgagtaccaccttccgcaccgtgtcatgcgacagttcgggaagaaacaagattggccggttgaggacatctcaactggagttgaattacacaagtaaatatttcttatctttgtttgctttcattgtcaatgttcaattttgtaccatttaacccttgtcgatgctcactactatttcatcaccttctacttgtctaggtatgacagggtgagaacaaagaaggtgaaagactgggggctagagcataatagatacattgatgaatggagaacagccggaaggaacgataggtacatcgaaactatacaccaaaatcatcttttctcagagtaccttcgttggctgcataggacatatagactgttcctccgccctacttggacggaagccgacatagaggatgaccgcgactccgatgaggggcggaatccctatgatgtccggactagagttggatatcaaatggagcacgccccacttagagacaaagtcgtaagttttcttgcatttgtcaaagttacttacatttgcaccctagaccctaacatatatcttttcacgctttcagtcgagagagctcctcaggagtgtgaatgaaatggggcatgccctccaagctccgaggggtggtgaggacacggagaacacgctccgcaatgttttagaggtaaaatttatttagcactttgcattacttgagttatgcctaacaaacttcttttttttttgaaatgcagaa

SEQ ID NO: 16753 - DNA, 44479 bp, Oryza sativa
  unsure (1)..(44479): unsure at all n locations
gcagtagttcatcagtctagacgcgctcgcgctgctcctccttctcgcagcggatataccccatggtgaacgaagacgcgcagtatggcgactagctccgggccgtgtgcccgccggacgcggaggagacggcgtgggtgcacctagaccacggcacgccgggggagctcgacagccagtgctacgtacaggaacgtgctcgccgggaaggtggtggctattcaactcggatcactggacgctgatcaacgaagcggcgacaaggcagatggtcgaggacaacgcggtgaacctgtcagcccctttgcttgttggcttgccgcttgatgttagtacacacatgcactgcctgttgctaccgcttgtgcttgctagccgcagtccagccagtcctcatctgtcgccccttgccgattgcctcagcaaccagcaggagaatgctcgacgcagatgcctcccaactcgcgtgtggtcgcgtcgttgtcggccggctcagcacgccgaccgcgtccatcggcggcggcggggcctcccccgctcgcgccgctcctcccgcctttaacgcagccgccgtcgcaggtgcaggagaagccaccgccggatgccgccatcttcgaggggatgccgacgcgagtcgcggtggcgagacgcaagcggcccttacgcgttcgtgggcgcggcgggagaacggcggaggcgggtgcgtcgtggccggcagagagggcgtggagcatagtggtggatagtacagtcacggggctgagggtggcgaggacgcggccattctcgtggcccgttttcttccttccgacggccaaccttccacggcagtctcgatctccgccgccgccgctccggccctcgcccgcacgccgctgtcgccgctccagtgccactcccaggtctccgccgccgctggccaccgtcccacactcgcggagagaaagagagaggggaggatatgatttatgtgggccccacatgtcagtgggtcccacctatacttttggtgaatgacaaatgggtcccacgtatattttttttatttctaatgccacctaagcgccacgtcaacaccatgtggacagaagaccgagtcaatactgacatgtaagcgccacgtcagcgaaactgtcctccaaaaccaccaagggagtcaaattgcaccggttttaagagttgggggtcgagatatccggttttgtggtttagggtcatggattagatttcgatcacttttgagggtcataaagtgaacttattccacagaataaacctagcccaaacatgcaaacaattgtacaggtggcctcaaatgaaaaaaagaagggagggggggaatttataccttaattagtccgttccatcgtgccaccttggtcaatataaatgcttgttcagtttattaccacttttaaccttatcattttttatgttatcaaatttggtactctctccatctacttttgatagtcatatttcatcttgacacacagaccaaggataaataattctacttatcatctatttaaatatgctactagtcattcctcgtaaacaagcgattcattaatatttacatttctcaatacccatgtagccaatcatgtgttgaagaatggagagtcacgcattaaatttaaaaaaatcattaagatgataggttgttggattgaaatatgcctatcaaaaataaaatttttagatttgaaaatatgactatcaaaagtagatggagggagtaataccataaactaaacactcttcttcattgtcaccttaccaaattttgatatttctaaaagtttcttccaataagagaactttcaaaatttggtaagttacaaactgaaaacattcaacaataccaactttgatgacaccaaagtgtgccaatatttggcaatgtcaaatcttagtgagattgattttgacaacgagctgaactaagctaagaacgcaagcaaattaggtattaactgacagctccataagtaactcgaaaagataatgaaataagtcagagctttaattttgtcttgtgtttcttcagaaaaataaactagcactcgactaagctaagaacgcaagcaaattactatgtaaaaaaaggacaagtccccctaagaaaacaggcacctacttatgtgctcgagttaaacgacatatttgaagactatttcctccgttctaaaatataagacacagccactcttaacccaaagaccaagaaacaattattatcatcttctagtttgaatcaccataataaatactcactccatctacttttgatagtcatatttcatcttggcacacagaccaaggataaataattctacttatcatccatttaaacatgctactagtcattcctcgtaaacaaatgattcattaatatttatatttctcgatgcctatgtagccaatcttgtgtagaagaatgaagagtcacacattaaatccgagaaagtaattaagatgataggttgttggattgaaatatgcctatcaaaaataaatttttcagatttagaaatatgactatcaaaaatagatggagggagtataatacatgcatccaatagaattagaggtcttgatggtagaggattaaaaaagtaataatttaacggagaagaggttctaattaattgtatgcatgcatgcatgccttatattatggaacatccaaaaaagtagttgtgccttatattatggaacgtagggagtactacatgatagattttcctggacaccacccattttgtttccatgcggtccgaaactgaaaccgcatggaaaaatggggggacgagcaccgggctattgcccgcacgtcttaacccgactgcacgggataatcctcgttatcccgtgctgtcgacttaagagaaccgtacggaaaaatcgattttcgcgtgcaggcttttaagtggactgtacggaaaagtagatggagagtatggacgaccaggatggatagaagtacgtatgtatatagtatacaactccctctatctactcgtgatagtcatatttctaaatttaaaaaaaatatttttgataggcatatttcaattcaacaacctatcatcttaatgattttctcgaatttaatgcatgactcttcattcttccatacaagattggctacatggacatcgagaaatgtaaatattgatgaatcgtttgtttgcgatgaatgactagtagcatatttaaatagatgataagtagaattacttagggcagtcctaacccataacactagacatggtttccataaactccacatcatcaagaaactagtactagacactactcttccaatgcaaacaccactattccatacttcaatttaatgctacttatctcacatgatgccttggatgttatgtagaaaccatgtctcatgctagatatagtttccttatctttcctcatttattcacttgccacgtcattttttttcctaggtggcaacttatttaattgctatggacaccatcctatttattggattgggaatgtacttatccttggtttgtgtgccaagataaaatataactatcaaaagtaacgaagagagtatatttatatgagtagtacacaagtctagtcttggtactagctggcgagccttgtgcatttgttgcttaattatctcgggaagggaaagagttggggaggtgagaactgagaattgaaggaaggcagagcaggggagtcggtagctagtttttacggtgaagaagatgaaacgatactccggtaattgatccttgattaatgttctagtggtactagttttattgtgaggtttaaacggatgagggttgtagctgagtcaatgacatgtcagccacggcaaattcaaatggacgtggctttgcatacaatattttttacgaacgcaaaaaatttgcacgttaatatattataagaagatggcataatttagttacacaacacaaacggtcagaaagccgttgtcaggggccaagaaaaaaaagaaacaaaaaacaaatacataaacggttagctacagaaaaagaaaactcctaccacgagggagggatgggtatggaaacccactacactccggcctgcatctaggcagggagctggagaagagcgaagatagggcgatgacgttgtaagccgcaaccgtctcgatttacacaggaccctccgcctcgatttacacaggaccctccttagacaccaacccaagcttgcatatcagattgtgctgcgcacacgagaccgtatgactcgggccgtcgagcgcgagtttggccgcaatcctctcgctgtggctcggcacttccccatggccgcgatggcaggcgacggaggcgggtccagtgggagcaacgcagggggcaggccggcagaggcctagagcagctggcaagaaaggcgcgtagagcaacgttcaagtccgccatcggccgaccctcaagatcgagaacgaccatctttgcatgccaatactcgtattagcggattgtcctgcctgaaatcgttggaattttcagtcacctttgaatttactggatgtgcaatatagaccaatattctataggaattgtatatatatggtttggaaaactcaaatccttttaatcaaaaggccaaataaaaaaaattctataaaatttcaattatatgaaattcctctgtaaatcatttacttcaaagaggctctaaatttcttttatgtttcaagccaattcaaatgattttttttggaataataattcaaaggaattttgtaggatttccaaaatttcttcaagtaccctgtgttccaagggatatttgtttggataatagggtttagacatgttaaattcctacataagtttaaacggcaacatacttaattaccacaaaaacttattacacggcaccttattacacatgaccatggatgtactagcatataaccacgtcgcctaaacaccgtgaattactagcccacacagattcacagccaaacaagagtaatctaagcatgaactccatcacaaatccctccttaattagcaaggcgattactcactcaaccaaacgccacacacgaaccagcaagccaacgccagcgagcggcggacgtcggcggcggcggataccatttcttccctacaggaaagcggcggcggccgccttggcgcccaccgtgcgcaggaggtggaagtagagcttggggttcgccaggaacgccgcgcgggagatgacgtagccggcggcgcccggcgcgttcatgatggcgccgccgactgccgccgtgggccagaggaagtaggcggccacggcggccccgccgacggccagcgccgacttccccacgccctgctccttcacgaagccgacccccgcggcgaggcccggcttggccgccgccgccacggtggaggccacggccgccaccgcgctcttggcggagttgagcaggccgccgacgaactcgctcacgccaaccatattctgctaagcaaaccaaaacgacagtaataaagtaaagtagtattagctaccgaggtgaggactgagtagtggagtcttccgttgcttatgtagaaggccatggctacagtaatatagtaaacttctataaagttgcaacttccaaaaagaatttaaaaaaataaaaacatattcttattagaaaaatctagtacataataccagttccaacccaaaacactagacatggttttcataaactccatattattaaaaactagtactccctagacactactttctcaatgcaaacaccactctttcatacttaaatttaatgctacttatctcacatgatgttttaaatgttgtatagaaactatgtctcacgcaagacctggtttccttctcttttgtcattgccacatcatgtttcattctaggtaacaacttatttaatgctatggacatcatcctaattattgggttaggaatggcctaatatgtcacatcccatactaaccttgtatttttatgaaacgaatggagcagtcccaatatatacgtatcatcattattgttctaattatatttttataaagttattaagaatataactatataaaagtaaataaatctaataattttatctatatattggatttttaataactttctgaatctattaatgatttaagagctcaaggtttgactctgtgtagtatacaccattagagcttacttggaaacgaaggaattcgacattggtaaatactacagcattgattgattgtttgcacggtcccaaggtgattcctttggctaaaaaggtcttaaagataggaggtgcaccatgtaccaccagcactaacgaaacaaaagtatgagctcttgtactacgcatcacaagcaaagcaacagtgaaaggtcaccttgactaacaacagtgaacgacgaaatcgaaaaaggtaagaaaccaaagctgtggaaagcatgaaggtgaaatggaagtgtgacgcaagatgggattccctgattgatgtcatgtatgcttatgtcacgttatgctgctaggaaagataaccggcaacgaatctgggagttttttttggaaataatattattttaatggaaaatcgcaaaattataggtcagttagacgaaatcgcaagtttagcaccctgtcgaacggaggcagttcgaaagggtacctgtcgaactgccccagttcgatagggtacagttcgacaggtaataaaataacataaaaaaagggaaaacactgtagcgacactgtagcgacgctgcctatcgaactcccgctgttcgatacgtccatgccacgcgccctatcgaactccccctgttcgatacgtccctatcgggtactgttcaagtacttttttattttttttcttggacaactagcctgtcgaactagggcctgtcgaactgccccagttcgacaggggtacctatcgaactgccccagttcgacagggcgctaaaattgcgatttcgtctagccgacctataattttgcgattttccattaaaataatattatttttaaaaaaaattcacgaatctggtgcactcatgcacacacacaatcaggcccctccaatctagatccaaaggctagtgttcaggtgaggtaattttgcaaaaaaagcgcccgcctcttgccctggcattttgcaaaaacccccctcacgattggttttcctatcccctcatctatcagatcgtgtgtcctccgagcgcactaatccatgactcttgcgattctctttgttgaacttgttcgttctcctgcatttcctcttgccataggtgaaaacggtgattgggaaggagcttcatgtccttcctatgaggtaatccttgaacaagaccttatgtcttctcctatatgatattttttcttacaagcatacacatgtactggatactggatattgttatattcttttttttcaagggaatggtataggagctatgcaatgttcttggcttccatggtctaacttgatttactatttctagagatactacttggtcaggtgctgaagaatagttgaatgaagatggtagcaagagaatatgggaggcatctgcagtagcaggaaaactattagttgatcaggacagcttgcttgattttaatgtatctccttatatatgtacaagtgcatttctcattattgatatgcttcagcaagcactgaaaattttcactatgcatgttcacataattaaacctggtattgataattttcacacagagacttcgatggaaaaaccagcaaatttttttacattcatatcagcaagccatcataaccttttgcattcagatttcaagaatttgagagatattacattcaattcaatctgggtgaacatttttaccatgtaagaagaaagaaaaatgtgcagtccgctcaaaattcagaatggcaaacattctgaatatttctgaaaatatgtgcaaatcaaatgtgcgtcagatttgttgttattgcttggtagttggtactgccaattgttgctttgtaacaccactaagcagtagcaatgattcttatcaaaattattcttcttgcttcctcacaccacctaacagtagcaatgcttcctcagagcgatagctttcagaatggtcaggaacaggggcatcgccacatactacatctacaatcactcaacgccggagagaaagctagtgcgcgtgtgtgcaccaggatgggtactgtaaccaagagcaagtacggagttgcctccatatccactgttgatgccacctgcagtaccggtgagagagagagaggggattaaatattagggtttgcagagaacttgaaaaagagaaaaatggaatttgggaatgtgagagagcaaacctgcagcttgggttcctcaataatgtatcccagatgatcgttttgaatcagtcttgaagctttgcttagccaccaccatcgccgaggagcttcgcgtcgtcgccgccgccatcatctccgttttaactttatttaaattagactacttcaagattaactatgtttagtaatatctacaaaatcaaattagttttattatatctataattaaatatatttatcttgggataaaaatgtaactaattttttcctaaaaatttggttaaaacttagagcatattcaatatatctgtaagtaaggtccatatctagaaagtcttctccaccagcccagtagtgtgcatagatcttaatgcagaatcaacgactaggggattaactgatgaattacaaatttgcaggcgactgcacagtagcaaaagcgcaaaaaattaaactaaaaaccagaatctagattccttttagctactccctccgtcaaaaaaaaaaacctagatggggatgcccggattcgtagttttaggtgaagtcacatcctcatctaggttgattttttttagggcgggagagtatttctcgtaatctctcagacagaacctacgtattgctcgaaaagctagctagccaggatagccaggataacatagcatgtcgaacagcaatcgatcgtcgatcgatcaatgtgagcagcaccaacgcaaacacttcaactaggtggcacgattaacgtaagttcctacgaccaagcaacaagttaacaacaaagcagcgcaagacgtacgtactccatccgttttatattgtaaaacattatagcattacccacatttatatgaatgttagtgaatctagacataatatattcatagcaattctaaaaattcttataatataaaacagtggaagtaataattaaggtcgtcgattcgtcacgtcacacggcgaaggcggcggcggcggcgacgcggccggcggtgtggaggaggtggtagtagagctgcgggttggcctcgaaggccatgcgggagatgaggaggccggcgccgcccggcgccttcatcatcaccacgggcgccaccgccggccaaagcaggctcaccgccgcgccgacggccacggaggcgatggctcccacgatgtatcccacggcaaccatggcgatccccgatccctctgcactggctcggcctcggcttctgttgcttaccacttggaagttggaagagatgaggcgcgcgcgatatcggcgaccaagatggatacgtatgtactccatatataatccctccgtcctttaaaataaaccaacatgtaacctctcatatagaataataaatttggaattctggacagttctttatccaaatttgttgtattaaaatagatacaataacaaactataagccaactctaaacacatatatagataaaaagaagaaagtgaagagcagtaggctataatttatagcccgctgcagcatagaatggacgcaatatatgtattacaggtgggatcatgtatcaatagtatagtatatgtttataggtaactattatatatattggctataaaattgattatagattatttggaactattagttggctatactattaaacttgctcttaggaggggatgtatctccttctagattgggtttttttttatagagggagtagcgcacaagctgctttaccttgggaagctaagtaaggccttgtttagttccccttttttttcaaaaaatatcacattgaatctttggacacatacatgtagcattaactatagataaaacgaaaactaattgcacagtttgcatggaaatcacgagacgaatcttttaaacctaattagtcatgattagccataagtgttacagtaactcacgtgtgctactggtggattaattaggcttaataaatttgtctcgcggtttctagacaagttatgaaattagttttttcattcgtgtctgaaaacattttccgacatccgatcaaacgtccaatgaggcatctaaaaattttcttttcaccaaccaaacgcaccctaaatgacatgtgggcccggatgaattcgaatggacgtggcttgcatgccaatactcgtcaaaagcttttgacacgcggattgttctgcctaattaagggatccgatcctcatcaattggaaaagaagaaaaattctatgcacacaaccacgacatccgattctcctacgaccacggtttatgtgatgcctgtgacatatactccctccatttgatattaattgtcatataattattgaatatataagcatatattaatttaatttattccataaataaatcataacattgcagatgtaaactagcataatcgcattatacgatctacacatataaattggacagtaaaccttgaacagatcgaatatgcgaaacataacgaatacgtattgagggttttcgaagctcagctgcacagcgggaaggactcgcggtaccgggcgttgacaacagcgtgcagcacccgagcgaagagaaagacgagctattgtggatgaacagcaagcagtcgcgcaaagcgcttcccaaaaaccttattgtcaccttctcccgatgcagtacgtcgaaggcgagggttccggagacctgctctcccaatcactggtgcacgctggcgagcaggatggaataaactatgtgcgacaacactgtatagaggaggaggcaaaccctaaattgatttcgcgtgtgtgttgactgaaaacacggcggcttaggagatttgcttcactccagtgcaggtccaaggcttgtctcaagtgtcaagagcatgtaggctgattttatcctgcaaccagcaagaaagacaaaaacgtaattagatgaacgatagccaatcggccgatagggccgatgacttattgtcaggacccaaccgatacgggtaaacctaattggctgtggctttatgatagtcaattagagccaaaaccctaaatatgccctattggttgtaggactgtttcttttagtttttatcaatcgttttaagacaatattatggaaatagccgatagatcaatacttagagcgaagaaagataatgtactggctaatactccaatacagacttatataaacagattaatctataaaaatataccaaataacaattgatcaccagatatgaagtttaagcggtcaatctaactcgatgtatttatataaagcaatctatctatataagaggcaattataaataaacagatcatgaaactcgcgctatcatatataccaggtaagatggactgaaaccccaatactatccttagttatgattagttccatgttagtttcaattatatgattctaagcacggctagggatgatgcatcacaaagtatgcaaagaacataaagtctagacaaaattgctacaggatatcgtgactaggcaaaatttgctataggacatcgtgacttcacggttttagctgtagtacaccgcacgaagtgacttttgggggaaaacactcccaaaagttggatatttgctagtgaacaccgcaagcattaaagtaataatttacggttagagaggagagagaaatcgtgtgaaatgtcaaaaatgcccttgggcccacatgtcaactctcctatctctcttctctctctatccctccttctcttctctctttatcccaaatgtcgtggcgacggcaggagggcgagggcggagcggccgcaacaacgggacggcaatggctccggccagcggcgcctgccgccgacggcgcccctccttcctcactccgacggcacctcctcactccagttgaagaggagagagaaatcatgtgaaatatcaaaaatgcccttgggccacacgtcagctctcctatccctctgctctctatcacctctttcacttctctcactaatctcttctctctctatcccacatgttactgacgatggtgggtaggcgaggtttggccggggcggcgggaggacgagggcggaggcagaacggacgcgaccaacggcacgcggaggagcggcagcgcggctggacgacgacggctgcagcacgcggagtgaggagggaggggcgccgctggccggagccgtcgcccgcgcgaagtgaggagagaggggcgccgtcgcccgcgcgaagtgagaagcaatttgattttgatcaaaatcaaaacgacttataatttcaaatggagtgagtacttatcggacttcgctaatatttttttttaaagtattttagttaatcagtaataaaacatactagcagtgaagcccacacaaccacccaaccagcctgagagcgtacccgtacataccaccgctcatgcatttggtacaatcttataagaatttgaagcttaatgttagtacggatggtgaaaattctataaaaatatacatgtttcaaataagaaacccttaggacttctttggatggtagaatttttcgttttttttgtatgaatcaatttaattcccatgaaattcattaaaaaaattctcaattccaacggaggctttaattcacatttcagtaatacatagagttcgactgttcgagtgatcagtagagcagcgaggtgtgtggtacaacgaggcaatggggggaaataaaattaagactccatacagcttgtaaaattaagaattattgaaaagtttggatggattttagatgagaattcgtaactattaatatcaaattttatcgctattaataaaaataaagtttgcatattgtttttatagaatttagtcacatatcggtatatgatataagtagtaccgtatatatggagggattatcaactaataccccattgttatccacaaattcaatgtgtaatcttaccgatgatctcggccttcacctaagaaaaacctcacatcaaccaatgataatcttattatttgcaattagctagaacagtaacactaacgatgaccttgacagttactatcatgaggaagtttctatcccatttctcatgcctcgtcttgttgtttcgatcgttatgtacagcaaaggaaaggaaaagggaagattaggaagattcgttttaacgagataagtcattaccgtatgattaattgggtattaactattttaaattttaaaaattaatcatttgattttttaaaacaacttttcatgaatttttttttaaaaaaatatattattaccagttcggaaatcatctgccgaacacagcctagacgacatcgataccttttcctggtggcaagcaaagtggctagcttaatttcaacatgcaagtagctgcagccaaacagcatataattttggaatattgtaatagaagaatatattgtaccccgtccgttcaaaatatatatatgacgtattttaattaaccgttaaataagcaagtttgactatagtcttgcactattttgcttacggttggaaaatcgtatagtcattagaaagcacttttgaacatgaatccaacaatatcattatttatggcaaaaagaaacctaaacattatttgagatagtcagttataaggttcaaaattagacagtcaaaattcacattacatttccgagcgtacggacggaagtaaatatgcgtacacgttcggcaaatatcatccatgggccatggcgtacgtatatgctagtaagtagtactaggaaaacatttgtatatactcccttatttatatactcgtaaagaaacgtaaagaaagttgtttagtataatgtttaaatcaaacattgggaatataaatcatgaataactctaaagttgttgagtttgaaaatgtaaaaattatatgaatagatttgtcttaaaaaataattttataaaagtatacatatatcacttttaaataaatatttttatagaaacaagaagttaaagttatattttggagaccgtgtcactgtcaaaaacttcctttacgactacggagggagtatatactaccgttaccgtatggcgtacaggagtatccgagtacgtatatacggggtgtacacgtacaccgtacacgtacgtaggttcattttacacttctcgccggcggcggcgccgccgcagcagcagcagcaggcgaggcggaggcagtggaacgcgagggcgccgagcacggcggggggcacacgaccactgcggcgacgcggagccaccgccggtgtgtccgtacgtcgtctccggcggcgggtgtaagagcgtacgtctcggcttcctcggcggccgcggagaggagcaggccggccaggaagacgacgagctccgtggtcctcgccatgacgagctcccacaggcggccgaagctgtggtcggcgccggcgccggcggccacggctgcagcgccgcctggtaggagcctctcctcgccgcggtctccgggaacgccattgctgatctctcgatctcagtagtgtgaggagtgagtgtgtgagtgagtgagactgatgagacaggaaaaatatgttgggctgtaaatatagaagtatgtttatctaggcccaagaggcccatatttccatatgtacatgtatatgttcagttgatagagtaatgaaaaagaagtgaagcttccagagaaaacaaacacaaaaaacttcatggtatcagagcaggtcgccggtgacctcgccgacgctgaacccaagctggcggcggcgcggaccagcgtggcacggcgaggcggcacggatcggctgccgccgaggagccaggtggtggcaagggagctgagctgggcgtggatcgtcggcgtaggatccggctgcggcgctgtgaccggaggagcggcggcggcggcgtcgacgacaggggtcgccagagctcgaagggaggaaggagacggctgctgcagctgcagcagaggcagcgacggcagaggaagccgacgtggtggaagtgctgagggcaccgggcgtgcacttgctggctgagttgcggcaggaggcccgtgcggtaggaaggagagagaaaaggagaagtaggagaaggagaggaaatctgcagctgaggatttggtgctgttgctgcgctgagaagaaaaggagaagcttgtgctgtagcggttgcaaggaaaaagagaggaaagctgaggatttggtgctagtggtgctgcagttctggtttgctgctgctgttgttctgctgaagtagtgttgctgctactctgacctgagagaaactgggaagtggtgctattgctgtgttttcttcttcaaattgaggtaatcagtgttgttcttgttgctgctacttgattaaaatggggaaaaatcagggacttgaacaagtgatgggtaaattggtggacatgcttgcaaagaaacttagtgaggccccaactacaagtaatgcagtggttcctcatactgaaacaatgcaaaaaattgagttgatgcaaaatgacattaagttggagggtgttaaaaattatttgagttggtcaaaaagagctttattgatcttgaaaacaaagggattagaagaatatgttacaagggagataaaggagcctgagagcacttcaaatgttgagtggaagacttggagtactaccaactcttcagtagtagcgtggttgttgacttcacttattcctgctattgctacaactgttgagaccatatctagtgcaagtgagatgtggaaaactctcaccaatctctactcaggagaaggaaatgtaatgctaatggtggaggcacaagagaagataagtgctatgagacagggggagcgttctgttgcagaatatgttgcagaactgaagcatctatggtctgatttggatcattatgatcctcttgggttagagcaccccgattgtatagcaaaaaatgaggaaatggattgagcgcagaagggtcattgagttcttgaagggcctaaattcagagtttgaagggagaagggatgcaatgtttcatcaaaccactcttcctaccttggatgaggctattgcagctatggcacaggaggagcttaagaagaaagtattgcctagtgtcacaccatcttcaccaagtgccacatatgtagttgcacaaagtaaagagactagggagtgcttcaattgtggtgaaatggggcaccttatgcgtgattgccgtgctcctcgcaagcctagttatgggagaggaagatttggtgacaggggtggagcaagaggtggaagaggttatgcaggtagaggtaacagaggtaggggttatgagtatagaggtgatcacagagctaatgtggtcactcttgaagagggttcttctggacctacaaatgttgatgttgccaaccttgttcattctacctcaggtaattcaaaccaagcatttatgtctatcaatagctctcattcaaattggatacttgactcgggtgcatctagacatgtcacgggtatgtgtggagaatttgcatcatataaaccatacccatttacacgaaaagaaacaattcaaactgctgatggaacatcatgctcagttaagggagagggtacagtacagtgtactcctttaatcactttatcatcagtgttatatgtcccttcttttccagtgaatttggtttcaataagttctcttgttgatcatatggattgtcagatctcccttgatcgtgagaattgtttaattcaggagaggcaaatagggaagaaacttgggattggcgtcaggcgtgatggactttggtatttggatcaaaaggagacaagtgaagatgtatgtcttgcattgatggcttctacaagtgaagaagaggctaaggtattacttttgcattgtcgactagggcatatatcttttgaaactatgagtaagatgttcccaacagaactaagtagagtggataaacataagttagtatgtgatgcatgcgagtatggaaaacatacaagaacatcatatgtgagtagaggactccgaagtatgttaccatttatgctaattcacttagatgtttggacttcacctgtggtctctatgagtggaatgaagtattttgttacctttattgattgctactctcgcatgacatggttatatcttatgaggcataaggatgaggtgcttaaatgcttccaggatttctatgcatacattaaaaatcattttaatgctcgggttcagtttattagaactgataatggaggggagtatatgaacaatgaatttagtagctttctttcatcagaaggaatattgcatcaaacttcttgtcctgatactcctgcacaaaatggagtagctgagaggaaaaaccgtcatcttttggagacagctcgatcattgatgtatactatgaatgtacctaaattcttgtggagtgaggcagtaatgacagcaacttatcttatcaaccgcacaccatcaaggatactcggaatgaagacaccatgtgagatgatatttggaaagaataaatttggtgttccaccaaaagtgtttggttgcacttgttttgttagagatcatagaccttccattggaaaacttgatcctcgggctgtcaaatgcatctttgtaggctattcatcttgccagaaggggtataagtgttggagtccattagagcgacgaacctttgtaagtatggatgttacttttagagaatatgtcccattctatggtgagaagacagatttaagttctttattcattgatcttgatgattcaactagtggttatgatggtcaacaaatggaaggtgaaatattgggtccaaagggagatgaacaatcaaagaaggaaaagcttgtgattggttcaattccatgtcctataggtggtcctgttgcacaggagcaagaatggaggaagccacatgaagaggaaaatcttcaagtatacacaaggagagcaaggtgtccagtaatacaacaagttgaagaggataatcaggtagaggaagatgtaagtcatgagcaagggtctttggagtcagggggagaagatgaagaagttagagaaaaaggatctgacatgccaattgctgtcagaaaaggtgtaaggagcaatgcaggtaaacatccactaaggtatggttttgaagatcaacatgaaggtgatgatgagaataacatatccaactatgtttcttatgactctttgtcatctacatataaggcctttgtagcatcactagactcaatgcaaattccaaaggattggagagaagcaaagcaagattcaaggtggcatcaagctatgctagatgagctagaggctcttgaaaagaacaaaacatgagatcttgtaccatttcctgaagggaagaaagttgtcaattgtaagtgggtatacacaataaagcaaaaccctgatggaaaggtggaaagatacaaagcaaggcttgtggttaagggatatagtcaaacatatggaattgattatgatgaaacttttgcaccagtagcaaagatgagcacggtaagaactcttatatcttgtgcaactaatcttgactggccattgcatcagctagatgtcaagaatgcctttttacatggagaccttcaggaagaggtatatggatatcccacctggatttgctacctcacaaactaaaggaaaagtgttgagattgaagaaatctttgtatggtctcaaacagtcaccgagagcatggtttgatcgttttagacgtgcaatgtgtggtatgggctataagcaatgtaatggcgatcatacagtattctattgccataagggatgtcacactactattcttgctgtgtatgtggatgatatgattatcacatgggatgattctatagagatagcaagattgaaagaaaatctaagtaaggaatttgaagtcaaggatttgggtcagtaggcatcgagattgcaagatcccctagagggatagtactttcacaacgaaagtatgcattgaatctgctcagtgacacaggtatgcttagttgtcgaccggcctctacaccaattgagcaaaatcttaagctttgtgctgagtcgggagatccagtgaataaggagagatatcaaagacttgtagggcggctgatatatttatgtcacacaaggccggatataacttatgcagtaagtgtggtaagtcgatacatgcatgaccctagaagtggtcacatggatgccgtgtataggatcttgagatatttgaaaggtagtcctggcaaaggcttgtggtttaagagaagtggtcatcttagtttggaaggctattgtgatgcagattgggctagcagtcttgatgatagaaggtcaacctctgggtattgtgtatttgttggtggcaatttggtgtcttggaggagtaaaaaacaacctgtggtttctcgctcaacagctgaagcagaatatagggcaatgtcggtgggtctgagtgagatgttatggttgaggaatcttctatgtgagttgaagttgttgaagaatacttgcatgaagctatggtgtgacaataagtcagctatcaatattgccaacaatcctgttcaacatgatcgaacaaaacatatagagatagatcgtttctttataaaggaaaaactagatgagggaatgttgaagctagactttgtaatatctggagaacaaatagcggattgtctaacaaaggctttaggtgttgcagagtgtttgtctatgtgtaacaagatgggcatgatagatatctatcgcccatcttgagggggagtgttgggctgtaaatgtagaagtatgtctatctaggcccaagaggcacatatatccatatgtacatgtatatgttcagttgatagagtaatgaaaaagaagtgaagcttccagagaaaacaaacacaaaaaacttcaaaatatactcctagacaagttgagaatttatcctagaggatgctaattgataagattcgcaagagtacgagttgtactatatgcaaaatcaataaagcaaccacaagtattactactccatccgttctattttaagtgcaatcataagtttagttttcgtgtccaactttaattgtccgtcttatttaaatttttttaataattagtattttgttgttatgagataataaaacatgaatattactttacatgtgacttatgtttttattttttaaaaaaattaaataagacgaacggtcaaaatcatgcacggaaaatcatgaccgcacttaaaatggaacagagggagtacaaagtaaagccatttgttcagaggaaaatatgtaaaatctgtcattcagaaaagatcgaatactagtactgtgctcttcccgactcacatccttctttttccgcgacgtacgctatttaaattgctaaaaagtatttttctaaaaaaagtttctatatcaaagttgttttaaaaattcatattaattaaaattttaagtttttttggctaatatttgatcaatcacgtgttaataaacaacattgtttccgtgcgttaatgaactccacctcgggaactcagccttagcattaacctgctatggaacaatactccctccgtcccataaaaagagcattcttagcatcccaatgcaaatttagtgaggagtaaagacaactaaaatgtcccttattatttaaaaaaaaatagtaatgatgatagatatgtaaacggtatttaagggataaaacttctcgttttacgtgctgaaaataggcaggacagtagaagttgattttttttgacaaaatttaaacttcagaaattgagttttttttaagatggagtatatgagaagagattttttttccttgagattcggacaagatgacagtgatacagtttgaaacagagctgacaaacctcttccctttcagttaagggtttaaggcatctgacatcagatttcagataaccacttccctttcagtcaagggtttaaggcatctgacatcagatttcagataaccaggaagcgttttgattctcctctctaaaaaaaaagttctgaatcctactcttttaatccttgaaaaggcggtggcgctgttcgttttcttacatctgaagaacagatgaaaggaaatcacagcaggtgagacaagttaaaccacatctccgtcgattgcatacagagcacaacgacgagaggaaacatacacggctctacaatctcggaccaaggactactcatcgatcagagagaaaaaaaaatgcagcagatatgcaaagatcgttacaagacagatatagaacagagaagctcaaggcgtcattaaccctatgaagctttgacaagatacattacattaatatatattggctatgccgaatgccgatatatcaatatcgctggaagatggattgcacaacagtggctgccttagttggaagaaacatgttgatgttggccattgagtggagtgacgtttgagatcaacagatgccttcatgtgtgacttgtccggagcatccatggcggaagcttgctgttgcctgcttgtgccggagacggttgagcttctgactcccctgatcctcttggttggctttgactgaattaagatgaggaaaaacagcataactaaaacagacaatggagttgatgaaatagtagtaacatgctagatcattcctaacgtcaagttattgttcagacatgatatatcaagctgagaccaaaccatttggaggctttttcactgtttggttcaggcgctttcaggcctgggcttatttgttccaaacttccaatagccatatgaaatagaccggcagcatttgattgaacaaatttcaccggattaagtttcctaggcatagaccatcaaaaactactgaactgtgatagataatggaagtctgataaaagaaaaaatatagaataaaaatttgctgaagaacaaaacagagttttgttttatttatggtgagtgcaggggcaaaatatatggaagtaaaagcggtacctgttatttgttgtcgggatgggatctggagccgtcactggtgttggtgatgatgtgcttggtgttgctccattttgctcctcccggttagtgtttattatagcattgtttttctccttttctgtctccatgagctgctccgaagaatgtagacaaaagggtttgacctccaatacagcttttgtagtgatctgatataaaacattgttgtaaacaagaatgaaatttaccttttgcagaacattattctggtttttaagtgacttttcctgcagacaggaagatagcagattgtaagaatattcatcagcacgaacctatatcaacttcgtccatttctcagcacaatattaacatggctctgttgccacttgccagatcagatacagtaacaatcagtagtgcaggtccttttttttccctatgtttatgcatacattattgcgtaaaaggctaacggtcaagtccttgccatatgcatcgaagatttattttcccgtagaatgttcaattttacaacgtagtctgacttagtctgttctctctcccctagaatatatacattgatggcgactttcctgttatacccatttgacaacattgtgcatttcccacaatatgaccaagacaagtggcttctcgttagttccttaggtgattcaaattgactaatgatttcttcttataatggaatttctagaattgccaaaagacatgttttacatgaatatattctggtagaaggcaagaagagttagttgtctgaaaattgtttgaatgcaactttaatactccaaaacaatatggtataaacagactgctacattgctatttaaggagccacattgagggtaacctaccttcttctgaagctcagaaattgattcaaacagaagctgattctgcaaaagaaaaacaaaaaggaaagtaatgatgttttcaaagattagttggaaataattaaatcaagcaaatttgatccctcagtcaacagtgcataatggacacaaatttcaccttttttgatcttatatgcttcagagaatattccagttgatgttccaattgctggagttcttttattgttagtgtgtccaattgttcacctaagagttgccttgagcagtagatagaccaactcaagttagcataatcttgttaccaaagtgaaaatttcttaagaaagtttgcagtacctttggctcttctgaagtgcatccagtttggacttcaaaattccatattcatcaccccagttttcctaggagaaaatgaatatcaagatcagataactaaccagctagttaaataaacagccggagatagttctccaacagtcagggatgtttttttacctggtcctcagtatttggctccagtacggctctttcatcaaacgagtaacgctggtagcgttcaaggatcccttccatactacagaagaagtatcacatgattatgctttggtttgaccaatgcatcaaaagatgatgccaagcatagtcttagagcaatatcaaacaaatgcacagttataatttttgtaccctcaataattcttaaggcttgtcaggtgacaactacaaaagtaggatccattattcaaattatccatgtataaatttaaatcataactgctacaaaaattatgcatcagaaatagcactttgaaaaacatttgtatttgttggctgaaactttatccattcatgttcttcgtcgtaagtttatatctaattagaatgattaaaaaaaggattatctggccttaataacattagtacatatggtgaatccacattactcccttcgttaacaaataaaagtcgttttgaaatgtgtaatcaaatctcaacatcaactcactggagaatggattctaaactctcaagggaacatcccctcgttttttgcatgtcatctaaatggttatgatttttttaaaaaaaaatcgacaagatagattaatatgtgatagattacttcacaaacatgcaagttcaaattcaacttctacaagttacaacaaaaaaaaattaaactatggctagttaatgtatattcacggtcaaatttaattttttcattgcaacttgtagaatttgaatttgtccttgcatgtttgtggagtgatttatcacatattaatctatcttgtttattttttttcaatttttttcacaaccgtttggataacatgcagataatgaggggatgtcccctcgagagtttagaatagttcccaactcggtgtataaaaataacattcatagattcataattgaataatgtagttatattttaactattttatgagtagatgatcatacaaagaaagatgtgtgttagggataatgtcaatatcctagacaagaaataaaaaaaggaacagaaggagtatttggtagcatagaagtagcttgaccttaatactaacacaataatgagagagtattgttgcctatccaaaaattttgcaaatttgaaattatatttatcacaaaaggcatcatttaggtcccttttttcccttacgagctactgatattatgctccctccatttcataatacttggtgattttaagttcgcattgttttagtttggccattccaattttataaataaacttttagtattagattatgtaacatattattaaagtatgttacatggtaatggtaaatatagagatataaatcccatccatcataatcataaattttaaaagatattaatggttaaactgaagcaatcaccggtcaaaattgccaaatattatgaaataatagagtataggaataccaataatgaaatatttaaattcctcccattaaacaaaagatattagcataaacataagcagtttgcttaattgaaaaccataaacatggttatacttgaacagtatagctatgtcaatcagtttattgttgtcctaaaaaatccatttcaagaaataaacaccccaatttgtgagagcaagttaatagcaatgggcaatggcaacttgcaccatgtatagctaacttggtgacagtacacactaaagggacaaaagaaagttgtagtttcagttaaagcaaggccgggtattaatttacttcccattatcttaaaaaaaaaaagggaaatgaaaccgaatgcatcaaatgaacaagttaagtaagctggtcaccttatattccacctcgaaattaactaaacaaaagtatcaaaccatatgtcatgtaaagctggccgcgccatttataccagtccaggagttgtcagtaacttaagaccttactggcctggttagaggagccgcttaattagcaaggcgtccgtgcatatttcaactgaagtgctgctctaatgatttccagaaataacgagacaaataatacaagtttaccggcctagctaggctttggtaataagcatcacttgtatatgctacagtacacaagagtataagcatatgataaacctagataagcacactaattaaaatttaaacatatctttctttccgcccgtactgatgaagcacatgaattttttttcacctattattccattcctttttatacaaaaaaaaatggaagtgaacgtgttcaccaatgctacgatgattgatgagtccccaagaacaaaactgagcagcatataaagctaaatcagcaacagtgcatgtaccaccactgtatattactagcttctgatatgcatggcagcagcagcagcagcatgccagcatcacatagagagctgtaatccaggggacacaagcaacctacaactagctagacttcgcgagcaactccatcccgagctaagcagcaatcgcacgaacgaacacgtacaaagccatgaaccgtatgtgcaatcagagagcacatgagagaaatcaatcagcacgaaataatagcaatcgtacacgcaccaacaccaccagccccctcgcattccgcagcggaaacgatcgaacacaaggcaggaacccgtacgaaacgaaatcgaacgcatcaacaagccgcccaggaacggggagctccgcgagctcgcccatggcgcgcgcgcggcgaggaaaggcgacgggcatgggccgtactacgtaggtaggcgggaggtcgcggagaggaggaggaggaggaggaggagctaaacgcgtgcgtacctggagtggctggagaactcgtagagcttgcccttggtggagaagacgatgagcgcgacgtcggcgtcacagagcacggagatctcgtgcgccttcttcagcagcccgttcctccgcttggagaaggtcacctgcctgtttatcttgttctcgatccgccgcagctgcaccggccctctccccatcgtcgtcggcggcggcggcggcggcgaaggcggcggtggcggtggcgggtggagggtggagagctcggggaagatggaaatggggggaggaagagagagggagggggagggaaggcggttttagatgggggtggaatgcggtgtggccataccagggcggtttcgagtgcctcgttgtcgatttccgattggccgaggcggtttcggggcggcgtggagggatcccggccgtcggatcaggagagaggtcgttaccgcggccctggcccggtggggcccacgggccacgcggcgcgcgcgaacccgtgcacccgcgggctcgcgctcgggattggtcggtgggtcggatggggcccgcttgtctgtgactgcgggtgcggtgggctcgcgtgagggatgggtttttctttttccacaacgtaggggggtgtcgggtacaaggaaacgagacgccggatgacacgtggcgagcccacgtgtggtcgtcgaagcgggcgggtggggcccacctgccagtacaggtttttcttttattttatttttttctttttagaaattccgatacgatacgagtatttctgtttgtactactcaactccgtatagccgccaaactgtttggcaccgagtactacctagtagtacaatacacgtactgggagtaccagcgtttgtttgttggtgttgaaagatttttttttcttttttttaagagagttcgtgttgcaacaatagaaggagcggacaacaagaccgtagaaaaaggctagactttttttttttaagatactccctccggtttcattttaattgacgctttggacaatgacacgctctacaagatataccttggatcttatttttctattataatatatacaataaataaatacatgtttacttttattacagtgttttgaaagacaaatctatatatgtttttctagtttctttaaactaaatatttttaaagttattgatggtcaaagttataaaagtttaaccttaaccttgtctaaaacattaattaatatagaaccaaagggagtaatagattaactggtctccacagcccaagaaaaatgaactaccttgtggctttgtattgctatgctaccgtggttgattgcaaaattgcagataggtaaatgacctttggctacacacaggggcggagctaccatgattcctgggtattcccgggaatacccaacttttttatcaaaaaacaagtatacttttagtatatacacatgtacacatattagtgcacctaaatcctcaattcttcgatccaaacacagtccaactggcctcttgcaacgcctcctaccaacccgacccactccgtcatgacccatcagacatcagctgacccacttagccaccactcttccatacggccccctctccctctccctccgtgacccatccctccctagctcggttccctcgcgccgctccccatttccaaaccccaggtggcggcgcggcgaggcggcaaccggcggcggaagctggaccgtgctaccgcggaggggtggcgcccgccactccgccaagctcaggcggtcaggccgattgggtggccggtggccgcgaggggcaggggcagctagcggctcagcgcttagacggaaatacccaactttaaaatcctggctccgccactggctacacaaacgaatgttagccatgtctaaaaggattaccatgttaaattcatgttgaaatatttttttaaagataatggaaaataatcatggcctttaacaaacaagcgatggagccatttcaacgaaaaatatgtataaattagagcaacctttgataaacaaactatgaaaatatacatattggtttgctctcaccttccttttgttttggattatactcctctatcccaaaaataaatcaaactccagagatcaatctggacacatgtgtatccagatttttatttttattttttttgtgaggggggagggggggctacggagtgagtacacgaaagacgcgtgggcatgcagaccacactcccacatccatgaatacctcccactcccaatgctcacacacccacaaatgtgcctctcactcgcaaaccagaagcacatccctggtcccactataatgttattgaaagtacatccgtgtgtgtggaatgtttattggaaccagaatttgaaccatattagctatttctgaagtcacgtacccacgacttcaccaccacacagacgatgttttcccactactgtttgtattttccttagatcttgtgcaaaggttgcatcttgcatgagatctaggcgatttatcatctctccccttgcatatatcctccaccttatcattcaatgttacaagcaacgtggaaagattcaaggtgttttatgacatggtaggctatctcatggataaaagttatcgggactatcacttaagatgatgtggtaggagtaaaaaacaatagcgatgtcttcacacatgcagctagcatgaaaaaaatagagtaaatataatggcaccaaacgcatatacttgattagcatacttaggggtgaaaacaagtcgggccgagctaggctctgctgaaattagcatcacaagctaaaagagtagctcggcttggctcaacttcttcttgacctctagttggctcgtgagcctatgaacaaaaaatactttcagagatgaagaggagtgagaggatattggaggagccgacgagaagagtggcaactaggagtcgagaccaacaaggcgcgcgacaggtcattgggcaccagccgcaccaactttgcgagaggtgagtggcaactcgcacattgtgcttgttagcacaagctagcgacaccaaggagcagcgactttctatagtttggtcaagcagagaggcaacacgacgagttggtggaggctagagatgccttcaattggtggagtcgacatgcctacgtgcagcctcaagtatgacatgtgttgaaccgaagaaagcagtgttgtgggtaggagcatggctgagatagggaataggagacagggtgcgaggaaaggttgggaacttcggctttctttaactagattgaccactagactaataatgtgctatgagttaaatgagtgggctcgccagctagcttgggctatactcattctcgaaacgtgttgtcttatgagtgaaaccaagccatgtgagactaaatggagctcacaagttcgagatctttgtccacctctcacacaaaaactgatgagtagttgtattagtatgtgctttctgttgaaatgaaaaatgtataaggtgaattagtttgagttcttttcagcaataatgacaattttcttattttccgttatcatactttccaaatagttaaacattgtgttttgtgaaaaaaaaatatttacatattttttaaaaaaaatcaaagaactctactttttaagtttataatggctaataatcatgctctaatggttgttctagttatacgagaacatgcaacctgccttctcaaacgaagccttactcactactaaaaaatggtttttctgtcggccaaaatcagtctttgatttttgccagccttactcactactaaaaaatggttttttctgtcggccaaaatcagtctttgctgatttttgctggcagttaggttaaccgcctgaaaccaaagggtagagaaaataaacgttttcacattcggaacttaaccgccagccaaaaaacatattttcgttggcggttctgttacatgggctgctggcaacagtccatttttgcttacgtagtgttaagacgaccgccagcgaagctcttttttggttaaaaaaattgaaaatatgttaatgcatctgttctctgaccaccagcaaagaaaattaaagaaaaattgaaaattgccagatacaacaaccctgcattcccattccacattgcaaatcaaatccaagaacatgccacaaatacaagcacaaattccacaaaatataagcaaatctcaactattgaacatgcacaatcgccgatgctagatctgccctcccgatgcacgctgcacatggtcttgggcctcgccaatgaccggcttgcggcggcctcctcctcctcgcggtcactgccaccatcgaggtcgtcgtctcctccttgcccttgtcatccccgcacagatctggcaagaacgaggccggatccgcgccgatagaggtggcggcggctcgatctcgccggtggagaggggagagagctcgacaccgccaatctcgtcaccctctgtgggaaggagctcgtcacggcggtggggagggagcccgtcacggcggccggatatgatgcccacggcgcctcccgctgtctgcgctgtcgaagaaaaggaaggcaagacggggacggagttggatccggcccccgccaccgccaaactggatccagccgctgcctcctccgccacctccatgcccacatgcttcacaggctccaggcccaccgccgttgtcccctcaagcgcgccgctgcccccatgcatgagctcaccgtggacgaaccgcagccgccacccaccggtcgtctcccctccgcccagatctgggcctcctatcgcagcgcgcggggaaggggaagggggagggggaaggcccggcttttgcgcgcgtcgatttcacagtcgccgcagtcgcggtccgctatcgccgtcatcttatccgccgtgtcagctgagagccgagaggtggggtgagatgaatctggagggaggtggtgaggagaagaggataagatggagtgactagtcagtggataaaatggagtccgcacttggtgttttaatatagcgaataacttcttgcggtcggcgctccttggcaaccaccagcgaaattttgattttatctagtggtcacttaagaggcccgctttaaaaagacctctatttttacaagcggttctcttatcccggccgctaacgaaaatgaattttttcgctggcagttcttagcacctcatccctcgttaaattttcgctggcggttttcgcttatagacgtcagagaaaaaaaatagataaacgccatgaaaaatcgattttctagcggtgactccctcccatcaaacaaaaagcaattctgacatagtcttaaaaatactgtttccgctaatacttcgtattgcattttttttagaaacctaataaaatcacaatttgtaaaagtactttctgagataaatctacacacgtgattttcatgtataccatctaaatatctttaagaagaaatttatgtgtaaggttgttttcgcgattgaagggtacggtgggtaattacagtcctccttccgatggaaatgccggggaacggcaacactctatattcttttatgtccttttgaatggatccatattcttggacaggtacattggatggcacatcaatattcacttggtcaaggataatacgaggtacacgatcaacatcatgatacgtactagtaccagctaaccactgcaccataattgaccgaggaaggcaccgatgagttgaagttttcaaattcctccatttcatattatatgatgatctggcttattttttcgaatcaaacatttctaatataaaacaaacatattataaatatacatttaatgctagatataataaagctattttcatgttgtttaattattctataaatttaattaaatttgaacatagttgacttataaatcaaagcgacttaatatgaaaacgaaggtagtcactccgtttcaggttacaagacgttttaactttagtcaaagtcaaactattttaagtttaactaagtttatagacaaatataataatatttataatactaaattagttccatcaaatcaataattgaatatatttccataataaatttgtcttgggttgaaaatgttactagctacttttttctacaaacctgatccaacttaaagtaaaaacgtcttttaactcgaaatgaagggagtagaacttaaaaacatgaaaaggtcggggggagaaacggccaccggcacgtgggaagaacggacgtcttccttcctcggccacacatatgcacgcacggacgccaccttgagatcacatttggagcaaagattctatacaaaagttgctacaaaagttttttacgaaaagtttctatacaaaagttgcttaaaaaatcatattaatctattatttttttaaaaaaatagctaatacttaattaatcacgcgttaatgcgaacattgtgttacgtgccgcctcctcctgaacagatcctaatccatcatcctcactccactctctctctctctttctcccgtcgacgcggaggcgccaacgccactgaccacccccatccatcaattcaatcaccaatcaatcgacggcgacgacgacaacgacgacgatggcgacgacggagacgaggacgacgacgacgtgctcgatcgcaagctagcggcggcgaatcatgagacgcccgcaatgaagtcgtcgtcgtcgtacgtcctcgtcggcgaatcatcggtcggcgaagcagctgcagctgcagcgatcgatcgatcgatcgatgtggccgtaacaacaagcggctgggagaaggacacatcgctagtccgaggctagtacttcctccgtattattttaatatatgacgccgttgacttttcgaccaacatttgaccattcgtttaattcaaattttttatgcaaatatgaaaatatttatatcatgcttaaagaacatttgatgatgaatcaaatcataataaaataaataataattacataatttttttattaagacgaatggtcaaacgttataaaaaagttaacgacgttgtacattaaaattaaaatatggaggtagtattaagctccgagctagctgctgaatgcagtgcgtgcagagagtctctgcactccgatccactgaactcatcacatgaaactgtttcacgtgtgtggctcggtttggaattattgaaccgattattaccgtatactatgcccctccatactataaaaaaaaccagcttagaattagatggggtttactccctctctattcatgctgagtaattttacagttgttgagaaggtaccatggggtactaaaaatttcgtgtaaaattcggtaccttatacgagataccaaattcataatagaaaaggtgatatctcatattagcttttaaaggacggtaaaattggtcattcatatgcatgccataaagcccggaaaaggaacggtgtcttttcttctcctctttggtcttgctgccatgcacaaatgcattgatcaaacgcatgaaaggagaaagtaacataggccttatttagttgggaaaaatttttaggtttggttatcacatcggatatacggacacacatttgaagaattaaacgtagtctaataacaaaacaaattgcaattctgccaagaaactgcgagacgaatttattaagtctaattttattaatccatcattagcaaatgtttactgtagcacaatattatcaaatcatggcgcaattaggcttaaaagattcgtctcacaatttacacgcaatctgtgtaattgttttttttccctacatttaatactccatacatgcgtccaaacattcgatgtgacagtgtgaaaatttttattttgagaactaaacagggccatagtataacaaatctgaataagaggttatctagatttattatactagctaggttatgtcttattcacatttagtttgattttctgtgaaacggactatgctttatcgtaatgataaattagatatttatagagagaaacttaatgaatgtcaacatttaatacatggtccaaaaaactgtctaaacattcatgtatttttaaagaggtgaagaaattacccaccgtataataccccgatgaagtaatggagcctggccacttgtgctgcagttgtacgaggttacattaactctatatgccaaacatgtgtttatggttccgtatttcgacgattcagaggtagatttgttgctttctccgtggcttttacgtcgttgcaggttgtgagttgtgaccactgaagctgagctcacgttcatgtctactatagtatctcagaaaaaaaaagattattttttttctcttcctatttattctaaaataaatttataaacacattggaaacagatagctagagtatagaataattctattacaatttgataaagtgagaatattatagttctttttttctattggtatgtatagaatagataaaaaatgaatttattttgtgatacagtgatgtgagagtattgctcaaacagaagacattaccaacttcgcctattttacttatgtctcactgtctcggcctcttttaagtttggacgtacctacgtctcgttttcatagacaacaactcgcaagctactgtataacagtggccgcctgattaaaatcctctgttttgtcatgttcttttgttaagataaaggattatattaacccggcctttacaccttgggggtgtacacagccaacaactgttttgtcatgttgatgtctggggataatctgctgagtttctgctgtcatagctgaaaaaagttcaggcataatgacaaatatgcacataatcgagtaaaatgagcacagtgccacagtgtaaaaactgcgtaaactcagactattcgcccaaactgtggcaaattgatagtattgtccgttcgttgctaatccgatgctaaaaaaatctcctaaatccgcggcattgtttagtggactttatgcctctacttcctctcaagtgttgaaatgatgcctctactacgtaaaatttgcgtatctttgtatcaggattcaggactggtgggtgtttggggttatatggccttgagcccttgacaagctcatggcatatgtgtgtgtgtgtgatcgagagatggagcaaatgtagcggtggaacttgtggtttgaaaattactatctccgtcctaaaatataaaaagttatcggtttggacatatgtattaaaaaaaatgtaggtgaaataaatggaaggagattatgattggttgagaaaaaaagtaagtggtgaatttgaatgatgtgtttggtttagaaagaaattattatatttttgaataagttctaaatgtaaaaaaatgttatattttgggacggaacgtgtactactcctaccacttattattattattattattattattattattattattattattattattattattattattattattattattattggcaaaaagatttacatttcttctttcttcttatggattgggatcaggtgcagtcacgactgcaactttggcagtagccactgatccaccatccaataggtaaggaacgtccaggattaattgtctctgctccctccttttagctatttgaacatgaaatgttttctcgttttctttatctcaactttctcaaatttaagagaaatcaaatgtagtttataaacaaaatgcacacatacttcactcaataatattttgcacaattgtacatagcactgacaaatgagctagtgagtttaacttttccctgtgtttgggaataatgcatccactgagtcaaaagaaaaaaactaaactactactccaaaatcttcccgtaaatcagtgtgaagcttctattgataacttttaaagaaaatgttccattcaggaaaaaaagaaactgtaaagaaaaaacaataggattaatgcttcttagttgaacagagcatgagtcacataaaaaaaaggttaaaggagttacatcaaaatatgagctctacttcaagcccttaaaataaatgccaagcttcttttaaacatctaaataagtagtactaaatttcttgtcaaatgaaaaataattgtgctagtatttcatgttcaaatgctaaatgaggaaggaggcaattaagtctgaacgttccttactagttggatggttggattagttgctactgccaaagttagtgactgcacctgatcccaatcctcttcttatgggttactcactgttcaccataggatgctggagtaccctgcctcatgattcggcgaaaacagccaaactgtccttgtaaacgttggattgacaggctttattggtgattctaccaggcccctacctcttgcatttctgtccattcaatcaatgtatggaaaacttttcagatggggtagtactgaagtggatacctcagccagtaaattccacagccgtgagccaattggctctgattggttgagataaaggtagaaaaatgaacaaaacaatcaaaataatttacggtttaaacctttatatctatatcatgtggtttaaaagtaaacggtagtagaaaatagactaggtaaaaaaaagctaaaactgactctaaaattaaaattaagttccactccctccgtttcacaatgtaagtcattctagcattttccacattcatattgatgttaataaatttagatagatatgcatgtctagattcattaacatcaatataaatgtaggaaatgttagaatgacttacattgtaaaacgaaggaagtaaaacttaaattttagccgtgaccaccaacaaggaattaataagagccttccaagtcaataattgagagacagagtgagtgagctattggtttcgaagagtagaagtaaaagtaagttggacattatatagggcgtaatctctcaatttcaatgtataagtatttagtaatggaggtcatatcataatacttggatgatttatatccagtactaggattttatatattggcatagagggaatagaaagagaaggtgccatccaatatatatatatatatatatatatatatatatatatatatatatatatatatatatatagtaaatttgtttggtgctccatggtgcccgggcaccattgttgaaattgagtatatacccaattcaaatgagaatgaaactttttcaattacttaggtattaacattaactactttactaactagtttaaagcaagtttgaactgaatttgaacttgtttttgttagattttgattctaggtatatagcatccatacatataatttgttaggtatgtaatcatggattgtgaaataaagttaaatttgagttgttttgttgataagtataggtataaatcaaattattataactaggtatatactcacaatttgaaaattttgaaaaatttgagtgattttgtgcattagataccatggtgcccgggcaccatggtgccccatatgagtgtcctatatatatatatatatatatatatatgtggaagagtccatcttctattatatatattcatatgtgtactgcacattcatgggaagttctctacttctcttccttttaaacactggaagtaaataaataaaaaataatttcctagaactgccaacaacaaagtcgttgtagtatagtggtgagtattcccgcctgtcacgcgggtgacccgggttcgatccccggcaacggcgaattagtttttaatttttttggcacttgaaatgcaagatgcatttgtgttttaaatgacgaaatagccgataatttccaaattggaaaaggtactcctccgcaactttacagtacaggaggtgattttgaacttcaagcttcaaaataatgtgttttctttgctgtttgttcagataagcaaaaacttcagaaatgcagtcgtaggtgaaggcagttctttcttctttttacaatggggccatgtatgtgtaagtgtaaatcctatgatttctttgataaaatgattactatcgtattattatcaattccaagcaggttgcttgtgcactggagagacaaaatttaggaacagataatttaaactgacataaaattggtgcatccagggatggtttaatttttttttaatgcaagtcttatcaaggcactacaaaaaggaagcataactgcacaacaccaacaaaacacatgatgcgatatgtaaacataaccaatatctttattctaatttgaaggtgattcgatcctgacattacaactgtttcatcacaccaaaaagaaaaaaaaaattgtaaataccatagaacagccaggacggttgtccagggaggtgacacatttgaagttacaacgctgaagcgatctcagttcaatcagcactaacaaaaccaaaagtatttcggtatttcagtataagcagttcacatgaacaaacgaagtttttatactaccgccctctcacttgctcttggcagtgccgtttgcggtggcaacagctccctttggtgggttcagctgatcccaggcctcaatccatgtgaccatggagtcggcgagcttgttgaagtagccatcgaccttcccgagcttcgccctcacttgcttggccagctcaaggtaacacttctggacagtgtcggcctccttcgggagggacgcagactggaagaaggggatcagctcctcctgccagaatatgccgttgtattccttcttgaggttcacaaaggggttgctcgctttgctgtgccagatgtagggaaggccagtcttaacacccaaacccaagtgatcggtaatcacctgtttttatgacagatattagcatggattgtgattggtgagtggtgaacaatagttagcttgcacaatgcacaaattatttctgaagggggagaaagaacaaaccttggtgcaccatcctgcccacatatcgtcgtaacgaccaataggctggccatcacccataagaccaaagtacatcgcaggaccgatgaggtcacggtcaaaagcaaggttcattccacacatcgggaataaagtgcccttcgggattgtcataacagcatccacatacctgatttcatcatcaataaacaaaaacatcagattggcaagaagagaacgataaaggatgagaaatgccaaaaatgtaacatcaatacctgctgttcctctcaagaggcttgacaagctgggtaggggcatcatagtctggaatgttgagccaaagcccatgagaaacggcagtcggggcaccctcacggaggctgaaggggtacccacggacaaaatcagcgccatcacggtacgggtcatacaaagtgttgaagaaaaatggagtggaagggttcagaaggttcttgatgtgctgctcaagtgcattgatatcctttcctgatgggtctttagcaacctgagattttgcaagaggaataggtcagcaatgaaccaaaaacaaatgatagggcggaatcagagaagtattagcattacccaaaagtaacaaaacagaggactaaaataatggcatcacactccaatgctcaacttttatagtgcaaggcatgtggaagtactcagtcaactgtaagctaatcaagaaaactattgtgaagatcatactagaatgcaactaaaggacatgaaagagaacatgactatattcttatgctgtaaacaactgaggaccattcatatagttaaggttgattctacagtacatccatgcatccataagccagcctaataaaacatataaatcaaataatttaacaagcaggtgggacccttgtggctcatgtgccccatgtgaatacacatggcatttgctttgggggaagaagctacaacacaaccgctgaatacatccaacagtattttttttccttgtagaagtaaaacaaaaataggaatacagtcgagataaccttcatgtacctttatgttaattcctacaaaatttgtgttccactggctcttaactgataactagtgaccgaggcttaatgatgtcatagtccatcacatgtgatttagatggattgtttggtcctgtctaacttcagattaacgtttttgtataaaggaatcaatcataattaaatacaaatctggaaaatgatgtgtagccaataacaaagccaagatgaccccaaaccaaagtggacataccattcagtccaaaagacaccattaacttgaccctttctctactgtttctacattgatatgttctgaagaaaagactactgataacggcctcgagcataaacaaagtaatataagcgtacatatgcattaacacaaccgacaaagcacagcggcaggacgatatatccgagccacattgtcgcgtactaacaatttctgaatactacaaacctgtggggcaccacagatatacatataacctattccagctcacatcccctccaaccgcaaccgcaacctatacatgaccaccaagcaagtgtagctagatccaatgcttgatgcttccaagcagtgggccaagtcaaacgttcaatccaagacaaagcaaacactgtcagatctgataatggcagactacatgcatgattccaaggattaaggagttactaccttttcaactaggcagatcaatcagtcatccgcaacatgtgaaattcacattcaacctacccacatcacagcactatgcagtagtaatagtagtagtatgatgtaatgcaaaaattaaagggtttttttatcactactaaactaaactgtcctaacaaaaagaactactaatctcgcaaaactgaagctaaactcaaaaatctaactacggggcaatgccgattgctgacgaagaaacagcccagagatctcgcctttcccccactaaaactacacatccagatccgatccccaccaaaccaagatctaaaatccccgcacacagatcacgccatggcagtggagaaagatcgcccaagatccagcggccatcaaccagcagatcaaaccttaacagagacagatctcactgaggcgaagttaatcgaggggtggaagggggaaagaagctcacgaagcagtcgtcgtcgatggtgtagatgtacttcttcttggagaccatgtagccgaagcagcggcaggcggagtccttgaaggagatgcaggaggccctggggccgaggatccggttgatgtcgtcgcggttgtagagctcgtagtcgaagccctcgggcacccggatcgtcttcttggggtcgcagtcctggacgatgatgaggtggtacgcctgaaagaaggacctccacatctccaggaagtccaggttgcggatcgtcgggatcacgatgtccagctcgtccttcagcagcggtgtcaccgcctgcgcgaccacggcgtcgtaggaagccattcccggtgtcggacaagtaggtagacatccatctggagttgtagatcgtaggtactaaggctatactagtcgggtataaaagggacggattctatggggtggtccgaatggcccgtggtgggcctcttttttgttgggctttgcgtgtacaggaagcaaaggtatctgtgtgagtgtgagtgtaagtgtgggtggtccgttgttgaagttggtgcttcgcttgactcattatcactactactggggcatggactgatttgcatggccatgaacatggtgcctaccaacaacatctgggatggttggctcaagaggggaagatatggtaacggctacgggtaaaaagggtcgaaatcggtagaatctcttcggaaacgatgctcgatcagccggtaattgaccatatctatcatttaaactactcagtatcgacattaatacgatgtagaaagaaattagaaaaaacaaaatttaaaaatagccaaaaccggtacagtcggaaactgtaccccttaaacggaaacggcgcccggtcgatcgggaatttccgtccgttttcatccctagtaacggcgatgttcttttcaacttatttatttatcggattaatggaatagattatttgtttcatgttttcaaaaagagtaaattaatacgtagtgtaggaacttggcaggtggatgtgatttagtgtaacaaattgaaaaatatgcagaccggtacatgaacttggcaattaagtgcattttggtcaataacattgttgcgtacgtatgattcaacatttcaacttattttgtttgttctcattataagcataattgctaggttattggtcataagtacgttttgcgttgttcatcaccgcagacaatcaaatatgtttgattagtccgatcactcgggaaactatgttacaacagtttttatgcagttagtttttacaatcattatatttttcggtttcaaatcaagaggttattttattattataaacaaacaaatacaatacatctaggctattattttgagagtcattatacttgttagattgcaatgacaactgcttgcttttacgtggcttaaaaagttagccacgatatatggtcgcatgatcaaatgttagccaagaaaaaaatgctgcaaatttgtgatatactcttccttcaatttttatatcatttcgtttaccctcttggacggacagccagtcgttctaagttctaagttctaacggcccttttgccactctagaatgcgtgctagagacaccaaaaccagtcagaaaaacgtctttgagtacgagctgcgcgcgattacttgaagattacacacgcaaatacgcctttccacatcgtacgccatggaccttagctacagctacacgcacatcaccatactattatttacttaattgtaaagatgaattgaatattttgaaaataaaattaaaatcaatggtctaaataatatacagtagaataaagttttttttaaaaaaaaaagaacataaagtgtgaagcactgaagcaaacaatttgtttcaattaaagctagtgaattttgatgcctgcaatataggagtagatggtgtgatcatctgtcacgctcgtacgaaagaaaggacgtacgtttcagcttatatggatggtctcctctctccatgtgagctgcaaggaaaacaaaaccggtaacatatcaatgcctaacagaaaatgatggctgctagaacgtacgcattagtactagtacatcaactaatcgccttttttgaaaataaagaaagaaaaagatcaatgctgacagagtacttacctgatcaaatcggtaattttagttagtttatatccagggtgagcaatgagcgtctttcattttcagtactacttcttccgtccataaaaaaaaatcaagggcttcatcttttctcgcttatgcttatacttatcagctaaaatttgaattttcaattttaaatttagaggtgattttgaggtttttttatcgaagtttatttttcagactttgcttttatatcgctaagaacacgtatataaaattttattcacaaattacttttcgtttgtaaatatgccatttctcttattccgcgaataagccaaatgatggctccgcaaatcttgactataaatctagataaatgtttgtccagatgcatagtcaggatttaaccctttttgacgaaagtagtggaatattccctctgtctcaaaaaaaagcacaacctagataaggatgcgacatctcctaatacaatgaatctggatatgttatagctgccatttcttcatcccaaggaatgaaaatgaaactttttagagatccaaggtatacagaggagacttttgagtgtttatacagatacaataatgagttgacgagacacacgacattgtgattctctcgagatgctagtctctttgcgtgcctcgcacgtcggccggtgatcgatcgccggtgatttgcctcttgcagtccgcactgtacttacaccgacaaagtattttcttttcacgaacacnnnnnnnnnnnnnnnnnnnnnnnnnnnnnnnnnnnnnnnnnnn

SEQ ID NO: 16754 - DNA, 740 bp, Oryza sativa
gcggacctcagtctgccctacaacgcggtcctagggaggcccgcgttggtgaagttcatggcggcggtccactacgcctaccttcagatgaagatgccgggccccggtggccccatctctgtccatggcgacctcaaagtcacgctcgcttgtatggagcagcgcgcggaccacctcgccgacgcgtccaagcccgaaggtggcgacaagaggcttggcaccttccgtccccgccgccccgaggcagcggatgatcacatgcgacgaggtcccggtcaaggaggttgccctggggcgacggcccgtccaagaccacacgaatcggtggtcttctggacggcaaataggaagacgcgctcgtttccttcctgcgggcaaacgctgacgtcttcgcatggagaccggcggatatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgcgaggtcatccatccggagtggctggcgaacccggtggtcgttcccaaggcgaacggcaagcttcggatgtgcatcgactacaccgaccttaacaaggcatgtcctaaggacccttaccccctgcctcgcatagatcagattgtcgactccaccgcggggtgcgaccttttgtgtttt

SEQ ID NO: 16755 - DNA, 2890 bp, Oryza sativa
  unsure (1)..(2890): unsure at all n locations
gttggtggatataaacggacttctttaattttagtacatatacaaaacctggacaaattgattgaaattatgtgttattgttgtgcagcttatgaagccttctttcacagttgtccgcgatagaagtgcgaaatgcttcctcctttttattcggggggcgatcagcgttaaggatcggttgacggcggcaaccggagcagaggttccatttcatcatgttgtgacacaagatggtcatgtctccaaattggtgctgggacatgctcattgtggaatggtagtggcagctcgctggattgcaaatcaagccattccttgcctcaatgaagcggttgcgcaattcccagattatggagtgaaggtaatttatttcccagacctttacagatgcaattttaagttaattgcaattagagcctacccactagttgtcaagttggaccattcttttatgatgcagtttatagaacatttctcttcttactctcatttagacagggatatgccaccaaaaccaaatcatagtttagcagtaatcttctaggcttatcttgaaacatggttcaagggagatgttttcctatccaagttacgccaaaattttccaaaacatgtgcaagaaagcaagtggatgggaaacatggagttttaaccaattagaaacaagatattattccttaccttgaagtcaaagtgagaaagactttcaagtactcttactatgcatattttatggacttcctaggattctctagtgctgagaaagacaattcagaagcgagcatagttagtccaaaagtaagctaaaagttgtgcctagtagtctagcacaaagggacaaagtggaaacagcacttagaagctcaacaatttagactaataactacgaattttgtttcacaaactagtaaaactgttattgcgtattttgcttattggcatacatcgtgtatttatttattatccaaacgaccattatactttatttagagaaagtgtgcagtctacacaaacctatgtagcctttttttaacaatctcaatgtagttgcattcattgtaatcaagttttctcgtggtacaagatgatgaacactgtgcactacatctgatcatttttgtttgcttactcaaatcacagcatttctgttgttatatattttagatcattgggcattcaatgggtgctggcatcgctgcaatattagcatacattctgcgtgagaatgagaagttatcatcatccacatgtcttgcatttggaccaggtatgcatcatggagcacaagcaactagtttaccattgttcacggaccttggaattgcattcttaacataagaaaatatatttcactaaaaggccatattagcaccttacacaccaatatagtctcatggaatggcatttgcacgcctacaatttaaaagctattaattaattgttataaaaaaattctagctttaactattcagcaatgaacaaatgtttgaaggatcttatgatttttacatattcaattttttttggacaaagattacatgtccaatcgatcgcgatgtacatatacatctgtagaataagtagaataactccatgttcttcttttgattctacaaaattatgatgtagaaatacttgatgtgagatagtaatgctccctgtcctactatttctgttcagctgcttgcatgacatgggacttggctgagtcgggtaaagacttcatcacaaccattgtcaacagaaatgacctagttccatcttttggcaaagtttctgctgccaagctccgtacagaggtacctctcagctacctgaattcatgagcagattcctaagtatgacgatcaaaacgggaaccaagaactgtatcgcagatgcagttctttagagcatatcatttataaaattcttccctgcaaacagttcttggaagctagtaaaagataatcattgccacatatttaccgtcgcggtcattgatgacaggtcatggcatcatcctgggtacatgacgttcgtgagcaaattcagcagaccagattgttgggctttgtcaatcgctctgtgagcatcatccgatcgcacgtgccattcgtctctgatcctagatccaaggttgtagatgttgacatgctggtgcccaacagctctgaggtatggcagatagattgttgcanacaccagttcttcgaacaagctaatcatacttgtcgcctaaatagttgattcatgatagtttggcaggctgatcaggtgaagccttcgtcagattcagatgctgtggtgaagaaccgccatgcaatagcttgctggtcatgtgttgctgcacataagcattccattgactctgcaaaacatggaactcatgacatcacaaatcaaactgatgtcaatgtcaaagctgagaagactgacatcgaaacggcacaactagtctcaatttccatggaagaacttgaccttcaagaatcagataatgacgatgataccgacagaggggagaatgagccagctctcaatgaaacagacgaagatcaggccgtggagcttctagaaaccttgaccgacaacccacacgagccgtcatcgtcgagccaaagtcaagatcccccccagctctaccctccaggaagaataatgcacatggttggattgccatcatcatcagagccaaacagtacaagtgaacaaggtgaggaggtcgttgccttgtatgagacacctcgacatctttacagcaagattcgcttggcgagatccatgataagggagcattacatgcccaagtacatcaggacaatggagctgttgatcgacaagctcgtcgccgaggaggaggacggcatcgatgacgaccacagattgggatcattgtagcattggctgg

SEQ ID NO: 16756 - DNA, 739 bp, Oryza sativa
atttcttccccccccccccccccgcgcgccgcctctctccggcgaacccctcaccggcggcggcggcggggcgagtgggacgccgcatggagcagtaggggacggagcggaggctgcgtgaggtgaagggcgggcgcggtggcgatggcgaactacctcgcgcagttccagaccatcaagtcctcctgcgaccgcatcgtcgtcgccggtacgggtctcctcctcctcctccctgaaccctagaaatggccccgggatctgatccgtcaagccgcgcggctggctcggcccgcgtgatctcggggccgcggcgattcgagctggaatagtgggtctagtttagttagattcgcagtgcaggtagtttgcatgtttgcgtttgtgtaaaatttcatagtgattgagctcacgagcagcaatggaagatgcggggggtttggtggttccatgatctgattctggaagcgtgatgcagtgcatcacatcggcatgaaacaacccgtgtaggattctcccaagtataactaccctcattcactcactgcagctcaacttgctagcacatttctagctatgttggaagattttccttttagggcgtacagtttggagaattacattgaaaatgggtttgaacattaattgttttacttctttgctgcacatgctggtggaaatgaatttcaagtttgtttatctgtgtggacttcttcttatacatggtaatttgcgttttgta

SEQ ID NO: 16757 - DNA, 2084 bp, Oryza sativa
gcaacgtggtgtagcgatggacagtgtttggttaatattgattaattactacaactgttttactgccttcaactactgcttttaaatgctagctttatgcaaaagaacctctagcctcctttggttatatcctgcatcatacctcctcttccggtatgacttgctgagtacagtgggtagtactcagtcttgctctcttttcccccacaccagagctgaagatcttcctagttggagctgttttgtcaaagttggtttcgtcgctgccgtcaaggattgcctgtggagtggagtcgcccgctgctgaagtcaagcttcccggtttagctcgcttttatcttttccgctgcatttgtaatcttttctatttttgtaagacgtggatctgtatgtcaacaattatcgtttgtgtaccctggctggtcctggacagggatttaatgcacattcagcttagaaattctggttcgagaatttctgggcgtgacacgggctccgaaactacacgcgaaacgggacaactcaacaaactgcgaaaataaagccctattaatgacctctaagcgtgccattagatagatctcgagatttgaggaattttggaagttgaacggagtcaaacggatttacggttgggaagatattgaatttctaagattattggatttttggtctaaaggaaaaggatttaattaaatcctttttggaaaagaaaaagaaaagaaaaggaaagagggagggattatagacttttcctcgggcggctagggcgcggcccaagggaaaaggagcggaccggccgagctaaatgggccggccggcccaaggcggcccaagtgcgcgcgtgcgggaggggaggagagagagggccggtggaccgggctcaccgtgcgcggtcccgggtgggacccgcttgtcagcggctcggctcaccgtgcggagggagcacgcggcgcacgcgcgcgggcgggggagggacgtggtgcacgcgcgcggtctgcggaggaacggatgcggcgggcccacgcgcagcctcacggctcgcggtggaacgcgcgcacgggaggggctgaccggggtcggcccgtcccgacctcggctgagctggcgccgacgtggcgcctacgtggctgccacgtgggctggcgggaggtagacgacgacgccggccggaacggacggcggacaacagcggcgagcggcggagcgaaccacggcgataccggcgaaagcgagcacgccgggtggttgcacgagacgaggggagacgagccaacggctcggattcgccggaggaagcttgacggcggcgaatcgcggcggcgacaaccggcggggagggaagagggaaacggcgacgaggccacgaggggccgattcccggcggtgagagcatccacgcggccacgggaatccgatgctagcgtcggattgggcggagctacgccgatcgaggctggcgacgtgcgggtgctacggagctcgagcggcgacggtggcgagcacacggcgagcgacggcaatggttggggcggcgccggctagctacggggagtctactcgtgctaccaccgaagactaaggggggagatggagcgaggaggaagaacggagaggggcactaccgtgcgggtcggggcgctgtgacgagaggccgatggcgcgggagtaatctctccggcctcgggccggagaagaggaaggagagggcgcggccgaagttcccttccgcgtcctagtgcgcaccggctcctccggcacacacgcgacggctgcggtcggcgagaaggacggcaatggcgcgggcgagaaacagggaagattgggaggggaaaaggggaagggagggcgcctgggtttatagggggcggcaatgtcggtttggaaaccgactttggcggtcaaggcgcgagctggcgctccggctagcggccaaaacggcgacaggagggagggaggatgacgccggcgggaggaaaaggggaaaaaggagggggagaaaggggcttgcccccttgccgatttgggaaaaaggaggaggggagctgaggcgtcgcggcaaagggaggagggaggctctgcct

SEQ ID NO: 16758 - DNA, 1041 bp, Oryza sativa
ggggggagggcttgccagggatgggaagaagtagagtgaggaagggggggcgctcggcgcggcgctcgcgcacgcgcgggcggagcgaggggaaagtaaggggggcgctcggcgcggcggcagcggagggggagtgccccgggggaggggagagggcgagagagggagagggagagcgggagcgcgccgggggaggggagaaggtgggccgagcgaaattcggcccatcgaccccgggggagtcaaaatagacttttacggaggaatttgatttggaaggatttggattcggaattgaactcgacgatagatcggggatttgagatcttgagatggcacggacactagacgacaagcgaagaaacaaatttcgcaattagggtttttaggaattaattttcccgctaggcgccacgacggaacgggcgctacagtccatgtgtacttgctagaaagattatagggtctgattttatatgtttttggtcccacgctaaaattcttcctcggtagtcgggactctgtaaaacaggccacatatttcatccagcccgactctgatttaggcattgggtcttgtaatgatcaggtcgtggactaaatccaagagatagacgccttaagtctaaccctatagcgtccctaatcatatttattcagtagtcattatcgtttagagttgggttttgcttagttatttctgtcatcgtagtttcgtcgctagttcagtttgtgcaaccccaacttcgaatgcttaatcataatatgctaattcagttgttgtctaccttgttttttattgtgttcatcgattcgcatgcagggattaaccttcttggtgagattaaccgggcagcgcacggtttataacatgaggagacggttgcctggttgataacctgagtagacgtggtgttgcgattgcaggattcagattgtgtcaatcggaaaccggatcatgtctctcaagtttccaccaaagcgagagctatcagtacctatcaaatcatatgacctagttgctctcatcagacggtccaa

SEQ ID NO: 16759 - DNA, 516 bp, Oryza sativa
cttgttttaagaacctatttagtaagatttgtaaattaccccttcaacttatcagtattaaaagtaatcaaatcgaaatgtatatagccacgtataaaatcaaactaagataaatattcttatagcaaactgatgggtattgtacattccgtagaaaatataattttaatttattttggataatattataatatattctctttcatctgtaaaaaagcacaaacttaactagtttaagaaaagtctgttttacctctaaaatcactgccttctctgattaccccattagataacgttggaccgttttcaacacttcatttaatttttcatattggacgaatactactctctatcgtttttacctgctgttgtccacgatttaaatcaaaatgcatgcacatgtttttctattatcttttctgcttagatgttagcaaaaaatacggtgataccaaggtaaactttatttagttcgacgactgctttgcttatataccatttgcattaatcactact

SEQ ID NO: 16760 - DNA, 2120 bp, Oryza sativa
tgtgtcatgtatgaatatgaccttttcgtgagctatcacgctacaacggtagaacatctaaattatgaagagctacctccattattgattttgaaaggactggacatatctagatttcaaaatgtctttaaatcattttctataaaacgttcagttaatagctacaaccaaaattgtctaaaaataccctaaaaatatgaaaatattggttatagtttttacacgccgaatatatttgtagtttggctaatgatcacacaaaatctccatttttttcttttaaatctttttcgcgaacgcgcaaaaggattgcatgtcaatatattagaagaaaagagttatagtcactcgacgcaatcagccagaccggcttatgcagagggaaggggaaaaaaagcaaaaaagaagctggagcttaaaaaactgcggcggctaaatacaaactccaagcagcgggaaggggccgagcctctttacactcccaacaagtccccaaaagtggcaacgccagctaaagaccacagatggctctctgagcatgtgtttggtttgggcacaaggtgggatgagttggatccatccctgttttttggaatggcatgatcccattttctgtttggttgaaaggatggaacgaatcctatttttttgtttggtttgaaggatatgatgggttggaatgatcctatgccttatttggatagagggatgaaggtgggatttctggagtgtacacattgtaaaataacatttagacatgaaaattacactatttgaaaattaaataccgttaatatcgctacatttttaatcagtatacatcaattcttgtatcaatccgttcatagaaaataacacatggccatcatctactgtcaagaaatttacctaaaaaaacaacacatttttgaactaattatactgctgttggttcaattgctactgactaattgacttcattcatacttactgataatactatgatagcgatcaagcgcttcggagatgagaattgacaaatatcagtctctctgatcaataccaattattggatagagaaatttacagaaggatagcagagtagcgaccggcaagagaagaggcatcattagctccctgctcgtgcgctcccaccgccgccttgcccctgcttgcgccgttggctcacccttgctcacgcgctcccgccaccgcttcatccctgctcgcgccgctggctcgcccctgctcccgtcgccgcctcgcacgctggccgccgattcgcccctgctcccgccgctaaccctagaacgcagtcgtgaggaggagctgaaaagagcgaagggaaaaaaaagggtgggccgtgagggttaccgcgcctcacacgcgtgcggaggtgggatgaatacgtccaccagtttttggcggatgagttggtcccgaatattgaaggaatattctcttttggaaccatcctatctcatctagtctctcaaccaaacacatgtaaaaatgggatgatcctatcccatcccgggatatcccttcaaccaaacacatgctgagtagatggactccaaaaccactaagatcgaagagagcgcagagtcgaaaaccctagagtttcgtttaaatcaaaatacgccctacataaaaactgaaaggtgagtgattataagttatttgatctgtcaagctacctctcgctaatcattttcagcgtgagaatggaattcgtcatgaagctcaaacccaaccatgcaagaatggaatatccaggcataagatcgcattgataccaaaagaataaacatgattccatcaggttattccttgagagttttagttcttggggccattaccctcacaaattaattcacagttcgatccaagccgatcgatttgctcccaaattttaaatggtttgtttaaatttgaagtcgtaacgtgtgacgtctctctcccaggatgtggggcccacctgtagggagagctttcatgcatatgctctgccatattctccctcgtcaagcagagattccagcttacaaagagcagagaagcagagatgtctcctcctatcatttggaatgaccataatgcccttacctgaaaacccaatattttttttaaagaacatc

SEQ ID NO: 16761 - DNA, 756 bp, Oryza sativa
tcacattagtgacttagcttctgtcaaggcacgaaagggatggcgccaatatatgttagaccacggcgccaatgatgctggggccgtgaaaaggaaaaaaattaccatcccaaagaacctattcatcctggatgaagccataaattaacacaatgcccgcataagatcaaacataggccgtgtttagttcgtgtactaaattttttttaaagtacacggacgtacatttgaagtattaaatatagactaataacacaatacattatagattccgcctgtaaattgtgacacaaatttattaaccctaattaatccgtcattagcaaacatttactgtagcatcacattatcgaatcatggcgtaattaggctcaaaagattcgtataacaatttacatgtaaactgtgcaattattttttttcacatttaatactttatacatgtatcaaatatttgatgcgatgaaatttttaaaagtttgaagggtactaaatactgccataactgtgtgaaacaaaagctgtcggacggtccagccccccagcattgtgctcagaaggcatcagccagttgaatagttgcctgtgtcactgaaacctgggcccacacccggttttcagtgggccccgtttggtcaacgcacgcaggcaaactatgacgtgcagtgcagtgcagcgcaacgcacactggtagtgattttgtacgggtagcagtagctagcaacagctaacggcatggatttttcacattttggg

SEQ ID NO: 16762 - DNA, 1406 bp, Oryza sativa
tgcagatacaagaggttaatgttgtatatattttgcaaatgctcaagtgaagttggattattagtgtgttttttattccacctggtcatacagctaattaattaattaattaatgcctttcaagtctcaaccttctcacagtcactcttcagattctacaaaatctacaaatccactggctgtaaatttgattgtctaaaaaacaaggcaaagccccctgcagaaaattatcggaatgtcgtgttttaaaaaagaatttgagagcttttcaatgatctgtatcctctcaatgaccattcatagaagctcctctttaatttgcatatatatcataagattatcttatcatatcatcaattgatgataattaatagtatatataacaagatcccccacgactccatgagttggcatgcatatggtccagcatgtccaaaatgtagagctagctagggtacatctaagatgcatgtgtggtggaccaactatatttttttcttggaggaccaacttatcttactgaaattttcacccatatcgatcttgagcagtagtgcatcctgctacagctcactcagctcgtcacggaaacatatactcccgccgtcccataaaaaaataacctagtaccggatgtgacacattttaatactacgaatctagacatacatatgttcagattcatagtactagaatatgtcacatacggtcctagattcgtttttcatgggacgggagagtatagtctgtatttctttcaaatcaaactctaaaaccttcaaacattaaaatcttgaaatttttagaatgtatacatgaaaaaacataattgtaagtagattcttctaaaaaaatacttttataatattcattaaggtatgtaaatatattttataataaattggtgatcaaagttgtacctctatctcaaagagcataatttatttactcgttgctgatatgatcaggattcacattatttgatccaggccacgtgcccaaggagtagctctagacccaccaagttttagggctggggcactcgatatgacacacaaactagtcacaatatattccactgcctttgtcccctcaaaatggagctagctccttctcccaataaatatgtcactacttacaactcccaaccatgtgtggctaattaattaatctcgcctctaaattaatcaacttcctagccaaaggattgcaaatctaacttcaagtgacattaattattggtgatcatcatagtatcaaccatgttggttttattcagagtactagaccttgcatgcgtgcaatgccattcgctagtgtttgaactgataaatttgataaaaagaaccatttgaagcgagagggagctttgctggatgcatacgtcgatctccgctacgaacact

SEQ ID NO: 16763 - DNA, 2747 bp, Oryza sativa
agttggcattcaatgaagtatatttctccacctgaaacaagcgagatggttgtcagaaaagagaatgtaatacatatacattcagataattgtcagaagagagaatgtaatacatacacattcagatattaatacttaagatgtcaataccaacatgataaaagaaaaatagcagagcagtaattcttaatccaaagatcgtttctcaggggagaataactgtacattatattgcctgtctgtctgatcatgctgaattccagttttagatgtgtgcatgtagcactagaaagaaagaggtgtatgtcccacataaactgcttgaagtggcaccgtaatgagtataaatgggttacttggggctggtaattgtaggttttcacttcaaagcacttcaccagaagtctccgcatgaacagcttccattgttaaaatggtgaaatctgtagacatctcgtaatacaatttgtcttcccatgacgtcggaagtaaatttcatccaagtgtggcaatcgctacatacacgaagatttttaatgacttgaaggggcatacagggaggcaaactcatcaacccaaaagtcacagctaacttctcgctgtgcacaagatcagtaggatctctcccttcttgctctttatcatggaagagatgatatttctcttgcttgtatcctactttggctaccctatcatttataacagccaaaaaattgtatatctgctcagccaaggcgtgtaatctgtcaccaacaaagaatgcatgaaccacattctttacttcaatccaactccgggcatggtcctttctgactcctctgtctctcatcatctttctgacctgatccatatttgaccacttctcggtaacagcatatgcatttgagagaagaacatatgatgcagaatcatgaggctccaattccaatagatgtttggctgcaaactctcaaacttctatgttcttgtgtactaaacaggcgctgagaagggttctccaaaccatagcatcagcagcaattggcatttcctcaataaatttctttgcacggtcaagttgcccagctcgtccaaagatatcgataacacaagcataatgatcaggccttggacgaatttcatactcatcagacattgatttgaagtaactaaggacttccttcaccaatcccacatgactgctagcagctaaaacacctatgaatgtaacatcatttggtttaataccttctttcttcatttgatcaaataaatccaaagcctccaagccacgtccatgctgtgaacagcttgtgataatagtattccatgacacctcatttctctcagacatttcagaaaattccatcttggcatcctcaaagctaccacacttcccgtacaaggaaatcagagcatttccaacttcagttttgaaggaatgacctgttttaataactctggcatgtatttgttttccttgttttatttctgcaaggttagctgaagcactaagagctgatacaaatgtgaacacattatgcttgacacctgattgatccatacgcataaataccttgagagcttcttcatgtaggccactttgtgcaaaaccagataccaggccgttccatgttatctcatctttatgttcaatttcctcgaatgaagagaaagcttctctgattcttccgcatcgtgcataaaggtttaccaatgcattccaaattgaaacatctcctgaataaccagacacataaatccgagcatgaatctgcaagccttgcctcattgcattgattccagcgcagccacttatagcacttgctagtcctatgttatctggccaaattccacatttctgcatctctttaaaagctgcaagagcgtccttacaacactcatgttgcacatatccagcaatcatggaagtccaggaaaccacgtctttctctttaagcatttcaagaacacgtcttgccttttcaagccacccatatttggaatacatatctatcaatacaccactaacatacatatcagactcgaagccagtttttacacttaatgaatggatctgctctccaaggtcaatttctctagtgcaagtgcaagtccttaaaatgcatgggtacgtgaattggttagggcgtatacctgcagcctgcatttgacagaatagctcaaaagactttgctagatcattgatctgcccaaatgccacaagcatcaggttccagagtactacgttagtcctatcactcgaattgaagatcacaagggcagtttcaacatcaccacatttcacatagaggtcaaggagtgaaccttccattatgtaatccgaagagatgcctgctttaaacagataggaatggagttgcgtccccttttgaagatcaccaagcgacgcacaagctgcaagcagactagaaatggtcacacaatcagggcttaaccctgagaactgcatctcctcaaatatctctaaagcatgctccccatgtccacactgagcatgtcctgagatcaacgtattgaatgttactgtgtcacggtgtggcatgtcgcaaaatactctctctgccaatctgaatgatccgcaccgcaagtacagcgtgataacagcattccccacaaagatttcagagcagaatccgtgcttgtaaccttgggcatgaatcaaccgtccttgcgcaaagagctccgctttagtgcacgaactcaggacgctagacagaacataaggtgtaggaacaaccccagct

SEQ ID NO: 16764 - DNA, 1757 bp, Oryza sativa
agtaatggcatgcgtagaaggtaggaggcggtggtggcggcggcggcggcaaggtcgccggacgccggcggaggcaaggtcgcctgcttgcgccgccgcggcggaggttgtgggagtgggagggccgagggaggtgttagaaactccgaactgagagtgatgaagatccaatggttgagattcggagatgcctctttagcccaccgacggctgagatcatactaactttgtttttcttttttccttttctaggtgacattcttcgggtgtgtttaagaggagcaaaaagaaaaaaaaagattaagaagaaacaagataaactattgatgcatgattatttgagtattaattattttaaatttaaaaaattaattaatataatttttaaaaacaacttttttataaaaaaaaatatagaaaaaataccatttaatactttgaaaagcatgggtatagaaaaccagctacttttctcccgactgcgcttgtctcaaagacaacctcgagttgtctgagcatctgattgattgcttcctgactctgaaatacactactccctccgtgctaaaaatagtcaacttaggagaggaagtgaccactcttattcgttgtataaggaggagtcacatcttcacctaggatttttttttttaacagagggagtaattcagacatcttgcacatcgtctgagaaaatccaagtactaaaatggctaactcatcaggcatttctaaattaattattctattgcaatatgcagattgcagaataaggtggtcgctctatgtcacgatttattcacacacacacacgaactaatacgcaatttagaaataaaattagaactcgaaaacatgtagaaatggcactagatcttcttgatgacgagtgtgattccgtttttcagctatgcgtgttatgcttgggcctcttcacgatcatcacggtcaagtgcgcgtgatggctgcagtagtcgctcacgctcccaagaacagccctgcaaatcaaaccgatttgatcaaatttcaggcaaattcaaaatccagaagagaataaatcgagtgacggatgaacgtaacagctgatcctacaaaatttctgcagattcttacaacaaattccatttcaatgatcacactaattatcaactttggtttttcccgtaactgcttattgcaaattaatatttttaggtaataaaaatagtaacttctaattgattaatttaccttttccatgccccatagccatggctgcccacaaccagcatatctgcatgatgcctttcaactgcctcacagaggatgttcctcgcgtctccctctaacacctcatagctcgcatcgatcacctaatcgatgaaaattggagattcttcgagggttgatcaatgcttgattataggagatatttttttctgctgagtttggattcaacaagcgaaggattattatatcacctgggagcacatctcctttgccttctcaattactctggcggcaccgcgcttcagatccaattctaaagtcggcaacagctccgtcgtacctatatttattacaagtcctcacgtgagtacgatccccgattctataatcaatacattcataatgtctaagagcgtgcatccaaggttacctagaccggcaatgccgatgacggccgatgcggggggcttagaggtgagcaagacgaggtggtactgttgcggctggcccagggcgaaaaaaagtttgagcgtgcactcccgcgcgta

SEQ ID NO: 16765 - DNA, 1438 bp, Oryza sativa
tcatgctgaagctgactagaagtgtcaatacaatgtcaatttattcacacagatacgtgcacaatttggtggtagatatatacatgaatgatactgttcagtccaggctgggccctccgctcatggactcagtgattgagcttcggcttttttactatcatcgcggtgcagtgcgcatgatgagaacagtagtcactcacgcttccaagaacagctctgcagggaagttcaggcatgccagtaagaccaatgtaggtgaataacatgaagtagggaacggaaaaagatgattgggagtaaagttgatgcatcagccagtaatgttgcatgagttcataagattagctttggttactgtcttccatgaaagaccaaacaaaattaagttgcaggcagcacgattggtcatttgtaggtcgatacaatgaaacaacaatgcattgtaatctgcctgttctaaaaaaaatctagtctagtccaggtcataataaatcgtgttaatccacttttgaagttatttctttccggtaagaccaatatcagttttctggttctatttttgacaagtgtaataaatcatgaaaagcaggaggattcacagctacggggccaagccgccaagtgaacttcatgacgaatgatggccataaaacatgtatagcgagagaaaaatgatgtactctattcgaatatacaaagaggctacaccaaagtatcagaagagcattatgttgtttatggaaattcatcaactcataatctggtacagcttctactatagcaacagataagcttttaatttaaatcaatgtccactgcttgcgcacgtgttactctatcaaatgcctagtcagacaccattttatagattctcctctttttttttcacagttctttttttcgaaacattttttttttcagagatgaagaagaggcagcagttttcaacaaattgaagaaattctttgtgggaaacaggggtcagaagaacaaaagtaggaaatggcaataccgtttaattgctccatagccatggcttccgacaaccaacatctccgcctgatgcctctcaacagactcacaaagaacattcctggcatccccttccagcacttcaaacagagcatcactcacctgcagcaaactctcatttgtatcatgatctaaatcatcaaaaatgtatactcataactatgataatacacactaataaaataaacaaaagacatagacaaatgaatgagttaagtcatggtttgattccaacagctggcaatctccctgttcttcagccaagcccagctgagctgatctcaattagctagctttttttagggcttccttaatttagagcaagtgtgacgtcttgtatatagtaagctaggttgccagcttaacttgctagtaactactactcccccatttcatattataagtc

SEQ ID NO: 16766 - DNA, 7158 bp, Oryza sativa
ttacatattttcttaattcccatgtcaactttaaaaatatttatattttaaaacaaaagtactaattaggcacgttccatataatattatgccatgtttagatcccaactttttacttcaaacttccaacgttttcgtcacatcgaacttttctacacacacaaatgtcgtatttagttttaaagtttttcttcaaacttccaacttttccatcacatcaaaactttcctacatacataaacttctattttttccgtcacatcgttccaatttcaaccaaactttcaattttggcgtgaactaaacacagccaaactttcaacttttccattacatcattccaatttcttcaaacttccaattttggcgtggatctaaacacagcatcactcgtgtcgtccaaagtttgtcgaaccgaagaccgcaagttgatgttgatatgttctttctttgctactactccctccgtctcattttaagtgcaattgtagtttttcgtatccaacatttaatcgtctatcttgtttaaaaaaatctatgaattttttaaagaagtcacacataaaatactatttatgttttttatctaataacaataaaattattaatcatacaaatgtttcgaataagacagacgatcaaacgttagatatagaaacctgtaactacactaaaaagggacggagggagtagtatctttcctcatgctctggttggtgtaaaaaaaatgtatccgatccgttacaaaatataaccatttctttgcaacatactcccttcatctaaaaataaacaaatttaatatataattactttatcttaaaataaacaaaactagtacgggatcacatcgagctagtaagtagtagtaatatgtgtcaacgtttgatgtcgtgattccggtatttgcatagtatggggatcgttggtactaggatatgtgcgagactgaggtaaaagagatggggacgaggatttttatacaggttcgggcccctgaattgtcaggtaataaccctacatcctgttggccgaagccagtattgatcttattcaccataatcacaccagtacaatatttggggtagcctatctaactgttgtcgacatggcggtctaaaggtctgactcgtagtcgacaacagagtactcttcctcctcgaatctgtgcccggagagatcagagatagcgctttcgtctctcctgactgtatccagagacaccgtaggggactagccgtgcctatctttgaagttgatatctggcgtcttgccttggcgtatgttggcttgtatgttgatcttgtatattgtggcttctattgttccgtgttgtccgtatcccctctcctcctagggggtcttgtatttatacctataggtgtctccttgtccaagtagaactaggaaaaccaatatggatacaatccgagtagtccttgtcgttttcatgtagaattctggttgtctttcttatccggaactcctcctatatctgtaggttgtttccgtataggacatagtatgtggtaggtcctgccgagatttagtcaactactattagatatgtggtatccataacctgacaatataattggttgaaggttcacttagatggtgctgtcgagttgatgatcacagcagccaaacactaagctctttcgccttataagatcgttaacaatagttttagaatgtgttattgtttatataacatttttcacgtgagaaacacctagaaatcttttggctagcttcacaagatagtgggctagacaatctggattcgaagcctcaccccttctaattatttgatattaggtcattttctaatatttgcgtttttttaacattttcacgtcatatctcaagttctcaacaacgaataaacaactcacataaacagatggtttatttagttatctcaaatatattcgtgtggtcaatgatttgattccacagatagttttatatatgacattaagttatccattaatcaacggactgcagtattctttcttttttctgctttctctgtatcttcaaaattcctatatgggcattctctctcaaatactggtgttacatcattgtttattctctaacctgtttgaattccttggattaagttactggctttctctgtatccttaaataaaaaacgaatcatatttgtccggttaactaaagtttttactcttgtcttgatcgttgagctatcaaaatgttaattattcgcccctctgattttaaaaatttgcacatttcacatctcttggttcaacttcaaacagaaatggttttaacaaaaaaagtgatgtcgtcactataccatcaataataaaacatgaacaagataaagaaaatattacagcaatttatataagacacatgttctttggtccaagttgcataaataagggatattttgttacttggtatgttttttttatagataatggaatttgttacttggtacgtaaccacaacaattatggcaaacaggtgcttaacaaaaccgcatcactaacaaatttagttatagttttgcacattgaacagtatcaactcgcaagaggaccgaaactggccgattccttttttttatattaaactggcaaattcctgactttttagtttttaggttttttttccttgaaggagatttaattcttgagaattttagctaaggccagcatatcaaagtacacagtttcaatgggctcacggtgggcctattttattcttcgcgcgggcctacgtggcagcgcgtacggcccaatatgcaaaatgcacattcctccattgaccggcccaacacggacgcagcacttaattaattctcgatcggcctctcacgttctgccctgatcgagtatgtgtacagatataaatctattaatttttagatgaaatatgtatgaatgaattagtgcgtattaactatcagtagaaaattatattaaccagttttgactgttcgtaattaagcaccgcaaaaactactggcctgtctctcaaattgtgattccacttcaaagacttactagttgagcggttgaattaagatcccttctggtatttttcttaagagatggtttaatttgggtatcaattctggacttgcctagtatcgaatgtgaggaaatgacccatttgagtgttgtatcaattgtcaagtgcattatttcgctttcgcttatgccatatattagggtccacctggggtctctagggtctcgagtctccactccccatattgtaatcatgggagaccccatgaagatcccactaaaattttctgtcatacgtttattagaagagggggctataattttgtatagtttgtttagaccctcctgttaatctttcctggatccgcctctgggtatgttgggtatgaaggaacttcaaatgaaaatcaaaggatctgaaacccacttattttttttttacatataggactgcttgaaatggaggaatggacccaagaatcctttggaaaactttcctaggcttctctagtctattatttttctagtaaaaatgaatggaaaagaaaaaggagctcaaatctaagggaaaattttcccatggaaaagaaaaggtaatagatgaggttagcttgacctaaaaagaaatctagctaatatctaataccttgttagtttaagcaaagtctaaaattcttgtattgcaaacatccactatatataaagttttgtgtttttcctaattcttcagttttattacatgtgcatttttatgttttcttttcctacatttatatttctctgttaagttttcctcaatctaaacaaggccttatgtttgcttcgtcctctgaataccacccattttctagagtctatgaacctgggcacctgttaaataaataaaaagtaatatgatatgtattaataaaaacgaaatgcatttatgccagtcaccttaaaatcaagaaaaattcagttgatttaaccaccatttgatcctcgtcaagattatggttcagagtaggcagtgcgagaatgggggcaatactgcaagaattaatggccaagctcatgtggtattttttttaaggggtttgcaggttttaaatgattcatggttgcggttgtgtggtagcttgatttgtgggtgacacaagcggcccaggagacactgagacaacggtgatgtagcgcctagcttggtcctaggctcggttggtgtttgagcaaggatggcaagcggtcaagaggtcatagtggatctagcaatgtaagcctccggtcaagtatgcccagaggaatctaggtaaggttctgtttgggagattttttttttttaggctgcggtagcttctcttagaaactcgagctctcacaattctcacctagattcttataatcggtagtgaattatataattcagaaaataaactagcagttaaaagttaaaaaatccagcctctccaaattctcaaaagctgactaccagcaaactatttcttagaattttaatctatccaaacagatcctaaaatagcaccatagcactatgacaaagaggaggacataggaggatatagtggtggagacatagagaaagggaggcagggagaaagggcagatagaggaaggcaggaaacattgcgaggcatgcactagcgtgggatgttgagggagggaattgtcgaagagaaatacgcttgattagattatcaacgtgaatcttggtataatctagaccataaaaacatctttacacttataattttagcctgcagataattagccatcgatctccagtgtctagtgaaggatgcatgcatgtgagtccatacattcatttaatgtattatgctagaacgatatctatgtactgcctccgtctcattataagtgcaacataagattccgtgcccaaccttaattgttcgtcttatttgaaaattttttataattagtatttttatttttatgagatgacaaaacattagtagtactttatgcgtgacttatgtttttaaatttttttaaaaaaattttaaataagacggacgatcaaaattaaacacggtaaatcatggttgcacttaaaatgggacagagggagtaataactagatctgtatgggattgatcaacaggttatgggcattacaacatgccatcatatagtccattttactgggctgctggcagtagacaaaaaatgagtcaaagcgctggatcgatcctatagctatcacctcctataaatcaaaattcaactaattaatgagtatatctcttgcatcttcgaaaggtaattataagcatatttgcacgccctcctcatctatttgggttcactgattggtttagttattcaattgtcaggacagagctacaattattttggatacgcacctttcagagaaatgcttatggtcttccagctaacttcacaaggtgatgggctagacgacctgggttcgaagcctcaccacttctaattatttaatattaggttcttccctaatatttatgttttttaatacgcattttttacatacaagcagctagcttgtggtcgatcaatattttacgcacgaaattaaaccatggttatcttttccaccgcatattcagtagtggagattccaacagattataactataagtttatgcaactatcttttatctaaaataattaaaacttgacttctacatctaacatagattttttttaaagcgccgactactgtaaaatatatagtagtagaatagatgttgattcccacacaaaattaaagtaacttctaaaacatactatatattggggatcttacaagcacaacaatagaaaaaaaatatagacacatatatgttcgagcagctgatcacaaccctgtagaattattctggctaatcgagagctatatatatggaccaggttagctcataggtttaacttaattaaacagtttatttacatctaccaatgcatcgtttggtgtgtgataaacaagagacaaccttaatcttctaggggttgtttgtttcactacttcactttaccaagccacgccttactcatgtcacagttgtaagttatgtgtttattttgcagctacaattaggtttgccacgcttttttattctttggatccacgagtcattcatttatctttttaaattaccccacacttgtaaccgtagccacacttttatatcatgtcacactttacctacggttagctgtgacaaaattaattcactaaccaaacagccaatgttttaaaaaaaaaacaaacagacaatctgcgtcaggatgcatgcatgcgatcgatggcttacctttgctcatgatcagacgacgtacgacaagatcgatgcaaaataatgagaaaattatgtggagctagtactgtatatccgttgatgcgatagacgtgatagctgacgcgattgcacgagttagggccactctcctctccctcgtggggttcagctgcaatagtgtgcggataaatgcatgcaccgttgctcgatgcaaaaggatctagtgatctcatattatcccaatccaataggggtgtaaagtttcagtgtgtcacatcagatattatatatggtatcgtatggggtgttcggacactaataaaaaaataattacataatccatcagtaaaccgcgagacgaatttattaagcataattaatcggtaattagtaaatattactgtagcaccacattgtcaaatcatggagcaattaattaagcttaaaagatttgtctcgcaaattagtcgcaatttgtgtaattagttatttttttagcctatatttaatactttatgtaagtgttcacacgttcaatgtgacatggtgaaaaattttagggtgggatctaaacaaggccatatagatgatataactggccgctgtgtatttctgcgaagtattaaagtataaatgtcacaactttatataactatgtaggagtaatatttagtcgtaaatttgattgattgaaattaataaggtacataatccaattagtgataaaatgattccggcagtctaggaatattaggtgatcataattaatctgaagtatcaaagcatgcaccatcccaattagctaggttgaagaattcgtgatgatgatgtagccactagtgtgt

SEQ ID NO: 16767 - DNA, 2911 bp, Oryza sativa
acgtgggccccggcccagaacgagccaaatgagcctgccgatttggaggagtgggccggagtggggcaatgggctgaatgggccgacctgctccggttgtcacttccgagctgcttgagcgtgtgcttggagtggtggtggtatgagctcatgacgatcgccgccggctatctccgggacccgcacaccgcattggcgacggcggccatcgtcatccagaccacgtcgttgttatacacaattccggtcaccctaagttcagccgtttcaacccgagtcgcgaatgagctaggggcgggccgaccgagatcggcccaagtctcattcgtagtagcaatgggaattgcgatgatgggctcgtgcgtagggctgacatggactacatttgggcgaggactatgggtccaagtgttcaccactgaccccacaatacagtcactcacaacaagcgtgctaccggttatcggattatgtgagcttgccaattgtccgcagacaaccggttgtggagtgctacgcggcagtgcgaggccggctgtcggggcggccatcaacctatactccttttacctcgtcggagcacctgtagccctagtgcttgcttttgggcttgatatgggctttctgggcctttgtcttgggcttctctcggcccaggtagtttgccttatatctgtgggctttgctacatttcaaaccgattgggaggcagaggctttggaggcctttcatttggttggtggtggagatgagaaatgtggtgatgacctgccatgtttggcccataaggtaaatgtatagattgtaaaaagttgcatggtttgtgtaatttgattttaaatcttttgcggtgttgcaggtaaaaattgtaaatttatgatcccagaaagatgactacgagaagtacgtttggatacacaaattatgtctaaaaatgtagtaaagcataatttatatattgactctccatatcctaaaatatagcaacttagtgtgagttcttatattttgggatgaagagagttataacctcagaaaataatttaatgcataaaaattagcaacattaatatcctaattttgtttattgaattattaaagaattataattgctagggaacatacaaaaattaaaaaaacccggtgcagcttctttaaattccttttcgccgggcaaacatggccggcgcaagcaccggccggtttcttgctgctcacaacctcgttcttcatcgccggcgatatgtctccggccggccatcgccggagcttgataggttcgccggccgtgcttgatgtcgatctgaaatgctagctagctagcatcctgatccgcgaacggggtattcatagtatgtacggcgacgcagcttgcatgattattgcatcgccgccaattcttgggccctatctctgttattcaatattgatcgatgctggggttcaatccaacgtgagcttgacgatgatgttttcggagaaggtatatgcggtcttggtttttactcacctaacagtcatttgtttgactgaccagtagcaaaagtttgtttttggataagttcaagtttggtttcccaccatgcaattttttactgtttttcatggtagttaattaagcgttgtgcattctctgaatcttactggccataatttgtacccaagttcttttacctgacggttgatcgaccatcaagaaaaatctacaccctgacaatggctactccgtccgtttcatattatctaagtcaaaactcttcaagttatagtatgaaaatacatctataacactaattattttcattataaattcaccactaaatatatttttatagtatattttttttgtatggaaaatgttgctctgtgtaacttaatcaaacttaaagaaatttgacttaagctgaattctaaacagcaattcgaaacgtctatttcctcattatccgtggacacgcttcctaaactcctatataaatgatgtatcataccagagttttctacatttaagttttttttaaattcaaataaattggtttttcgagtttgtaatatttaattcttgattaatagttataattgtgtcgttttatgtgtccccacaaattttgcccaaacaaccattgcgaacttagctttagctctagcccaaaatgtttataacatgaaccggagggtccggttcagtacgagtcagtcattcatgagattgattgtgtttggcatcagtctttactttgttcgtgttacaagtagaattggattgtattagtagcattttttgcctgtcttaagtaactgctacacccgctcgagatagaagacagggagaggatcaccacaacgttgtctgtaatagtctcagtcacaatctcctgctactgcgggacgatgttgatttgtatattgaatttaaacgtaacctatgtctagattcatcgttgtgaattataaattttatatgagggagtatgtctcatataataatactaattaattctatactagttcaatacattgcatttaataacttaagaaaataactcaagtcatacaaaaattagcacagtaaaattgtaaaaacccgctgagcaaacttggcctgcaccggcttcttgtctgtttgattaaggactaatattgccacacatttttaactaaggtagctaagtttagtcttgccacacttttgtggtaaataaaatgacaaactaagcttaggtaatgtttggcaaaaaaatagagtgtatgacatgtgggccaggtgtccaggtggttaagagttagacaaaaaaaaaagacctgtggtaagaaccaaacgctatctattaaaactgtggcttgccttagggtagatatggtaaatttagggcaggtttggtttgaggcctaaattaggcttaccaatatt

SEQ ID NO: 16768 - DNA, 2323 bp, Oryza sativa
caggatcattttggttgtttcaagcaactgataaaattaatagaaataaaagatgtggagaggatcaccccggcgttgtatgtcatactcccaatcacaatctcgtgcttttgatgatcaatgaagatatgtattatagattgataggttcagatgaccaaaccttggttaattatgcactcacttctgaatcaggccacacagtggtatatttgccacccatctacatttctacatcagttttatcatattgtcaaaactggggttcatatgattttcggtatatgattctgcacccaacatttcataaatcaatcaagcatctgatccattgttaaatcctccttccaaagcataaacccatgattaactgtccaattaatattcttctctttctcaccaaccaatcagcttgtaccaaatcccagctgctagctgagccaccaattccagccacacaagaatcataccatcaaccaaaccaaaactctgctttggaataacatctctgaatttttttctgcacctgcagatatgtaacatcatctagatcaatctgcagttttctacttagatctgaacagctgcttattattattcccatatataatccatcacaattcacaggtgttcaactgagggaggctgataccctatgcaagtttgcatgtgtcacatatgctgatgttaacttgtctgatgtctcactcatcatcaccaccttatcaccataatattatgcattatatatgctacatgacctttcatagttcgaatggacagtagccagcatataataaatgagaaaaaaaagtgattatcttgcagggaattaattggttataaattataattaaatttcttgattggaatccagaaccatccaaaggaacttggtccatctgagaaagaaaaaagaaaaaggaatttggtttcctctgcctagtcggtgcttacgtggagattcctccatcttaactttggttagtacgatgatcagggggcacgaatagaaaaataaaacactggataaatattgatgtcatgaggttcttcaagaggcattagtactgatcccctggtttcaaatgaaatttgtccaaaataattgtcttaagattatgggaggtagtataacacagggtgcttgctcctttcgccacgataagtcatgatttttcagtcaacgcctacttgaacaatttccaagcctactctctcacgaagacaaaaaaaaacacctttttactgaataggacacaatttcaaggtagagttttctttatattaattcaaattaaagaaccaaatctactccaggttcactacttcgaaataaaaattttgttttcgagggatgagcgggctgaaattaactgccgcagttgtacacacaacctactggaaacaagtttcagccgaacaaggccattattcttcattagatattgtgattttttaacagatttacgctgaatctaaacaatttatatattgctaaattcaaacaaaataaatttcaggacaaaacaccctgaattttctgctctctccatttcatattataaatcgtttgacttttttttaaacttctttatatttgattaagtaacatttccaatacaaaacatattcaatgttaagttcaaatgaaactaatttggttgcttaattgtcgctaattttatctataaatttggttaaatctaaataactttgattaagaaaaaaaatcaaatgacttataatataaaatagagggagtacgtattttggaaggtgacaagcaacagaacagattgattggtccactctaaaaaaaaggaaaaaaaagattggtccaaaagtagaacaagagaataaccccagcatatactcactcctattaccaactatttccaccatatggagaagaagagaggaaattcaggtttcttccaagacaggcactgggggaggctaggattggtgcttggacgcctgcagcacacagatgccgccggctggctttctttcaccgatcagaatgcggccggcgccggcaaaactgaaggtgtacccaaaatgcccatctctctctgaatgctgtgcctgctaaaaggaatcaggtgaggtcaggattggatgggattttgttaggcttatcagcatcagctagtaggtagggtttggcattttcacatgaaaaagttcactactacctctcccaaatgcaacctatccggcaaagaaccttcctggaatggctccggaattcttggccgcattttctttggtctagaagtgggggtttgcttgatggcttaatgacatcttagatcat

SEQ ID NO: 16769 - DNA, 966 bp, Oryza sativa
gtcttttggcatttcaactcctcgacttccacgatatgaccaagagtccaacatatcatttgctagcttgaagctataaagcataccatatggaatatcgcttggaatgcctaatttttatctcccttgttggggttaaaacaactagtaccaccagttttttaattatctaatttaacctaaccaccaaaaaaaatcagagggttaaaatagcaccatctaccattacatgttaccaattgaaaatcattcttgagctaagcgagatatcttgttcaacaatccaatatatccagagaaatcattcacttctatgtaaaaaaaaccgtactactattactgaatcttatttataagatcaagtgactattaagtctcgagtgcaattatcgtgaaaagcttacttttaagtaagtcttcaattctattccataaatcaaattaaacttacataaaatacatttatagtcaagatatcacatatagccaaaaaccttaaatatatattggtggccaagcgacaccacccattttagtgatatgtatcatgcgagtatgtgacagacctcttacgtaactattgtcatatgttttgattgcacgatgtcgtcttttggcatttcaactcctcgactttcgcgatatgaccaaaagttcaagatatcatttgctagcttgaagctatatagcataccatatagaatatcgctttgaatgcctatttgtagtatcattattggggttaaaacaactagtacgatcagtattttcgttatctaatttaatcaaaacaaaaaaaatatgtttgagaaggtcaaaatagcaacatctaaatgtattattattattattattattattattattattattattattattattattattgttgttgttgttgttgttgttgttgttgttattattattgttattgttattgttattgttattgttgttgttatt

SEQ ID NO: 16770 - DNA, 2423 bp, Oryza sativa
ttgtaagtctttgatgttttcttgcatttacttgggagtgttatgattagttaggacttagcgttcgcgaaaaaaaaagttaggacttaggacgatattaaaaaccggtggacataagacgagagccacatcagaatttattaagaggagcatggcttgaaccccgggacggctagccgacaccttatggggctagtaggaaggccctgggcctttctcttaagacaatatttggctatcaagaattgacatccagtaacaacacctcaccgaactaccgaagtctagcacgatggaagaaaaataggtaggaataaagattcgacaacattgacgtccaagtaaaatttgacaaccagtagcattttctacagtattaaatataggtaggaaaatacattccacaacattgtcgtccatacatcacaagtactattgattactgtacctacattcttaatgtatgactctactacctacacccttaatgtatgatgctggttagttcaacatacaaaataattcggaaggagtaccataataaacttttcttgttcatagttggcagttgttttggcagcaaacacaaagaaactgtaaaataatcggctaatcttagattattgattcatttccagaatagaggataaactacagactactaacaagggtgatatataatgataagagagaagaataattcgtataaactgcatgttgttcatcacaatttcaacatagttttgttgctggttgccctgtcgcaaccttttttgatacttcagcactgaagcagtgacataccctacagaaaagaaagactagcagtctacctcttaggagaaactctatgatctgaacatactatcttctttttgcctcttgatactaagccttgctactacaggttacacctggcatttaggctatccaatgagttataattaactcatactagtagaggcttttttcccccttgtacaattcgactccgttattttttgccatacatacagttcagaatttgaagtgatcagagaagaactccgttgcattttgcgaacttaccgtgggttcatctaaagatcatgttgcttgcagaggaacatataggcgcacgacgatagttatcgcgatggtaactgcaactataagagcaagaatggccatagaatcaggcctacgagccatggtcaaaacagctcctcccattgcggtagctcctgctttggtcaggtcatgctcattcagctcaccgttggtgcaatcttgctctagcttcatccctgtctcattccatctaggattcacctgccctttcttcaccgttcgcttaagcagagatggcactgaggaatatgccagtgaattgaccggtttaacatattcttccttagaattctcttcctcatgttcaaactcatttttcttcatgactttttcttctgctagtttcacttctgctgtttctgccattggtatggtctctgtttcttctgcgagtttcacttctgctgtttcagccattgatgcagtctctgtttcttctgccagcttcagttctgctgtttcagccatggatgtggtatccgtttcttcggctggtttcacctgtaaagtttcagccactgttgaggtctctgtttcttctgccggcttcacttctgttgtttcagcaactggtgtggtctccgtttcctcttccagtttcacttctgtttgaaccattggtgtggtttctgtttcttctgccggtttcacttctgctgtttctgccatcttcacctgctctgagacttgttcttgatgcatcaccttctctgtagttggtgttgtctctgttgatgcagtatcttgatcaacacagttgttgttgtcatgttcctcaagggtgatgtcagggctgctgaagctaaaagtgttttccgcagaattttcttcaccttcattttcctagcaatcataattcagaagaaccagatagaataaataaggcccctataaacaaatagcacatggatgatcacaggaagcagatttccacaaatgttaaagagttgtagtaggaagacagtacatttacaattatctcattctcggcatcatttttgcctgaattatcatcatcctctgtcacattttctgtgtcctgaagcgaaaacaaaaatgaagttacagaacaagaagtgcaatagggctcctagaaaatggcatgctttctatagcaaaatgttttacatggttgcaacaacactcaccataacatgtgcagtgatctcagcgcagtccctctctgaattgtgattatatgtctcaacagcttcattaaccttagacccaaaattggcataaggaatatgaatttacagagcaaaagtgcaaaaggtccctagaaaatcaaacatgctgctcaaagctaaatg

SEQ ID NO: 16771 - DNA, 951 bp, Oryza sativa
gtcacacagctgcacttaatcgatcaggaatgtccaagcaccacaaaaacatgggagaaaacatctggataagagaaaaagaactccatccatatctagcatgtcaaatcgaaactagaatactagattgagcaggcaacaaagtaacaaccgagtggctatctcacctaatcggtcgaagcaagctttgctactaattgttatcaaggcccacgctatcaccaatttcaccatgagtagcgtaagcgctggctgcagcgacctctcaacgctgcagtcctactcacgaacacaacaggaacccaacaccgaagaagtgaagatggtggtcattcgcatattagtgtgagcacaagatagtagcattttgtcacaccgtccatttggaaactaattaactgtgcatatgctatgttatgaacccctgggttcatttcttaaatgccaatggattaaactagctagtctagagacctagagatctactcctatatggattgatttgagtttggaatctggaggagcgtcacatggtgccacatgcttgtttctcggatgaacaaaaagattcgctgtggctcgagcggaacgaggaggataaccacgggtttagtttgaaatataactactgtcaattaatgttagtattgtattatagcatattgtactgtaatatcaaataatatgaattagtatattgcgaatatgtttgcttgtagtttgttttatttgataaccatatatctttataaatatagctatatggcggtggttgttttaatcacaacacttagatatatacatgtatacttatacacaaaagaaatctataaatatagtgatagttggaaaatgttataaaaatatatatagaggagtgtgatatgaaaaacgtggtaaaggtctgatgactgatggagggggagaggccatccaaatggaatatagtgg

SEQ ID NO: 16772 - DNA, 3160 bp, Oryza sativa
tctcttctctcatactgtatgtttggatccaatcccctcagcccaccagatccttacgcattcatccatccatccctactttttttgcctgaaaagattggagaccatgttcttggattccaggatcgaatccgtggaagcaacaaataaaaatcacatatatatttttctttgcttggtcctgagttttgtttggttccttcctgcttggtttcttcctcaccgtcgttgacgcccaccacaaggagccgcctcaccttggtgagcgcggtggcggccatggtgacgatgaacagcacccgggaaaaagggaagaaagaaaaggaaagaggaagaagacaaagacgggacgaagaagaagaaaacaggaagaagaagagatggatggaaaacgtgacggcagtggcactgttccaattttataaaatttgaatgacacggctacgaatagacgaattgtagtggtatttttctgaatcgacatatttgtgatggcatggatctaattaaccctttttttatttgtttttattttgattgatgctgcaatgcaagtcggtgttgtggatttgaatccgatgcatttgtgttcatgtatagattgtgttgatgaatggatgtttgtgattgtcttttgttgaatgaataagaattttttatttgtgggtgaaacccgagggcgggctggtttggcggcgaaaattattttttagcgctgaaactattttcacaggcggggctgctgttgcgtgggaaaattgaatttctgcatgtgaaaatgattttcgcgggtggtgcttggtccgtctggaaaaattaatgatttttacgtgcggatggtttggccgcccgcgaaaacatgttttggccgcccgtaaaaaatagtttttctagtagagtctgtcaacccatccatcagcgcaacccggggcgctgcatcacggcggccggcgaagtgccagactgccagcccttagataattggacggcgccaagctcctgccgccgaggcgcgtgcaccacaggtataggcgcggcgcggccagcttcatcgcgcaaaccacaccctctgcggccacccgcactgccaccgcctcatccgtccactgcttcagcgacggccacttggtacatatgcgctagcgccatcaccagattccaaacagaaacaaagcaaagttcagaaactccacgcctaaaaatagaaaaaagcatcaagaggtatctagtgtcgaccgttgcttaatcctttgttcatgctcccgtctgtgaaaacaaggagcatgttgattgtctgattctaatgcttgatggcagggagaacatcaagtgcttgcgattttccactagttcgttagagaggtttttccctgtgtgccattaaaaaagatgatgccttcctctgtgccactaaaaagttcgagcctccctccataccatcgtcgaattttatcgcgccctccacaccattccatccgtttttgttgtaacggtgggtaacggcgcagccaaataacttaattgcccttaggcatcctagcactctcctctctcccctcaaatgcaacagcagcaaaggagtgagaaggcgagccagcgcctggggacggacgcggccgacgtgggctcctgcagggcgaagcgcagttcgccaccgctgccggcactggggagaagacggcggcgtggcgacaacgacggcggcggccacgggtaggaggaatacgagcagttcggcggcagggtggggcgcgttgtgtggcgaagggaaggtgtcggggttcccaacgacgatgcgggcgtaggaaaggatgaggccgcggaggtgcgcgatggaggcggcgaggtgcgcgcggagggcggcgtcgcggatggtggagatcttgcaggccttgtcggcggcgtggcggaaggaggaggcgaggtaggcaaagggggaggggttgccggcgggttggtccgagagggagaggcggtcgatgaggaggatcttgcgcgtgatgatgtcctccacctcgtcgggcgtccgctgcggccacgctgccggggacggcgacgccatcgccggtgatgcggcgcgagggttgttgcttcgacttcgtcttgtagttgggcggcagcgttgcaacgacgacgatgaccaccaccccatcaaggctgtagcggaggttatcagcaggaggccactgtcctcctcactgctcgtggtgtgtcaacagccgatgcagagccgccaccgcaacgtggacgggttcgcggatccgcggcatggcgaagctggaggagctgttcgctcggctcggtcgagacggcggtgacgagggaaggggaggccggcgtggtggcgcgggcgtccagcggctcggcacactcggctgggtgtagccggtggagagaggggaatcgagggagaagagagaatgaaagggcaagagcgatatttttcctgtccgggcccacatgacagagttgcccaacggtaacccaaaaagaatagcgacggagcgacggaatggtgtggagggcaccataaagttcgacgatgacataaagggaggctcgaactttttagtgggacagaggaaggcaccatcttttttaatggcaacctcttcggtagatcctgctcataacacctggtaatcctaattgcagttaagaccttgattccgtcagtcacgcacgcgtatcggtagcgccttgccaggcggccgcacgtcgctgccaggccgacgccgtcgcctccaccctcgggcgtcgtccctgcaaatcacaggaggagaccctgaagagagatggaaaacgaagaagtcagaggatttaacgccacggtttgggggcaatttgatgccacggtttgagggcagtttgatgcccacggttagggttaacggaggatttatcagaaatcgtgacagagtggcatgtttctaatttttaaaaggttcagtggcatccacccgatttcatgaatactattagtaaatttttaattgggtaaatttacaatggcatggatccaattaacccataaaaaaacacaatcatcgtagggtgcagctccgtcaccgccggccttctccctgctgccctttactgctacaaatgggagggccatgccgacgaggccggcggcctcccccctccgggccgatcagag

SEQ ID NO: 16773 - DNA, 7633 bp, Oryza sativa
aaaagaagaaaggattttcctgggattaaaaattgcactttggtgatttttaattggtaaaaattatttccaaggctctgaaaattccactaaaaatcctgttagcattatttgacatgtagaatccaagaaaaattccacatgccgattccgattattatttgcatttattaattagggaattagctctaggttaattaagataatttcttcggacgatttatttagccaatttttaaagcaagcaaaggggggaaaacttcagggcgtgacagttcaatcaagaggaatcaacaacagaacaactaatcaaacgtattatgaagggggttaagatgctgatacatagcaagaatattacttcaaccccgatttgtaacggtatttttatttgattaatcaccggaggggagagattcctcacctgaatctttcattgccaaagaaagatagttctgagttacagagattgggctataccagcggcaagccattacagattaaacagaaaaaggggaggagatataaagaatacaaaagagaggccaccaccttcccaaagagacaacaattgatgttaggcacctgcaaaaaacccaaccaaaaaccagagcaacctaaagctatcacctaagctcatcaacaaacattttcttatgcagacttggaaacgccagtactcctcactgaagggcctttctgccacaaggtcagcttggtttaacagcgaccaaaagactgtggaagtcaaaaaccacccgcatcagccatcaagaattcaacttaaacttgttgctgcttggatcagtgcttgctgacgcaatttgtgggaaggaagccccagaagagggagggccactgaaggttgcggccataggccgcccgtatcgagtcttcttcaatccgactataacaattgcttgcaagttccatgacctccaaggtcctttcagggaaggaagcctcaaaggaggaagggccgctgaacaatgtggttgaggacatgccaaggtaaagagaggagacgaacagggagctagacaagagagaagtggcagatggggggaccctacggatggaattccaacaactgcgacagcagggaagtgcttaagatcagatgctaagccagccaaaagagagccatcagttctaacaacaaagacctaagccatcaagcaaggagcatgcctaaaagagatccagagagaggtgaggcacgagcaacacctagatgatggatgaaagcctagctggtcagggcaaggagcagcgcaaggatcggtgactagagagacatcacagttgtcggtgacatgggaccgggagtatcatgactagaggcttgaggcagacacaatcgcccacgtggcctggcaccctcggggggtgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcacttagtcctcacaccgaaacaaaagcagcagcagcggaaaaaggcgatcctagcggggcttcagctccactccacaggcaaaactcaactggggtctgagccttggtcctctaacttcgtcttcagctcagaagcactacgcttctgaaaaagggggaataatagcaagattgagtacaaccaccgtactcagcaagccacaccaacgatgcagacgtgcaaggggatccaaggatggtttgtggctatttgcataaaggcggttgtaaaacattttattgagcaaaacagtaaaactgttgagtaattaaagtaaattagatctccactgatcaacgctacaccacgttgaacaggcccaaccaacccacctgtactacagtgcattgggtcgatttattaggggtgagactaatcacggtgaatctggtcgatcgcccataaccgcgggcacggctattcgaatagttttactctggccagaggtgcacaactgtacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccattcccgcttgtggcaagcgctgtaagtcttccagggtttcccgtgaaccggtccttaattgccatgggtgcgactcacaaaaccatgcacccacagcccaccattcagtcgcattttagttggataattacgaccataaaacatggccaggtgtttcgagcacgcagctcaacaagatactagaaaggtctaaaactgtaattatcccatcaactgagctagtggtaattaagcatggctaagcatatagttctagctaggtcacataagtaacacaagctagtcgatttatcacccaaggttgacaaaggacagatatcaagtaaacatggcacaagcgagcagataggtaaaccctattcccatgtaattagcaagacatgcatgtttatttgcaaacggtaaaacatttataaattgggatcaacatgctcaaggggaatgtgtgacttgccttgcttcttcacttggatcttctaaactcttttcctcgcgaccgcggacttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctataattaaactcgatttattgcgcaattattaattatttttacaaaggaaaaaggatctcgctgacgtcagcaaggggcagccggcgccgacacgcgggccccacacgtcagcgggtcaaggagctcggtgcaccgtggaccgggaccacaaggacggtccaccgccggtccacgggatggacggcccagatcgggccaagccgatcgggcagctgaggggagtggtggcagggcacgggcacagccagggctggcccgaccgaccacagagggcggcggcgcgcagacggccggacaaccggcggcggcggcggcgcaacgcggcgctggcacgggaggcggccggcaaagaggaaaaggaggagggaggcggctcaccgagaggcgcggcgacggagggagcggccgcggagggaggcggcggcgctccttgggtcgacgacgcggagggacgcacggcggtggatggcgagggcgaggaggcagacgaggtgcaacacacgacgacgaagccgacaaaggtgacggcaagcggcgaccgcggctatggcggtgatgattgccggccggaaacggtgaatggatgtggtggctcgggtgtgtggtgggaaggtggtttcggtggtggcgagggagagaaaaacggtggccgagcttgggcttgtggcgacgaagccggcggtggcgacggagcagtgctgcggcggttctagcgacgggaggcggcagccggcgctcacaaaggcaatggcggctcgggttggcagtggaggtggcagcccggtggtggattgggggagtgtagcggtggacgacgtgcggcgtggagtggtgatgccgacggcatgggttgcgcggcgcggcggtggcgctagcagcgacgaggtgcggctggaggcgacgaatgggtcggcggcctcgggtgcacggtgaagaagtggttccgggggtggaggagggaagggaaacggatgccggggtgaagcgtgggacggcgatgccgatggtggcgacggcgctgcgcggagatggcgagagcggcggctagaggcgaccggagctcgccagagagcggcggcgcgcgggagcggcgtggggagagcgggagaaggcgagggaagcgccggcgaggaggggaaacgagagaagggagcccggggatggattttataagctcggggagggaaaatcgttgccgggcgtggcggatttggggcggcaatgacccgcgacgtgggtgacatcgtgggcgaagtggagctcgatcccggcacaatttttgggggaaacatggggagagtgtagaggaggtggatgggaaccgatttcatgcggtttgggcgcgagggcgcgagcggaagaggccggaatcgtgggcgacgtgggcggcaatggcggcacagcggtttggatgagggaggctggaggtagaggaagggtctgacaagcgggtcccacggccccacttgtcggcctgaggggagggaggaggcgcgcagggacgcaaagcagacttggggaggggaggcgcgctgggccggcggcccgaggagagaaggaaggagggggaggaatttgggccgagcccgaaagggaggaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacaaatctaccccccttacaggaatctcgtcccgagattctgggatggctagaaagaaagctggtgctggtcggcggtctgactgatctgcacattgaactgccacatcctgcttcgaactgattgattgactggttgatcaaacctgcacgattgaactggctggattcgacctttctgttcctttgctttgccaaaactggaccgactggttctgcttgaactgacccagactaggactgcggatgctcctgaaacttacttatcttggactgaactgttgaggttggcaattttggtaacctgagaattcaccacgctggctataagaggatgaaaattgaatctggcatttgtaaatcatttaccctatgtccgcttcgactggtcccaattcaaatgacaagtaattccaggaaaacctgcttgacctgcctttcgtctgtactacaactgtcctcgctgttgcttttctaagctaaactgttgacatgcttcacaggtgtaccttagaatcgaacctgtcgacctgagattggggtgactctgctgacaccttgcaactggcttcttcaagtactacccggattgttgcactgggttgaaccttcaactaaaacagcgacgaagtgagccaaaactcatctccgagacctaccccccttacatggagtagtcttactttctcctgactaggaacaattggactattgtccttgaaaaataaccaacacttctcttgcttacaaaggccctcactttgaaaactgaaacttcaccgattcatcaaaatagagtaatgacggcgcactttcatcccagcaagatttggaacttaatcctcagttgctgatgggagattccacataaaagtgactctcatttagctcatgaacacactgactcttgactaactttcccataagttctaactactggcatgactgtcctgcttctatcttgacttcggtgtcgagttgcaaaaactgaactaaccgactctgcattggaactgacacaactcgaggagttggggtgtcgctaacaaagctcttgatgtgatgacgctgacgccttactgtggaacaaccctctgagaggtgccctgtcgtacatcttccatggatagttggacactttgcaaaaactgctcttgaaaaccataaccactataggtagcatatgttactcctgggattggtggtggcttagctgtgctgctttgctgaggacttggtggcgtactatctgaggttgtgggtgcttcctctttgaaaacaaattggctttggctctgatcctaattccagcttgcatctaggcttgtacatgttgttggagacactggtgttgcatctgctgcattggactctacggttgctgtatcaacatctgacacatccatcatctgacattggctaaccaaaatctgcccagagagaggtgctctgatttagcttgtagctggctgccttgaactgatccaatggctctgaccgcaacacactactgctggagttatttccgctacatttgaccaggtgtcgaacctgcatctcccacatcgatacacccatcttctgatcttggacaccaaaagttgatcatgagcagggttcatctggcgttggggcaccttgcagctttcaactaaaccattgatctgtggctttaattgatcttatctctgacactgaccatctgctgctaggacggaagagaggtggaagagaggggtcgctaaagataaggtactaaaccacttgcctactgatctgttgtgactacacttttattgttcaagttgcttaagcaaacaacctagtatggtcgcatccccaccaatgatgcaaaccatacccctacacacaagcaaacaacacacgatctagaaagctaacggaactactcttctgggaaagattgggtttaggtcaacttcgggaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttgacaaagaaatgccgaagggcgagaggagacatttttcaaatagggttttcagaaagcttgtccttagggtttgaccgtttggctcaacctacagtcaagttggctctgataccactttgtcacgcccagaaatttagcccaaatttccagactattttgtgtattaaatccctgtccaggaccagccagggtacacaaaacgacaagtaataaacagttccaaacgtaaataaagcgtaaaatacttacagaagaggcgcttagtcctcacaccgaaacaaaagcagcaccagcggaaaaaggcgatcctagcggggcttcagctccactccacagtcaaaactcagctggggtctgacccttgctcctctaccttcgtcttcagctcaaaagcactacgcttctgaaaaagggggaataatagcaagattgagtacaaccccggtactcagcaagccacaccaacgatgcagacgtgcaaggggatccaaggatggtttgtggctatttgcataaaggcggttgtacaacattttattcagcaaaacagtaacactgttgagtaattaaagtaaattagatctcctctgatcaacgcta

SEQ ID NO: 16774 - DNA, 25335 bp, Oryza sativa
  unsure (1)..(25335): unsure at all n locations
agagaagaaagnaggggaagaaatttgggccgagcccgaaagggagaaaggggaagaaaggagaattaaatttgttttctttttatttaattggttaaatgatctttgtgactttaaaactatttctcgagctccgaaaattcacggaaaattccggagagtattttagggcacaaagaatattgcaaaatattcccggccaatgatttttaagggaaaattttaattctcccattatttcacttggataaattgatttaacttttatttaatttctagaaaatgcattatttaatgatttttaatcccgaacgaaaatcggggcgttacagggggcgtcgggcccgagggtgatgtgttcgccctcctctttgtctccccgagggggttgggccgcttccgcctcggccccgagggctggggcgccccgaccccttgtggattttgcgccgcgtgtatgggttaggtacggcgctcacctaaccgcatttattgcggtttggacgagcgcgttacgccgcatgtaacgcagtgcagcgcgctcgtttatccggtctgtgaccagtcacagaccggtcagatcatgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaacatgcagattgttaaactgacacgtggtggacaagaatgaccggtctgaccggtctgacaatggtcatgtcatcagcagacagccatgtttccacgtcgcgcctgcttccggcggaagtggaggtaggtatgggccgtcccgtcagaaggtcattcggacgacggcgatgcaaatctccgtccgttaatgaagagaagtcaaattggagggaagagaggatgagtccccacacaaaagaaagagagggagagatggtgcatgtgggatccccttgagatataaaaggaggaccttgcccactgagagaaaaaagaagaaaaaggatccgagcttaatcgggggctggctggcattttgtagcttcttcatacacagatccaccaaaacacaggagtagggtattacgcttctcagcggcccgaacctgtatacatcgcccgtgtcttgtgtgtttccacgatcgcgaacttttcacatacagactaggagcttagaatctcacccagggcccccggccgaactggcaaaggggggcctgcgcggtctcccggtgaggagcctcacgctccgtcaacagttatagagcacctcaaagaggaggaaggacaaaggagggaagatgttgctgggcaaggtcgcaggcaccgaagaccgcattcgtcgaggccacagcccgccgccggcaccacagagctgaccacgagccgctgatcggtgcaccgccagccgggaccagctacggtgcacaagctgtcgaggccaaagcctccaccgccggccgtaagggggtgggtgggtgggggagactaggnccgccgccggacgccatcgtaacctacgtcaacgtggtctacgccgatagccttcgccaccgctacctttgctggcagtcaccaccgcgtcttccgtgcgcgccgacctcctgcgccggctgccgccagccgccgagtcgccatacgccgccacctccgcctcacattgtcaccgcacgggagcggctcgctctagccagatccggcgtggaggcgtcggatccacccacgaggaagccagatccggccgcggctgcgtcggatgcgctgcctccaccccacgtcatcggactctccttcgcgcgccggcccgccttccacgcacagagacggggcgccatcgagtcttggcctcgccgccgccatcccggctggccgcacggaactctggtagcacactctggtggcggcgaggggagagagaggaggagaaagtggcggtgggggcgctaggttttcccccgagtcgcccgctccccgagtcgcccgcgcgcgggcgacgtgggggccaacagtttcttcatttgtaacagtattgatagaccagagtctgtcgcgcgggcgacgcgggggccagcagtttcttcatttgtaacggtattgatagactagagtctgtaaccgtgcatgtatagtcagcttccttgcgcaagtggatcaggaaggatgacgactccgtttttacatcactaaagaaattcgcagggaatttttctaaaaaaaatggtgaggaagatacgagaacagaataatctgagaacccaagcaatggccttgcggcttgtttggttattaccctgataagaatttgcctgacctaaaactagcctgacttatcttagtccttgtttggttgccacactgagagctcttctcctcggccttggcctgacggacccgggcaagtgattagcctgagctctacgcacacgcgcgcaacataaattaatgataacccattggagcgagtgttaggaaacgatcggcagataaacgataaaaaacaatagaacgattggcagataaatgataaagaacgatagatcaatcacgaagacacgagatttaacgtggaaaactctcctaaaacaggagagaaaaaaaccacggttgccagtcagcaaagatctttactatattatgtgagattacaatactgaacagcggcttacaggaagtatatatataggtgaaaccctaaaaggataacgttctgtatcgcttcgctccggcccaagcctctagcgacgggcctccgcttcgctccatccgaagttggtgtttatatgtgtgtaaatgaatttgtatcacaactcaccagcgaggacccctgtgcgcagcatgaggcccatagcaccactacaccttcgccgccattgtcgtcatggcgagaaaagcccagacctccgctgtcgtacgtcgccgcgtgaagcccagacgtcccatctgccgctgtcgtcgtttcctgaagctccactgcagtgtcgtcgtcgcgctagatttggccatcgctatcgcaccgaagccaccgactgctgcttgctagattcggcgttgtgcgcgcgaagacgccgcggacgcttagctaggatgttgattcgctgagttccggtcacgcggcctgcctttccgcacgaagcacgcaacaggtcagcaggtattgtcttcgatggaatcagataactttgtacagtctgcagttgtgccactgatatgtgggccccactttagtatggcccacatgtcagtggcataactgcaaactgcacaatattagaggagtctcatccatcttcgatgctgggtgttcccaacccttctccctcatattctgcgtgcacacttttaaactgctaaacggtgtgttttttttgcaaaaagtttatatacgaaagttgcttaaaaaaatcatattgatccattttcgaaaaaaaatacttcctccgtttcacaatataagtcattctagcatttcccacattcatattggtgttaatgaatctgaatagatatatatgtctagattcattaacatcaatataaatatggaaaatgctagaatgacttacattatgaaacggagggagtacctaatacttaattaatcacacgctaatagaccgctctgtttttcgtgcgcaggagatttgttctcaactgcccacaacgaacacagcctttgacatgaagttggagtttaatttgatgcattctcctaattgtttcccctctttagatatgtgatagatttgtcatttgcacatggaaagctaggtagcagatagatttttggtgggccatgcattcttgccaatcccacattgataattgatggtggggaagcacaacttaaaagatagtctcatccattagacaagtcttttgggttgtatagtcttaagacctaaaattgtggcctcagtcgagcctgtggcggagcgagcccaatgtgattcgggtgacccacagtaagtgagccaggttgcgcactctaacaaatattttgcatcttattccgattatcacttgacttagggcctatttagatcctccaaaatggcaaaagttttatcattttggagcactttttaccattttagatctaaacactagtagcaaaagttggcaatttggcatttgtcatttgctagtctagggtagcaaattttgccaaaaatgctctgggaccatgcgcgtgctctctctctctctctctggtactaaaatggtaaaactttaggatgcatctaaacaccaactacatgccaaatcttttcccaccaaaacttttaccatttaccatttgctattccaaatgaatcaaaacggacccttagcaaaaattatgtaccgcctaatcatacttctcaggcggcagctgcaaatcgaacaatcaaatatcccgcctgcctgaccaggcaaaaaagtagggggctgtttggttgctgccctcgcctggagaccattgctcaggcaggtcgatccgaccgcaggcgaccgaaatcggacgcctgagatcgacgcctgagccaggcgcgaatctgagggcagcaagcaaacgcgccctagaactcatctgtcaggcatgaaaaaaaatctcaggtatgctgttcaggataccatggtcaggcggcagctgcaaatcgaacaatcaaatatcccggctgcgcaaaaaataagggggtatttgggagagaggggctaaactctcaaaaacataagtccctcccataggaacttatatttttgtgagagagactaaattgtttagccccactttagtccctccaaccaaacaccaactaaagctcatctgtcaggcatgaagaaaagtgtcaggcatggtgttcactgttcaagtgttcagggtaccatgatcacacaaaaaatagaactcatcggagaactgtcaagcatgaaaataaataccaggcatggtattcaggataccaaccaaacagacccttgatgccagcatgatcgaagcatggaactggcctgttgggcttgctgaaatgggccgagatcaaggcccattaaaacgccacgtggtcacgtggagcgctgctctccctccttggcgggcacgccaagcttagcacgcaccgtaaagtccaaatttgaccagtcaacaagtcaaagaaaggcacaactccaccttatcatctccactatataaaattcattttcgatcgatcgatcgctcactcacccacttgtctcacactctcactgagctcctctgcttctcgcatccatggccgccgccgccacgggccctgtccccttcaaggacgccgacgacgacggcacgctcgccgccgccgaggcgcgctcgcctctcccgaaggaggagttcggcgacctcgtcgcggcgctgccgcggaaggagcagtacctcgacgggcggctctacgaggggttctggctgccggagcactacgcgccggggatcatcgcgttccgccgccgtttcacgccgcgcgccgacgacgtggtccttgccagctaccccaagtgcggcaccacgtggctcaaggcgctggccttcgccgccatgacccgcgccgcctacccggcggacgaacacccgctgctccgcctcaacccgcacgacgtcatcccgttcgtcgaggacgtcttcaccgacggccacgaggccaagctcgacatgctcccctcgccgcgcctcatcaacacgcacacgccgtaccagcttctcccggagtcggtcgtcgccggcgacggcggcggcggatgcaaggtcgtctacatctgcagggaccccaaggacatggtcgtgtcgctgtaccacttcatgcggcgcctccagcccgacctgtcgctcgccggcgtggtggagtccgtcgccgacggcacggtgccgttcgggccgatgtgggaccacatcctcggctactggcgggcgagcgtctcccgcccggaccgggtgctcttactcaggtacgaggacctgctccgcgacggcgccgccggcgagcacgtcagggcgatggcgaggttcatggggcggccgttctcggccgccgaggaggccgccggcgccgtagcgagcgtcgtggagttgtgcagcttcgagaggatgaaggcgctggaggtgaaccggcggggcacggcggggtcgtacaagagcatgccgcgcgacgccttcttcaggaagggcgtcgccggcgactgggcgaaccacatgtcgccggagacggcagcgaggctggacggcatcttccgcgaaaaattccgtggcacagggctcaccattgttccatgacacggatcgagcagttggccagcgacgtcgtcgtcagtcactgacatgtgggccatagcaaagtggaacccacatgtcaatgacccaactgcatgtcagaggatctgcttccgtgtgcttcatttcattgtgattttgctgctgtttcggacatttttgtttggcatcgcttgtttttatttgtgattacccacttttctcggttccaatcatggaacggagatgtgacgaaaggcgcatcgaataaagaaatgagagtgattcgggcttgatcatcatccacttgattttgtgagcatcatgatacaaattattaaatgaaatgatgtattttgtacgaaaaactttaaaatataagataaatctatttctgagtttaaaacaattcaaacttcgagttatgaaattagtttttttattcgtgtccgaaaaccccttccgatatccggtcaaacgtctgatgtgacacccaaaaattttcttttccccaactaaactaaataaggtcttattttgtttgggctatttattgatttgggccgagtttgtttgttcgttttggacttttttgtgtgggccatgtgttctgcatttgcccaagtcaaagccatgaaaagatccaaaagagatggtggttttgatgaaacaagcagagtaagaaaacgagattgatcaaaaaaacaatcacacacaaaaaaagataaatcagaaacacagcatgagcgaaatacactactagaaaaataattttttatggtgttggtcaataattttcgctggcggaaaaataccaaaaccgccagcatggtcgtaacgagggggtgaggggtaccatgttatatcggccgccaacgaagatatgttcattttcactggcggtcacttagatgagccgctaacaaaaatggataatttttgctggcagttgggttaaatagtccggtagcaagttacaattatttttgctggcggcccacttaatcaaccgccagccaaaattgatttacactggcgctcttaaaaaaattcgcacataaaaaaatcaccgcgcgcccatacctttatccacccaccactacagaataaaaatatctccacttctcccctccaaatccagatccacttcctctcctccaaatccaagcaccctcctctcctcttcccctccagatccacatctcctctcaggcggcgactgcggggttctcgggtggcgacagcggctccggcagctatgcgtggtggcgacggcgacgggaggcgggcacgtagctgcgacgggaggccgtcgtcgggggggtgcggcgacagcaacgggaggagccgtcggggggcgcgacgagctccttcttcttcccttccccttccacagtggcttggtgctgcgatggttgcggcgacggctcgttgttgcgggacatggcgagctcccccctcccctcccctcccctccccttcctctccctctccctctcccagatctagccggaggggagggggtggcggcgaccacggcggtaacggaaggcaggcggtggtggatctgacaacggggtcggcggcatgagagcaaccgcgacgacgacgaccgtgaccgcggcgacgacgacgacgatgctgcgcgccggccgggagcacggctctagcggcttcttccctcccctccttctccctttcccagaggagaggtggaagcggtggccgtagcggcgacaacaggtgggcggcggcggcggatctgaccgcggcggccataattattagaaccggaccggaccggcggtccggccaggaaaaaccggaaccagggcaccgcccggtaccgcggcagccatagttattagaaccggaccagaccggcggtctgaccgggaaaaaccggaaccagggcgccggccggttcggttcagatataagatcagcgcgcaatcaaaccggagagaaaccggttgaaccgggcggtttactgcagaaccggagaaaaaccggggtggttcaaccgcttgaacggcgtcacacgtgaggtggcgacgctgtagagtacatgcgtcacatgaattagagaaaataggtaaaaaaaagctgtagaacccaaaacctccatgcttccaccgagaatctctaccagcaggctatgtgatgggttgtgaaacaactataacacacacctatttgaacctctttaaaccgacggtttgaccagtccgaccaataaaccagtgacccaagtgacttaacggttcgatcaccggtctggtcttaataactatggcggcgacgacgacgacgaccgcaatcgtcgaccacaaccgtggcggcgatgacgacgacgccgctatcgacagctctatgcgtgggcggcggttgtgatattgatgtttgcttgttgaaaatgtggtgaaaattgatgtattgttttctgcatgtggatttgaatatggatctgatgccgatttgaattgattttgagtatggattgaaaaaaatccaactgctcaagaggtcgattgctatttttttattggaaaaaaaatcttttcgttggcggtcctcttaaggatccgcctgcagcggttctcttaagggtctgccagcgaaaatctattttcgcaagcggtcctcttaagcgtccgcctgtgaaaatcctattttcgcaagcggatcgcaactgccagcgaaaatcttagatcttcactggcctttgctttgtggcggctccaaataccgttagcgaaaacgcaaaatgaccgccacgaaaaatagttttcctagtagtgataagaggagatcgaataaaataaaataaaaatccagaagtgttttaggtggaacctgaatttggttggttacggaggtaatcttgaccctctcacgcaagatttcgttgattttgcttactctttgtttacttgatctcaaccgcgtcaactttttttttgttcgatttgttctactactcgatgaaacaattgcagctctgtgaaacttcaagagaagcctccattgcttcattgttggcctttttattatcgacgtttaatcattctaccattataaaaaccatttgtcgcacataagaaaatataaaaagaaaattacactaagctccaaatgtacaaaaagttactttggcttcatcacagagtatgacaatatcgatcacaactattactcctctctctgtaaaaaagataaattttataactaagaatatgtgtctagactcatagttaagatgaggcttaggatatgggatatagatcgacgttcagagtcgcaagaaggcctcattcaatacaagaacgagagaactagagaacagaaaattttctgaaatactcctccgtttatatatatattagtttcaaaccattacagagcaacaaggaaacaagcagccatcccgatcgatcgaacgaacatactcgaccatgcaagaaagcatctagcattaataggtagaagtagaaccacaagcaacgatcacaatgcgtgcgtacgtaatgtcgtcgtcgtacgtcgtcacgcggcggcggcggtgcggaggaggtagtagtagagcttggggttggcctcgaaggccacgcgggagatgaggtggccggcggcgcctggacctttcatcatcaccaccggcgccgccaccggccaaagcagcaggctcaccgccgcgccgaccacggccgcggcggccgctccgacgacgaatcccagcgacaccatggctagctctcgatcgatcgcggtctcaacctcccaaggtcgactacttctgaacttcccaagatcgagatgactagtgctagacgtggtatatataggcaatttagtctgcattaatttgcttgttttcctcgggaaggggatgggttggaacttggaagctgatcacaatttgaaagacggtatagatcaaacggttcgtagtaaaatgtgtgaagacgatgggacgatgctttttttttttcgcaaaaactaatcagcgaggcctcttgatattgtcttatcgggcgacgccaaccatagaagccgtggagaagccagcgcacatgcatgcctttttttctattacacatcatgtattgttttcccttcttacaaagttttctctcaaattaattatccgatctataatccgattacaccattgtgttcgttgcaattaaatcttcaaaactagatcttacatgattatactacgatgaaaaaatatttatacttgtaaattacttttgttatatacttaagttacttttatcatatatataaattacttttagatttaattaattactttttatatattcataatgctttaagtcgattatatttattatagtttttagtcaattctataatttatggactttaaatttaatttttagatacaaaatatttttctctcgaatttacttctaatgttgtaacaacttacttctattttgtgctaacttacttctattgcatagctaagttacatctattgcatagctaagttactactacaatttaaataaattacttttaaattaatgaaatgtttgaatatattcaacatggatttttttatctcatattttatgtagagtacaatgatgtaaatagatcatgaaaataatatgtgatttaaaagatataagttattaaagagcttaaatctaaaagtaatttatgtataggacaaaagtagcttacatatataataaaagtaatttacaacatagatatttcgtgtaagatcttgttgtaaagatttaattacaacaaccataatggtgtaatcggattataaatcggataagtaatttaggagaaaattctctaggaagaaaaaaaaggcatgtactgttgagtgtactagtaactgtttaagagaagggcgtcgctggttagcgatatgccgctagcgcgcgcgatctagccgtgtctttttttcccacgcttttttgggactccggccggtaattgatccttcaataaagttctacaattaagtgagaagcagcactgagaggatgcccgtttcgtttacccgagtaattaagggggtgtttgggagacttcagcccctctctcaaaaacataagtttctaggatatggacttatggttttgagtttagcccctctctcccaaacaccccctaaatctgtgagcagacgataaattctagtagtagtgtgctccttcccccaaataaaccatctcatttataaaaaatcttagagcaagtttaatagtatagtccactactagttttaaatcatctatagccaatgtaatagccaattcatacaatagttgcttactatactattaatacctggtcccacctatcatacacacattccgttttggagtccgtgctacagctggctatagacttatagcccgctgctcttctctcttcctttatctatttaaaatatgcttatagctggcttatagcgtgctattgtaattgctcttacatagacgtaggtaatagtatagtaggctagtaacaccctagttttctccatcctaacaaaaagtgaatctagaactctagtacaactaatctatatgtgttacattcaatactagattatttttttatgggatgaaaggattaatttttcataggacggaagaagtggtatgaaactcaacgtagcacaaaaaatctagaacattctcatttataaaaatcctatatagatgtaggtagtagtaggctagtaacaacatagtaacatatgaaactcaacatagcactaaaaatctggaaaggaagcttgtttggttggtttagaatatagtaaaataaaaattaaaaatcaccaacatttgtaactaaatttcactcacactaaataagttgtcactcacatccgtggaccttttaacttctaacgataatatctaacttttaaaaataaaattagatatgcattttttatccagatcgatagatccgttaacattgactcagactcgttcgttcatgatttttataatctatgggcatgtttaaatcaattttctgtggtaaaagttttggtgacaaaaaaaaattagcatttgaagttgaagttttaatagttactgtttagatgcatattctaccatttttctggtagagagagcactcccaacgcacttttcgacaaaatttactactctagattttcaaattttcaaatgacaaatattaaattgataacttttactactagtgtttagattcattttgacaaaatatgcttcaaaacggtaaaaacttttaccattttagaggtttggaagaactaaacaggccctaacttcaccaataaacttcaccaataaattgctcgatcgtgcatccacataatgactttaagttgatttttttatatgaagggattaaagttgatttttataataggttaaagttgatatattttataggatgaagggattaaagtttatttttttaaggatgaactaaaggagtacgcgatgaccaattcgaatggaacatactatttgggcgtgtatccatgcaaagctaggatgcacgatctgttgagattatagacatataatgatttaatttattccataaataaatcatgacattacagatgaaaactagcatgaacgcatcattagatctacatatgtaaactatacagtataacataaacagatcaaatatgcgcaacatattgaacacgtaccgaggtgacagaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaacttattgccgccttctcccggtgcaggacgtcgaaggcaaaggttccggagacctgctctcccgatcgccggtgcacgctggcgagcgggatggagtagtctacgagcgacggcgcagtacagagtaggaggcaaaccctagattgatttcgtgtgtgttgcgtgaagacggcaggtcggtttatatagagaagggtcgcttgatcagggcgcccgcacgatctctactgcgcgtaaccgaaccggataagtcacgcgtaacttatctggactccacgccgtttgcacgcaccggatttttcggaagaatctgaatttgcagcaaaacaaaactgcaaaaagaggctgcatctgcgcaagggtgaggagccaatttttcggaccattcaacgcgtacgtcgtgcacgcgcgccgcctgccctgccctgccctgccaggccaggcgaggcgaggcgagcgagcgtgcgcgtgtgtttcccctcttctctccaccacacatgcttcaagtgactaggagggcatcctcccttttaaggaggtccccctctcctagaataagcaaggtggtactaaactccacatgcatgccatcccatgaggtgggcttttgtgattttccaaagaattaatcttcgagtggggtaaggcccattcattaattccaacaatcccccccaaattcaaaatcccactgagatttgccttttccaatatactgtttatataccacggttcgatggagcccaatttaggttgaacatccacctagaactccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatactctgcaggacaacatcttcgctaattaaagccaacagaactcattaaggcatagccaacctgccttgcagctcacgagagtatatgcatcttcacttggagagggtatatatattggtactctcctctagtttattaatggtttgttcttcccaggatctaattcacgggatctccgatcacatagactgggttaccaccatagtataactcacatgggtctcaaacccatctccttcgatgcattgtctatcacatttcgtgatagtcccttcgtgaagggatctgccagatttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagaatagtgaagccccaattccacagtacctttcagatagcgcattactcgctcaagcgcacgccagtgatcatctcccggattagaggtaaatcggctcaacttgcttacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaagatttgtcccaaatatcagtatgtcgtcaacatacaagcacaaaataactccctcacccccaccatggtgatagtacacacatttatctgcctcattgactgcaaagcctgcagatgtcaatgttttgtcaaatttctcatgccattgcttaggagcttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtatcaaagaaatcttcgccttctttctgagtatagcccttagcaacaagtcgagccttgtacttttcaatagtaccgtcaggcctaagcttcttcttgaacacccacttgcaccccacaggtttacacccatagggtcgctctgttacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcagagggttggttcgaaccactatgtgtatccttcattgggaaaaagctctcaaagaaggtagcatcacgagactccataattgtaccaacatgcatgtccggtacctcggatttaactattaaaaatctataggcaatgctgtgatgagcatatcccagaaaaacacagtccacagtcttaggtccaagtttgcgcttcttcgttattggtacattgactgtcgccaagcacccccatgtgcgcaaataagaaagtgatggttttctaccaatccatatctcatatggtgttttgtccttatttctgttaggaactctatttaacacatgatttgaggtcaacaatgcctccccccaccatgccttaagcagtcccgcggcgtccaacatggcattcaccaagtcagtcagtgtgcgattcttcctttcagcaatcccattagactcgggagaatagggaggcgtcctctcatgtatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatcaatgtcatgaaatatcgttttccacccttcgtcaacaccccattcatttcacaaagatctgaatgtaggagttctagtggtgccaagtttctctcttcggcagccttgtgaggcttgcgaggttgcttcgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacaggcctccgcactcataacctttaccaataaaatatccatgtttagacacgactactttattagactcaaaaaccaacttaaatccgtctctggtcagacgggagccactaacaagattcctgtcgaaaacaaaaacgaatccgaatttgcagcaaaacaaaactgcaaaaagaggctgcatctgcgcaagggttaggagccaatttttcggaccattcgacgcgtacgtcgtgcacgcgcgccgcctgccctgccctgccaggccaggccaggcgaggcgagcgagcgcgcgcgtgtttcccctcttctctccaccacacatgcttcaagtgactgggagggtatcctcccttttaaggaggtccccctctcctagaataagcaagtggtactaaactccacatgcatgccatcccatgaggtgggcttttgtgattttccaaagaattaatcttcgagtgggctaagacccattcattaattccaacacgatcaaccacactgcttaccctacaacaaaaccagcagctttttcccgtacgtacgtggaggataactatgtactagtgtagctacatagtacttactagctagctatagcctataggtgtgtagtcgtctatccagcagcagcaatagctaacggagtggagtacgtacgtcgccggcgccgtcgcgcgcgtcaggcggcgacagcaaaagcggcggcggccgccttggcgcctgtcacatcctgattttcgtttcaggatttataaattatttaataaattattaatagaatttatattaaatgttctttaatttacaagtgaagttaaatgtgggaaataaaatttccctaatataaagcatggatggatttaatttttattaaattctccatgattaagtcaactctctgaaatcttctcaaatttttcggagctcaattcctaatttttaatcatacaaagaacatttcagtaataatccacatattaaattaatcattaaatggtctggttttaatattgttaaatactttgagtgtccaagtattttcatgatttttcttgaaattatttgagcattggaagtatttttaacaattcaaagatcatttaagtgattattttaattgggaaagtaataaaaatcctcctcctccgcttgggccattttcggcccattccttcctcttctctctcccttgcgcgcgtgctgtgcagcccaagccggcccaagtcaagtgctctgttctgttctcagccaaccgaaaaaagtctagtttgcctccctggcactgttcatcttccagctctggacagagcccgagccagccgagcctgtgcacagtgccgccttcttccaccaaatccggcctcctcgttgctcctctttccaaattagttgaggggaaatattcctcttattctcctcttccttttccccaagaaatccccaaaattttatatggaaatcctttccaatttcgcggatcaaatcctttcctttttccggcgaagataaactttcccgagtttttcccgtcgttttgggcccggacccgagcttccaaggctataaataggaccccctagtcctcctctttcgtttgccccctctcccgagctctctagtgcctcgtagcctcgtcgccgcgcgcgtttagttcgtcgccgccgccggccgagtgcagccgcgccgccgcgccgcttctgccgtcgccgccgcttgccgccgtcgccaagaggtgcgccaaggggtggagaagcccggccgcccgtccttcttcgccgccggccgccgtagctcgccgtcgtcggtaaggtccaagccgccgccgcctcctctcgtcgccggccgtcgtcggacgtcgattgtcgttgtggtgagtaccgttgggttcgcctcgtcgtcctctacgtgtgcatgccctccaaatccgcagccggccgctctatctccggcgaggtcgtatcgtggttcgccggcgccgctccagcagccccgcgccgtcgctgtggtcgtcgccttcggtcgccgctgccgccgttgggttcgcgaggaggagaagaagaccggcctccacttccccgtcgtcgaagaccccgggaagcccgtcgtcaccgtgaagccgatccgttccatcttcagccgcgccgttcgtcgccgtccatcgccgccttcattcaccgtcaccaccctcgggatcgcaggagcgaggtgaagaccgtccgccctcggttgttgcctctcgtcgccggaaagccgtcgccatcgtcaacccaaggtcgccgcctttggagctcgtcgcctgccatctccctcgccgtctgtcgtcgcataagtggtggtaagggtcactttgatcccctctcgctcccggtgccctccgtttgcgtttgtgccgtggttcgccggcaaccgccgctcctttgccgttcacctgtgaggttttccctagggccttaatccgatctaatctaatcttgtttggccctaacgtcatcatcgtctccgtgtgtgtcgtcatcgctgtgtcgtagctgctgcttgccgtgccgctgctgcgcgtgtgccggctgagccgcttagctgcagctgcttgccgctttgccacagccgcagccgtgccggttgcgtttttgctcatagccctgctgttctagccgtgcatggttgctaccggctgtgccgtcaccctaaccctagctttgtgtatccgctgagctgccgcctagccaagccaagtcgccctagtgccgccgtgtcgcagttgtgtgccgcttaaacctagccgctgcttttagtcgagttgtgcagccgtaggtgcaaccctaggttcctaccggtctatcgtttgtcgtaccggggttttaccatgaatcgtttctagtccaccggtttagccgcagccgttgttgagtcgttcgctcgttcgttcgaatgaggtgttccccgtgcttcgttcgttcgtccgtgttgagtcgtcctttagttcagagccgccggttccgttcgccggtttcggttgatcatttgggtgatcccgtgtcacgtagaattgactcgttgagtcggtatctcgtgaggcccgcttgccagatcaatctaagccatccgatcttggtcaactctcggtcaagattaatctcagccgtccaaaatcaatataaattcgttctatcttttcaatggcatattagtcctttttctttttatcatgtcatctaccaatataatctaatcttttccggaggttgctttaatcttctgtctccgttataaatcatttgtaaattgtttaattaatttggaatagtcttttctttaataggtttaattggaatttaatcttgtaaaattcataataaattcatatgaaatcagaatgaggccgttcaagtctcataattcatctaaaattatgatctacatgtttgtttactttttatgtattgtttatttggtttttattagtctttttcttcgttttgcgtgttagcttgtcgtttccgtcgttgcgaaggttcgcgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaacctattcctttgttatggcctgcttgcattgattactttaatccttgataccttgggttattataatttgactagttgagctttatatattagttcagctagatattagatgtgattgcttagccatgcttagaaacattagcacactattgggataacttatgattcgttattatttaatgatggtttaatggtagctcacgatggtcaaacgtgattggttaattaattacttgccaactaaaacttgataatggggggttgtgagcacatggttttgagagtcgtgctcatgacaattaaggaccggttcgcgaggtactgttgtgaaacattaaccgtaccaaccacaagccagcgtgggcaacggctttaccttttgtatagcatggttcattgcggagcaccagactgagaagtggcggaaataagcccacgggggtcgctggggagtccatgccttgttttataagggggtgattatgatccaggaatggtgcactgtggtgagttgtgttatgcagagggtattgtcacagcctctattcgggtactttccagtatcgcgacgcatggtagacatgatgttgaggctgtgtcttgtgggtacagtggtacacctctggccagagtaaaactattcgaatagccgtgcccgcggttatgggcgagttgaacaatgtttttcgtgattagtctcacacctctcacaataattatggatgctataactggtaataatttgcttagctcctggtttggagttaaatctgtacagccgggtatggttgttcaggatggttgggcctgtgcagcatgggtgtgctgttcagtgttgattaaaatttttaattaattactctactgttttactactcttaactctttgctaaatgctgcttttgcaaatgagcctatattatgccatcctttggtatccttgtgcacttgcatatttgctgtgtggcttgctgagtatgtcatatgctcaccttgcaataatcaatcaacctcagttgaagaaaaagaatccagaaggagaagacgtttggcttataccccagttgagctgcctgtgggagtggagccggagcttcgctagattttattttccgctgcagttttcttcttggtgaggacttagtgcctcttaagtaagtatttatcgttttagttaatttgatgaatctgtatattaaattgtcagtttgtgtacctcggctgattcctggacgaggattttatgcacaaataagttcggaaattactagtgaatttccgggcgtgacagcgcccaccgtgcgcaggaggtggaagtagacctgcgggttcgccaggaacgccgcgcgggagatgacgtagccggcggcgcccggcgccttcatcatatcatcgccgccgccggcgccgaggccggccacagcaagtacaagaaggcggtcgacccgacgcccacggccacggcagcgatcatcgacggcgccgcaaccatcggcactacaagtttgtaattccagatcgcgcgcgtggagaccaacgaacaatggaggagatcgacgaagagatcaagcagagtgaaaggtgcggccactggtggtaaagctagtggtaactggttttatagaggattgcaaaacacaggaaagacatagaaatgactgtttgattgggccgcaggaaaaacataggaatttgaggagaaataaagactcaaaggattctttccatgaggttctatctcatgtcaaatttcctccaaaacttgcaaaacttgtatggaaaaagataatccataggaatttcataggattttataggatcaattcctttaatttaaagggctatatagaaaaaaaatcctacaggaataaaaccatctaaaatttctatgaattctttttaatcaaagggccctaagttgctggtggttctgttcatggtggctgggttcctccggaagggccgggaaggggcgagggtgcacggacagcgggacaggtggcagaagtgtgggatgcatattgcctggttttttacttttacctggtccgtctactcgacacgcgtacagggatcgagatcggtaggggcggcgctccaaggagcatcacatcggtagagacggtgacgaaggagatcacggcaggctcgtatgttatcatcaatcaaatttgtatgctttacacgtgagatctacgtgttatatatttaaacaaacattattacactataaatgtatgttgtgtgttcttatttatagggatactagcttaattaaagaaaaacagattgagaaaaaaatttataaatgataaaaagaacgttgattggggaccaaatcagagtattccccaagtctatttgaagattactacgtcacttttagttcatagaagataataagatataaagtttttaattcggattcagctctcctaacaccatcaatttcaaacggatctagccgctcatatagaaggaatctcgggggtccatgtcacgccccgaactagtcccgaccggaactagcccgtgacgttccaaattaacctgttaatcgataccagtcccaggaaacagtgctggtatcacagggagacagaatatcatagcatcagaggtctctttattatagagtagaggtacagtcatgttgggctgcggacagatcccgagctcccaactgcattacaaaagggaaacggaagccaggacttggaccaatcaacacaggcgcgacttgggaactaggccgaaaccctaaaactcatcgtagccggcttgctcctggaagaactcctcatcagcagcttccgcttcatcttcttcagcaacttggggggggtcatttatatagagcaagggtgagtacgggagtactcagcaagccatgggaaataagtgtttaatgcaggcttcaaggaaaggctgttgtttttgcaattgtttttatttgaactcttttctaaaacaactaggtgagtgcttctcaaacgacacggatgagacagtgcgtctcgtccggtcggagtatgtgcaatgtatcagtctttagaattgaaacaaggttggcacccggccaacagctttttaaacggccacccgggccaaccacttttcaaacggccacccgggcctagctgatcccatcacctgcagaattttcaaacatcgaaccccttttcacaacagtaatttcacaagcagtagtcaaacaaaactacgctaggaatcacctcacatccgcccatgaccgtgggcacggctgttcgaacagtttgttaacctctgcagagggggtacactttactcacacgacattactaacccggatcacccagcccgtggggatcagccacgtcgggagacctccaagctttcatgacaaggcatttccaaagccgacacaggtttaccatatgccgacgagaggagtcccagaccaacaacaggttaggtcccagaccatactgtgccaagaagcccaggggtcctccccgacaccaccccggcgaatccacatgtctctcggcatcaaggctcccctgataagctagttactcagccaagggtgtcccattccacccatgtggtcgtacttgtcttatgtttggatgaaattccaaggaaatcggtccttaagtgcgagagcgggaaaccgtacacccggtacgttccccggtccgcggttttggaaattcatttagttcgcaagcaccgacccaggtgtcgggttttccaaatcttttgtaaaacccaagttttacgcaagttgttattcagattttaagtttgaaggcgtccgtcgatactcgcacagggtgcacgaatatcgagacgcaactagatggttacaaggggacatggtataacaattaacaaaagaaggatcaaatacaacaaattagataggtccgccaatctgccttgcagacgggacaaacagattaagtgcgatcctatcaatgcataatatttttcaagcaacataattaaatttcaaatataggctcaagatgttcaaaggtagcttgccttgctcgagatctggagcttgatcctcgaaatcctcgcactgcgggtcttcgggctgtcacgccctgaagttttcccccctttgcttgctttaaaaattggttaaataaatcgtccgaagaaattatcttaattaacctagagctaattccctaattaataaatgcaaataataatcggaatcggcatgtggaatttttcttggattctacatgtcaaataatgctaacaggatttttagtggaattttcagagccttggaaataatttttaccaattaaaaatcaccaaagtgcaatttttaatcccaggaaaatcctttcttctttttggttttcctttttcctcctttttcctcttcttgggccgtcggcccagtccacccgtcgcccgcgctcggacttcccttgtgggccggccccgtaccctttccccttcccgaagatcttcctcccttcctctatacttcgggcgccgacaggtggggcccacct

SEQ ID NO: 16775 - DNA, 947 bp, Oryza sativa
aaatccttggaagttagaatggatcaatgttaacaaacattcagtttcaagctaaataaccaaagtccaatttgtagaagagtaatgaacatatcataccagatataagaatgtcatagtttccactttctaggaaactacaaacttgaagcatccttacatcataactgacatgaaaaatgtgcaataaaatcctatagaagtaagtgtcaccattgtcacacagtgattacctgcagtgagttgctccccttgcctagtaattccaggccatcatcatctatgcatgagcaacaaaccattgccaactcctcaagtttctcaagtgaggatattgatctaagggattcatttccaacctggtccagcaaaaaaaaaaatctgttttagttttatagaacccaagtacgtcaagaacataacgaaatggaaattgtacatcaatgaatagctattcaagatggagcatactgcagcaaggacataaagaagcaaacatccataatatcgacgtaaagcacaaccattgtactgtaaatgttcctgcttccagtggtacattcttcaaccatgtcaagaacagctgatcagctctatctgacctagtcaccccatttggttactacatatcaaggttggttgaacccaagctcaccctttctagccaactgaattaacggaaaaggactcatcttcttgccattttattcagaagttatgtcttgacgaaatgtgatcaagcccaatattaagtactctgaaactcatgctccagttacttccctattagcaaaactgttctaaacacaccatgaatccaccatacaggaatccacaacagtaatctgctgcaactaaatgaatcaggctcaaaagaagcaagtgtagatgtcccatggtaaatttctcgtctgattccaaaaggacaagtaactagtagcaaattg

SEQ ID NO: 16776 - DNA, 616 bp, Oryza sativa
gcagtagttcatcaatggtcgagtatgttcgctcgatcgatcgggatggctgctcgtttccttgttgctctgtaatggttcgaaactcatatatatataacacggaggagtatttcagaaaatttggtgttctctagatctctcgttcttgtattgaatgaggccttcttgcgactctgaacgtcgatctatatcccatatcctacgcctcatcttaactatgagtctagacacatattcttagttgtgaaagttatcttttttacagagagaggagtaatcgttgcgatcgatattgtcatactctgtgatgaagccaaccttactttttgtacattcggcgcttagaggaatattctttctatattttcctatgtgcgaccaatggcttttataatggttgaatgattaaacgtcgatataaaaaggccaacaatgaagcaatggaggcttttgttgaagattcacagagctgccattgtttcatcgagtactctaacacatcgaacaaaaaaaaagctgacgcggatgagatcacgcccacacagagttgccccatcaacgcaatcttgcgtgagagggtcttgattacctccgttaccaacccaattcatgt

SEQ ID NO: 16777 - DNA, 529 bp, Oryza sativa
ccacgaacggcagcacatccgcggcgcctaccggaggggtggttcagttcagtgagtcaaatccaagtcagatccaaagtaccggactcgaagcacacgctcgtttaccgcgcgtacctgggccggcgaggccgacggcggaggcggcggtgggcttggcgttgacgacgacgaggcggtactgcggcggctggccggcggcggcggcgaaaaagtggcgcaccgtacactgcagcgcgttgtaactgtgctcgctctcgttcacccctaccaccatagaaatactgccctccgccgccgacgacgcctggggcggtttctccgccatgtcctcctgtcgatcgctcacggaaacaagtcacgaagtgtgtgtacgcttcgcgaaccgtgtgctttctcctagtaagacggcagccattggctgacaggtgggcccgggggaggtgggtggggacgcggcatctccaataatggtggtggtagtaggtccgtgtgtgccacgtcacttcgtgggtgttcaggttcagtg

SEQ ID NO: 16778 - DNA, 407 bp, Oryza sativa
tggcattgtgatttgtgcaattggaacttgttttagtctgtacgaatctgtgaattgtgatttgaattgcgaactgtgaattggtacatttgtgcaatatggatctacaatttgcagggaggcagagggcggcgccaaccaccctggcgccgaggttgagaagggcagcgccagccagtgccgcgtggcaaaagggtttcgggctgggggagggcggcgccagctacccaggcgccgtggtccatgagggcggcgccagccgaggcccggaggcagaagggcttcgatgggtggaggaggggggcgccagccaccctggcgccgcggtcggggggggcgccagccgttgcctggaggcagaacagacttggcgaaaatttgggggggggagaaagttggtggggccc

SEQ ID NO: 16779 - DNA, 953 bp, Oryza sativa
atgatgttaaattttgtcaaaaaattgttcagtttgttaaaatgctgctaaatttttgtagaaattccatcaaattcagaatatgtgccaattgttatgttagtcaatgtgggtcatttaaatgtccttttgccaagaatttaaattttcaaagcatgcataaaatgggggcaaaaccccaattaatgaatatagataggagagggtataaatgtccttttgctaaaaatttaacaccgttaacttttccatccaaaacaggggcaaaaacattgttcggttcaaaaaagtgagggcaaaaatgaaaaccccaatattggacactaaagtgggggcagaaacgaaattgccccttaaagatttgctacataaaaattcagaatcagcaccctttgttcatcctcgatcacaactcttaaggaaccttgttttcacacgcacgcttcccaactgctaaacagttttttttaacaaaagttataaaatcatattaatttattttttaggtttgaaataattaatagtcaactaaccatgcattaatgtctcacctcgttttgtatatcttttcaattttctttttccctcttctttcaaacacacccaaaaacttagctctcccaggttaccaatggcatgcagtgcattctgggtagcatagacgcctaatagctctagtagagatgtcatactccccagagccggactatctcgcagctttacttaatttgttagcaagtagctgaaccagctatcttttttctttaagataatggacaaaaattcggtctatatatccacatagatatgcacatgaaactcttgtataatgcattaaatatttttgaaaataaacttgacatatagcttaaaacaagtgatctaacaaatgcagtggagaatatatatttcaaaccgtggagtaaataaaccatttcaacaatcccatgaat

SEQ ID NO: 16780 - DNA, 2222 bp, Oryza sativa
aaaataccattctcctgaaaaaaaaatccttctcccgagtaaaaaatatcattctcccgattggatgttgagcccggataaaaaatatccttctctaaaaaaacgatgttcaattatatccttctctagaaaaacctagtatggtaaatatccttctctaaaaaaaactttgagtgactagtatacttttgtggagcacatggtgctagtactagtatggcaaatatccttctctaaaaaaactttgagtgactagtatactttcgtgtagcacatggtgctggtgctagtatggcaaatatccttctctacaaattgagtgactagtatacttttgtggagcacatcatgctagtgctagtatggtaaatatccttctctagaaaaaaatgaattaaagtaaaggataaacaacgtaaaatctactaaaagtaccaaaaaaatggaatttcatcaacatctgaatttttgtatatatattatttattttattgttttgtatctagcaaaattgtagggtagaacgacataatagatcctggcttctccatttaattcggagaaaaggaggtatttttgttcatggaacattgatagagaaaaaagccgactatcggatttgaaccgatgaccctcgcattacaaatgcgatgctctaacctctgagctaagtgggcttacataacagaaatagtgtaacaaatagaaatatgtatagtataggaaatccgtaaatctaaaaaaaactttgagtgactagtacacttttgtggagcacatggtgctagtgctagtatggcaaatatccttctctaaaaaaaactttgagtgactaatatactttcgtggagcacatggtgctagtgctagtatggcaaatatccttctctaaaaatttagtgactagtatacttttgtggagcacatcatgctagtgctagtatggtgagtattcttctctagaaaaaaagatgttctcgattttgagtgactagtatacttttgtggagcacatggggctagtgctagtatggtagtactgtaaagacagcggtagttgttcaattaattgagtgactagtatacttttgtggagtacatggtgctcgtgccagtatggtagtattagagcaggtacaatagcaggctataagccagttgcaaatatattttaaggagttaaataaggagagagaagagcagcgggctacagaattgtagccacctgtagcacggactccaagacgcagtatgtgtatgacaggtgggaccagatattaatagtgtagtatgtaactattgtatgaataagctattagattggctatagatgaactggagctagctggtagctatactattgaacttgctcttataaagacaatggtagtcgttcagttattcaaagcgttgtcgtggtatcctcgctgaatatgactgttgtatggaccttgtcatgtaagccgcgagacttagcatgacttttgcacatatggctgttaggcgctcgtatggacctgcttgtgtacgactaagattcgatatctagtcatttggaactgcttctacatatgctacatgggttggtttgttctgactcactttgcaactttgctttggttgcccactggttatgaactcagggatttgattatttattgccgtgttcacttcaactccaaatgtgccagaaagacacaagttttatcatgttatgcatagctaagcgccaaatattatggcgtggaaactgcaacattcagcgccataacatttggcggggacatacagcactacaccaagccatacctacctggtcgactaagttaacccgttcagcgccaaataccttggagctgaccttagccacaacagagccgagtccgatggtgctgagctttgacacactggcaccatccacggtgtcacgacattcagcgccgttacatttggcgctgaacctccgggttatttttgaaataagttttgggcgcgattcatttacgaaataagtttttgcaaaggggtaaattgtcaaaaattttgcatggtgcagaggcctattcctcccgcgcgtaagaggctgttttacgtggatggatcatgcggtggttaaatcatgcgcgcggatggacggtaatgattggtccagatgatttggccggtaggattggagagggataactcctcttttttatattagtatagatatagatatagat

SEQ ID NO: 16781 - DNA, 4957 bp, Oryza sativa
gggggagattttgaactccagatcgttggggatttttatacaggggttagatccacccctttgtactcttggtatgcatttttttaataattttaaaccttttctttaattatgatagatctatgcataaaaatgcagaatcagcacccgttcatcctcaatcagaactctaatgaaccttaccaatgttatgcagcgcattctgggtggcacagactcctaatagctcttgcagcttcaagcagccgaaccagctatcccttttttcttacaaggatatgcacatcgagctcttgtataatacattaaatatttaaaaaatataaactttacatatagcttaaaacaagtgatctaacaaatgcagtggagaatatatatttcaatccgtggagtaaataatccatttcaacaatcccaccatgaataatatgaaaactaacagggtcttatatcttcttccttgaattccaaataacatagtactgctctttatagagagccaactaaacaactcgattctaatttcatggaatggaaacaaccaaaacaactggtagatagatagatagataagccgataatttcacccactctgttgcatcgcctattgttcgtgcgctcccttgttgggcttacgatgatagattgcaggtgatactgaacgaccataattacatgacgagtaagacacctgcaacaacaagttagtttttattaaatctaccattgaatatatttttattgtattttactttgctttgaaaatgttgttatttgatcaaacttgaataagtttgatttaggaaaaacccttcatcgatttgtagtgtgaaaaggagtacaaggtaaaaaaaaaagtctcaattgaatgattatttgtgttgtacagataaaaaaaccaggcaaatatctaaccatgcaaatatgcagaaatttggctagttggaaattaacttggagtgacccacgcatataagcattatttagagatgcacttgatactgcagtggtaagatgtgtgtggtttcaaccctgagatcacgtgttcaatccccaacatgctcgtaatttctcaatataacaattctcttacgtaacatagttgacacttgactgcaatggcataaaagaaatcatctcaatataacaattctcttacgtaacgatatagggggaggggaaaaaaggaatgtataactaggagtaagaagttgattgcacgctgatatgctaaagttcataaagagttttttgggttttttttaagataatgaataacctggcagctgcatcaaagacgtacataggctatcatgcattactgtacgccaagcaaagatagaaaaaaataacgttcataaagatacatcatattaaacgttgagtgggaggcttggtggacctagcattatataatggctagtgcatgaaaaaaaaggttgttgattaggggaagaaatcagctaagtacctgagttagttcatcacaatagtaattcgagcgctgcttgatttggatagtccttaagtgcctcttcaataacagccgtgttctcacccatgtaatcaatggttacatgccgaagggagtggaggttctccaaacctaaatcatttaagtcacccctccttagtctggtcccaatacgaagacaaagcctttcaaggtggggcatagctcctggttgaaacgacggcatcatgcagctataaaagtgaaaatcttttaaactccgaaatgcacatgcacctctgtggatagtgagcttttcctgcagttgttccgaaacaaatgctaactgtagcctgagaaagcgaagagatggaagctcagcgaggcgatcaaggtggtcagactggagatattcgaaacacagacaaatggataaggtggtgaggcgggagagcatcgacgaattgatccaacatgggaatgctttcatatacgaatggtgcatgaacaacctttggagaccgaaaggaacctgttgcatgtctatgatttcttcaaaactattattatttctcaaatctaggtcttgcaaattggtgaacctttgtatagacgtttgaatggattcctttaactcaaatgttttttcactactgaaaacgatcctaagagtccttagctccggcaaattagcaagctgttttattacctttcgggtagcttctattacaagctcctgtaaagatttcatatcccccagcatcagaccttgcgccagcttcacttcgccagcaaatagccgcaatagtttccttagtttgacaaaagacattggaaacactaccttatgagatttaaaagtaatatggtgttcttgatctagcacctcttatgtccagggtttcgagagattctagttttccaatgctttcagggagctcggtggcactatagcaccctagacgcataaatcttaggaggcgtagcttgccaagatcactaaaatggttcttgcccataccactgcagtcctcaatctgcaacacacgcaggacatgaaagctcgacaagggtggtatcgagtcgaccttgccgaagatagtgagtgaccttactttggacaattgttctcttgcttctggtgaggcataagatttgttgctgttatggagagagagtcggtgaatcttcttcttcttctgtgttgtacatgtacatttacctgcttgttgaccatctgataaatacgttgtaacaaaatcttcttccgctgacagctgatttattagctcaagcaccatgtcatgtactctgcactcatgtaccttaccatcttcgtattgaaagtaagtatccatcggctggatcaagcttcgattgatgagctcgctgaagtagctctctccaatctcctgcaagcttgtccctgcaagtcgtgtttcatctgtaataaaaccctctgctaaccaaccccatatcaaaacatcttttctaattagctcatcctcaggatatttgcttagagacaacaagcaagtcttcaaatgaaaaggtagatcgttgtaactgaggcttaatatcttccgcatgttgtccacatcaaggttgttctcaagccccaaactgatagacttattgaccttgtcccattcctctgaattccttggtttgctagcaagtaggcatgctgtagtgatgattgctagcggtacaccaccacatttcttcaaaattttctcagtgacaccacacaaatcagcaggacagtcatcgttagagtcaaatattcgtttgcagaacaattgtctggaatcatcatcagataagggtttcatttcataaacaccaccgcctgcatgttctgcaacgaccttgtttcgcgtggttacaattattttgctaccaagtttagcatcttgcacagcaagtttgatagtatcccacgctgattttttccatacatcatcaatcacgcacaagaacctaaagatggtagcatatacacatgttattgaacctagatataaatcatgtgaagcctgtccaaaaaagataggaatatgtatcttgcacattgaatgtcgaaaatgatgtgcagctttaaatgtgtaattttccaacaattttgacacaataagtgcagctttgtgaatttctattcacaaagttacaaagatacttaattatgcgtaaatagggcagatttctgaataactatgtgttccattggaaaaccaaaactttatttacaagccagttatattataatagtataaaaacttgagctaggattcccggttatattagaatacaataaaaacttgagccaggactcttatttgtacaacaaaaggtatcttcaaataatgataaaaggtaggtataacatagaaatgtaccttctattgttgaggaagtctctaattttgtcgatgagctgcttcgtttcccatgtttcatctatgtgggaatacattttctcatcaagttggagaagaatgttcttgagaatcttgtttatatcaggattcaaggacaccgaaacaaaacaatagctgtcaaattttgccttaagctcctgaaataatgaattggcaagagttgtctttcctaagcctccgaatccaacaatagaaattatatttgattgttggctggatgagccgtcatattccaagagttgcttagttagctcattttttggcttgctaatgccaatgagttttgttgcctttcggtacatagcttctaggcgagaatcaacatccacaacagttggcctggcagcgatgtcatcgactatgcacctgtcacgacgctcgctgaccttcttgacctggtccatgatgtctttgatgacaccgtggatctgatggttagttttgaacttgttgaacaaattggtgaccttcttgaagctcgtggcaggttcatgccccttgcactttaacatgaaggtgtcgatggcatgctcgatgtcgtaagatagctctcttaccttgctggcccagatcttgacctgctggtcaagttgatccacaagagtctcagccaccttgtggagtgctgcgttcatacctttcaactctttctcaagttcttcgatctctcccttgacacccttttgcagcttgtattcgccaaccagcagctccccaagcttggggaggagggtgttcattgcccctgtggcgatgttcatcttggcctatctgatgttgaatgcctgcacgggtacacacagatgcacttaaatgagcctcttgagtttatcagtatgtatcaggattcaggaatgatcaagcaaccgcacaaacatggagaaaaacgacatctgaataattaagctgctatgtagcatgtctaatcgagactagattgaggtaagaaccgtgtgcttgctgcatcacctaatcgatccaagcaaagctcatcaccgtgagcagcgcaagatagcgacctctcaacgctatacggtatactagtaacaggaaggaccaa

SEQ ID NO: 16782 - DNA, 5201 bp, Oryza sativa
ggttttttttttttggcccaaaaaagaattttgctggcggccgatttaacaatgccgccagtgataattcattttcgctggcggccatcttaagccaaccgccagcgaaaatgcatatttgctagcggctggcttaagacgaccgccggcgaaaatgaattatcgctggcggtcgataaccgctagcgaaaatattgatcttcactggcctttgctctgtgccggctctaaattccgtcagcaaaaacccaaaatggccgccacgaaagatggttttcgttgtggtgggaggaaggagacggggcgctccgcgtcggccgacgccacccgccgggaggcagacggaaacaatcatgtcataactttcgcagtaaatcaccattatacgataattcatttaccgacgaaaacgtcacttacaacgtagtagtaactcaattactgcattatgcgaatcacctcatccagaaacaacaacacatttaccacaaactcggtcaccataggtactaaacgagtaacccatttattagctatggcaaacaatttaactacccagtaaatcgattaccaaaagcctggctgtgacaaggtatccctattaacccacagaaattgatttacctccagcggagtatcttcaacaactaccccgaattcaaatatatctaatctatatagtaacgaacgagctgagggcaaccgaacacggattttgcggactctgggcgcaacgtgcggtgctcggaacaatattgcacgcgcaagcgctaccattaacataactcctttcagcccgatctaactcttttaccactcatccgatcaccaattcaccactaccccttctccgtacatcgatagaaaaattagtacaatttcatgtacaaataattggggtctgtcttgaaccccacgacttattgaacctagactaaaaatgatctttagtcacggttggtaacaccaaccgggactaaagatcaaaaagtacctctcaacttttaaatagggactaaagatgctttttagtcctggtttttattaaaaccgagattattgtgaaatttgaccgaccgaccaaagatggtttctccaccagtgtgtgcttttgacacatgtataaatgttctatatagatatttgcaaaaaaaaaatattgatatttcaaaattttaaagttcaaggaagttacaaagacttgaaaaatctgaatacatgaaaacctaatctaaaacaacattttatttgttagtggagagtaagtcatagtgcatttctgtttcgtaggtatgactgcaaccaaccgtccgaatgggattctgttgtataacatccccttttgaaatacatcaactccataccaagttcacataaaatactgatttttttaaaagaaaattcaaactttttaaattttatttttaaaggaagactatctcaaaagagacctaggatgtagaagatcataacatgagcgattcggcagattctcattttcaaactagaaccaggtttaggaataaaatttgggagagtatattaaaaactaaaagttactaaaaaggttttttaaaaaaatctaaaattccatcaaatttcagatgggccggattactcgtgggcccacatgtcagccacacgccacctcgcacgtgcgtcacgtgacgggctcctcggcccattacctcgcgtaccctcgcacccgtctcccgcagacagatccgcctcgattcttcgccgccgcgacgagctccctccatggcgccgccgcccgccgccgcgacctcctcgtcgtcctcctacaccgacacctcgggctcctcctcggactcgtcctcgtcctcggggagcgaccgacgccgacgccgcgcccgccaccgcagcggccaccggaaggatgccgcggcggcggcggcgtcctcgtcgtcggcgctgaaggcgcgcaaggaccggaggtcacgccacaagcggcgccggagggagcggcggcggtccccgtccgacgacgacagctacaggcgaggctctccccctcctcctcctcctcctcatccttcctttctaggtttcttgtgctagggttaggcccagatcgatctcgtgatctgtgaggtaggggatacggcgatgttggtggtggattacatccagatcaacggtttgacgggattcgatgggtggattagcatcggtgaatgaattttgctcgttagctcctctgatagttcatcttgacccatgattgacgctacatcaggagtggtattaaggggataacgaattagttgcacaaggacgtgaagaattttcggttgttttacaactaacaaaggatttatttgttcagtttggtttggtcgtgccttacttgagcaacgagagccctaaccgtgagaaaaattttaggatttcacttcaacttgatacttcatccgtttcataatgtaagactttctagcattgtccatattcatgtagatgctaatgaatctagacatatatgtgtgcctagattcattagcatatgtatgaatgtggacaatgctagaaagtcttacattatgaaatggagggagtagtaatgagcactgaatgctagctcgaatctacatggtttggagaatttctgtgatgtactttttcaatgtgtaacaatcgcaacagtagtaggacaaagcctcattccttcctagtttaatagtcagtgatcggttctatcagcagtaggacaaggatttcttagatatgatttgagctcactattgaagatgagtgttcgcatctccatttaaaattccttttcagtcagttaaatattctgtaagcctgagagggtggcaatccatggcatttaccggagctatgatgctttgttcttttgaattcaatttatctgtgattaggagctatcatggcatcaagtttaggcagctaaagcatagttcagaatctaggtaccagggaaattttgaaacaaaaaatgccatagtcttgcattacattgttacggcttgaatcattcaattggatgacattgatcggcatagcaacaagtttttccctagttttagccttcaagctgtcttggctttctctgctacactgaaaaaaatagagatattttgcttcttgcgaaacttgtattcctgtttgctttatgccaccactgttattttgaagtttctggtgctttttgtagtagctcaagctcttacgacagtgaacatgagggcaaatcatgcaagcacaagaagagcagatcatcaagaaggtactgccccatcaatgcattcatatttgatttctcatttagattttttctccatgcgtcgaatatgtggcctcattgtatttacttacctgacagtctagggagagggagcgaagcaaggataggcattctaaacgagacaagagcaaacataaagaggtaaaaatcctatttattcagaaaatacctttttcttggtttaacttttcagtgaattgaatctgtgttgcatgtaataatcactctctagaaatcagcaagtgttggttgcatacttgcgtttgattgctgttacagtgccatgctatatctattaatagaaatctacagggtcatgtcttatgaagtagatgtgtagacttaaaatatatgtggtttacatttaaatacaagaggtccttatatatcttgctgcctgtttctgggttggctctttgacattggagctgggattcgtgaacgggtgacaacatggtggattggcttgctggttggcttgttggttgattggttggttttgttctcttcaatgcgggagctctacacagaagaaagatagtgaacgtactagtggccctgtgcagctctccaaggtatattagatacttggctttacatttttcttttctatttgttttatttaacatatgaaacattctttattctgtaaatcagtttcttggacgtgacaaggatgaaggtgttcaaaggagtgcaatctctggtaaaaaggtgagaatagtctcttgacctcttcaatgtacaccttttgaattgtacaatagagggggggaggggggggtgcctgttgaaataaaaaatcttctgatcaaagtaaggttatgaaatatgaacaattttacagtatccaaactgttccatcggttgttaaattcaataaaacagaatgggctacctcgcatatgccccccctcataacaaattattttaggaaagcaaaagatttgatgcatttgcattgacagataatgatgaaacttgagaaatccaaggaagacaagcaggcagagagcaagcgcaatgaattgttgaagtttctgaatgcaagttatgattgacagtttgttggaagtgctgtcatttgctgccttttggatttgtcttgatactaccgcttagtccaccagtgctgttggttatatttacaagttttttgttccctgttattctagttatggcatgaccgtctgtgttcatgccagcacttagatagttgtcgcatcaccgttgtcactaaaaactattacatttgatcctgggctgataatgttttcaattttcatgttattactagcatatgcatttgagtgtttcccgatattttttactcaagtgtaaatttctccctttgctgtttctgtatggttaagctttttttcactagggattagctgctcgtttagctgtttactgataggaaagacttccaattggtcttctcacatgaaatcgcactcgtttagattcatgaaaattattagtcgttgaaattatggctgagtggtaaacacggtctatttgagttgttcaacgtatggctcgtatctctcgatgacctttttgcaacagggcaccttcaaatattgacaacttggcattgagggtgcggttgactacatcaaagtccagacttgtaggccttctggaatcataccaaacattgcaaagagcatataattccgcagaaaatttcagatcattttgaaaccttcgagtcgatcagttcaaccatatttttttaaaaaaaaaaatcgcaaagaaacgattatacgatcgcttgccattggtagtctggtagagaccctcatcacttgagtttgtgccgctgattatggctgacaatttcacttgcgtttcttcttgttcttttagggagggtgtttttttttttggggggggggggggg

SEQ ID NO: 16783 - DNA, 2569 bp, Oryza sativa
cggtgctaacaatttcttgtctgtttctggtaaataataaatatatttgtttgcactgaacaacacaggtgatgaacaattttagcaaagaattattttacatgctttgccactcttgtccagacttgtaggcaatagcctataagtactacctttgttaaaaaatataagagattttgaccatataattatgtgggtactacatagtttagctacatctagcatttgttagagtacatgatgaacaaactggccgtgattttcttttattttctttaaattctgtagccagaaaccatgtaataaatctccctgaaaaaagagatatcatcataatttagaaaaagaatatagtcacgggaaacgggatagtgtacaaactcatgtctgaatctacacaagaatttcattttcagtgctgaagaatgatggggtgcgtgtatgcgtgtggctaatcccagaaaagtacagaaacttattgtagggttattacagatttacatgaaaaatagctgcttttatcagatgatgataacatcagataaaatgggtagagcttatcaaaagaaaaatgtgttgactatggcagcaggcagctacaattgagcagccaggatctcattccatgtgtctggaacaccaggaaggcaccagtgcaagcaatcctggacccctactctacctctgatgctgtacctggatatatgcccttcatccctcagccgcgaaatcgcggtgatatgcaagagcttgattgcggtgcctctcaccgcttcctcggcttcggcatcgtcagaacgattccgaaacaccgaattccccttggataaagggtttttgttgtcacatgttcctccagtgttccactcaccattgaagaaatgcctgggtgacaatgacctgtagaagaccttagatgggggtaccttggaagctcatcatccagccacctgacaacattgtggatggtgaagttcttcgccttccagatgacggcgatatcccggtcatggctcggtgccccggagacgtacatttgccaccggttcgccttcatcttcccccggttccagtggtgcccggtgttcagaattatcacatgaaacctgtggaggttcttctgaagaaatgcaggagggcggtctaggtgcattgcatagccggttgcctgatcagacctcctgagaggctccagatcacagagcgttgctgaccagtagtagaggatggtggtgttggttcttcggaaccggtatgcccaacctttcggtctcttagcgtggcgcgcaacgacaaggctgtagcgtttaccgacatcttcgacatgcgagtgatcatccccacctgtgagcatgcacatcatggactggaacatctgcctccccaaggagtcacctacaaaagcaatggttttgtcctgcatcctgaggcatgttaggattagcatgacctgaaagacagagaaaaggatgcagaagaagaagaatgtgttgattaactgtttcttgcagaatgtagacttaccttttcaagaactgggaggcttggaattctggcatgtcacagccttcaggctgccatctgaatttctcataagcgaaatcctttcgttgtgtcaatctgcaagcccagctatcagagagccattttttgcagctgagaccagaatataatggtctgctgtcatcaggaacccatcttccattcctgtagtcacattctgctagacagatgaagaaagcatcagaagaaacagcattgcattagagctgcagaaacttctgactagtaaccggttttgctaggcaaatctgtgagttgagtaggatttaaaggaacattgtcctctttgagcaagtttataccaatttagtaaaaaaaattatcttatttacatttttaaggggatatttctataacagacattatattggatcataatcagagagatgttggccatgacctttcttctcaggaggtgatgcttcccttttaccagtgacgttttctgcttcatgaactacagactgaggtggagatgcagcagtagcttcccttcctacttcatctactaactgcactaatggatccaagctagaaaaaatttcttccttggagatatcatgatctatatacttggattgaactgaagaaatttacagaaaaatgtcagtgcaaagaacaacacatagaaaaaaactcaattagagaatggatatcagctgttgagcttgcaaaatgagaggacctggatggctcaaagccaatggctctgatcggaggagctcgccgcgatttcgcagcgatcccttctcccatttccatgtcaggagcaccacaaggagggcaagacagacaagcttgagctgcttgaacctcagaccattcagattcaccaatctcatccctttactgtgctctgaagcaaacccctgttctttttcaggactgaattgtgctcacaagacatcaactgcagataaaatagaggttctctgaattctgttggtcagccaatcaggcagctgcatcatacaagaagaatgtagacaataagtaaaaaaaggtg

SEQ ID NO: 16784 - DNA, 1119 bp, Oryza sativa
ttgataggttgtttgcttcttcccgggctcaaaattgaaaacgaggaagttcacaaccaaaacgcttgtatcctgacacaggacgatgaatcgaactgaattcgagacgaacacaccaagaaggcgagacggcagcaggacaagcagcagagcaaagaaaccaggcgagaagggagacagatactgaccaagaaccggagctcgccgtcgccgtcgccatcgccggcgagcaggacgaccacgaagctcacctcacctttttatttttttttactaaatcaccgggggtagagaatccctacctgaatatattattgagccaaatgatcttacacggggcaggcttcacctacgcaagcgcagaagctctagattatatgagaatagagtacacgtggaatacaaaagaggagagaccaaataaagaaaaacctcccaggagataactattgatgaccaagaagctcacctcaccttgatcctcctgccaaaagcccaaaggtttcggtgtgactgtggtggttgtagtgcggtgaggacggtggtggtggtggtgagatggagagagagaaggtgacgtgacgtggggtgcacgtacggtaacggtacggcaatgccaaagcttggatcactccggaaaagggattaaccgaggtggtggtggtgatgtgtacgaggaggaagaaggaggaggcgtcgcgtagaatggaatcgatagcaaaaatggagatcgagtattatcagagtggttggtggttaggcatgcacgtcaggatttcaagatagcgtcagagagtatcatctgtcgaatcatcaggcattcaaccattttaggctttgccgttcaccgcaccttggctgtatatccccacggtctctctcaactatacactatacgaggccggcagccaccgatggtccatcaattcttcacacactttattttcggatcagagatattgaactaatcagactgtaataccaattatagagtcataaatagtcttttcttaaaaaaaactaaacaatgaggtgagggctctcccacttatatattaggtctcttgcctttctacaactcaatatgggactatttcaacaagaaatactctatacatg

SEQ ID NO: 16785 - DNA, 598 bp, Oryza sativa
ccctagggccttaatccgagctaatctaatcttgtttgggcctaacgacatcatcggatacgagtgtggcgacatcgctgtgtcggagctgatgcttgccgggccgctgctgcacgtgtgccggctgagccgcttagctgcagctggttgccgctttgccacagacaaagccgtgccgggtgggctattgctcatagacctgctgtatctagccgtgcatggatgctaccggctgtgccgacaccctaaccctagctttgtgtatgcgatgagctgccgcctagccaaaccaaggagccctaatgccgccgtgtggcaaatgagtgccgcttaaacctagccggtgcttttaatcgagttgtgcaggcgtgggggcaaccctaggatctaccggctatagtagtgaccggggtgtaccatgaaagattataggcaccggttagccggagccgttgcagagtcgatcgctcgttcgttagaatgaggtgttccccgtgcttcgctcgttcggccggggtgagtcggcccttagtttagagccggcggttccgttcgacggtatttggagatcatttaggtgatcccgcgccacatagaa

SEQ ID NO: 16786 - DNA, 148 bp, Oryza sativa
attcataagcccttaccaggtttccacctcacgaccatcaacgtacctgctgataagccattttttggtttgggcatgtcagctccatcacagctgcagcagcagaagcaggcttgagaatgtttctacgtgctccagatttcagatg

SEQ ID NO: 16787 - DNA, 1040 bp, Oryza sativa
gttttctctaacttcgatgtagcagttatgttgcattcatttttgagctttgcatctagtacatttgcatatatccaaagctttttctgccctaatcaatataaaggtcgcggtataagatttttttcaagagtgatgaagtttttcatgaatttgcagtaactccgtacatctattcatgcttatttggagtctttggactaagctatgtttttatcgttgcacaatatgtcattcacttctcatagaaaatatagatttttattgaaatcttaggttagaaatgttttttttcatggatagattttatagtattagatagaggttttaaaagctgtgcttctgataccagatcagtcagatgacattataaaacattaatattgcttccaaccataaacatgtaaaattgtaaatctaatttccaagttttccttgttctttctggagaataactgtttatttacgaattttttagtacttatcatgcttcgaaactaccatttcatcatcattgactatatctcattcttttcttctgtcttaaggatctaactgtggtgtaaaacttatcactttgctgcgtaagttagtatatattatagagatatctaaaataaaatgtaaggaatattgtcttacagcatggtttgttattagtattcataacattctgttcacatgaatgcagttaattctcctggaaaacatcgagaatttggaggattggatactggtgatgatcaagcggcgctgctaaatccaggatttaaagcattgacccaaattgtccaggatgatgtgttcagagaatttgagtttagacaatacatatttgcttgccaggctaaagtataagacatgtcgtaaaaaaatgagtaactgaatgctattttttcctatgattttttttgtcaagtcagtaatattttttttcattcttacttcattgcaatctgttcttcattgctgtactgcttggttctttttttattaccagttacatgcccgtacgttgcaacgggatcattagatttttt

SEQ ID NO: 16788 - DNA, 2006 bp, Oryza sativa
ataggtgcttcgttttacgtgccggggaggacccctcctcccgaacacagcctaagtttaattgcttaaatctaatgtttctacttgttcctatttaatattgtaaattaagtacaaaaaaagtggaacagtagtgggaaatagtattatgcaagagttagtttgtaaaaaatctttaaaaaaagaacttaattttgtacttggtcaagaccagtttctgttgctatatttttaatcatttcacactagccgtgctttcatttttagttgtaaatcattttggaagttacctgtcttcacacaagtttctattgtttgatgatttatatacatttgtcataaaccatttatattttctgttaataagtaatgttgttgtttatttgtagtttcaaatcatttactagttacatccttatcttcacattagtttctattactgtattaagtaatttagtcctgatgaatcattttcggagttgcctaaccatgttgtcatgaattgatcccgtgtattcacggaatcaagttgaggggtgtatctccagggaatgacccacttgaaccacccaattatgtttagtgacctatagtgcaatttactcaatatttttaattcaaatggaaactgtgtctgttctttctcttctttcttttgtactcttaacaatatgtgttagtttttttattacaatgaatttcttgtgtgccatcaatcaagccctttttcgttgctttgtgaattacatttctctcagttttgtactgtacagaaaactgtttgtttatatgatactcttgatggatattgcagtttctgaggcttgcttatttgattggttatggagttgagatagaaaaaagtccagtcaacaggtactaatccagctcctctattagatatactaaattcaactttcctattggtcaattaccaattaataggttactttcctctctttttacatgtcactgaacagtgagacattgtatcttgattgtttcatgattcatcatcaatcttgcattcaaaatgatatgttttgttgtgtctgcagtgcatctttaagcatgctaccatggccaaagccagctacatggccttctattccaccggattcatcagcagaaacaatggcaaaggagaaggcaagcagttttcagcattactttttgacatttaatcttctagtgatgcttcatgtagactgctgttctcttgtattgagtcagtttgctcttgtcctgcttaattggcccataccacttcagcacttcctaagttataactctaatgaagccataacttataagaatgtgtatctttcgcacacattgaaaactttcacatgcattacaaatatgtaccagtcatttgttaatgtagaacaaatgaagaagaatgggaaaacaagttcccagattatatgacacagaacagtagtggcaatgatgattgaacagtgtaccataaagttgttgctgatattttcagtacttactgaaagatgcgatgggatggaatatgtaatttttagaaatgcttgtactgacctgtactttgctagtctttttgtttatcgtcacgcatgaacttatgtgtttattcatttcatatttgggaaactgtagcttaaagttatgaaatattttccttgtccagatgattctccaagcaaaatcaagagaaaagatcttcaatattcacaggaaaccactgccattagaaccttctttgcttcttcgtgaggttaataggcgtagggcttttctttctgttggaaatatatctgaatcatatgattcaggtgatgggtaaggactgtcgatttcctccattttcatgatgtaatctttcaagtgaaatttttcagcatatctgtgttaatgtattcttattaacacatatctatgttcttttttgtgtgggcaggtcaggactggatgcaaattcaaaaccttcgcccaacaaatatgcttcgaactacatggccaggccaatgtca

SEQ ID NO: 16789 - DNA, 3849 bp, Oryza sativa
acatcacactcgagtctctcagcttaagattgtcggcttcctctagtgcagatgaaggtcttaaggtacagctgagttgctattacattactgtttgcttattgtttatttccttgtgggatgttagttatagccttataccagtatggttgcaattagacttctgtttcaccgttttataacttccagtgctaatgctataacgcgtaaaaaggtccagatagtgcatttgttcttttcaatcacctaatgtttccatgtcatgcagacgataaagagttcagatgctcgagttcttgtacccggtagaaatatcatcaccttcgacattcctcctcaaaagcctggatcctatgtgttgggtgctctgacgggccagattggcaagctatcattcagatcgcatggattttctcaagatggtccagtggacactgatgaattcatgagctttgagaagccaacaaggcctgttttgaaggtgatgacattaacattaactggagtgtcacaaaaatttagtcactattaactcacaagacacaactaaaagatggatatcaactaacagaataaacatttttgtaattaacgaaccatattatattgggctttgcctcaagtgttttctgtaattactgcaggtgagaaaaccaagggctttagttgatattactcctgctgtgtcctctgcattgcttatgaatgaacttcagtggattgggttaattgtcaagccaatagactattctttgaaagatggcatattgcatatagatgcgggtgctggactgaaaattgaggagtcccagatgattgagatagaaacttatggaagtgatgtggagcatgttggtggtactgatgcttccaagacatcatcaagctccactgatactcgtaaggttgagaaggtccctattgaagatgggaagataaaaataccagactgggctagtgatgtgactactcttgtatggtttcctgttcgtgctattgatgatacaattgcaaggggtgcatcgccaggtttgtacaaaataaataagtaatgtattcagcatattagaatgttccaggcagttgattgaatattttattttctgtatgtttcaatcaattggttgacctttgtattgtcctttttttgtgcagcatcccctcagaaacagagcatagtagatgggatgagaatgattgctctcaagcttgaatttggagtttttcttaatcaagtgtttgaaaggtaaacttttttctgttcccatattttgattttttaggtacaccaaataaaataaattttttgaggggtccaaataaaataaatttaccattgtgattttatttccaggactatcgcagtacatttcactaacccattccatgtgagcacacgcgtagtagataagtgctatgatggaactctactactgcaggtacaactctctgcacaattgttcactgagacacttcatgtattgatagtcattcagtcttcttggattcttgaatcccaatttgtatttttcttggtgtccaggtgatattgcattctgaagtgaaggccactctgcatgtaaaggatatatggttggatctgcaatctggatttgaacacacaggaaagggagatggacgaccaacttcgaacttgttccctctggttattgctccttcttcgagagctggaatcttatttgtaatacgtttaagtgccttaggaggtgagaccttttaaatatcacacttatcatcttcagttgccacttgcaattcatctgttgcacttcctataaccaaaatatcagagcatccaaaaaatcttttagggacagacaagtggtattagcgtatttctaattgcatattaccatactataatcgctggctcttgctagcatgctgctggtgcacctaattctttcatgtgtttagatttgtgagacttcaagttcacaaacaggacactgcccatgtttcttgattacatcttccatatctcccttctatcttgcaaagagaaaatcagatgtaaaaaacatggcaattatatttgtgttcctatccaaaaaagaaaattatcattttcttatgagagggtcacacttttttgctgttatatatccttgctcttacacatggatgattgactgaatataacttttgcatcccacattccagatatggatgagctaaaaaggcagatagcatgttgaatattaagtatggaatatccggtgacagaacaactggagcacactctccagttcgtgttaaacctgatgattctgaggagcttgtattcaagattgcggtgaagatgaagcgccctgtcctggacccatgtgtggcagttgggttccttccgttttcttcggactgcttgagggttggccagctggtcaacatgagatggagggttgaaaggctgaagaacccggagcatgcctctctgttagccgtaagtctccatatgagccttgcttaaaatcacattcattaagtgtaccagtactttaatggttatgatcttgtgagtacattgcttcagtagacaggccccataggacaagagagatgaaattgttttctccttccaactgaactagaatttggttttggcaggacaaaatactttatcaagtcgacgccaccccacagacctggatggttggtgggaggaaatgcggtcacgtatcgctgtcaaacaaacaaggtaactaataatttcgagttcagacaccgaaactcgatatatcgatttccatcttgcaatgccaaattttcagttcgcctacaagcccttgtgaataacattgcgcgcatgttccacaacaaacaggttcaaggatagagatcacggtgacgtgcgtgccgctggtgtccggctacgtccatccgccgcagctgggcctgccgcacgtcggcgaggccaacatgctgcaacccggcaggccctcacctggtgtgcgtccttcctccgacactgagcacctcatactgcataccggcttgatccatccatcatacacagattgtatgttaggcttgtagcctgtagtagaagagaaatgccacttacactggtcggcttgagatgtatcgccatttgcaccggatgagatgtatgctgtttttgccgagacattcttttgtgcagatgagttctttttcgtcagtaacattcagaacgtgttccattgtttcatgtaccataagataagtaacataattctccgtgtatatcaaatcaagtgatagactggattttgaagtctaccagaattccggcacaagagttacttcgttctcgataattcattcctgtacgtgcagatctgtcattgcgagctggagtactatgtaggtcaaatggagattaccgttcttctgttaactttttttttcactgggaattatttctgttggtatgtcaattacaattactactgtttgttgtcacgtatgttcaagtatatatagagtaccttagcagtttcaatagatcgtcccttacattagataagggattatcgatttaagattcgggcttgcaatattctccatcacattagactacgcgtccgtccagatgtttttcattatagaaactgaacatcaaacaaaatcaaccccagtaccacaaaatcgaccaaaaattcaaatcgattttataaatcaaaatgtgccaggagacaggtaacattgacgcgggttagtaagcgccatgctgtttaattctggtccaaattcaatctatgcttctctctacaggatgaccaacccaatatcatcggccattcttccagtcgtgaagcaccaaaaaaaaaacaaaacatatctgcg

SEQ ID NO: 16790 - DNA, 741 bp, Oryza sativa
aggacgagctagcccgagcgacgggcggcttgaggcagagcttgcccagaaggccggtggttaagccggtggcggaccaggcagccggcgacggaggcgaaggccgaccaggtgctggcacggtcccattcgcgtggcagcctcatcacggacctcgcctattccccttcctccccacgcgcgaccgccgaagtggtggccccccgcccccatctcctcccatccttctcccttctttgtcgccacggcgaggacaatgctcgccgttgtggcactgacagccgccgcggtggtcgctgtcctggagtgcactgtcggcggtctccaccgagtgctagatacgggagcgcggtgggtggcagcactaaacgcgaagatgggagtggcaaactttgggagggcgtgtgctagagtggggggccccggagacgaagcataggccagacggcgtcgttgatggctcataggtgggagccggcccttccggccttctctgcctccgcctcactccaactctcgagatctagaggctgatgtgtgggtggtgcgacgaggacgatgaggaggaagaggaggaggagaggtggcgctccacctcccccgtggactgcaccggccgccccgctcttggttttttatgggatagaggaagtacttgttcgcagctcttttttaatcagaatttatcactccgttcgtagacctgtcgggttaacattgttcgcggctcttttttaattg

SEQ ID NO: 16791 - DNA, 691 bp, Oryza sativa
  unsure (1)..(691): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaaagtcctcatagtctctagagatcaactggttggtcaattcatcatcaagaccagacataaacttctcctgcttctcggcatcggtacgcacgtcctcaggggcgtagcgcgcgaggcggttgaactcatgcaaatactctataactgttctggttccttgttgcagggaacggaactctctcttcttttgtcccacaattccctcgggaacctgtgctttattggaactatgacgaaactctgtccaagtaaactctggcccagccggacgggtcaccatgtagttgtcccaacaaatagaagcgggaccttgtagctggtgtgtagcaaaagcaaccttttcttctcggtgcattgcaaaaga

SEQ ID NO: 16792 - DNA, 1654 bp, Oryza sativa
ttagaaggcgtagctaaccgagatgattaagatggttcttgtcaattccactgcagtcctcaagttgcacacacgcagtacatgaaagctcgacaagggtggtatcgagtcgaccttgccgaagatagtaatggaccttactttggacaattgttctcttgcttctggtgaggcatagacttattgctgttatggagagataatcggcgaatcttcttcttttgtgctgtacatgtatgtttacctgtttgttgaccatctgataaatacgttgtaacaaaatcttcttctactgacagctgatttattagctcaagcaccatgtcatgtactttgcattgatgcaccttaccatcatccaacagataatagacactcatcggctggatcaagcttcgattgatgagctcgctgaagtagctctctccaatctcctgcaagcttgtccctgcaggtcgtgtttcatctgtaataaaaccctctgcaaaccaatcccatatcaaaacatcttttctaattagctcatcctcaggatatttgcttagagacaacaagcaagtcttcaaatgaaaaggtagatcgttgtaactgaggcttaatatcttccgcatgttgtccacatcaaggttgttctccagccccaaactgatagacttattgaccttgtcccattcctctgaattccttggtttgctagcaagtaggcatgctgtagtgatgattgctagcggtacaccaccacatttcttcaaaattttctcagtgacaccacacaaatcagcaggacagtcatcgttagagtcaaatattcgtttgcagaacaattgtctggaatcatcatcagataagggtttcatttcataaacaccaccacctgcatgttcagcaacgaccatgtttcgtgtggttacaattatcttgctaccaagtttagcatcttgcacagcaagtttgatatcatcccacgctgatttttcccaaacatcatcaatcacgcacaagaacctaatgatggtagcatataaacatgttattgaacctagatataaatcatgtgaagcctatccaaaaaagacaggaatatgtatcttgcacattgaatatcgaaaatggtgttatcaaattattagcaaagtgattgcaagcaagattttctagaagttacaaagaaaagattacgctgtgatttaaaatatgaatgagaaaactaaatagtatgtttgtcaatcgacaatgcatggctatcaaacttctctaattcgaaccatagaattattatcttttgtctcataagagagaatctttgtttttaacttctaaactctcctataaaatagcttgacaagatctccatgtttcaatcttctgtctaaatatcgtgatttgttccagttactacatgttattaagtgattatgtcgtattttatatagggttgacaaatgaatctgaatgtgggaaatgctagaatgacttacattgtgaaacggaggaagtacaaatttacatgggcaatttttcagcaattttgacacaataactgcagctttgttaaattctattcacagtcacaaaaaaaacttaattatgcgtaaacagagcaaatttctgaataattgggtgttccattggacaaccaaaaccttatttacaa

SEQ ID NO: 16793 - DNA, 726 bp, Oryza sativa
atgctggcttgtgggctcttgcccgatatgcactaaaccttaaacaggtaatttttctccagagttttagattattcccttgaaagttctaaagaaacaacaataatcttataaggttgttcttctgcagcttactatatcatactgccaagtcactggccctgggcctgtgtcacctgttaagctccctgaggtgcctccaggatgttaagatggtacacctctcatgggtctctatagaagggttcgagatggcactgagagcggcttgcgggaggctgaagaaactgaagatgctgagtgggctgaagtctgtgctgtctcctgagctgctccagatgctgcaggcctgcggctgccgcatccgttgggtcaacaagcctcttgtctacaaggactaaacctgctctcatatcatcatctgtgcagtgttaatatcctcggatcatacaccatggagcccttaccaagtctagcatgcttacaagccatgttagatacccgcaataatcgtcaattttcatacccaagatgtactgacgatggtgtctctgcattgctgcagtgccatccttatgtttggcaactcctagaccaatgttgtcatcttcagattaaaatccaacatttgcaaacatgaggcatcgaaacagttatgttctgagcaagtgatccttgtaccagactgcaatgaaatgctctacactttcaattggtatatgcaaa

SEQ ID NO: 16794 - DNA, 26351 bp, Oryza sativa
  unsure (1)..(26351): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcagggaccatgtgagaggttatcaaggcatcagcaccctgattttgactctaacccaaccataaactaaccaatgctaccactttttaattactagtttgttggcgtgctgtcattagtgagttgatcagagttttgtgctttgtttgcttgctgagagagagattgacaggaaagaaaaagaaatatgtgggcggttgaggaagccaagacggatcgcacatagtcttgcaataaaaattgtgaactccacatggatgcgactggagaaaagagcttggtcggccggccatggagtctttcttctatggctgcctcctctcaatgtgtcctaagctttgctgctgcctgtgtttgttttctttgattagtctctttcttagagtaattagagtcttttatgaaagttgtcatggacgcatgtatcactcggacaggtagaactggttcaggaattgaagacaaagctaggaaatttaattaggaattgtttagttagggaaaaatttaggtttagtggttatatcggatatgcggaaacacatttaaagtattaaacgcagtttaataacaaaataaattacagattccgctctgaaaccgcaagacgaatttattaagcttaattaatttattattagcaaatatttactataacaccacattgtcaaatcatgatacaattagacttaaaagattcgtcttacaatttacacgcaatatgtataattggtttttttctacatttaatactttatgcatgtgtctaaatattcgatgtgatagcatgaaaatttttgttttgggaactaaacagggccttaagacaaagccagggtcgtgtaccttttgttcattattatgaaagtaccttttggaattggttgacccatggattcatttagtgtgaatcttagatcaattgaaaaatacatgtactctctctccaaaaataaatcgactcaaaataaattaatgatgtctatagaataaaattaatggttaaacacaactgtccacaagatcacaactcaaaataaattggccatgccaaactacaatgggcgccatgccttggtagtaacgtagccacatgcgtaaatatgggcaccattgtcagattattttctagagaacaacacagtaatacctccgtttcgaactactcgtcgttttgatttctttttaacgtttaaccatttatcttatttaaaagattataaaattattatttattttatttgtgacttgatttattatcaaaagtgcttcaaatatgactgtactgttttttaaataaaataaatggccaaacgtggtaagtaaaaggttaaaatgacatctaattaggacgtctggagtactaacatgcatatatgacctgagacatgccttagagatcaaggtgtacgtctctgtcagagttcataatgtgcgtggattggggaagggggcaaccataatctcaatcagggcaactaaccacgtcaaagacaccgtccgtacgctatgcccctgcttcctcttctttcagcatgtttttttattaattagggtacaaaatgtggaattagtattgcaaatcgccctccccatgtcttcgagaacaagatctatccacatcattttctcccttaaacacgtttggttaaaaaaattcttaaaaaaaaacaactgttttatcctagaaaaatgttgcttgtgatctgagagggacaacaggcaacagccatgtgtgtgactcccagggacacgtgtcaggatgtagagaaaccatgcccaggtgtcatgttaatgcaactctggcagtctgcatttctgcaacaccaagctagatctctccatttattaaaacaaactctaatgatttctttttgtttttattagcatttgtttaatgatcaggccaatggcagcctcagaaaaaaaggagaaaataattaactgtgaccacaatcaagattagccacataaacaaaatcattgatatggttggcccaagatgtccaagtcaaggattggatggagcagatcaaaagatagtagagaaaaataaaaagaaaaagaaatggtcggaggagcatgatctgcatcaatcaagtgtccttcgtgtgcttcttctctaggaggctctagaaagcagaaactaatcactaatcatttttctcatgtctcttaattaatctagaaaatttgacggtatttttccaagtctttttttctctcgtttccccttttcaatgagatgaaccccgtgcaccgccaattttaactgtcctggtgatgtttctacgtgacacgtcatggctgttaagtgggattacacctttgatttggctgaaattgcatgtgatgccatccaatatgttggaaaaaatgactcttttgccctgtctcaaggacgtacggtagcaggggagagttggcgccgttggcaccgtgaaacaaatcttgtgctgatttccatgtatgaccctgcctattctctcagtagcaatttcatatgggtacttatctaattcttttctcctgctataatcatgctgaataaacatgcaatattttaaattataaaaaatagcaacaatgctatttaaccagttctttttttaactctgaaatagtttaatgagaatgagagagcatgctggaattgtttgataagaaagagggccggacgcagagcgattgatgccataaatttatttcattttgagtatgttagaaatcttagtggtacgggtaatggtttataaatcatacctcaataatatgctttgttgacttactatgagattcatgaaggaaaagcaccccaaattaaacaattgatcttagattgcagtacatgtcatttttaaattaggagttttaaacaaaaaaaaatattgatacgattatccacgtcactttctctagtgctataaattattctgtcttgtccacgaaaaattacagtgaggcatcccatggaacggaggaacttagaacgaattgaactaatccgtaaaaagttcttttgtaaacttttacattctaaatattaaaggagcccacagcatacatagcttcatcaatatagccatagcttatgtgcgagagccataaaatttatagcatctctaatattcacatgcaaaaacccgtcaatactatacgtatgcagtgattttaccaaactcaagatatactttccctcatccacaattgataaacgcatagccagtttttttttaaaaaaaaataaaatccacaaataatcaacgccacacatttgcatgcggtatgcgcagatagtccaggtggattgaatatatgcctctcgcatgtagaacgtttgcacacggagaaaaatgatatgtttgctcagttaaatgcagagtcacacacactcaacgtgtcatgtggtcgtgacgtgaggcctcaggatataacaacacaagcatgtaacgaggcgtgtacgaggggattttctttgcatcttggtcagggtccaaatgcaatacgcttatcagttatgcatagaatgaagttccgggttagtgtcgatgtattcattcagataggatgtgcatatatatatttttagggatatgtccgcacgcgcatacgagtatatatgttactccatccgtctcattttaagtacaactacacccaactttaatcgtccatcttattagaaatttttttatgattagtatttctgttgttatgagatgataaatagaaaacctacaccacggcatcccatggagacgggatcccctcctcctacctcactcctctccccaaaatcatccgaatcctctcctcctacctcactctcctcccccaaatcacacagcactgcagccctccctctccctctcccctctctctaaagaatgccgagtggagacgaagccggccgggaggaaggggtcgtcgtcatcgtctccggcggccgaggaggacgacgacgacggcactgcgtcagcgaggtcggccaaccctcggcggggtcgcccttgagctcgcctcccctcgttgtgccgctctggctcaccgccctcgtcggtcaggtgtgcgccggggagtcgtcgccccagggagggcagaagcgggagcccccctcgtcctcgccctcggtctcagcgtcaccgttgtccccgctgcggcctgctgcttttgcgcctccgggatggacgccgacagcccgcgtcgacctacaacaggtatggccgtcaacctcctccttgagacttctcgcgctctttggctcgggcttcacccctcacctcgccgtgcctcctcgacgccatcttccgccgttgcggccctccctcctccacgtctcctcctctttttgacagtaccttctaataccccacaagtatcaggcttgataccttggtatcaaggtctgatacctaggtaccacccggtatcttgggtaccgagcatcaggtatcggtcgatacctaattggtatcaaaggtaccaggtaccaaccggtacaggtaccaggtactagaggagcacacatggacagagaaaaggaaaagggagagtcacttaaaatattccgctgcaacggtgggctagcagccctcgatgataaaacataaatattactttactcgtgacttatgtttttaatttttttaaaaaaaataaataagacggatggtcaaaattcggcgcgaaaaatcatggttgtacttaaaattggacggagggaatacatatttctatatcttttaaaaaataataaaaaagagagcacacacatcttctctagccctaaatatgccgaagaatattccatgtctcactctagtaagcgcgaaaacaatttcttcctccgcaaaccagaagcacaattaacgaaatggcaaaaccgtcaataaactgaaaccccgggccttgttatgaaccccccacgaaccttctccccgtccacgtccacccctcgccgtcgtcaaagcgcggcgattaacggcggcgcgcgacggcaattccacccgaatccgatgtataaaaccaccccgcggctcccccaaatcaccaagaagaacacccacctcagattagtcccaaagattattcgcgattaagcttgtttttttttgttcctaatcgcagatacaaagaattcgctttgcgtttgccactcgagaaagattttgttttttttttttggttaacggataattaagcgccgcccctcctcgtcgtcgtcgccgccgcatggaggccgtcggcgtggctccggcccccgcgggggtgccggagaagaagctgctcgaagtgaaggagtcccggaaggcggcgccggcggcgccgtcgacgtcgatggcggccaagtgggcgatgaagaagaagctcgtcggcggcgacgccgggtacgtgctcgaggacgtgccccacctcacggactacctgcccgagcttccggtgcgtgcaactgcccccatatgcctcttcttcttcgggtgtctcgcggttagctgagatgatttgagtcgaaaggttaaagttcttttgctttcttggggttctacacagttttatgtgagctttcgagcaaagatttggatttttttcccgctcttttggggatgtttttttggcctgtgtttggttcaggtcatcccaattccagtttgtggattgatttgagaaagtgatttagatttaactcttgatttacttggtccgataatgttttaagcaaatgttccgataaagtttgaagcgaagttaaatcgatctgtaaaaaatggattatgaaatttcaatttctgtgggcgatgcgcctactgattgagctgcagtatcgttttgaccccatttcttgaagcaactgctcacctgctactgttgctgatctgcagacttacccgaatcctctgcaagacaacccggcttattcagtcgtcaagtaagaattctcctcgtctcctgctctaaattaattccatttgatccatgagaattccattattccatagtccaaccacgcttggtacaaaaaggcttacctttcttcacaccacgtgtgctccttcttcttcttgcaggcaatacttcgtcaacactgacgacaccgtcacgcaaaaggtgaggcttcatctttccatgacgaaaagattactgtaattcggttacagggtgatcatagtttgactgagctaacttaattttgtggtgtttgctgcttgcttcagatcgttgttcataagaccagtgctaggggcacccatttccggcgagccgggccgcggcagcgggtgtacttccagtccgatgaggtcaacgcggccattgtcacctgcggtggcctctgccctggacttaacactgttatccgcgagcttgtgtgcggcttgtatgatatgtatggcgtcaccagcgtcgttggcatagaggtgattaacttgttcttattttgtcacggctttgtgtaacttagttctttgttgggatgctaaacatgttttgggagtagttgatatgtacattttaggatatcagaaatgccattactgcaaaaatcatctgagaacacaatactgaaagtgacacaagcattttagttggcacttggtggccaatgacatgatgctaatgctgtttgtgtgtaaatggtgctcctaatcagttgttgtgatcattctgtttttgttttattgacttgattctgatgtgcatgtttagggtggatacaagggtttctattctagaaacaccgtcgcactgacaccgaaatcggtgaatgacatccacaagagaggtgggactgttcttggaacctccagaggaggccatgacaccggcaaaatagttgacagtattaaggatcgcggtattaaccaggtgtatattattggaggtgatggtacccagaaaggtgcttccgtaatttatgaggtaactcacaggctgataatgatgtaaataaatgtttgtgggatgcccaatgctatctataacacaaacttgttgaaaatgatttcaggaagttcggaggcgaggcctcaaatgttctgtggttggtgtcccaaagaccatagataacgacattgcggtactttcttctttccagcacacttgagtttggattttcttcatgctaatcgctaagattgatgttgaattgtttgcacaggtgatcgacaagtcctttggttttgacactgcggtggaggaggctcagagggccatcaatgctgctcatgttgaggctgagagtgcagagaatggcattggtgttgtgaaactaatggggcgcaacagtggtatgtacctccccaatatgattatgatttatgaacttgcccccacatattctaccagaaagtactaaggagctttaaaatttactgctacagggttcatcgcaatgtatgctactctggctagtcgcgatgtggtatgttttaatcattctacttgttcattgcattgatcaatctagggtaaatgctgaattatatggttgatctacttttttacttcaggattgttgcttaatcccagagtctccattctatctagaaggaaaaggtggactccttgaattcatcgagaaacggctcaaggacaatggccatatggtcattgtagtggctgagggtgctgggcaagatctcattgcgaaaagcatgaattttgtggatactcaagatgcttctggaaataagctacttctggatgttggcctttggctctcccagaagatcaaggtcagatgtggtccaaaccttcatttccttttcatagtggggacaacaatgatctttgcttatgcctcattcaattttttttaaaaaatgctgataattctccaactacaataaatttgatcacatcaggtttcttttattgccaccaatgtaaaactaagccatcatcgaactagtactttgtcttcatatttgtcaatatcgtaaagcctggaagaaccaaagaaccatgatgtgccctgatctcattcagaatgctgaattacttccctttcttcatcatgcaggatcatttcaagaagaagcgcaacttccccatcactctcaagtacatcgacccgacatacatgatccgtgccgtcaggtcaaacgcatccgacaacgtctactgcaccctgctagctcacagcgccctccacggcgccatggcggggtacaccggcttcaccgtcgcgccggtcaacggcaggcacgcgtatatcccgttctacgtaagtccagaacactctttttcaatgatcaatctttagtgttcagttcagttcagttcttcacaccagacatcaaccatatcctgataatctggacactgaaactccggcgatttctacagagaatcacggagaagcagaacaaggtggtgatcacggacaggatgtgggcgagggtgctgtgctcgacgaaccagccatgcttcctgagccacgaggacgtcgagcacctcaagcacgacgacgacgagcaccacctgcacaacacgcagctcctcgaaggcgagagctcgccggtgaaggactcctccaagtgcaacgggacagcagcgccagtgtgagaaccaacgagaatatatatatatatatatatatatatatatatatatatatatataagcatgtaattgtagctttctttttgtcctttttttctgaaatgacattgtggggaagctactgtaatagaattaccgtgtaatatagcaaggctggtttcatcctcgaagcagaatggtaggtttggttttgttgggaaaatagtaagggtttcatgtcatcaattcatcatcctactagtaataagggttaattttgtagtatagtggatttggatcgtgaatctcgggcttgaacttaggatgccaattctcatcgaaaatgtacatagagcaaaccttatttcgcaaaacatttgtaccgataacggcatacaagtaacaaaaaaataatttgtatctgtgttgttcgatgttcaaatggcaatgcaaaaataaattacaatggaaaaccataaaatcagtttcaaaattaaaatttttgcagcgacttgtaagctgaaaggtatacaatgggatttacgcacctacccatgcgtcttgtgtagatgacagttatttgaagtagtacggcagttcagtcaagtgttttacagggaaagcatacagggttcctctacattgacaagatcaggttcacaatcccaatagaaaaccgatgaaatccagttaaattttgttaaaataaaataaaattcggttgatttttttaacttggcaaaaaagagagagtgaattgtgctttctacctattctggaaagtccagcaggatggaattgtaaaccctggacaagattcctacagggatgtgttccaagcagtaggaatcttctccagacttaaatccaaaaactaaagatcagatatcttgtagactaatcgagtgatgtccaataagaaatacgattagtacattaagtacagggcgttgcacagaaaacatatcacaaccccatgctgtgaacacacgctaaaacacatacgcgttaaacccacacacacagcttcaaatcttcatcgaggaaatctgaagcttgagcatacacgttgtcacgtaactacacaggcgcagctgggatcggaaacaacaggtagagtagtacggctactgcttttttcttgttttgccataacaacagtgatgaaaaagaatcaggtctctcctcgaattgaggagagtggaagagattgttctagcctctgtacacgccggagggatcagcgttttgaactatccaagggtgctcgaggagcttgtggaggggcagacgatgcgccgaattcttcacgagcatctgcagatcaaaatgctttcttgaggttcacactctggtggatgttctacttgtgtccaagtgacgatttacttgtcacagttttacagttatgtaaatcatcaggacaggagcatgcttcttacctgtgaaattaggtctttcgcagccggggacacgaatggtttcagtgggaacttcaagtcaactttcacaatcctgcatgtccacaagacatttcagagaacagtgcttgcaagaagtttcatggaacttattggtaattacaggtgagaacaaatggaattaattgtactctgtcgagcatggaggatagattgaacataatcacgagtgtttattaaagtagcagaaaaagataaacaattagcagagtatagctcagatatcagaaacgatagtgcagaatacaacctctaatgggcaagagacaatgagattcacaagggcatttgagatatgtctcaggctagttagtaaaaagtcactgcattctcactctgaaactcatcattacctgcgatatgtttcggagtgttcttttgcttcgaaaggtgggactccataaaggaactcatagcacaggatccccaagctccaaatgtcaacatggtagtcatgttcagtcttctccactggacaaattataaaaattttagagtcaaggaaattcatacatttactgatattttcaaggaaagtaaatggaaaggaaagtacccatttcagggggcaggtaatctaatgttccacacattgtccttcttctgttgaaggtgtgcacagaccaaccaaagtctgcaattttcagttcgccctgttcatgaaagaatgcagccatgtaattaccaaagaccatgtttcaacaagtaaacatcagagagctgtagtttcaaaattgagacagtcagacaaagaaacaaaataatgcaattacctgggacccaattaaaagattttcaggtttaatgtctctatggatcacatgctttccgtgaaggtagatgagcgcatgcgccagtgatgcaatgtactaaaagaacaggcaaatctcaattattacttttcgacaaaggtaacagaagaaaagtttatcaagcatgtgtgcagatcatctacttacagtcgctgaacgtctttcagagaaatgcttgcacctctgcaactccttataaagttcaccttttaaggcatactccaagatcaagtacacacgggtctgcagaatccatgtagcagaagatatgatgataaaactagaggagataaacaattacatcatatcagaactgtggtttttttttttctggacctgatcatagaaatacccatacagccgtagaatgttgggatgacgaagatgactctgaatctcaacttcccgacgtagctgatgctccacctgggactgctttagttggctcttgaaaagtactttcaaagccacaatatggttactctgtttcacagaaagaaaatagattaagttcactgaaagtggaataattagaatcaaaacaaacaggaacaagcattctgaagcatacagtacagttttaggttacaaacatttacaattgcaggagatatttaaaaaaagctttaaagatcaacatattaagcatgacccagaattccagttagaaccatatgaaagtgcactacttttttaaaaaaaaatatactacctccgttttttaatagatgacgctgatgactttttctcacatgtttgaccattcgtcttattcaaaaaatttacgcaattataatttattttgttatgagttgttttatcactcataatactttaagtgtgatttatatcttatatatttgcataattttttttaataagacaaatgtgagaaaaagtcaacggcgtcatctattaaaaaacggagggagtatatgatagcgcactacttaatgacataacttaaggctcgagagtatacaaaagatctatacaaaacttacaccatgcaatgcatgacacggtatcatgttttttcttcaagaaaattggatatctagaaattaaaatcaaaattagatagtttgtcttgttcttttagcaaattcattgtagcagacattaagcttcttagctgagatggagaaatagacgaattaaaaggccttcttgcttcctagtatacccaaaaggctccagcacaacagcaccatattattcaacaataacatgcacaatacccaaaaggctcatgtagatctaagatcggatagtgattatatgtcgtgaggtcaagcaattgtaactagtagtaactaagttagtgtactgagctcaagcaactgcaatacataaacctttcactcaagtaatgctcctgaatcaattagtagtaactaatagtaccaagaggaatggaaaatgtgtaacaatgaatataacaatcagctgtggctgaaatgacaacatgtgagaagaatcacttactctcttttctcttgctaagtaaacatggccgaacttgcccctcccgaggggcttcccgatgtcaaaatcagacaacacccaccgcttcacctcctgcgaatgcggcgaagcctagaacaaacgaccagaagagcatgtcatcatctcattccatacaaagcaggtgaatcagaagcagcctaaacatttcaacctcataataatatcctcaaggtcaatttaatttttagccaagcaaagcttcacataggaagccgaaacagccgcgaatccctgacaaaatcgcccaaatggactgaaattttagggccgtcctgtccaccagatccagagggaaaccatcaaatcaccaaatcctaccgtttcagcgcaccataaacccctcgacatgacggatcgaacacacgaaccctagccacatgactacgaggaagaaaaagcaagcagaaacgcgcgtattcgtgacccctgtcgcgtcaacaacctacaggacccagaaaaaaaatgggggaaagctgaatactagaccaaatccccgccgattcgtgcgaaaccgcaagaacacacgaccaccctaaccccatccaacacgccaaatccctccccaaaatcgcaagaatccaacacccgccggattccaccgcacgaagatccgagaaaggggaaggcggagaggggacggggacgcggggagcggacgcataccttctcctcctcgcagcgcgactcggtggcgatcgccatgggggaacaagagagagaggggaggggaggagcggccgcaacggcgacgaggcggagagattcgaatgggggatttgggggatttgggggaggaggccgcttttaagacgtgggtggatcgctcaacggtcgaatttctttcggcttcatggctggcagcgcgtgcggctcacgtgcgagccgacgagccgtttgtggtcacggtatgggcccccaggatgatactgggccgagagattgcgctcatggcatgggccaccaagatgacgtatctagtgggctgagacaaaaggtgggcctttatgggctctcgtttttggagagcttcgtgctcatgcgtgctgaacatgtcgaatttctgaggagagaaaaacatttcaaataaccctctttttttcattactctatgatgcatgagagaagagctaaaaacaattaagatgatatggcttcatgagagaagagcattaactatatttagtggggatgaaatttatagatatataggattcaaggacttttgtttgaaaagttcgtgggctgagattttttgtttgaaatacgattttattcttggggtatatattgggtgttaacccatctaacttcttgaagaaaccatttgtctcggacaaaccctcctgcagcaatagagggttgacatcaggatacaactatacaattaagattcttttagcacagtcaatcccttacgtacgtagcattccaattgtattcacttatcaacatcactcattcgatattttacctactttgacgatacaataattggctcaagccacccttacttaaaaacaaaacacaataaaatgtgagccgtctgaataacaaaatgtgtacactcatgatgcatcctccccgaaaatcagcacacacgcaatgatcgcacataaacaaaacccccaacttgtacgtataaattactcggtgccctaattgtatattgtacagtattatctactgtatctgtaatcaatatgcaggccaaaataaaaagaatattgcatggttatttaatttgcaggcgacaaaacatgcagacatgcattgcacaccactttattgtctcgccacaaaatgtcataaccaagtggattgcgatctaattaacaaatggctgatggcttatctcatcttggagcttggctaattaagtcagacggccaaagttcagagccgacttgtttcatcttcgcttcttctgattgctatggatcggacaagcacagatccttggagattttggagcgtttacatatgcgacttgatgaattaactttcaatttattatcatcttgtagacttgtacatacttgtgacgataaactagagtagattctcttcaaagataaattaagtttcagtgcatacaggaggtagcaattggctgaaaatgacatattcctttgcagttcatccccaccccccattttcattattagctgtgagcgagatgatcgaacacgtcaaaacaaaggtatttgtagacgtttagtacaccctacattgcagatttgcaactttagcataacgctggaactctgaatttttgaacctttaggtagacagtccatttcaagtagtacatattgaagttgcacggttgatatgatttgacccctatcaaatttacttaatctcctccccgtaaaaaaaaatacttaatctccatatgcgaggaacaaattaataagtaatctatcacactagagcttagcttgacgcgtaattacatatatttacataagtcgaagagtgagacctagtcatttgagaagtgacatttcgttttctcgtgctggaatattcagaaattcagcaacgagacagggggcaaagtgataaaacatcgctgtctacaattctaaggcctactctcttggctcttgcttaattaaacactgaagtaaagcagggcgtcttttccttatccgtgtctgtcaatagagcaaaaaagtggctttagtttgggtttatactccacatgacctgtctagctagccacttttttgctgttttgatgtttagggtgttgatgtgttggattggattaacaagttggacacaataagaaacagacagcattcagtcatggtagatattttgtcaagagaatttgttggtgcagcattgtcagtattttcttgtgtgtttagcttgtcaagttttttttttcagatggcagtagtcaattactcctacttcatgagtaatacaaatctagaatgataaaatgcatactacttccgtttcagattataagacgttttgactttggttaaagttaaacttttttaagtttgaccaagtttgtagaaaaaaaatagtaacatttttaacccaaaacaaatttattatgaaaatatattcaattattgatttgataaaaataatttagtattataaatattactatatttgtctataaaattagtcaaacttaaaacagattgattttaatcaaagttaaaacgtcttataacaggttagtacgtaacatatagaagtagctacacgctggcctacgcgcattcgaggagaataaaagatcgaagctgtacgtatacagttttcaaaaaaagctgtacgtataccgaaaaatcaaatatgactggggcaagaccatgtggacaggtcgatatttatatttatgaactttccacgctcctgtagatcgtttttcatccgattctctgtgatcttgcaaacacggtggaaacggtgctgactgactgactctaataagtctaacgattaacttaatttatgtgatctgagaaatctatccgcctatatatcttcccccataatcatatcgcctacaaatacttatgttttatgaatgacagataaatttatcatcttaaggaaggtataataccagattttctaatgctaattttgctgactctaataccttagatatctcttcagatactataatttttagcgtaaaattcttatattttcagatatttttttgaacatatataaaacctctcaataatcatacatacatctcgtatcaagtccatgtaatgtaacgaagataaaaggcggtgaaggtgaaaggcccagacaaggcgacgaacggcacgtacgtacgaacgtacacgtacgtaggggtagagtagtcgccgcgtttcacgaaagaaaccctgcctttatttgccaccaaggtgggtcccacgtacggtcccaagcagccaggtggtggatctgagccgaccatcgcatggtggacggtccagattgatccgacagggactgggttgcagcagagagctgaggccaacattgtggtcggaaacgattctctgacacgtcagaatcgggcatggttgcattgcaattccaattaactactgcaaatctgcgtattgcatggtaacgaaagaaattagtcacgactgatcagtgaataactcaaccagtccggtcattttccatctgattaatccctcttcctccacacgattctgcaatgcagacaaaccttcagaaccaaatactgtgttcagtcaccttttgctgctatatatcctccgttcttaagtgctgtgattagatccaaacttcagtcattttctatcacatcaacctgtcgtacacataacttttcagtcacatcatttccaatttcaatcaaaatctaaactttgcactgaactaaacacagactaggtaagcagaatcaaaggataacaaaagaaaaaaattcaccgcctgatacaaacaaaagtgtgatcaatcaggctaagctaagcatgtgagcttggaattaaatgtcgcctctccatcatcacaagcgtccctaaccatgtacccctatgtgtactccgctgctaccatgaaactacagtacaagtactgtccgattttgttcctcatgtgggccccggctgtctgccctgcccagcattacaatttataaaatcttatttttgtaagcttagcattacaagttttttttgttaattacaggctctgtttgtgaccgtgatttcatattgcccacattttttttaggggaattgatattggccacttgcagagcagcagggcacatcatggacgaaagcgaatctcgaggcggatcatggctcatcatcctcaggatcaccatcagctatcttctgttcttcccggcccatgcaaactctctgtgcaatttcacacgcaaacatgaaaaactacaagacgagaattaacacgaatccatgtgaagcagatttgttttttgagtctaaacgaacatgtagataccacatttgaagcacagcaaaatactagtagtagctttttgttcatagcaagtgatctaactttgcacctgatgaattttctcatgttcaagtacactacacgcttcttgtaattacgcgatgtttgatcgatcgaccaatctcgcaggaacacgcggagatgtggcatgtactgatcctaacactagtgtttgatctttgaaacgcacgagttcactacactagtgatgatgacaagctcggatcgagagggtagtagtagccgccgccgatgaagtggtcgtcctccgccgtggcggcgccggcgaggtcgtcggagctcatgcagaattccgggaacagcccgccgccgccgccgccaccgacgacgacgacgccggtgtccgccgaccagttggaccccgacgacgcggcggaggcggacgtcgagcccccgtccgtggcggcgccgtcggcgaagggatcccggagcgccgtggcggcggtggcggtcggcagcagctgctgcaggaagtcgtcgcaggtgtacgcctcggtcttgacggtcggtacggcgagcggcgggaggagcagcagcgacgacgacggcgacgtgtgcgtggcggcgaggggcggcggcgccgggagcggcagtaagggcgtgcagacggcggcggcggcgaggcggcgcttgagcttggtgttccagtggttcttgacgtcgttgtccgtcctcctctccagctgcgccgcgatggtcgaccacctggaaggaatcaatcagtcagttaccgccatggcaagaagagagagagggagagagagaggtttaattaacttacttgctgccgagcttggagtagagggaggtgatgatggcgtcctcctcgtcggtgaaggcgccatggcggatgtcggggcggaggtagttgagccaccgcagcctgcagctcttgccgcacctcctcaaccctacaaaacaaaaaagaagacaattcaattcaattcatcgtcagaaatcaagaagagtagtggccatatcatgcaggatgatgagaagacatggactgaccggccttgttggggagggagatccagttgccggcggtgccgtggcggttgatgtagtcgcgcagcgcgtcgtcctcctccggcgaccacgggcccctcttcaccgcctccctgtcgcagcacggcgtcctccccatcctccacacacaccaacacaacacctcctcgatctcctctggatgacaagggagggacaagaagacgcaagcaagaagtggaggctacttgtattgtattgtacccgcgccgtgtcctgtcctcttgctgtgtcctcgtctcgtcgtctgcaaggtcttataaaaaaaaaaaaaaaaaaagggggaaatcgcgcgctgggtgggagaaagagagaggaggaacacggtgaaaagtgtggaaaaggaggccgaggtgcagtgaccgagagggttcagcttcagcagcagaggctgcagtgcagagtggcgtttgtttcccgtttcgatctttgattctcgcctgcaggctgcagctgtgcaggcttccgtttttcttgttcagagtactacaaacagtactagtacagacgcaaggacgcgacaaagtactccagtactctattctctcaattggagtactgcgagtactccaatattttcgctgacaggcaatggtactactgaactgctagtgttatgagaatctactagtgctaatgacaggcaatggagtggagtatggttttgtttacatcagtggagtaggagtatctagttctacttctttgtatactactcctatacctgtattggtctgtgaacagtttgtagtaacaagaatgcaagaggtgtagttgcagccggcgtgaagaagaacaccttgcgtttaccccgacaagcatgcaggcgtagttgcagcgtttgcaggcaggcacattttttgccaccaattgatggacgatcaaactggccgacgtggtttcatcatatatcccgtttgctcttttcgcttattatacacacttctatctcaacccatctactcctcctgcatctttgcagtagcagtttacccaaaggcatatactctagtggttgtagtaagctgagtagcaacttaaggtcctgagtttaaatctttatctgaggggctaagttctttatttaaactaggaaggtggcccgcgcgtatacgcagacacttatattattgaaatataaaattattgtttgttcagaaattttgtctcatagatttaggacaaactaaagtttggataatgttattttataataatttaagggttctatttttcttaaggtatcttagaaaaccattcacgaacttttgagtaggagatggattaagtatttacaacttttgaatcatgtttttttttctcgagtaaataagaaactattggtagttaattatcatgcattccatctatatacatatcatgtagtatggccgcaaataaaaaatgcgagtgcaagatactcaaaatctttgattaaatcgtctcatgaatacgcatgatatagtaataaagggagttaagcatatgcatgggaaaaaaggaagaaagagaaaaatgaaaaaagggatgggaggcgtacgaacccgcgcacgtaggtacgcacctatgctgaggtgggaccctgtagtatttagtttattctaagatcaatttaatctaacggtttataatattggacctaccgatttaagtggaaagtaagtaatagatactttgattttttttcttataatttctaatatttgccctaatttattagagcaccacgtggtagcttgagagcattttaaggaattttaaatgactaattagaatattaactgcgcaatatatatgtatgggacatatggtagtatttagcttcgtccatgtttatatacatgtatagagaaattaattttgtggctagcaagccattagatgtctaattaatagaaattaattttgacacatatttacaattgttcagagtaactcttacatattcaatttacgacttcgatgatccgttgatcaccaatttactaatcaccatgacttgcatgaaaaaaaatgtagtaaggtttaggatagatgaaattgatgaattatataatttatgtgatagctatttgagggtataaacgaatgaattgctaaaaagttataatgttgtttaaagaagacaccatttagaaacttagaaagcatgcaaacaaaaatccaaaatatggaatcgggaaaaaaaacagagtgccttaaactccatttatcacccttgtcgtagtaagagttctatggatattcgtcaatattacgctcacatttataacataatgattcctttcacctgtacgaatagatagtacaaaatccaaatacgacataacacaaatacattacaattattatgtaatcaattcttggtttcaacttaaatagagctaattagtgttgagaaaaacataacccatggtacttaattattctctcgctacatcacacctttcattttcttttcatgttattaacaaaattaatcatctccatatatgatttaatatgtggcaaagcggtagcgctacatcggttgtgatcaccttagatgtctcagacactacgctttgtcacacgtgtgaaaggaaaaggtgcagacgtgcattgtgcagcgggcaaaaagagaatttcggacgctttattcattagcaaataatagatctgatgattataataatatgtccgtcagttctagtgtaagtataaattagttaatatatattttaaattgttattttaatgggtacacatggtgtgcatcttattttaaagggggctgctatataacggaatctcattttcgaacgggatgatcccgagtaggtattaggtgtgatacctatcaggtatcagacgattctacaaaacaggatgatcccgagtaggtatcaggtgtgatacctattaggtatcagacgattctatacacgttttaggtgatacctgcgaagtatcatgtgatacttatcaagtatcatgcgattttctaccacgtatcgcgtgatactcacgaggtatcatgtgaaacctgtcaggtatcagatgatttcaaccacgtatcgcgtgatactcgtgaggtatcatgcgatacctgtcatgtattagacgatttctaccatgtatcacgtgatacttgcgaggtatcggatgatacttaccaggtatcaggtgattcctactagatatagctgggcatcccgttagggtaggagcaccccgacacgcgcagtcgccccctgcagccgtcccttgtagacgaggatggcgacggcaagggcagaggacgggcgcggcgacggcggcggtagcgggggataggcgcggcggcggcggcgacggcggcggcgacgggggacggacgccgcggcggcgactgcggcggtgagggacaacgacagcagtggtgggggatgggcgcggcggcggcggcatcgacgggggacgggcgcggcaacagcgggggacgcgaatcgcgtttgtggagaggagctatcccgttgggggacggtatcccgtcccctagcattcccgtattttaaaatagtgcattacttgagaataatagaccaatgtaataaaaagtagatccgatgatttatataatggggccatcagtttaagtgcacgtataaattagttaatatagatattatttatttgataggtacacgatataattgtgtaaaatttattttaaaatagtgcattatttgaaaataatattacaaagtaaaccggtttaagttatatgatggtagattatttgtttgtaaaattataattgtttaaaaatatatccattatatatataaatggaaaaaaaagaagaaagaagaaaaaagaaaaaaaagctcgggggagaggaacgtacgtaccatctacgtacgtatatactccacctgccaatgcgcgggagaaggataggtgggacccatggtatttagtttgttttaagatcaattttacctaacagtgtataatattggacccaccaatttaagtaaaaatcaagggacatatgttttgcttttttcttagaatttataggattttctctattttattagagcgccacgtggcggtttgagagcgtttgtagaaagtttcatggacttttagtatataataggtagatagatagatggatgcatatgtccggttgaatgtacaagccgagtaaaaaatacccttctctaaaaaaataaaaaaaagtttggctcatgatgattagtattataccttgttattcccctttttttaaactattgttcttttacctggagtcctggaccatatcaagcacaaaagtgagtcatccatgcaagtaccgtacctgaaaacagaggcaacttttggcaagtcaccaaatttaaattttaattactctgtgttcccacccctcttttaaccccagatcttttgtaatgatcatgccgtacttcgcacacggtgctttaaaaagttttaaatcgagtactcatgtctttcgagagagatgctaatcagtaacctctagaccatgattactgaatcccatccatgcaagaaggggtttgcagaccatgattagacccataccaacgtgattcgttttggataagtctccctaaacattagtactaatcaccaattcaccgtcgtcgtgaatcgtgtgatcaccaaaagcaaatgtgatttgattttggtcatggcaggcaatgatctgtcgtttgcagagacgaagaaaaagaaaaggaggaacctagtgtgcccacacgaagaagcccgcggccagcaaacggacggcccagatgttgacacgtcggagggagcttcctccctcgaccgtatgatcgccggaggggtacgggtctcgtggtcgggcccgattggtgaaaggagacctccgttttgcgagtaattttttagcttgacatttgggccgtgttcacgtcagctttcgatccatctgcctggtggtgggcccacgaaattgccttgtcatttccgttctacttcatcccatggtcgatatgtattgaggacactgtcattagtctcgcattttttcaaagggagaaaaaaataactttatattagtcgtccatgactcatggtgtgggtatttaattacctggctggtgtgtgtaactcgtgttgaattgagtcctagatcaatggagaacgtcatcatttataatggaggcatttgcaaaattgccaccggttttttcaattttccaagaatgccacttgaataatagctctagtagcatttttgtaattttctagtagcagtcttgcaataacgatttaaagcagtggtaaaattacaattgcccctttataatgcgggtttaagctgcgcagaacataatcctggcaaattgtcaaaaacatggaacacaataatggcaagaaacacaacagttctactctgacacttgtactaaacagtttttcattttaggtactccctccgtttcacaatgtaagtcattctaacattttccacattcatattaatgctaatgaatttagacatatatatctatctagattcattaacatcaatatgaatatgaaaaatgctaaaatgacttacattgtgaaacggaggaagtacaaattaattttttttcagcgggaatattttgagagttcaaaccaatgtagaacaacgccaatgatggtggtgcatgtgcatctttcgtgtaactaaaaataaatataaaggaaatgagttgtattttcaagaataaagtcttctttccatcgagctcaaacagttgtgacattttgggtccctcgtctttccgtcgagtttaaattacatccctaaaccacaaagtcggaaatcttcacacttaacttgtaaaaaccgggttaaattatatcctatgacagtatgggtggctgtcttcgctgacgtggcatccatgtcggtgcccgcacgaggagtaggtggagtacggtggattcggcttggagaggcggcagatgacgtggttgaagagcgactaggcgacaggggtcggcgtgctagcgtgcgtgtggatgaggtgcgcgcgcatcgactgtagcgaccaacggggtggttggttggaggcgtgggatgccgccgtgctaggccgcgcatggggggtggtcgagggaattggaggcaggagagggagggggagacggccagcaagcccgtccaagctcgagctcgcccggcctccgtacgaggggggagggggatggcgtgattgagaagtagtcggacgacaggaggtgacgtgcacgtagacagtggatcatcggagcgcacctttccgacgcttcatggtgccctgtctacaaggaggagttcgagcttggggaccagatgccgtgcaagcacctataccactccggctggcccgtagctcttgcccccgttcacaaccacatgcaagtaccagctgccgtccttcaccgccgtcgagtccaacgccaacaaccaggctcgctgcaacaccacaccgctagctagcaacggcgacacggtaaaatggcccgaacagggagcagacaatcgtgaggtgtggggcctgttcttgtggttgtggccaccgcgagggctcgaagaccacgacgacgggtgcaaacattggcaatggtgactcagcaggctaacccagagagatgggcccggtcaacttgccatgtaagtgaaaataggggattatagtgccatgggactcaatgtgcgcaggtttgtgccccgggccggcacaagacaagccggaactccggaagctggtgagcccaacctgctcctgtttctgggcccagaaagtttgtcatgggcctggcctaacataaactgctttgcgatccaagcccaatacatggatgcaggccgtaacagagtaacgctgcccccgttctgcagttcaagtggggtcagtgtacaaaccagcgaagctggatttcttacattttagccattgtacacatgttttttacaaacaaaactctggaataaaaacttattctaaaaatacacatgttttttacgccttggttaaatttcttgaggtcaacgacactaatgttgatactctcatcttttatggtagctaagtcgacgaaacggctaatacgcgactagtcgcactcaccctcccgcgcgcgactggacacgtgtcgcgcgcggagaggaggcggcaacggcgcgcgtacggtccctttttttggcgtacgatttctttttttttctgttttttttctcttccgtacctttcccggttttcttttttttctttttgttcttctcgtatatttttctgtttttccttttttacacatacaaatacaaactttatatacacgtatataaattttgtatacacatatgtaaacttttatatacgtgtatacaaagtttgtatacgtgtattttttggtttttacacatacgtataccaactttgtatacacatatataaagtttgtatacacatatattttagattttttatatgtatacacacaaactttatatacaaatatatcttttatacattaaaagtgcatatatataaaaattatatatatgtacatatatatagaatatacatacgtgtgtgtatatatagtatgtatagtagtactccgtaggataagagatcagac

SEQ ID NO: 16795 - DNA, 3495 bp, Oryza sativa
ccccccccccctcctaagtcaagagcatatttggaattgaaatatttatattttaaccttctttgtaagaaaatctattttacaaatagatctcatcgctaatccctctgcatctcgtctgctacggtttagggcgacaagggtatgtcactagcatcgagaaatatgtttattcctaaataaatttgtctatataattatctatttgaaaaaaaacgttattaaaagggtcaagacataaaataagaaaagatctggatccaacaagcttctctgtcagggacaccgcaacagcacgttaaacacttcctatcaactacttttgtccctaaaaattaaatatagtactcgctcctcgctctgtttcattataatacctccgattctaaatatattatgccgttgacttttttaaatatatttgattgttcatcttattaaaaaaatttaaataattattaattcttttcctatcatttgatccattattaaatatacttatatatatacatatagttttatatatttcacaaaagttttttaataagatgaatggtcaaacatgtgctaaaaagtcaacggtgtcaaatatttagaaacgaagggagtaagacgttttgacttcggtcaaagtcaaactgttttaagtttgactaagtttgtagacaaatatagtaatatttataatactaaattagtttcatcaaatcaataatttaatatattttcataataaatttgtcttgggtagaaaatgttattatttttttataaacttagtcaaacttaatattgtttgattttaaccaaagtcaaaacgttttataacctgaaactgaaacggaagggagtataagatattgtataacatattactaggaatcagtatatgagatcacatattaatacatagggcctgtttagatactttggcaaaaatttttactctgtcacatcgaatatttggacacatgcatggactattaaatataaacgaaagactaactaattacacagattgtgtgtaaattgcgtgacgaatcttttaaacctaattacgccatgatttgataatgtgatgctacagtaaacatttattagtggcggattaattaagcttaatacatctcacggtttacatacgagttctgtaatttattttgtgtactttaaatatgtgtccgtatatccgatgtgacacgataaaactttacccctatggatctaaacacagcctataatttgtaatttgtgcagcatcagcattcatctctttgtcgtctgcaagtcagcttctcccagtttgcaataaaatcagcgagttccgagatctgagcgacagagcaaccccaaacaatgacacttctggctatcaggattcgcattcgggccatccatggacgacatttcccgcatgcagcagcgtcagcgtggcaattgtccgagctgccatggctccacgtggtgcgcatgtacacactgtgcttgcaaatcaacgaggtggactttggggcatttaatccggcacgttaccgtctgcctccgttgagatctccgacaccgacaccgtgtgactgaccacagattctgcaagccacacagactctcaggctgtgtttacttcacgctaaaattgaaagcttgttgattaaaattaaaacgatatgatagaaaagctagaagtttacgtgtgtgtagaaaagttagaaaagtttttgatgtgatagaaaagttgaaagttaaaaaaaaaagtaagaaactaaacacggtgtcagtgacaccagtgcaggtctgcgtttgtggcagtcgatgtaagctcccagtccgatgcacctcgaccaaaccacacgacgatcacggagacttcgccgtttctgctgaagatatcgaagagatattgctgtcaccgagtatagatgattggcagatgcacttctcttgatccagacgcgcatgcgcgggtcaacacaaggttccatagatgattgggagtgtgcttagggcacccacaatggttatctatatgctctctataagagatccatgtcagcatattttcctacttggaagagattaaatgaagagagagagcaaaactatctactaacctggagatagtctatagagaaaaacgaggtaatggattagagagctataaatacccatgtagacatactattgaggtggtttactattaatctagtctattgctgagatgtacatgttttatagagagcaccttactttaccattgcgggtgctcttagagcaagttaatcgtatagccaactactatatctctaaatgatctataggtaatataatagtcaattcatacaacagttgcttactacactattaatatctagtcccacctatcatatactctctccgtcctataatatagcaacctagtacgggatagacatttcatattacaacgaatctggacaagatggtgtttacattcattgtaaggctgtgtttacttttctgaaattggggagaagtttggggaaagttggtagtttaggaaaaaaattgggagtttatgtgtgtaggaaagttttggatgtgatgaaaagttgggagttggggggaagtttggtgtgaactaaacacatcttaatattaaacgtctcatccgatactagattgctatattataggacggagggagtacacattatgtcttagagtccgtgctgcaactggctacatatctgtatcccactgctcctctctattattttatctctttaaaatatgtttatagctgatttatagtctactattgtacatgctcttacaaagcaccctcttcgttcttaaataaacaaatataatatcaaatatagacatgctcttacaaagcaccctcttcgttctattatttaatttttttttataatttgtatttttattgttagtagatgataaaacaagaatagcactttattcataactttttaaaaaaaattataatttttcaaataaaacgaatgatcaaatgtaatgttgaacatagaaacccatgactatacttaacttttgacgaagagagtatagtattgcttgaggagtatatataaaactatagtatttcaaccttcggttcaatttaattagggaactgccatcatatttagtttattacttcctttaattataagtatttaatgtttagcgcaagatttatccatattgtattcaagcaactttataaaaactattatgtttattacattatggtattattttttgaagaaaatttatgtgtgacaactttttgttcttaaactaagcattttgagaaattatcgatactcaaagctttaagattttgactaaatcattttttctaaacattaaatatgattaaagagagtcaatatagcagatccgctgatattgttaagcccggacgacgaagagcatttgctaggcagatcaataatttttcacacgtatggccaatataatatcataatagca

SEQ ID NO: 16796 - DNA, 21092 bp, Oryza sativa
agtgctgcgtcttataatgagcagtgggcaaacgactagtaatagtctagtacatttttttctttttctttttttacgatgactatatgagaacatataccataatactacgagtacgtagataaaaatacaatctctcttttttttttagctttaaatatctccgcgctccgtctctagatatttggcgctagtgagtattacacttgttgttaaccgtatactcatatatcgctttcttgccataggggcacgtgagtgtttggcaacatatggattacttgtcgaaagtagctagtgctcagaatcccagagaatcgtcgatctgctactgctgccggtacacaagttgagaagtttgcggtcagcagttcctcctggagctcaagtacaagcaggaggagatcatggttctttgggtgcagtttcaggtgtgcagtactcctacagcgaaagggcatttgatttgatagatgagctagatagggagggtcagcaaaacaagggaaccagcgtgtctgttttggttggattcacgcgtttgctgaaatgaaaacttcgatccggacagaaatttgtccctatagctttcttcggattgtgaaaaatagttactctctctattaaggctttcctagaattggaaaaaagtttggggaaagtcaagagcttattcggttcacaggattttcaaatcacaggaataggaaaaacgtaggaataatgtaggaatgcacatgcaaaacaaaagattggaacacatgaatttttcctccaccgagctaaacaaaagtggatagattggatattttcattcctatggaattagtacattttgaaggattggcatagtgttcctatgaaaaatttttctttgaattttacaaaccgaatgcatgaatagtgcttattccaaaggaattgagatttcctttaggaatccttcaaaacgaataaggtcttagtagtttgaaattttttttgaaagtttatgtgtgtaggaaagttttggatgtgatctgatgcgatggaaagttgagagttggggagaagtttggtgtgaactaaacagggcctaaattggtaatttggactactgattgcttcatcagtttattagtcactaatctctttgggccacagtaatcacccacaaaccaggaagtatacagaacgagaccacggaacggaatgaaacctgaaaaaaagttggccatgccacagacgtacatacgttacggtcacacgctatcccagtatcccttcctcttatccatgccgttggagcggcacaccgcttcggccgcgcgcgatatctatcgccactcgccacgccgcgatcgcgagcgcactcacgccgccgcggcgccgctggtatgtacaccccctcccatctctccccgttgtattcgccacccgataaaatttctactctttttttctttctatcaccaccacctggtcattcatgtgtacataaaccgtactataatacgtaatacagattttacgggtatatacctacgggtacagcagcagaagctagcgtagatttgatcgatgtacgcaaaaaaggaaaaggtatctgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactctttcccatatataaggggggtccgggtgcctctaggggcatgtgttgattatccccaaatcatacaatcaataagatactcggcggattcatccccggacaggagtagggtattacttcttgaataagaaggcctgaacctgtataaatcctttgtctccaaacccattcacttctccagcttgatagccacccccttttattattgccgaaatctagtttcgacagttggcgcgccaggtaggggtccgtcaagcttttcgccgatcagtgcaatgggttctgtctccggcatcgacgacctcgtcttcccacccgggcagacgtttcggttcggcagcctcgacttcgtcaccaacaacttcggcaagatctctctccttgactcggagtcagaccagtcgggagagaaccggatttcagtcccgtttggactcccaaacgcggctgaaagttacttcaagaccgtctcaatcgagttggcttcaaaccactcgggcgggatcgcatcttctccaatgtcaccagatcaagatgatgaggcttacccaccgatcctgatgaagctccccgacgatttggcggccgtctccatcacgacagcgtctccatcccgtaggcctagacggaagtcggcttcaacaccgatttcgcctagcttcagggaagtcggcgttatcctccaaccactcggcacggtttcgacggatcagctggatggctactacagctctcccaccgtcgactcgcgtcccaccgacatcgtagagtacgacgagtttagttctcgctacaacgacgcggatctcgacgacttcgacggaagcctagatgacaaccacacccctctctacttcggcgtcttcatggccgataacgagacggaggagcaacgccaagcccgggaaaccgaagcacgtcgcgagactgagcgtcgccgactggaggaggagcgtcaagcacaagaacaagaacggctacggcgtgagcagcaggagcgtgagcgaaccgcgaaggaggctgaggaccgacggcagcgagccttggaagcaggccgccgagcacgtgatttcatcggccaacaagatgttgaagggacaccgattttccgcacccctcaacagaacgcggttgccgcgatcaccctcctcgacaccctcctcaaggaaaacgagctcaatcaatctgatcacgtcgtcaacaacttgaaccagacaaagaccatgattgcggcttcggtcccagttaactccgaaagcgtccgcacgccgactggcagccgactcccccacttccgatctcatgactaccgttatccaagcctcagcatcactggcgcaggatccaatcgcaggagcaggggtcacgacgagcggtccgttcactcgcctcccgaccatcatagggagcgccgagtggaacggcctcgctcaccacctcgtcgccgccccgtcgatcttcgcgacacaatcatacagcgccgagcagctcgaggccatcatcattcgtcggaccgccacgacgacgaccttgatggagtagcagccttcaccgacgacctgcgtcgagtggattggccagccggcttcaagccgactggaatagagaagtacgacggcaccaccaacccagaatcatggcttaccgtctacggtctcgcgatccgcgcagcaggaggagatagcaaggccatggcgaactatttaccagtaactttagcggattccacccgatcttggctccatggattgctccgtggtacgattggatcttgggccgaattacgcgaccacttcatcgccaacttacaaggcaccttcgagcgtcccggcacacaattcgacctctacaacgttgttcagaagtccggagaatcccttcgagattacatccggcgattttctgaacaacgtaacaagatctccgacatcaccgacgacgttatcatcgccgcattcaccaaagggattcgccacgaagaattggtcggcaagttcgggcgtaaacctcccaggacagtcaaacttatgtttgaaaaagccaacgagtacgccaaagccgaagacgccgtcaccgtatcaaagcagtcgggtcccagttggaagccaaaaaaggatacgccggctacgggaggaggtggaagtaacaatcataaggaccgcaagcgtaagcctgaggaacttgttgcaaccgccattcactcttctcgacagcgttcgcgcgtcaacacgttcgacaagatcatgaattcccaatgcccgcaccatcctaactccaaccacgtggccaaagattgtttcgtctacaagcaattcgcggagcaatacaccaagactacacggaagaactccgacgatgaacaaagcacgtcgaggaagaaggacgacggcgacaccccggtaggatttcaagaccaccgcaaagagctcaaccatatcttcggcggccccctagcttatgagtctaaaaggaagcaaaagttgaccgaacgggagatcaatgctgttcagcccgacacgccccaatatcttcgatggtcagagattgcaatcaagtttgaccgctcggatcatcctgaccgagtggtccacccggggcggtaccccctggtactagacccagtggtccgtaatgtcaagcttcgcagaaccctcatcgacggtggcagtgcactcaatatcctcttcgccaagaccttggatgatatgcagattcctcgctccgagctaaaaccaagcaatgcgccttttcacggagtaattccgggattatccgcaactccactcggccagatcaccctcccggtcacttttggcactcgggaaaacttccgcacagagaatatcagctttgaagtcgccgatttcgagacagcataccatgccatactcggacgcccggcgttagccaagttcatggccgtcccgcactacacttacatgatgatgaagatgcctggtccccgaggagtcctatccctacggagcgacatcaagcaagccgtcacatgcgacaaggagagttgcgacatggcccaaacccgcgagacggcgtctgcccgggaggatatccgactggctgcagccacggcaagcgaaggagaagtgcccgctaccaagacttcaaaaagtggagaaagcgaagccaagactaataagattcccctagatccttctaatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttgcatgtcaaagaagatgccaagcctatcaaacaacgactccgccgattcgcacaagacaggaaggacgcgatcaaggaggaattaaccaagctgttagcggcaggcttcatcaaagaagtccatcatcccgactggctggcaaacccggttctagttcggaagaaaacggggcaatggcgcatgtgtgttgattatattgacctcaacaagtcttgccctaaagatccttttgggttgcctcgcattgaccaggtaatcgactcgaccgccggctgtgagcttctcagttttttggattgctactcggggtatcatcagatccgactgcttgaagacctcattcatcacgccctttggagcatactgctatgtcaccatgccgttcggactaaaaaacgcaggagtaacttatcaacgtatgatccagagatgcttctcaacgcagatcggccgcaacgttgaagcctatgtggatgatgtagtcgtcaagaccaaacaaaaggatgatttaatctcggatctagaagaaaccttcgcgagcatccgcgctttcagcatgaaattaaaccctgaaaagtgcaccttcggagtaccgtcagggaagctgcttggttttatggtgtctcataggggtatccaagccaacccggagaaagttactgctatcctcaacatgaaaccgccaagtacccagaaagatgttcagaagctgactggatgcatggcggcgctcagccgatttgtttcaagacttggcgagcgggggatgcccttctttaagctactgaagaaaacagatgatttccaatggggacccgaagcacagaaggccttcgaagattttaagaaactcctcaccgagccaccggtcttagcctcatcacacccgcaggagccgttgttgctgtatgtatcagccacctcccaggttgtgagcacagtcttggtcgttgagcgtgaggaagaaggccatgtccagaaagtccagtgaccgatttactttgtcagcgaggtcctagccgactccaaaacgaggtaccctcaggttcagaagctattatatggtgttctaattactaccaggaagctatctcactactttcaaggtcactcggtaacggtggtcacatcatttccactcggtgatatactgcacaaccgcgaagcaaacggacggattgctaagtgggctttggagttgatgtctttggacatatcattcaagccccgaatttcaatcaagtcccaagcgttagctgattttgtcgccgaatggaccgagtgccaggaggatacccctgcggagaagatggagcactggaccatgcatttcgacggatcaaaaagactttcgggcactggagcaggagtggttctaatttccccaactggagaaagattaagctatgtgctttggatacatttttcggcgtcccacaacgtcgccgagtatgaggcgctccttcatggactgcgaattgcgatctccctagggataaagcgtctaatagttcgaggcgattcacagctggtcgtcaaccaagttatgaaggagtggtcctgccttgacgacaacatgatggcatatcgacaagaggtacgcaaattggaagacaagttcgatggactcgagctcagtcacgttcttcgacacaataatgaagccgccgacagacttgccaactttggatccaagcgcgaggtggcgccctccgatgttttcgtcgaacacctttatacgccgacagtacctcacaaagatactactcaagttgcgggcactcatgacgtagctatggttgaagtcgactggcgagagcccctcatacgattcttgacttctcaagaactcccccaagacaaagatgaagccgagcggatttcaagacgaagcaaactttatattatgcatgaagctgagctgtacaagaaaagcctttcagggattctgcaacgctgcgtatctttagaggaagggagacaattgctgaaagacatacattctgggatatgcggaaaccatgctgccgcacgcaccattgtcggcaaagcttaccggcagggttttttttggcctactgcagtgtccgacgccgacaaaattgtgcgcacgtgcgaaggttgccagttttttgccagacaaattcatctaccagctcaagagttgcagaccatcccactgtcttggccgtttgcggtttgggggctcgacatggttggcccgtttaaaaaggcagtcggcggttacacgcacctctttgtggccattgacaaattctccaagtggattgaagctaaaccggttgtcacaatcacagcagataacgctcgagacttcttcatcaacattgtgcatagatttggagtgcccaatcggatcatcactgataatggcagacaattcactggcggagtttttaaagacttttgtgaagactttggaattaagatttgctatgcctcagtggcacatcccatgagcaatggacaggtggagcgagccaatggcataatacttcaagggattaaagcgcgagtttttgaccggctaaaaccctatgccggcaaatgggtggaacagctaccatcagtactttggtctttgcgtactacacccagtcgggccacaggccagtcaccttttttccttgtctatggggcagaagcaatgttgccgagtgaagtcgaattcgagtctttgcgctttcgtaatttccgcgaagaacgctacgaggaggaccgagtggatgacttgcaccgactggaagaagtccgcgaagcagctttgattcagtcggctcgatacttacaagggttgcgacgttatcataatcgcaatgttcgatcccgtgcctttctagtcggcgacctcgttttgaggaaaattcaaactacacgagatcggcacaagttatctcctctatgggaagggccatttatcatctctgcagtcacccggccaggttcctatcgactcaagcgcgaagacggtacactcgtcgacaactcttggaacatcgaacatcttcgtcgtttctacgcttaagcttatcactgtacttccctatcttgactgtcaacatcaagttttcttcttgaagttgtcagtcgggggctatcatcataataacggagtgtgattttttatcaattcaatttgcttccttggtttatcattgccttgtttgattttttctacttagtctgcgaggactgaaagtttttaatagcttctttgggttttaggctcaacaaagcttgataaaagcttttaagaaatcaaagacttggctagaattatcaagcacagcataaatacaccagtattgtacaagttatgcctccatttgctacatttatgctcagtcagaatcagtcctttcatcatcagagttattactactcggctgaagatcggtgttgcggaattgatctacgacgtcacttgcaatcttgtcagccgcattttgagcattgctgataagatcaagagcagcctctacgcttgtcctgtctgcaaagccatcaatggcgtcaatttcaatcctcgggtacaaggatttggtcatcgccaatgccgtgctagctcccatacttccagctttcttgatattcttgaaatatacatccggagcaactctcagcttgtcgaagatttcggttgcgtcgagtacactcggaccactgttattgaggaacatagcttggacgagtggtatagcgacattagcgacttcatctcttgctccttcaagcctcttgatcttactaactaggacgtcaaattgagcttgagatttgattttgcggtctacaaaacacatttatgataaaaatctactgcattaaaaagagagaagttcagattgtcagctggcagtaccttcaacctccttcaaggccgagtccctttgcgcagccagttctaccttgtctctttccagggcttcaatttgtttctccatttgagccatcctggcggcttgcgctgtttgaaatccaaatggttgaggatacagttacgacagcgtaaattaatgggacagatctagagattaccttttgatgaaccactcagctcgaagtttgaatcctggagctgagcaattcggtcccttaattccttctctgtctttttggcgagctccttggcctcatgtagctggtccctaactgcttcaagagttcccaaatgaggaactagcttttctaaagttgcggtcttggcctcattgcgaagatggattctctgcatgatggttcatggtttagttttgctgaagagaaaacaaagtcatcaaaggcagtcacccggaagatttacattcacaatgcgagtggcttctccaagtgccttcttcagctggcacacttcctcatcttctttttgacgatttatgacgatgccggtagcttgtgagttctcgtcccaccatttgagcaagataggaggacgagagtcatcagccgcctttatgcgaggaatttcttcttcgtcatcgcctggtggtcctgatgtatttccaagatattagacgaataagctgaagttatttaaatcggcatcacttgagaagatgagttacttgaggatgttcctagctgagcgtggggtgatccttgttctttatctggagacccaatcaacgagtcgttaccagcctctggtccttgagaagttgtcgtctgcgcttcaacttcgggagtttcttgatctggacctacatccgactggtttccagtcgggggctcttgggttgttgtagtttcagttgctgccgactggttttcagtcggaggctggtcactcggattggccttatcacctgaagtatgggcgccagtcggctggctttcggcagtcggctcagaatccttggatgaacttggttctgtcacagtcggatcaggatcttttccagttggatctatgtcggatggtttcctgcaaagtgttctttcaatattcagtattatttccatgagagaagcatgtcgaagtgaaatggtaccgagagttttatacctggaagatgttctgatctttggccttggacgactagccagttttttcctgggagtggtatgctttgggagtttattgggcgagcctttgtccccagatttgttgccgtcgtcgccttcgtcgtcattaagcaccagctttctcttgcgagaacctgtctgcccagtcggattggaggtttgaggttgcggatctgatctgattgtcggccctccacctccctgaacggtgtgctggcgaggagaccggcgctgagtgattggggggtcagacttcatcaatacatattcctgagtgagatgcctccacggttagttaactcaacatgaagacaagattatgttttggtcatgggttgaagatttcagatacgtacctgcggaggcggattgaatgcgttatatggcacaactggcagctgatgtgaatagctgacgacaatggcatttgagaagattttatacattctctccttcatgattttaaaatccagagaatctggttcttcacgattaggatcatgcttaccgtcaaactcaaatgccatacgggatctttctttaattggtgccaatcggcatttgatgaagtgccgagtaatctgctctccttgtaagccttgttctttgagttttagcatgcgattcatcagctccaaggtttgggctgcttcatccccaatcggaagagagttccaggtatcttggtacgccggaggaagacaagagtactcgggaagagcaggctcaggattctgaatataaaaccagtttgcgtgccaccctttgtttgaggtcttgaagggcatagagaagtacttctggctcagagtccccctcagctgaaatccggcccctccgactacacatggcttactcttgtttggttggggcttgagaaagaagattcggcgaaacagagcgaagtggggcttaattcccaagaaggcttcacaaacatggatgaaattggcgatgtgaactatggaatttgggtttaggtgatgcaagctgattccatagaagcttaatatcccgcggaaaaattttgaggtcggaagagcgaagccgccatagaagaaatgggagaagaccacagtctcgtgtgtatcgggggtcggaaaagcctcaccgcacgctggccgccacccgatgatttccttggcagggagaacgccgtgcgccaccatctccttcaggttctcctccgtcacgtcggatggcgcccattggccttcaaagctttccttctcttccgccattgatttttttttcgaatgcgctgatttgattcgagggatggctagggagaggtgaaggattgaggcggtggatcacgggaaggattttgatgaacttttcgaaggtggattcgagtggaatggtgaaccctagtttgccggcgcagctctgtactgtagcagggagtggggaaaatggcgagagttccggcggggaagatgaagtgtcgcttggatctcgggatttcttgttaagggtatcggaggtacgaatgggtttaggcctgaacagtacctcagcccagtacttttaacagcgtggcccattgtgctccttagggacttaggcattttttgctttggcaatttatgcgcacaatagtgttgcccaatgctgataaaatcctttttacgcggtcatataattctttggaattattacaatgcaaattaaaaggtgcccgacagaaaggtgttatgctgtttttgtaagcttttttaggctacaaaagctgtctgggttaacttgggataacttgtttttaccatagtcatttcctcggtatgttatatgcctgttttcgttatggtaaatagtcatagcctaggctattagacttattcattaccataatttttataatatttggtgggtaatctttagagttttctattctgatgcctgtcaagtgtgttcattcgtgaaccttttagagtgttaaccactcggattccttttaattatggctaaaaagcagtcggctaagaatgcctctttaggcgccgtgtatgcttttgtcatatgatgcacgattgtgctattattttgttctcaactatatgtttagtttgttaactaatcacatagttgggaggtacacctaattaggtgcatctattcgatgcaccatattctttatcttttcgccctttacagtcttcgtcttcactactcggcaggccttggcatgaaaagtttgaagcattcggattattatctttgagaaggctatgatggttgactgcaaaggtctcgggggctactgtggagattatggatatcccatatctacacggcgatgatatttggactgaatataggataccgaatatagatagaatatcttatttgtatctcgggtttgtttctcaacttgtacatcaaggaaataccttgagacttagtcggttacgactgtattttatctgtatctgcatattccgttagggatatagattatcttttgtaacacggactccttcccatatataaggggggtccgggtgcctctaggggcatgtgttgattatccccaaatcatacaatcaataagatactcggcggattcatccccggacaggagtagggtattacttcttgaataagaaggcctgaacctatataaatcctttgtctccaaacccattcacttctccagcttgatagccaccccttttcttattgccgaaatctagtttcgacagtatctctctacttttgacttgttgcatgtgtgtgctgtgctgtgctgtggcagttactaatacggtcgccgtacagtgcacgtacgacgtcacgtgcatgcatgcaacttgtagtactactatgtactatacgacacgagtacgagtgctgtgtgtgcggtctgccttatccacaggatggggaggagatgaggctaaaatcgatcgatttggccggacccgcgcgtatctaccgcaagaaaatatattatcgcaccctcatacatggtggtaccacccaaaccaaaccagatattttacgcctaccccctaccgccatcaagtccttttttgcaaagcaatattttgcaagttgtgtatctattgatacatgtgtttatcggttatgaattttcatcagttgaatatgagatattcaatccggttttaatatatggtgtcattgatttttattatatcctttgattgttcttcctgctttaaaattataagtaatgcttaaagtttctatagtgacaaaaaaaaatatttactttaaatttctaaaataaaacgaataatcttaaaaagtcaatggtataatatattattaaaaagcacatatagtatattagataaagataaaaggttaacacgggaggcaatcagcagatcatatcgattgagagctacgaaagataacaatttggtgataaatacaacctctgttctgaaagataagtatttatatatatatatctattatattattaaaacagctttgaaaggaggcaccacgttcgctatgggggctagaaattcctacatttaatcagagaaaaaacaaaaaaatattaaaccgttagatcacaaactgactagattttaacggtgtagattaatttgaagaatatgaatatgaatagaaactactgctctaacttattcaattctaataggaaactgagaagtaattacaatattttcattgatgaggaatcggacatgcacgttgcatgcatatagtatgtgttggagccgaatagataattagaatacaaaactaattactaattacagaattccccgtccatctatgactgaataaaatatgataaatatattaagcaatgcaaagtgattggcaaaaatatattgacatgttctaaagattcaaacggagtaagcaatattaaaagaagagtccatataagaacacaatacgagattaatcaaaatcgaaataaaaataaaataaaaaccaaaattaaaaaaaaaagaagatcccaagtaggaatataatttaaaaataactaaaatttggaattacaaataaggaatattaaaagaagagtccatacaagaatccactacgagattaattaaaattcagaataaaaaataaaaaaaatcaaaattataaaaaagaatagaagagttcaaagtaggaatacaatttaaaattaactgaaattcggaattaaatataagcaatatcgaaataagagtacttataagaacccaatagtagataaattaaaatttagaataaagaataaaataaaaatccgaaattaggcaaattaaaaagagagttaaagtaggaatacaattttgaaacaactgaaattgaaaataaaaaataaaaaaaacagaagaacacaatacggaaaataaaataaattctgaaattagaaaaagaaaaataagatttcaactagaaatacaatttataaataactaatattggtgaaaaagaaaataaaactattgaaagaaaagacaatctaaaacacatgacgagattaattaagtaacatgccgatagaggagcagagtggtggcggttgatgagacttctaaaaactattaataaaacaccaaatagaatcctaatgacgattaaaaggaatgatgacagacagattgtgaagcaatcggtcaaggcggttggcaggaacttctagaaagtaaaaaaaataaaccccaatgataatcatatttgatttttgaaatctcaattagaataaaaatgagaggcaacgagcgggtcgtataggagtacaataacagagccgccaatggttggtgggtcttctcgaaattgaaaaataaatttcaataatagttatattcgatttttacaatcccaatgatactaaagagtacgcggcggacgggtcgtaaaggacggcagcgtttaaagggatttctaaaaattataaaaaacatgaacccaatgcgataataaactctaaaaactataaggtcaaatttttaatggttcgggcttctaaaaagtaaaaaaataaaccctaatgataatcatatttgattttaaaatctcaatgacaataaagaagagcggcaacagggagtcgtagaggagtacaatgacaaagtcgctaacgttttggcaaaacttctagaaggtagaaaaatgatcctaaacgataattatgttcgatttttaaaatagcaatgacaataaagagaagatgcagtggacggtcgtagaggagtataatgacaacatttgacaggatttctggaaattatacaaaaaaagcccaacaggacaataaactctaaaaactataagtcttaacatctaatttttaaaggtttctaagaatgaatagaaacggtgatagatcgagcaagctaataaagaataatatgatagaagtaaggggtagccactgatgtgacttttaaaaactataaaattagaaacacgggaatgataagttttggtctttcaaaatcttaagacaacgagataactatttaataatttttaagtaaaatcatattaaaaaatatataattttatatgggtgctagccgcgcaattgcgcgggccacccagctagttttgtgaaaaatagcaatgaatatactgtggaagaaagatgggcgtagcagttccgacctgccattgcgttttgcggagtcgtagtttaagcgctgatcgatttggatccagagctgtacatttccaccgctatacgttaatctctaattaactcgagcaaattagttgacgactgagttggagtcagatctaaacacaagcatgcgagaggagaaatattatcgaaaaatcagcccagttacagttacagctatgcatgcgcggaggaagaagatatttgtagccgcagttacgcaaattggggaaagatatttcttcaagttgatcaagttgcttcatcatccataaagccaattttcggtcgggtccgtaccttgtgcataataaacatagattagctgtgtttattactactcccttgcaacttttgtgtcgcaaggctctcaccacctgccactagtgccgtacgtcctgctgctagctttgccacgcataacaacaaactgaacattccgaacaaataattggactgaacattctgaacaatccataatcgccagcaaaattgggatggagatggcctaaatcgagctcacacacatacagtaaagagcgagtagggttgtgttcgaggagaaggagatagagaagattaggaacatatgcaaaacgaggtgagccattagcgcattgttaattaagtattagctattttaaactttaaaaatagattaatatgattttttaaagcaatttttctatagaaactttttgtaaaaagtacaccgtttaatactttgggaagcgcgtgcgcagacaaggaaacaaacaaactccctaccccagaacgaacgcagccacacgtcgatttccatgtacagtgacgatcgacgcgttggaacgcccgtgatatttgtcccgcaaatcaaaacctctcgttgtttttgcggtggaaaccaaagcaaggcctgatctagtttctaactttttctttaaactttcaactttttttattatattaaatttttttctacacacataaacttttaattttaattttaattaaacttataattttagtgtgaactaattaaacacactccaaaccaaaacagcgcatgctgctaggccgtactacgtgactggagcgttggtgatgattcgtgtcacgtggcggcgacgtgcggaggaaggcgatccatgcggctgtgtttgtgtggatggcaatggatggatggataacgtcgaggctagtccaaccctcgctttgagtaaggaagggggtccatgctgctggattggctctactcgcgtgtgtggactacagctgtactgctatactaggctctctccgcctctttttcttctcctagtttgtcggacatgaagcggcaactagtagtattattttcccagaaaatttttggcagcatatagtaatatcttcgtcaaattgatctgatcatttcccagaaaatcgtcttcttcttttatcctactacgtcaaatttgtcatcacgattacgagtataatacggagtataaagcaacacgaactgctttgtcagacaaacatatagggtccgtttgagggagtttttagtttctcgtcgaatcggaaactacccaaacaatgcattttttattctagattataagaaacggtgtagtatatgctcatagataactattatataaataagctactccctccgtcaaaaaaaagataaaccctggttttcgtgtccaacgtttgactgtccgtcttatttaaaaaaattatggaaaaaaataaaaagataagtcacgcataaagtattaatcatgttttatcatctaacaatgaaaatactaattataaaaaaatttcatataagacggacagtcaaacgttggcacgggaactcacggtttgtcctttttttgggacatagagagtattagattagctatatagatgaattggagctagtagttggctataaaacttgctctaagagcaggtacaatagcagactataagtcagctataaacatattttaagaagattaacagagagaagaacagctggctagctgtagtacggactctaagacacagtgtgtgtatgacatgtgagaccagttattaatagtgtagtatataactattgtatgaatgagctattagattggttatagatgaatttagagctagtagttgactatattattaaacttgctctaagtattcggtacagtatatatactgtagtccacgccatctttttttctacgggatactgtgtatggagcttgctggactgtgcgaggtcgtgacgtaaacaggaagggtcgaaaaggactagacatgcccatcaaaaaaagaaagtaaagtgaaagtgtacgagacgaaacggagcaacaagaagccaccaccaccacgcccgctgtctcgtgggaaccggacacacaagcacccgatattttctcccccaccccgaccccgactccgaccgatgcgttcgcgacccaacccaccaacccattcgtctcgagacggagtcgccgcgatccgatcgatccgggtcagattcgggtgccgccgccgccggcgtcatcgtcgtcttccccaactccggcgacgtgtacgggcgatgaacagtcgcactgcctgcaaaaggcaaagcggacgctacgctaccgggtagtagtacatgtacatactcgaataaagaggacgtgtctttttgtggccaagcagcggtgcggtggaagaagcagagagctgcagcatgtgcaggccaatcctgcaccatcgattccaccaaagatgacaacgactcgccggcgactccgccgccgtcgcactctccgccggtctctgtcacggcaggttccccggcaccatcgccccccgctcagctccacaaaacacatcgatttcgtcactaatgaacagagatattaagatgagtgttatttggatcaaggaagtaatgaaacatatagcaacataatattattggatcatttacttgaagcaggtgattacaatacattgaggggggcttcatcaccacatataggtagatgagtcagcaaaagattttcagatttaaagctaaggtacaaaatatgctgttgggggttcttaacaaaacaaagattacatcaacaaaataggaaatcaacaagagggggggcttgattgaaatcgatcgacgatcttcatcagctagtcgatgatgcaacaaacgatgaacagaggataaacccccagaaatcactgaaataggcagggccgccgccgcgacggcggccgaaatccggccatcttcttccgccatgatcttcttccttccgtgcttccttcacctccacacaccctatgcacacaggagacactgaatcacctccatttctactcctcttttttttttcacctaatttttttgtgggtaattttgctactacctcaaaaccccaaaacaaatccacccatctttccatacttgcctcctctccaccaaccatgaatattcacatgggagatagatatgtacaggaattagtagaaacttgacttgaaatcacaaaagaaaatgaaggatttttttgtcgtgccatcattttcttcttaccgccaccttctcctcctccatgccatcatccttgatgctcacaaaaggggcttccaatagcgacttggaagcctcagttgatgaggtcggacacccaatcaacgtcgaggccaacaccggcggtggcgaaggctgtggcgtcgccggagatggcaccatcccggctcagtcgctcgaacaccttctcccggagggctcttccggactccaccctctggaccggctcctcgtcgccgatgagcccgaggtccagtggctccaggttgggcatgaagctggaggcggtggtcaccgttgccgtggaagccagtggagtggtggggaggctgtagaggccggtggcggccttgggagacccgtagacggcggacgacgaagggtagctccacccgccggacggcgacgacttcaccttgttgaggcggagctggcggaacgaggccaggacgtcgttcaccggcgagccgacgccgggccaagatccgcgacggatggccgcggcaccgtcgggcgacaatggcggggactccgacgggggcgacttgggcggagacatgagggtgctggtcggggacgaggacatgatggtcttggtgaggtagctctcgaacgcctggcggcgcagcggcgagccgtcgtaggactcggccagcggcgaggacgccacgctcctggggctggactgctgcgccgggaggacgcggagctggtccggggtgtgggcgaagaagcagacgcggcggcggcaggcggtgccgtccttgcacggctgggtgcggtagcgcgccgggtggagccaacactcaaacacgccgtgggcgtactcgcaggcgtcgccgcgcttgcacccgcccttgcggaagtccgggcacgcggtgccggagtagtggtacttgcgcggatcgcggcggcgcgccttctcccccgggtgcgcgaaggggcactcggtccagtcatggctccgcccgcgcgcgcaccgccgcaccttgaactcgtacatccggaactcgtcgcacgcgtacgcgtccaccgccgcggccatcgccgcggcctcctcctcctcgtcagcccccaccccgacatcattcgccggcaggtaatcccgcagcgcggcgatcacgtacggcgtcatctcatccccaccgccaccaccgccgccgagtacatcgactccgctcacggggaggtgagaccacggcgggacgctgctgactccttcccccatcatcatcatggccaccgccggcggcaacacgacctccgatcaaccggtgtatggactacggcgagatctcgtggactcggcgtatggacgagtaagagagagtggtgcgatgtgtaaggcgaggaggacgaagccgaagcggtgcgcgcttataaactgctccactaaccacggtctcccacctcgggatagagtcgaaccatggttgcgttaaaccccaaccacggttccgccgtgggcggaggggtcgtagtagtaccacgcatccggtaactgacgccgtctctcgctccccacatcccggtgggcgcagcgccacgtctcactgacagcacgggccccacgcgtagtcgggcccacttccagcgagacgggggcgtcaagcaggaggtggggacacgtgccggtgaggggaggagggtggcaggcatgcggggggcgaggtggagcgagagggcagcgggggtaggacacgtcgcgcggtggggggtaggggtgccctacggattt

SEQ ID NO: 16797 - DNA, 6024 bp, Oryza sativa
ctctgtttggacgcatgcgtgtgggccagcggggccgcggattggccgatggttcaccggagatgggtggttttcccatacgtggatcactgtcgccggagatgggtggttttcccgtacgtggatcactgtcccgttgatcgttctttgtttcgcgatatcgcactttgtgattttgcattatcggtttccctttttcctttttttcgggtacctttctacggtaactcattgaatcgagtgattatttgatcatgttagtaatactccgtattttaatgtacgacgccgttgactttttaataaacgtttgacctcgtcttatttaaaaaatttatgtcattatcatttattttattgtgacttgatttatcatcaaatgttctttaatcatgacataagtattttatgaataagacgaatggtcaaacgttgattaaaaaatcaacggcgtcatacattaaaaaaatacagatggagtactaaaaaaataattttatagattaaaaaacactatcgatcgttaaacttgaaccaaactacatcatctgtctttcaaaaaaaccaacttctgatctagacatatactccctccttccctaaatgtttgacgccgttgacttttttaaacatgtttgacaattcgtctcattcaaaaacttttgtgaaatatgtaaaattatatgtatacatacaagtatatttaacaatgaatcaaatgatagaaaaagaattgataattacttaaattttttaaataagacgaacgatcaaacatgttttaaaaagtcaatggcgtcgagcatttaggaatggagggagtaatatgcctatattggtaattagaatttaactttactttttttaaggacatgaggagtatcaattagacaataatcttataaatcatgaaattaaatccgaactcatggttacaaatgttgttttggttgctccggaacattgatatggctctcaacgtaggccgaaactttacttccagacttctctataagcccctgcaatcgaaaattgaaatttgtagatatccattcttcgacccgagctcccccaccttgattccctcgtgcagtcgataaggaggatgatgataccgtggtgctttggacggtgcaattagttctaccatagattctacacccatgaccaatagcacatcgcaccaaaagcatctcgacatgctgatattctttgatcatcgcgtagacaacatgagggcttcgatgccctaggcaattacgattacatattgacatatgcaatttacaagattgagggtataaaactaacacatatacaaattcaaatactgttgaggtttatctgacagagtttcggctcctaaatttgaccaggagtgaagttcgaaggaatctgaatgctgttttgcttccctagttaatttgtgggaatatttcatctcacttcatttccttttgatagagataaaaccgtttgatcgagttccaatttgagaaaaagataggttacactttttcccattactgagatatttaactactctctgtcccaaaataaatatatctatgctatctactattaatcttaaaataaatttattttagaaaaaacgcttgtatcggagtttgtaaaaatatattaaaaaagttgtattggaagtagataaatgataaataattgtattatgatttggtaaagtaaggtttttctagttttaaatttttcatatttatatttttatatggatgtggagcatgggatgaatgaaaaatgagtttatcttaaaatgaagacaaatgagtttattttcaagtaaatgcatgagcagtagtcgaaagatacggccccatcgtttcgtttattcgtgtaataagccaaataccatatttttaaccgaagagtaactgtgaataaaatttttatatacgtgctcttagcgatctaaaagcaaatattaaaaaatgaatttcgataaaaaaaccctaaaatcagctctaaatttaaagttaaaaatttaaaatttaactctttaagaataaggagaagcatagatgcccctcagattttagcgaggtgtcatacaatcgtacggcaattcagccagcggatgctagcgacaaaccacgatggacctccacccggcgggcgactcgcatggctctccgccacgtttgctgggtggccataccgcaccgcacacgcagtcacgcgccctgcgcatgcacacgccacgctggctcttcgctcgggccaccgccggctgcggctcgcaaggcgacgaccagaagaaaacgccggagatcgaagtggtcggccccacctgtaggcctgaaacaaaaacacccgtttttctcctttggaagaaagatagtagtagcagtagtattgcacattgccgtactatgggctcttctcttttttttttctcggggaagaaaatccaagaaaatctctctggtctacggacaaattcatccaaaaggattttcatttttttctctggacgtctctttccttaactctagcgttacactcctactggtcgtagcgtatggccaccctactacctctcgatctttctcccgatcttctctttggcagatcgaaaaactcttaaccgcgcaagctggatgtgatgtcacgtacgcgaccgatccagccgtacgtgacagtcacaaatcacagaaacgagagagcgaccgagtgaggcgacggatccgttcccttgccgtcccggctcctcccggccgctggtctcgccgtcacgcgtcgcgacaaacacaaacacacacacacggttcgatccccacgcgagcgagccacgtatagtgctccgttgtttcaattcggcgcgatccaggcgtgacggtttctttaattaaaaatttctgctcttggacgaaacggacgctgcagaaataacgcagcgggtcgcaattaatcggggcgtgaggtcagccaaagtggacgtgcaaccgcgcgggggccaaaatggcacgtatctggcccggaaatgggagacaccgctcgcacacgcctccaaattttggtaacggccaagcggatgcccatagcgcagcgcgcagtactactgattgcgtgcaccgatggcgacgttgcacagcgagagcggccaaattaacacagctgcaagataaagattttttttttcgcggggaaataaacgatcacggtgagattattatgctgaaaatctttactcctactttattgtgctatatttgttgctgtaaatggaacgggggtgggaggctgagattatggaggggcactgttacacgtgtacgctatcttatcctgattcacagtgataacgtacggcgtgcgattgagatctgggaggagagacgagggaaaaggagggtggaataatagcagcagcggatgggaaggaatcgtggtttgggtggagagggtgggaggtggtacgacggagctccacgcggcgtccgggggctttggctaatcacgagatggggcgcgcgcgcgtacggctcgcgtaccgccggccggggcgggggcccccgacgcccacgccgacgccgcgcgctgcgcatcatcactgcgtctacagcgccgcccggtccacatcgatcgatccgatggctaaaaaagtccaactcactccgtgtctccgtcgaataaaatttaaatataatttcattctatttttttctcataaatattcaggatgcaaacttttttttttacaataatataccgtcggtttgtgcggaaatggcgtagaatgacatcgcggtcggcatcgcgcggtgaaaatgctagactgcgcggactcgcacagcaacatcgcgagaccgcacggtcccacgggatgtaaaagcgaagccgaacggtctcggtcaagcaattagcgataccggtgccatgccgatttaattagttattaattaaatgctaattaggataattaatcactaattattattattatttaattgttaatgaagtaattaaccacaaatcaaatggaaaccgttggataatgtcgttgtttgatttggtgagaccgatggtctcgctcttccattcagcgagaccgcgcggtctcgcacttttactgcgcgataccgcccacgacatcacgtgtatgttattttcgcgcaacggttgtgcaagatcgatggtatattttcgtaaaaattttgcatcccgaatattcattttaaaaaattgagtgaacaatatattttcaaatttaattctatctccacctcatttaaaattgatttttttcaacatttgaccgccgttatattaaaaaaaattataaagaagtaaaacaaataaatcatcgtataaagtactaactataaaaaattaaaataaaatggacgatcaaacattagacataacaagatagaataaagagctcctactcacttccttcccaaatatatataaagttttggttaaataaaacacattataatactacgaatttagataaaaggtttattcagattcatactattaagatatatttcatcaatctaaaacttcttatattttaaagacggggaaatagtatatttgtggcagctacactagtcgacatggtcgtacgtgctgccatctttgtcactgcacagtagcacagcggctgtagtagcgccgcgccatctttgcccattccatgcgtgcttgacccgatcgatcgagcgcgaggccattcaacaggctaggcgagatatcagacgaatcaatgctttcaatgggcacatcgtgctagctgctgccataagccgggccgttcaagataagtgtgggtcgctggggagcagcacgcatgcatggccatcacgcacgctaagacaccacaccatgcttgatgaacgagcttgcttgcttgtcgatgggtctctccaccctctcccggtgtggcgcgccatctcgcacgcgcgagtcacgtgacaatgtgacatgaagaaccctggcgttcctgtaggccgctagaggatttgtccaaagctgctgcctttggcttttccaagcggtctcgagaatggccaacagcacaagcaagagcaagggatgatgcacatagcctttgctttttgcttggtttgggttgggttgggttggatggctttgctccctgcctaggttgttccctcattccctacctagtgtgcacccatcattgcagcacatctgtggctctgatctctcctccatctcctttgcatctatccccctccccctgctctatctttaactgcacaaatgcagatcctcttgcatgcctgctgtccctgtagcttcagacccaaggttggccaggctagcgagctgcgtggtgactgacatgcatgttcccgtgcaggagaacgcctagtttcgggcatctcagctgtagcgggtggtgtgtgcgtagtttggatagttgcttgctcagttgctccgatctggaattccagaatcttctttgttttcccggacgtttctggaagcacaaaactttgtttagccttcatatcaatcttgcgtacagtatgaattttcgagaatgaacgtactaccagtatgctttatttctaagaaaaacagtgttttaaggtggtgtttagaaacgagggactaaactttagcctttctctcccaaacaccccctaaatttttttgtttagcatatgcaattcaaagcaagtactcattgttgttgactgctgagttatggcgagacatgccgcatcagtcaaaacaagcgtcgatcgacgccgacccacggctggctcggtggcctgcctgccgggttgatggtgatcgaccacatccacacagaaaaaattgcatatataccatcgcaaaagattggattcgctggaatgacatcacttaaacgggcttcgctagaataccactcctaaccaaatcgtgtacgctgaaatgccatcatggaccaatctgcccttgggcttcatcttcctcactccaactcctcaactttctcgtcactgctggctatggttgcggcga

SEQ ID NO: 16798 - DNA, 42498 bp, Oryza sativa
cagttctcctcgccgccaccatggccatcggtgacgacgaagacgaggagttggatggaggaagaagaaacccgagggtaaatctgtccaggatggtatttcagcgtacacgatttggttaggagtggtattatagcgaagcccgtttaagcaatggtatttcagcgaatccaatcttttgcgatggtacctatgcaattttctcatccacatgatgagggacgcgtgaaccgtgcgatcgagccacaccgcgtgaccccacccaggcacccacccatcccgtccgtccgtccaccatcaaaccggtaggcgcccacgcgaccacgcggcgccccgcctgccctgcctcctccacccggggcgcgcgcgacaccggcacagctcgtccggataagcgcgacaccgcgttttcgcgtagagtacctgggaatcgaagggatcggacggtgtgcgcggctggaccacgcaccggatccatccatcatccgtccaccgctcatcgctgcagcctatcgatccgtgctcgtgcacgtacagtgttcctctgtgcctctgcacagtaccaattactgctttacttaaaagcgacggagttggctataattgggacgaaagccaatgtgcacgactcctccctggtctggtctcccggtttgggttgggagatgctttattttgccaggtttgttcgtggttatctgctgcattggcttggctgcgtgcgctctgtacgacccggcctagagtacgtacgtacggcgtactgtttttgtttttaatgcagcgagtaaactctcaaatccgtagatggcgtacaccacgtttgacaggatggggacttggctgctgcccatgctgtccatcgatccctctctaagctagcgcacggcgtgttgcctgccggggggtgcatggcaagctcgatcggtttgacgccgtgtaagcatcatgtagccaagatgggaggccatgggggctagcatggtacgctactatacctatacgtaggaactgcctgtggtgtcaaaggctctaggagtatatgattggtggacctaaggcccgtcgtcgactttgaacggctggtgtttgaatcctctagatatgtagataaaaattactacctctgtcccaatatatataagtatagtcatggatatccgtgtccagcgtttgaccgttcgtcttatttaaaaaatttgtgaaaaatttgaaaatatttagtcacatatatagtactattcatgttttatcatctaatagcaataaaaatactaatcataaagaaatttcaaataagacgaacggtcaaacgttgaacgttaacagtttaaaagtgcacttattttgggacgaagggaataagtgtttcacgtaaaataaagtggtaataacgtgtgattaattgagttttaattattacaaacttaaaaaatagattaatatgatattttagaacaactttcatatagaaagtttttgcacgaaacacaccgtttagcagtttggaaagcgtgtcacgagtatccaaaatttatcctctccctacagaagaaacagatgggggtctaaacactactcccttcgtttcaaaacaaactaacttagaagggaatgtgaccattcctaccaatctggatgtcacttttctagatttgtggtataaggaggggtcacatccgtttttaggttaggttttttttatagagagggtagtaaatagtggagcatttgatatttaattatggtcttgttactagttatttaaaaattctataattaaaccttttatatctgttgctaacacataaataataggcaaatatcgtgataactgacttgtcaagataggtgatgaacaatatgtttacaaattactatagtaaatagtaggatgctagagaaaacggttgtcacgcataggctaaagaaaaccttgaacctgtggaccaaagtaaactccttatatggtgtttttacgtaaaacgaagtgttattaacatataattgattgagttttaattattataaatttgaaaaatatattaatttgatattttagaaaaactttaatatagatagttttcacaataaacacaccgtttagcagtttgaaaagtgtgccacgaaaatcttaatcttcatccaactctggttggagaaaagaatgggtagtcttacaaccgcgcacaagacgactaatcttctggagattgaaaactgtgctaatagtaactcagtagggatcaatccaatatggcttgcatcaagtcgaatctattgctctactgtactctaaattaagttgttttatataaacccacgttctcaccaagcccttcttctcaaattgaaatgcgttatgcctatgtaaccatataccttttactctatccgttttatattgtaagactttttgtcttatctagattaatctattgatcaatttatatgttttccatacgtctaaatccattagcatttatgtgaatttgggtaatactagaaattcttacatttggagaatggaggaagtattatatattaagatatacgtagcaacctaatactcaaaatgaagtggtactagtctaattaatcaattttgagtattacgtaggtggctacatttttgcacatggagagcagagaaaaatgacttctccttttactgtttgaaagttatttttagcctcagcgtttcgcttattcatatgtttatccacaccgcttattagaaaaagaaatatggtaatacttttacatacacgtctttagcgatttaaaatatctaaaagtaagtgatgtaaaattaactacgataacactacaaaactagcttcaaaattaatctttaaaatttaaaattttgactaagcatcagtgaaacaatgagaccctttatatggttatcatatctcttttaaggttgtgttcagattaagacttcgcacggatgtttttcaaacggttaaacattttatagaaagatatacatagaagttacttttaaaaattcatgttaatttattttattttttaaaattataataattaaatataacatcaaccatactaatgattcacctaaatttaggtatttttttaattttctttttccttctctcgaacgcatccagactctactactgctcttcgatacagggatagatgtcctaaaaggtaagcataggagaggaggtggtggattattttaggaggtctgacatggtgcttagagcctaaggtttgaccggttccttccttcaccttcagttccttccctccccgtatgcgataaagatcagtcttctcctgaccaagcgcctttatcctctttgtcctttgggtttgttgccctcacatggccatgcttattccacaaccgcattcatctctgcttaaacacacccaacaaagcaacctcagcactatcacaccagctaaataccctagtattagtagtttttttctaaatcgtgtactactaaattaattaaccattcgtctcggtcgcctggagtggtggtggtttgctttccacttcgagatcctgggcgtgtcctgcacgtgtggctttggcatgtgagctttgcctagcttattttagctttaccttagctaccttaattatttgtatctgtctgggcgtagcaccctgcagattcttccttatcctcctgtagtatggtctaactatatgatggtcatagctaacccataatcatcaaaataaacaacaccaggttagtacagttgctgtcgatctcctctttgattaattcttggatggtacgataaactatagtactcctatgtaggagtagcctggtatctctctctagcttttctttgtgggctaagctaattaaagcaatattcaaatgtccacccaattaacaaacccgaccaagtcgttaatctccccagactcaaccgcataaaatactgttctttaggcttgcaagttgcaacatctttccacccagaagtactgcacagggataaaaaattttgcgtcgcgatcaggttaagcaaagcccgtaatttgggggccgctgtatatacacatatatatggctcacggtttggggcaaagttagtaactccccgtctctaaatatttgacgtcgttgactttttaaaacatatctgattgttcgtcttattaaaaaaattaaaaaattattaattcttttcacatcatttgatttattattaaatatacttttatgtatatagatagttttatatattttataaaatttattgaataagacaaacagtcaaatatatttagaaaagtcaacgacactaaatataaatattaagggacggagtgagtaattaatcggcagccgtggtgacaaatcgacgcatccgaaacgaagtccaagttcgtgcccaatgggtggctggccctgtttgtgggcgcaattatatgagccgagcgcatgcaaaattttcctgcggaatcgcgctttttcagctgcacggggaggaggtgaggtgatgggggaggaggacccctgtgtgttgttaattgtggagcacgtaacagcgacgtgctgatgtggccggtttggtggtcgcattatcctcccccctgatctagcaaccgcgacatgatcaataattaattagtctatgtgctcacaaattaagtagaatcttgtgtgtgtggagcaagcagacaaacgtacatgacgttaacttcgtactagtacactgcaaaaacacgatcatttgctagccgcttacaagatgggacagctacggagtgagtgtggtttaaatgactattttcttctaaaaagattagaaataatccacctaaatttaaactctagacttaacacggttgtatttcaatgataagtgacgtattcgtgataactttatcaatattataagatatactagtccaatctttcgaagatgcttgtagagataagatttgcgtgcatacgtttataggagatgcatgtgcatgctgaacgtctttctatatgtaaaaaagatgagattgctaaatgaacgatcaatcagttcatggccgttgattgcagagtggaacaccctctgcatcgatcgatctcgccatctttgtcgtccttgatagaatgacacgataaccagtcgaacgatcgtacgtagcaatcgtaacgaaccaactgcttgacgtttccctgttttgggcctatatatacagaaatatcctcgtcagcctcctgatcgccaaaagaccggccctagctagctcaccggcttttgttggtggcgacggcgtgcctgccggttgaccatcgccggccagcaagccaatccggccgtcggcgtccgacaagtcaatcctacctaaaaatgaaccgatgcgagtaagaacggcccgaccggccgacgtggcacggcaacgacggcgtcacaatccggataagatcagttcccatccacggcgtggttatatgtggtggtcggaacatgaagctagctagttgtaataaaaaaaatttagttagggcagataattaattaagacgctataaaagcgtcattatggccgcattatggattgcaacccaagcaaagtatatacagttaagacaaaaggttaaggccagtaaaggttactccaggattacatctggttaactaataatcggagtaattaaattaaacagaaagcaggggagcttgatggcgacgtggcggtctggtggacagatgcatggataagaaagtgtgatcgatcgaaccggctggcttaatttggctaatgcacggctgcaggttaagctagtggacaaggtgcggatggaatgtttggatttcttttgtctcaaggctttagctttttttgatcgatcgatgcttttttagttgtgtggctgagacgaaaggctaacatgtgcccaactcgatgccggtcttgccacgtacgtacaaggagggtagattgtatatagacagatgctaaacaaaaaaaagggctgatcgatgagtgtgcgtttgactgtttgagccgtgcccctcctgccggtcaattgggagttggtaggggacagtttgggtttttcttttagagatgactgatgagggagaggcagcgagggcgtttggttagttggttggtgcgcgagaagattggatgatccgagagtcgaggaggtagttagttagtagtaacacgtaatgcggttgagtcatcgacggatcagatggagggtgggacaccggtacgcacccctacgtggtgcggcgcggcgatctcccacatgcgacggcatgtgcgcccgcgacgcggcgcatgcaggcgagaccccccccacacgtcgctgaccctccctctccaaggcgcgcgtcgcgcggggggcgtttgcacgtgaaacgcgagtacgtggaggtggagagagcggaagacgatgggatcgtggatggcgtgcggcgcgcccgggacacgtacgccgcgcgcgcgggggaccagcatatgccggcgtggtactgagtcgagaccgacacgatcacacgagtgtccgccgcatgcacgcagttactagtgccacccaacccaacccaacccaacccactgggtgtacgtcatggcccaggggttggttaggccgtttcctcggcccagcaaatctcattgctcacaattgtgggccgtccacgcatgggagcatatgctaacgggccgacttggtgctaagatttttttttttgtgcgattgagcataataaaatttgatgctgtcaaattgttgaaggataacagattaaacattgctttacgaatgacatcatatcaaaatttggtagtttcgaaacactaccaaattttaatttgaaggtatcaaactaaatacatccactctatcaaaaatttggcatcaccaaaacttaccaaaatttgataaattgacaacaaagggcatgttcagattgtagctaaaataaacctaaacaagttttgccaatgccaaaattttggtaagatggtaatattgccaaaattttggcagaatttcttatgtattgaccaaatttggcaacaaactaaacatagacattttttttggcaactttgctaaaaaaatgataggtttacaatactatttttgaaaactaaactaccacaaagcctatatatttaaaatgaatgtaccataaaaccatggattaagtaatagagttatcatttttcgctaacacgcaaaatgattgcacatcaatatatcagaagaaaagagttatacttacacaacgcaatcagccagaccgacttatgccaggggaagggagaaaagcaaaataaaaaactgaagcttaaaaaactactgcggcggctaaacctaaactccaagcagcgggaagggccgagccacgctacactcccaacaaatcccaaaaaacggcaacgccgactaaagaacacatatagttaatagagttatcataaaactacatgtttaaacgccaatttttaatcacaaaaatacaatatttgtaactcaacatcacaatagtattagcaatttgacctttaaaattctagttttatgataggtttatcaaaataaataaaatatttatagttttgtagattttactctaagacttttctttttagctgccatctagtaatgctgatgtcattgctaccgtcaagcaatttttttccccgagacatgtcattgattatgtcactgtaatggtcacacattgtagtatactcctatatgctgtactcccatgaaaagtcatgagacggcctgtgattggatctttcattatactttgtcaaataggcgagaggaaattcaatcctttcttcttcggacaatctacattggatatacatgttcatatccgtacattcgaaattcagggccaatttggattgctaccctactaaaatttgcagtagtaaaccaaacacctctactaaaactctacctatgccataaatttggcttggcctataaacttgtctcttatgggcaaattttggcttcaatccaaataaacattttcaactctaccctaccaaaattttggtagtaccaaaacttgcccaagatttggtactaccaaaattttggtagggcatcaatccaaacatgccctcattttgtactttgcatctagatgtctcatctcaggagtagaagattccaagtttcacagataagaatgtcgttgtgaactgctgaagcatccatgactatactgtatatgcaataactgtgtcacaataatttgatagtaatctgtatattgatatctggttgtaaaatattccaagttgcaacgatagatgctgtcacttcctgctgccaattcttgaggcatagatgactgtgcatggttactgtgtcacaattatttgacaataatctgcatgaaagcgcattacagccacagaatatatcctgtgttaactctgacgaaccaatcttcttttgtgcaacctacactatgcgtcctaccttttgctattcaacaacgatcacttatgaaacaacatgcagtagtgtgtctcaatctttgaaaattctccatgtttagtgcagaatcaaactatttactgatatattgatcctaaaaagatgggggtgtttgctgaactgtcgccgtcaaatttcttgtctccacagaagtcttcactgatttatcatcttcctttatccaaaaaaagaggagccatcttttcttctctttcgtggcatcactttgcaataatttgggctccctgtttagatagatagatagtatactgtagtgctacgcaaactagcgaaaattgatcacgaaagagacacgaatggttgccctatacgtttcttctattggagcacatacttgagcttcagttatgtcaaccattttcaaggttgcgttctatccatctcatctgaattaactttagggtcaacctaatttttttttgggttatctgtaccaacatatgatgaacaaaaaaagggagaaagataacacaagttggggttcaccaaagtcaaaacctgactccaattgtagacgcaactaacacatgatttccctgaacaacaagtacagagaggataaacaagaagcatatatatgaacttgtaggcatcttttttttttctccttttttcggcagaagattgagattgcttcacgaacaaaagaaagggcacaatcatcgtacacacaggacaatgtgaattgtagcttaggtctctgagaacacacgtctcgcatagtttcttcaacgaaaacgtggaaattaatgggccagtattccttgctgctgctgatggcacagcttcagaacaaaaagaagatgaagataagaagaagaataagaagaaagaagaacattaagaagaaatggatctcatcgttctctgccgcctctgatggctccatcacggcacaagactttgctcgcccagaattaggtttccgatcacatctccagtcgagaccatccatgcatccatcatcatcaattcatcatacagcagcagcagcagcgaagtcttgcagaccatacatacgatatccatggccagagaaagcgatgtatcaagagctaagtagccctaattattcgatctcttggtagtactttttaccagcaattcagattcagccatcgttttgtatgtgataagtgtgcacgttacgagaggatcgatgtatctgaataattggaccagatataatctttgtccatttaatttggtttcagtcgtacatcgtctggtacgtgtgtgccacgtgtgcaggggagattgaaggcgacaaatggggaactgacaggtgccatgcatcatggcctcgacccttcgccttcggtggccggcttgattgatttcatgtcgttgcatacgtacgtgtttggccggtgttcgtccacttcacccgtcgttgatttgcagctgattttacggcggtgaaggctgagcgtacgtgttggtccaaaaagtgtcaactaatatgatataccgattcacagaattaaattttttaatacacaaattaaagtacatactcgtatcttttaataagattagaaagggtagatgctctacacagttacaacaaactacacacaacgactctagacccatcttgcacacaggttggtgcccatcatatgaagattgaggacccccaaggctgccaaacccgttagtgtgcagactcgcgaccaaactaagcagaccttgcgattcaaggcattatgataatggtgtgaacgaatgaatcaaacattagaaagttgataagtcgatctaaagaagtttagtaagaaataccgatgaggaaaaagtttttataaatatcatgtgccgtttagtaatttaagagaagtgtcaatgataatttacactctactcataatttataatctgttagctagaactaggcataaacacacttgtaggccggaccgctgcaccatggaccaagtatataaggtattgtcgtctctattatgtgatatcccataatctaatgggagaaataaccgaagtgtgtctctgtcaatctccttataaaaatgttagtttcacaagtgttctctatttcaaacgtgtttccccaccatcaataatcgctatggggtcagtccaataatttcaacaagatagaattagctttgatctgcaaagataaagaaaaaaaaaagacccgaagaaaagctcattatccttacccaaccctccctgaactaaaataatcaaagataagatcacagaacaccaactttatctaaattttcttttgatctcttcttctcccatcactttatatctccaaccatttgagttgttaattaatcaacacaagtactctttcagcatgtgcagggggcctacgtgcgactccagttccaatcctgtggtttgcaatcttagcctttgccttcactctatatatcttcagttctttacacaacaccatatcctaatctttgattctttcctttcattatattctctctttgctagtacctttctagctagctatcaccctcctaaatagagcaattgtttactcccaaattggcaagtaagtgtgtgcttttgttaggtacagcgctcttatcgttgcaaaaaagatatgatgaattactgtgcctgagtgaacagaaaacaatcaatatacatctcatagttttaatatatattgaattgatttgtttgtgccttgagctaagttaacatgcatccatcagggaaagcgatgcatgtcgcagatccaaccaccgttgcagtcgtgcgactttgggcaacgaactcgagaccgccacctggcatgtttgagcggcttatcagatatttgttcgtcaggattcatgatcctatgatcctatctaatcttgggtgagattgacctgaatgattgataactcgattcattgaatccatcgtttcaggggcgaagaacttgtcgattccgaactgaattcatatattgtgagaaaagagttgtccttttcttttcagaaatatactattgtggtaagatttgaatataagttgtgatagtaatttacttcaaaaatatgttactgttgcgtttgtgacccaaattcctttacgaaggtaaggtggtttaatttaatacagtacattggataaagaaatctcagctccaaagcaaagacctctccctgcgatattaaaattaaggagagaatgagagttaccccatatacttaaatcagttaataacctttttaatgcttctatatatcctatacacgagtgtttgctctccatagggtgattcttaacccatattcttgggaaaccaatgaatgcctttttctgtgcgagactaaggctctgtttagtttgcgagacgaaaaattttggcgtgacacgttagatatatagacatacatttgaagtactccctccgtttcagtttataagacgttttgattttagtcaaagtcaatccgctttaagtttaaataagtttgtagaaaaaagtagtaacatttttaatcaaaacaaatttatttaaaaatatattcatcaattattgatttgatgaaactagtttagtattataaatagtactatatttgtctataaacttagtcaaacttgaaatagtttaacttttaccaaagccaaaacgttttataacctgaagcggagggagtattaaacgtagactaataaaaaaacaaattacattccgcatgtaaactgcgagacaaatttattaagcctaattaatccatcattagtaaatatttactgtagcaccatattgtcaaatcatggaacaattaggtttaaaatattcgtctcgcaatttacacgcaaactgtgtaattattatttttttaatatttaatactccgtacatgtgttcaaacattcgatgtgatagggtgaaaagtttttatttgggaactaaatagggcctaggataaactctgatcggtagttttctggcatttatcaccatatgctacaagcacgtttgctaatacgtagtagtactacacacaaagtaaatactatatgttagtactttatgtgtgttatccgatgggcgatgcaaacattattattctcgaagaaggatattacctcacttttttttttcttacctcatgcatgaatcaaagagccaatgtaaggttgcataatctgacagatttccttaagaacatccgttgaaagaaaaatagtaattctggacatttaaaccttggtcggtagctttctggtatttatcatcatgctacaagcacgtttttattatgtagtattgcaagcaaagtaaattctatgctagcacgtaaatatatgttatccaatgggcagagtaaacagaatagtaagagttttttttgcggtcctaagagaaggatagtatctcacggtatctcttcatggctataaaatctaaaaaaacatcgtacaatattgtacagtaatacgaagaataaagaaaagtggtagtactatctacaaaatatatattcttcgtatttggtgggtagcagcctagcagggacgctgtgagatccattcaaaatttaatctaacaaaattgagcaactgaatccatacgtacataccaaactggtgcaagaaaaggcaaaagaataataataataaaatggatttgcgcactagccagtgatttgcctgtccttctcagtgtccactgcaaactgaataagtgaatatggtgatctcatctttcaccttctcctccccataaaacaaacacaaaccaaaccaaaaaccaactctttttgaatctcctttgtgtcaacataaagaagccaatcaaggtgatggctagagggagcatgtagcagccgttccttttattatttgcaagactagattagtccagtaaaagcttcacttcctaatagccttataaaaatgatacatggtggaagatggcattgtgtttttgccaaggggacacacacatacaccactagcaaaagcttctccttttaggcacaaataattcagtaatctctaagataattccttttcttcttcttctctctctctttaagttcaagtgaccctgattgtccccaaaaaaggcgtcctcggcgacgaactgggctgatcgttctgacggacagtcgagatcttgagctccagatcaggtggctggagttgcagttgcacctgaggctttgccaccatcagagaaggatggattgttcttggttgttcgctgctgctgctgctcactgctggtgatgaacagcttggcgtcagggttaaggatggaggaggcagcagcatggcttctggctgtgccatgctgctgatacccagtgacagtgcagggaatcccatttcagcaggcacagaggctgtctcgtgtctcagtttcagacgttcattcacactcggagccttttctgcatcctcaatctgaaagaaaagaaaaaaaacatcaaattttcagacatgttaggttactgtaactcactcatataaatacatgattcttgctgtctgaaactgtctgtgtagatattgttgcaaagatgtttgaagtttaccacgtcaaagaggctggatcttctcttcttctgcgtgaggctgctctgcctgaggaaatacttctgggcatggctggccacctgcgtcggtgttcttgtcgtgacgaagtgccgggaaatgccgcgccagtcgcctttcccgagcttctcgagccctaccaggaatttcctgtgctcctcttcagtccatggaacacctgatgacagttaactgatgagtttgacatgttcagaatttcaggtgtagaaaacacagcaatttagaggatttttttttatctgttgatatctgcaaaaacaatctagtgtttggagttcaagaatctagatgcaaatgattaggacgagacaactaggataaatcaggtctttgtttgtgataaggatgagagtttcaggttgcaacttgagagacagaaatctgattcttaggaaatttatgtcagtcatgcatatattcctgtaccaagttggaagcataaaaatgggcttgtatggcagacagcaactggtggcaaaaattggagaaggggacataacaaaagaagtcaaataacttctcatcaacaaaaataaattcagtcttaatgatgattagatcactgtcaggtggctgtaattagtgctaaaccacaacaaattagtgaagcatgcacaaaccatatgtctctcaagaactcacccttcttcctctcctgagctctcgccatgaggccatcggagaggtacccgttggccatcttctcgccggcctcctccaccgacaccagcgacgacgacgacgacacggtcggcgacgagttggaggcggcggcggcgaccgcggcgtagtacgccggcgacggcgacggcgacggcgacgataggcactccatgctgaagcacttcttcagaggcgcaccgccgacgtgcaactgcaccccgaacaacctcacgccaccggcgccaccgccgccataaccgccgccactctcctgcaggctcctttggccggtgcaagtcctggagttgtggccattgttcccgcagctggagcatttcctggccatgctcgccgccgatggcaggccaagaaccacaagaacagcaagaacaacaagaagaagaagttggagggaagcaagaagaacaagaagaagaggagtgggaattctaaggagttgagataagatggtgcatgtggagatgtagcaatagcagcatctagtagcttaataagggaggagaaagaaagatgtggtgtgggacaagcaactagctgaggagctaacacctggtgccaatggaaggggacacacacattggcatcatctccttttatggtattgacaattcaatccaaatgctggggcaccatgatacattgattctactatagatgctgctgctgctgccctatttaactgcacctggaatccacaggaatctgaaagagagtctctcctctttggatgctattagtgatatttaatattatctatgtcaacatcatgttgcatatgaaaatcatgtttgtatggttcatatcaggaatcttatacctttgcttgtgcatttttgccactgcacctgcctttttatcctggcaaggtcaactgattggaaaagagaatttgttttcttcatggcctgaaattgtttttaaaaatagacagagagtgagtttttttttaatgttgtgctgaacgtgtatgccatgccacaaaagaaattgggtaaaaaaaatgttttttgtttgatctagaagcaaaatgatggcatcgatattatcgaaattgtttcgagattagattggattgagtagctattaattgctttcttagtttggaccagaacaatttatagagaaactttcattttgtgatgtgaaactaagacctcagtgtccgaggtgtatgctgacgtcatcgttaagaaaagcatactttggtccatacatgtcctttcataacgtccggaataatattatgttattttgtttgttgccacacaaaaaaaaattctagaaacgtaatgagagcgatttgaagtggaaagtctattttgtcagctcgtctagatcaaataataaatcgataagaaacacactgcaacctcagctaacctcccaagattaaaaaaagaaaattcaagattcatttgagatactagtttgctctgctttgactaagaatattcagattgaaacagtataaaattgaggatgagattttaatgtgactggatgtgacaaaaaaagagggagaatatgaagtagttggttaaggtgaagatttcttgtgttgttcttcaatttgtcccatgtcaagaataaagggcattggccaaataacaagaaaataaacacagagcagagaagcccttattaatgcaagcaagcatacttatcaaggttaggtgccaagatccaggattggacgaaattaggaaaaggtctcgctataacaaccacaaaagggagagattccggtactttggaccttatgaacctgcatagcattagaaactatgtgctattttttttgagtttcatgaaataaaaaaatcaggcaactgttctatttgttcttctccttgtatataaatccaactggatgagttacagtctgaaattggtggattattaatttactagaaacatctgtactttgtgcacccaacttaggtatgggaaattcttagtttttgatgaactcatctttctccttatcaacagcaaggtctctctttagccttttaaattccatgactagatttggacaaccaccacattagagttagttgtaatccacaccaaacgaaagtaaataaaacaaagttgcgaaatgaaggggggcacatccaaattatcacttcaattgcattttaaaattttttgttagtatatacaaatgggcaatatcccagcttaactttactagtcaattaagcacagcgcaattgtgctttcctggcaaagcccttatttccgtgttcttggaggcttatgttgtgaaacacatggaaaaaatcctaccacttctgaattctttatttatattgtaaaaaaaaaaaagcttctcaatggcatcatgcaaatgctacaataccctactgaaccaatgatttgaagtggcacaagagacactccttcaaaggaacttattatagctgtgttaggtgctagaggatctactgtagtgaacaaaacatttcctgttgaagtgttgatcatctgtgcctgttcatgatagatgagatgccatttggatttcaatgcattattattattgttattattggattctactggtttaataggtctacgtgataatgatatgcttaattgatgcattgcaaagtgcttctagctccttggaataaaatgatattgcacaactgagaatgaaaaagaaacttcaacggcatgtcctcttgtacagtagattcatcatcttaaagtgaagagcaatgatactctgtgcaatgatccatccatcaatccatcacagaagcaccattgcaccaaccttgtttcttgcaaagttagagcatctccaacagcctctccaaatcgaactctccaaacacccatatagccaactctccatctgatttaactagtcaaactaggcactcactccaacagactctctattaatcctctccaaaataaaatcggacccacatgtcagcccctctcccctcttcttcctctctccctccccttctttctcttttcttctactccccttccttcccgtcgaggcggccgacgtatggcgcggtggtgcggcggcgctgggaggcgggaggtggaaggcggcgcggggaggcggccgggaagcggcgggaggcggcgcggggaggcgggaggcgcggggaggtgggaggcggcggtcgacgaccccgacgacgacctcgacgatggcgcccccaacgacgacgacggtggcctcggcagtggggcggaggtgcggcgctggaggaggttgggcaccgacgcggcggaggccggaggggcggcatggggaggcggctgggaagcggcgggaggcggcggggaaaggcgggagacagcgggaggcgcggggaggtgggaggcggatgaggtgggaggcggcgcttgacgaccccgacgacgaccttgacgaccccgacgacgacctcgacgacgaccttgacgacgatgatggcggccctgacgacctcgacgacgacgaccccgacaacggcgacctcggcgacgacgacgatggcgcccccgacgacgacgacggtggcctcggcactggccactgggggcggagggttgcgctggcggagggtggggaaaacgcgtggggcccacgattggagaggcgcttttggctggccaaagttggccagcgtggggagaagtttggccagccagttagctaggctgttggagtgtgtttttgatccaaaattgctaaaatttaacttgaagagtgggataaggaggctgttggagatgctcttactgctgtctttctttctccagtgattctgccccttgtgagtgacaaatccaggcatgaaaaggaagctgtgacaaggtaggaggggtatctatatccaaagcagatgttgagtgggggatgctattcttggtgaattaattgcaaaggaaccaaaaccagtacagtttcagatagatatccagcaccagaatcctgcatcttgtctggttctcctgcaagaagttgtactgaagaattcctttcccttctatccaactcttttttcggagaagaatccaatccgttgggaaaatccatctctttttctggagaagaatccaatccgtttggaaatcattaaggaatatcaatttggatagcaaaacactacggagcatgtccatttcagccgcactttatgtcttctaaattattcccatatttcctttttggctgaaacactttactgaatgtctgaaacatataaacacaatacaaaaaatgcagtacttcattttaagctcgagatccattaattgatagagaactgcatccggtcgcgtccaaattaacgtttgtgtcaccaactcgccatccttaataattctcctactcctcaatgtttttttgttggaatgtgatgtttgatctgccaagaacggcgcaaaagtcatcacatgcaccatcatcaatttattaaaccgcagtttgcccaacacaggactcatcacccatcaaagacataatgttaagatctcaactcccccaaaaaaatcttaactccctcgttaagatcgccccatgaaaattgaatctccggtctccaaattaaatagttgaatactactccgttccagaatataagaggttttagttttgtcataagtcaaagttatctagctttgaaaaaaatttgcaccgacatgtacatcataaaattagttttattagatattgtagatattaatatatttttctacaaatttagtcaaaactagataagtttgatttaggagacaaaactaagcctctcgcattctgtaacggaggcagcattatcttacaccaaacgtgtctccttgtttttctacattttttctcttctaaatattgtcacgaagaaaatgtgaggtcaaatgacctggtaaaaccaagtacctggttagtaactacgacaacactgttcatatcattcagtctagaagaaggccataggtgagaggtgacaaaaacacatgtatggcatgcatccaaggaccagctgtgaaatctacaggcaccaaacatgcacggcagggttcacaatcacatcacaaaaaattcctttgccatgaaaacaactgaacaggttttatgaaagttttcaaactcgatcgagctcagctagttcacaatggtcaatggatgcaaaccatcaggctcgtcgcttctctacgcgtttctttcgatacacctggacttgccgggcagcagccactgtttgacagctgaattgactgtctctgaaacctgaccaaacattccaaaaaacattcagagtttcagagagtttatggcctgagagatcatcatactaccaagttaccaaccgtgtgtttcagagtttcagtatgaaagaggcaggtttgatctgaagacacagagcatttcaacagtcggtggcagaactgaagacagtctttttttttttttttgatggcgaactgaagacagtcaagagcagaggaagcagatgaagaaatggttttcagttcaattgaatggatgagtggatagagcgagaccatgggccggtatgcggcgccatacatgggctgaatctccggcccacacagcacagcccacaagtcacagcgaactctccgaccgttgggggtcggaaaagaattctccgagcccctactgggtccaagacaaccgttggatggaggcgtacgtgcggctaggatcaaaagcttgtaatgtaggcccattagaattgctgcccggcacggcccaacccaacgccgcgcataggaataagttcactttgtgaccctcaaaagtagtcgaaatctaatctataatcctaaaccacaaaacaagatttctcgacccccaactctcaaaaccggtgcaatttgactccctcagcggttttactgatgtggtgcctacgtggcaatattgactcggtcttcttttcacgtggcgcttaggtggcattagaaataaaaaaaaataaatgtgggacccatttatcattcaccaaaagtatgggtgggacccactgacctgtggggcccacataaatcatcctctcttcatcctccccttctctctctttctcttcatcaaccttcgggcgagcggcagccgtgggacgagggccagcggcggacgggggccagcgacgggcaggagccggcggcggtgttgtcctcgtcgaagcgtgacggctgtggccggagctaagaagggtgacggagcaccgacatcggcggcggcatcgggtagtagcctccggcgtagtacggcgtcgcattcgctgcgaagtacgggaggtgaaccggcaccaccatggccggctccgcccagttgtagtggtggtggtactggtactccactgccaccgccgctggttcagatttgtcgccgtcgccgctgctcttggtggtggcgtctttggacgatgccgtcttcccaccggcgcggccagcctcgtcggcgcgtgtggcggcttccttcctggccgtgcacttgctgcattcctgcttgcacgccgccgccgtcgctggcgacttgttgcctttgccgtccttgccttcgtctttgcgcgcgctcttctcgtccgccggcgaggtcggcttctcgccgccattgctgttgctcttcttgccttcttccgaaggcgcagccggtgacggcggcggcggcgccatcacctcggcgatcttgccgaccttcgagagcttctggacgagcaccctgctgtccacgtcaccgacgacggtcaccttgtcgagcgacgggttgatctcagtcctcagcacgcctgcaaaatccatgcacacaaacacaaaattcagcatctctgacgaagcacaagattcatgcacacaaacacaaattcagcatctctgacgaaacaacaaattttcagcgtctcagatgaataacaagaacacaggagaagtgaatgatctcgatacctttcaggcttatggctttcatcaccttcctcccgcaagcatgagcaaggagacggggagtaaggggaggagaccgctggtgagaagacggaggcgagagagaggggattggaatcggtgagctcgagcttgccatcctgccctccatcttcctcccttgatgcctgcttgctccccaccatcggctcatggtggcgtcaccggagcagcgtcttccccgggagtgaggtccgccgccggctcccgctcgcagccgttcccctcgtcctcccactaggggatccggcccctcgcctgcccgccctcccgtcgccaccgtcggctcccacccgctgccgccgccgccgccgctggcccctgtcccatggccaccgcttgctgaacggaagagagagagagaggggggagggggggggggggaggatgaagagaggatgatttatgtgggccccacatgtcagtgggtcccacccatacaatgacaaatgggtcccacacatatttttttatttctaatgccacctaggtgccacgtcaacgccacttgaaaagaagaccgactcaatattgccacgtaggcgccacatcagcaaaaccgccctccaaaaccaccgagggagtaaaattgcaccggttttgagagttgggggtcgggatatccggtttggtggtttagggttatggattagatttcgatcacttttcagggtcacaaagtgaacttatccccgcgcatatcatcctacggctgacggcccacggatcacggcccatgggcccggctgccccgccgcgccctatatgaagcgctcgagagcgccggttcacctcgtccccatccgcctcctccgccgccgccgcgtacatgaaaccctagcggatctcctctccgtcgtggccatggcggagcaggggtggttgttctgttcctgcctctagtttctcctatcttcatctacttgattctctcgcatcttagtgattttggtgattttgattttctagtttttgaatttgtgattttggtggtgtgttcttgatcgcctttgagagaaccgggtggatttattgctggtgccgcgtcggttccgttgcgggcgtagatgaatccttgtgcttcagattcatccgacgagctccatccatgtcgtctcctcgtgatgctgggtggcagggtgattttggaacattttctttttttttacttctctcccgcgagatctatgtttgtttgtttgcgtttgtgcaatggtgtttttgctgggttgatggccttcataatcccggattaactcgcttagctgttcttctgattcatgggaggccgagatcgatgctggcagtttcgctgatagccccttcctcttactggaggtgcttcattagtaactggccacacaatacacaaatgatttcaaaacttgttttctccgtttgtttttttgttttgtttttgcgaaaagtttcgcttgggatgcgttgcgcagaacgaacaaaccatcttctgaaatccaccgagatcaatagacagggtgatgtttatattggtagaaatacaagtaatcataaaagcagtaaatttggatatgccaaatttaacagaggcatcgaacgattgaacatataagaatatcatccaaagatgttcaactgttaccgcaagaacacggcaataaccttctttttagtgttgtgcggaaatatgttgaacggttaattgacaagcaaggattaaccttacttataggcctgttaatttgccattatgaaacgtgataaagacctagtaaaccaaagagaattacccctacattacgaacttacgattggtggcgtgcgtatgactcgaaatggtcgagcagcttttgttggagctctgaaacaaaggcaggacaacttgtggatagtacacgtcaaaattggaagtttggttgaaattgaaattggaatgaattggaagtttggttgaaattgaaattggaatgatgtgatgtaaaagttggaagtttgtatgtgtgtggaaagttttgatatgatggaaaagttgaaagtttgaagaaaaaatttgaaattaaacaagggcctgatgagaggtctgcttagctcatgcctgcgtcagtggaccatccctgacgaccttccaatcttcgccactactcgctccatggtgcagatcaaggtgacaagaaaccagaaacaaaaacagtggtaggaatctgcgagtcttgtgccaatggttcacattatcaatgtacaccgacagcagcgcacacagcctcaagtttaagaatggcagcgtgtttaaacagatgtaaaaataataatttctttatgaaactttttcacaacaaaattctgcttctatcattttctctcttctttttctcgtatggaacgatgtgatgagatatacatgtgtttctgactacaaacatatgaacaaacagacccacccttctcccctacaaactcactcccacctctgcctaataacacatcgatacagattatatcagttaaccacaatgaaaagaaaaaaaaaactgccattagctgcatcactggaggtaccaaaacttgctggcagtgaccatctgaattcagactagcccatgcagtgttccaccttcatgagcttgtattgtcaggccatcaaggattcattcatttgccaattgctaaactttgagcgagatccgagtcttgatgggcttcagcttcactcccatgctctccggtgacagaagttcaggcgatatacagaatgggttcagtgtgctccgggggctgctatccagctgggaaggtctgtagagcccatatcccatgaggaagtactccatggggatcaacatcgcgtgcggttgctcctcggtgacgagtgacccgcatgcctgaacctgcgatttagaggcgaaatgcacattcagaacttgccttactctgcgtatggatcatcaatttgctatgtcagctgttaaattgtgatatggtctttatacctcgactagggcgcaatatctccggtctagctttgtggtcatatggactgcgtcgtcgtggaactgtgagttctctcccacaaaaatcagtgtccgacactgaagcttcttcaacgcttccgtcaggtcatgtctcctgatggatggaaaaattcacttgagtatgttcaaatcctgtttctttgcatgttcaggcaatgcacagaagataatttgtccacttactcgtttatcgcctgaaggaatcgccatacattagatccctgtcgctcatgaagtaactgcataaaaggaaacctattgcttcagactaactttctataagtagacagctaccaatcttgtcaaaatcatatcagaaagctgacgaggagatgaactacttacacttctacaggcttgcacaatctctgattcagggtcttgtccattcccacgaacttcctgcacatagcatcagaaaactgttgagcgaagctgatatacataaaaggatgcaaataaaaagcagctaacagaagaccaagtataccgtgctaaaataccgctgaagcaagcattccttgactagcccacgactcccataatagtaaagcaagtttaataatacctggtacataagagtttgaggttaattcacagaacacattaccaatactgcagtaccgacagatttaaatgtatgttagtaccttattgtacaaccactcgctccaagaaggggctttgcatagcggcgaaactagcataaggccaatcactctatcccggtattttgtctgtgacaatgtatacatacattcttaagaaaaagaaaaagaaaagacaaggcaagctttgaaataactgctcagagtaatacttactgcaaagagggtgagaatgtaggcaccggcagtgacacccaaacacatcacagatcctaatctgtatgagcaaagccagaagcacagcattagaggcgtcgatcaagcaccagccgattataaggcgcaatttggccagtgtcgtgatacagtacccgaagaaatcaagaacatccgcgacttgatccacaagctcatcaacagatggcacgggcacatcggatgaaattggagccgctcccaactgtaggacaaaataacacatgtaagtatcagagcaaatacgggcaaacagtgaatgcttacataatattgggtaagaaagagccatcatgactgacctcatgaccttgaggagtgatgtggtaaatacaaaaattgtgaagcaacagcgacgcggcctctgggcagaagaacaatccttgaaagcaagacatatctaccaaacaaaaaaaaatagcaacatcagctaccctgccatggaaaaattagcaagctttcacctacaaacttgaaaggtcatcagaaaactcacaatttagagctacatccgggtatgttatgagcgccggcttgtcttcatctccaaatacagaaacagatacagagccatatctggttcgcactcggtgttcctggtaaaaaaacacaggacacaaatttagcccattgggatttgacaatcctatttgaaacaatagtataatgaataatcaatcagaaccagcaattaaccaagaggtattgcttcccctcggtgaaacctccaccgacattgcttaacaaatagaagcaacataagagagattctcgttgtcattgcgttgataagcactaattggaagctgtagcgtaggggcttccgttcttaattaacattaaaagcaaacaaagatgctacatttttgcgtgtatttttgtttttcctctcttcctgctcctacggctcgagtaacattgcaaccataacaaaacgaggagctgcaagaactagctattactgaccaaaatcataggcatctaatctaatgctcctaatttgtgcaatgtccctgaacaagtgaacagtaacgaaaaggagctccatggcacccccaaaaatttgaagcatttgctgctctaatcaagaacagcaagaaaccaaaatcagggagcaggaatatccccgctcctaccttaaccaccatgaaaccaaaacacaaatccccaccaaaccaagcttgaaggaggggaatcaagcaagaaacgggagagaccgaaagcagagcgcacggaccttgccgccgaaggagatccgctccacgtcgatggacaccgaccggctcgagtcccccatgccgccccgctccccttctagaagcttctcctcctcctcctcctcctcctcctctgccaccaacctctcctcttctctctctctctctctcctcgctgcctaaattcctcgcatatatttgctcgcgtatatatacaaccgcgagaggagagagagagagagaggagagggtggcttggcttggcttgcccagaatgagcgcaaaccaccgacggcggtgagctcaccggaggtgaccagaatatggcgggagagagaggagaggagagggagggtggattgcctgtttcatgggatccacccgttgaaggtgggccccacctgtcaatgaccttcctcctcacgcgtttgaccggtggtgtgtggggttagcgttttcgcgcttgtgacagcttgggccgatcgtcgcttgctacgggcaccaaacgggttgaccccccgtggaaggcattaaacattttttccccttctttttcatgccaattttgacgtatttgtcgttcaagctaaatcttttatttagataatcgttcaagctaaatctagcacacgagatatttgtggccattatgaataaaaagtcgtttttcgaaactgtttttcataccatcatttttggggttttatttggaatcattttggtagacattatatatatttattctgtgaggagcctacgtgcaccttccatataagaataagttcattttttgttcctcctatttatctcgaaataagtttattttattaatcatatcagagtttgtgcaagtagactacaaatgcatttgagtagactagcaaactactcatgctttatatgggtaaaagaatatactagtatattataatatgttatagacaaaatacattttttatcacaaatgttagtatcacttgtttgcttattaaaatatatgatattcacttgtttgaaacaaatattggactctattccataatatcaaaaaatatcaatggctaatttgaactacaaaagaaatggtgggatagcggtgacagattcactgccagcaccactaatgttttttaaatgagtatagataaaagagaaaaataattatattgaggtttgataaaatagggtagtatagtctcttttttaatgtattggcatatgtggtttggtttgaaagttgtatttattttcgaatgaagggattatagttttgtaaagtgtgactgtgtgaattgtttgagggacctaaggaatggatatatatatatatatataatgaaatttagaaaaatcatttttatttgaaattggacacgggaaggcagacactatgagttcgtgtagtaaaacagggtgtgccttttgtgtgcgccagctcaggctggtggcggcccatcagatgctgagctggatgggggcccacacatcagtctaacaaaaggtgcggacgtggtacactcgagcgcgtcatgggtttctcctgattggccgcgtccggtgggggccacctgtcagtggtaagtaatgcgcccccatgatttgcctcgtgagtcgcgacaaaattaataacactcctactagtacaatctgattaattactactaatagatttttggagatacatataccgattgttttgggatttttgaatataaatcacttttctacccaaatggtttttgcactacttttattctgtttgttttttatgtgagtcaattaaaccagcgaggaaatctaaacggttagaaaatgtatgttatttcttaaaacttgtttttttatgcaatttcaacacgttgacccggagaagtatttttagccggcaaaataatatattccaatattatttccgaaaacaaaaataagaaaaatattagatcctttaattgtcaagttagtattgttttagagcctaacaggtggtcggtttggttgacttgccagctgaacaacgtttctcatacttcttttttttttctccctgccctaatttttaaacgcctcccctttcacacacaaacaaagcaagcttaattagattcttaatctttagctttctttcagtttgtttggtcgtctttgtcaaaccttttggatggatggtaaaggggagctcaagctaaaccaggacaccctaatttcattttcggccaatgctttttcattgctacgaaaggtggtcaatatttttttttaaaaatgtttttttatcaacttctaatcacatatgcatgtggagatgatctcacaatgccatactataataaaagatcttaatttttttattccgaatgtgagatcataagatggaagctagctagggtgcgttcggacgtaggtttcaacttctattcccttgttttccacgtgtacgttttttaaacagttaaatgatgagtttttttttaaaaaaaaacattagttttaaaatcatattaatttatttaaaatatttttatagctaacacttaactaataacgcgttaataagccaccgtgttttacatgtataggagagaagttcacaatcttctcttccgagggcatcctaaggccccgtttggtagagctcctaactccaactcccaactccaaactccaactccagtgagagctagctcctctaggagctgaggtaggtaaaaaagtgtttggctagattactcagctccatatttctacatcctttgtcgccatttcatcgaacaccttctaggcgtcgccttgacgttgccgccgtagccagtcagcccacgagccaccgccgccgagaagcccacgcatctccgccgcctcccaagccgctgcgcaagcgccgccgcacaggccgccgccgtcgcccaggctgcctcctgccgacgcccccgcacgcgagtcgcctgccgacgccgccgccgcgtgctgcccgtcgtggccaccggaacaccgcccgcagccgccgccgccgcctgccgccgccgatgcgccgcggcctgctgcccccgtatgctgccaacgcagacgccgccacaaccggttgtggccgtcgtcggaggatggggaagaagatgggccgccgccacctgctggccccgccggcgcgccgcccgtcctcgtcccccaacagccgctctccgccgctgccgcagccccccgccgccagcctccggccgcgcgtgcgtgccgcccgtcgtcatcccgcagccgccgccgcccgccgctgtcgctgcccgtcgccgtcaacgctgccgcagcccgccgatgcccccgcactagctcgggattgagaggaagattgggggaggagagagaacgggaggaaagaaggggtgaaagggtagttgagtggcattttcgtgtaaatacactaaaatattagaaggtagtgggtcttttggggtggagtggagctgtggagcagcaaaaacccagctccacccccgtagttcattttctaggagtagctctgccaactccactccaaaaaaaggtgaatctggaccgtttggcacagctcccgctccaggtaagttggagttgggagctagagttgtgccaaacggggcctaagacagtgatgagctcctcctagtaattagcaagtgcccataagccggtcataaatgtgatccacgtgaaacaacctacagatgccacagatctcaccaccgcacgctccattgaatcatttgcaaggtcgcaattaatcatcgcagatgcatctgaagctgagaggcagcagctagctagcagctgggacctgcaggtgatggattcaggattcgcatatcgatcgtgaatgaatgaatgattccctaattaacccaaagtgttagtgtcagtgtcagtgtttaatttgttgctccgaagaaaagctagctcagccttttgggagctcaattcgacttgctagctactaatgacggattactgttgattaattaatcttcaactgcagtaatgcttgctagctagctagtagtagtactgtactcaactggtaaattaattaactggttacactttgtaggcttgtggatggatctgacgaggttgattaattagtaatttttctgcagaaattgcaaagctagatcgatcgattgatcgatctatcgagcacgagtggcacaggggatcagtcggtcggtccaaggtcgccatcagagttcgtcggttggtctaattacccaactgacctagtagcaaaatactactccctatcattttttaatagacgacgccgttaacttcttacatgtttgaccattcgtcttattcaaaaaatttacataattataatttgttttgttatgagttgttttattactcatagtactttaagtgtgatttatatcttatacatttgcataatttttttaataagacgaatggttaaacatgtgagaaaaagtcgacggcgtcatctatttaaaaaacggagatagtactaatctatagttatttgattttaattgcagctgagatcgatcgagtggtgctccatgtctcctccgtgagagatcgaaagcttcttctttattaatccttaattctgctcggccatcacgtcgtgcgtgtgtgtacgtgcagtaatggccggcgatcgatctccctgtccatgggtggattaattactctctttaatcttcttcttcctcctcacgtcgttgctcagatgataataattcgtggatactacgataggaaggcttagaaattagcttgaatttttatctttagaaagttagcttaattttcactgttgcgattcagacgatcagtgatatgatatgatgcaggtgttgtgccgcagtaagcggtaaccagcaattggttagttatcagttgacttgcaattaagtaggcagacaccggttaaactttttcgtgtcaggattattgttaggtccaatgccaacaaaatactactccgttagttttgtccatatacatcatttcgatctcgcatgctgtttattcggtcaaacctgtcaaaattttgcctaaacatcgcgacaatgaagccaatcaaatcgagcaatagtcgccttgattggctcttctgtcaatggacagatggagagagagagagagagagagagagagtttcagtacgtgacagatgcagatcgaattcgatcactttcatggaaaaagtttttgctgtgaatcaaacagatcatgcaggaaccaaaggatctggaaagaaaaaggatatttgagcacaaggaacagcgaccccaaccttatagcacaaataaagaaagatgcaagaacatggataatggcaggcgcaaggcgacttgaagaattccttctaagttaaccacaacgtttatgtaattttgtatagctcttttttgcctctaggagatgtatttttttacgcctatatctaatgaaatagcacaatctcgtgctgattccttaaaaaaaaacagatcatgcagattaatcttgagagttgagagctactcttactgttcatgcatgcacggatgcatacatggacaaaataaaagggactgacgatgcaaatctacaccactcaatcaattctaatccgagatctaccaaatgtgcatatgcagaacaatttgccatcgagaaaccttgaataattacagcgaaacagtttattcaggaaggacgcccaaaatgcatggcaaaacacaagtagttctgatgttttttttcatacattatctatgacactaacatatcatctgtaaataaagcagaatgagattatagtcatgcgtgtaatgtgtatgtgcatacctgtgtatgacaggctgacagcatataccttctgaattacgtacactgctgaatttcttctttgattaatctattgccttagagtccagattttgttcttttttgtattatctgttggcttcggcctgttagttatcaattgactacacttcattggtcatttggaaaaggaattacaataaacaatcatcaattaagctggctgctagctgcatgacaggccagcagttgcaggtagttccagaagtagtggcacacagacgagtagggaccatataccgtttagtttcagcaacattttgtctataatcaatcggaacaagcaacctgattaaaataagtgcagggctacacaaccaattaaaacaacaagaagacatgagactttggccatctctttgaacccacaaattacacgtgaaacaattcagtagattcagttcataaaactggataagttacaagcaagtttctgacactttgacctgaaacttgttagctgggcaagttcagaacctctcaaaaattacagtactaaactgatccacgtgataaacattatcaccaagaactcctttaaataatctccttgggctgtcggtgagcaaggttagcatcagcagcatggcactgatcttcatcgtccacacaagcatatcatggcccattattcagtacagtactcggcactgtgccagtggcttcatcgtccattgatggagcaatgcaggtgaacgatggtgatgatgttcaatcgctgtaccggcctgtgcatgcatgcgaatcattgaaggcgaaagaacccatcggtaagtagattgcctgtccattcttgacgaccagtagtaaatagcagccgtgcgatcctgcaaataattcaagcaagagcactggtgagttgcagagatcggaacaggaggcgcccacgcggctctcgtcagaggaagaatctggaggagaggagacatggcgctaattaggagtccagtagcagtgatggtactgcgagattagggttctaattagggtctggttaggccattgttgcagcaagttaaggtactagtttgtagtttgcagagatagtagcttgaatgcatgaaggattgggtttttcagaacttgaaactgtgcagacaagttagaaaacgtgtgagatgtttggaactgaatatggcccgagagatttttgtctgaaattcttctagggtggtttggtttgacgaagtttgtggaactagcagcttcaatgcatgaagaattggtttttcagaacttggacaagtttgaaaaatcatgtgagatgtttggagcttgaatacggcctaacattatttgtccgaaatccttccaaagtgtctgaaaatttttccaagatacagcctaggttgtacgtagattcttcctatgtgtggatggttgcgaccttcaaattatcaacagcagcggcgtgtagcgtactattggttgcaagctaccgggcgttgcaacagtcttaacctatgattgattggcacatggaagaacaatcttgggatctcatatctgagtatatatatattactgcaaattagttaacccattactaatccatggctagaattgggctatatgttcttctcggactctcccgacaaaccgattcaggctccgcgttgaaatgattagacacaaccagcttagctagctcctaattttagtatttaaaatgaagatgaattctgcatgcggctacctttgctgcttaatcatttgataggctgtttgtcaatctgttctgcacttctgcctcttctttttctggcagctccattatttgcatgttgtcttatcaaccgcattcagaatttaaattttagaatttaattttaagttgatttttatgtttttttcatcgtagtttgttttataatattggcttttcaattggtaaaaaacaccgatatgaaagttttatttataaattatttatattactactagtaatatttttttttctatggcttatcaactatagagcaaactatattctttgtgggggagaaaataagaagcagccaagactggttgttgattagcaagggccgaacgtaagggcacaaaaagattaagcccatgaatgcaagatgagctaatattgtcgggttaaatatatttgggccttttctagaaaaagaaaaggtatatgtggacctcaacgcgcaggcacattgaatagtgggccaaagataattggaccgaaaggcccatgggcttcccttaggcaaaaggtaattggagctgacgattgccttgattgtcctttagccatatttatgtggttttacttttatataagttaaccacctccaaaaaattttctagatagaaaacatcaattttaaccgtcaacagatatctacatcacaagtatcacaaaatactattacatcataggggtagaatgtacgtgtgtgtttacatagataagtgtgtggatgttatgagcgtatgtgtttctacgtgtttcttaaaaaaaaaagaagaagaaaaaagcttgcatcatgggtgcatgttggtgagccaacagccaagtagcacaactgcaaaagattccccttttagatggacaaatgacaaacatcaacaggttgaatgaagttcagtggatatgatttcattttcgtctcaaccttcaaccaaagttatattgtccatacatccatgagccgtctgttgcagcgtcgaaaaggcataaaaatcggagcatcatatcgctgaaatgaaagaaaatgactccagtggtcaatctccacacaaccattgccaaatatgttatgttccttgaagaaaacaaataatatgcatgtttaagcaggttaagaaagtcatctatgtaaggtaatgtatatattatactcctatataatttgacttgcatgaatgaacagccgtcgccgattttcctcgccggaaacgaaccaaaactggagcagaagcccacagaatgtcactcaaaactgcccagaatacaggagatgaagtcaccaaaagcaggttttatcatagtctcatctgatgagactgacataactgcgtaaacaaaacgctgatcgaattagtcaaacaaacaaaatcagtgctttaccagtgtagtgtcaattctaaaactgcaaagtcaaaacctttcaattatatttcgaccagagaaaggaggacacatgaagctgcaagtgagatcgatgcaattttttttgaaaaaaatctcaagattgacttaagaagatggccatctcaagattgggctaaaataacatatagcccaattcggtcgtctgcattataggagtattatctgtgccaatgtcaatgcacctcttgtcaaaaacactaattttcttatcccaaaaagattgtcaaaagcattacgtatacatggagtgataatgacaccatggtaataaactagtttacttgtggagtgttgatttgcatgtatactatatactccctccatctcaaaatgtttgacgccgttgacttttttaaaaaatatttgatcgtttgtcttatttagaaaatttaagtaattattaattcttttcctatcatttgatttattgttaaatatacttatatatataatacatatagttttacatatttcataaaagtttttaataaaacgaatggtcaaacatattttaaatagtcaacgccgttaaacatttagagaaagagggagtaatataattgcacacaagagagatactcttgcatgcatgcgtacaaggagatcaggagatcccattggaagatcgatactcctcgttatttctaatttgactggttccaatgcatcatcatcgattcatcgatccaatattgtggcgtcatttagctagcaaggggatcgatgtatttaattagtagtcaatgagcaagatataattagtactctactattattttgtctcctaaactttggggttaagtgcattttgcatctttgaactcttcaacgatatattccaggaagatttttcttataaaatatgctttgtttataagcaaatcgatcatcagcatattcgagtcgctagaagctagcatttgcagaattgcaggactgcatatatttacactgctgccccgtatgtttctgcaggataaaggtcattttggtcttccaaactattttgccagagcacttaacccctgaacatttttccagtttatttaatttacacctcgaattattgaaaacggttcaccttactttataatgctatttcttttttttttctctctgtataagtcaccatttgcacaatattttgttaggactgatagagacgcattttaacttacctttaaacatttttagatttttttttcacttttacatatgtaggaaacaagaagacgggtgtaaacatcgaggttttaaattttaagcaaataattataaaaaaattgaaattatttccaaattttgatgatggcatcatctatggatctaaaaagttttagcttaaaatatgacttgtataaaaaaatagaagaaaaatgctattgaacagtaaagtaaaacaattataatagtttagaggataaaataagccaaaaatagtttagagtggtaagtactccaataaaatagcccacgggagtaaaatgtacttttttttattattagtttgtgtaaacaactaaacacgattaagcttctctactactccctctatactcataaaggaagtcgtttaggacaatgtttaagtcaaatcttgggaatataaatcattaataattctcaagttgttgagtttgaaaatgtaaaaattatatgaatagatttgtcttgaaaaatactttcataaaagtatacatatatcatttttcaataaatatttttatagaaaaaagaagtcaaagttatgttttggagaccgtgtcgctgtccaaaacgatttccattacgagtacggagggagtacctcttaattagaaaaatacactacctccaactttccaagtctctgaaagtgtgcaagtaatgtgcatagactcttgcctgtagaaagaaaaaatgcctagtggcagctggtgttgaactgttgcaattaattgccacaatggatggaccttatgctgttgcgaagagtcctcgtcaaccagattaccagcgctttgcacaatcatggtcagcactagccaagttgctgttgttttgatcattcttgttaagatagccaaacattttttctagtggcaagttgccctttcagatatgttgtctgttgttcgcacacggcgacctcgcattccttcccaatctcttgcagaagaacacattaaactagtaaccaacttgtaattgcactgcagatccaatgcatgcagaatgaaaaaacaatgcacaactgtacaccctatgcagctagctgtgcattctcaagatatatcatgtatatgtatatatatagcagatataaatctgtaagcttcagccaagcatggaattatggagtagtactgtaagaaaatgacttagtgatgagtccattatttcagtaatttaagtattggttcttatccattatctaaaaaaaaagtattggttcttatgccatacacttatactacagagaagaaaaatcttctcactttgaaatacagctcagcgtgcaccatgacttatattgaatacagatatgttcattaagctccctccatctcaatttctcattgttttagcatttaaattttttatcaaaatacttgccattatcacatttaaaagcatttttagaaatgtctgtcccatcctacccttcattatctatgcagtcatacgtacgtactagttctcctcacaaaaaaataattgttaatatggaaaagatgattatgatgtaattaatgaggatagcaacgtaatttgtcgcacctcttagtttaatatgagattccctaaaacgataagtagatggaaatagatggaataggatttaccttgttatatgtttcatagcttatttctcactgatatatgaatcttacgggagagatgatctgaaaaaaatgtcctaacttcgaagtaagtcggtaacaaattcccagacgatgcctatatggtatgaaaggaatggtcggctaacatccaagctagtcactaacttcgtcaactagcttaatgtgagcatgacaaatcagaggctaggaaacaaaaggttatctcagatgatcaagaaccaattggctggtcaagtcatcctatcttttccatgatattgtacacatctggttaatgcgtattgaattcatgacttgaaggaataggagctatttgtgcaaatctagctacctgccatttgtttaacatgtgtttttgttgatttgaacatgataagaaataattatatatggagataatccaaaatataccattgacaagagtctaattaatttcacgttttaccctcgactattgcaagtttctgggaatacgaccatacaaacgtcattaaacgtcattgtttaaggagtgctattgtcgtcactgttccattcatgggctttcgttagccacagtggaaagacccgtttgtccttgtgaaggctgtacacaatgtattgtcctacttattttgataccgttaaaattatctttcagagttcctctccacgcaggcaacccctacgtgtgtgccgtcaccgtgactttcaagcgggttgtatgccgcgccaacacccgtcggccactccgccagacagcaccactgctgccgggggaaggaaagatctacttttctttggcccaccaaagtctttcccaaatttgctttggtaaggtttgtgaccttggtctatgacaatgagggcaatttggttattaatttggataaaattaacatttgctaacagaaacccatgaacggaagggtgacggtgatgacatttcttatataaagatacctgtactaccgtattttcttatacttacactcgctgatggcaaaacgtaaaagagaatcccttatatgccactagaatttgaccagttcccttatatgccacttaaaattggcttctctcttatatgccactagttcaatttttttcacacttttatgccactcccaccactatagttttagttgactgttagtcaaatgttagttttttttcttaaatgaccaatataccctctcaactaaaaaatgtgtaaacttcaaaaaatcataactaatttattttaaatcctttttgagtaaacaaaattttgttagaactagtgaaaaatgctatttatattaaaaatattattggaaaactgcatatttcatgcttatattgaaaatttatttgtgatggtaatggctaaaattgcatgtgatgcagaaaaaatcaattttcatatgttgtatcaagaagctatattagtactaaaatacatattattggttgtatactaattctcaagggcaaatgtgtccttttacaataaagttaacggtcaactggcggtggattgacgggaatggcataaaagggaggagaaacttgaatcggtggcataaaagggagaagccaagttgaagtggcatatacgggagctggttaatttggagtggcatataagggattctctcaaacgtaaaatcagatgcatgtcgatggcatttcttggattttctattatgcatgactcttgttcttcgtatcctcttgtattagactagcacactagcataaagccgtcagagttgagttcctaagcataaaccatttgggatgaccacaattctcaccataggttccgttgttttgagctaatggacgagaaacgcccaggggtcttccggctagctccacaaggtggtggactagacgatctaggttcgaagcctcaccccttttaattatttgatattaggtctttccctaatattcgcgtttttgttttgagctaatggacgtaaaaactatatacattactatttcttagacaaccatttctaatttatttgttaactttatactccctcattccctaaatgtttgacgccgttgacttttttaaacatgtttgaccgttcgtcgtcttattcaaaaacttttgtgaaatatgtaaaactatatatatacataaaagtatatttaacaatgaatcaaatgataggaaaagaattaataattacttaaattttttgaataagacaaacggtcaaacatatttaaaaagtcaacgacattaaacatttagagatggaaggagtaatatattttatcagctagacagcttattcgaatagaccttaagcaaaaccttttttgacgtgactacttttgtggaaaagttagacaaaaacttcagaccattgaaatgttttgcatccccatcatcttagcttttggatgcacaaccagtaacctaaattctagagacagaggttgacaactgtattgttattggagatgtgagcccgtgattaagacagtacaaaaatcctctccggccgccgcaaaaagcccctgaaacttgcagattctccagtcaataatgtcttgtctgcacatcggccgggtcagatcgatcgatcgaaaagtctctcagcaaattctccaagaacatatgctcgatcgaagtgtcgaacacctgtgcgctcgatcgaattattattccttcacacgcggagaagacgaagcaatggaggagtacaacgtcgtggaatcgatcgatcgatcgacggcgacctgacctgtcctgcgcatcgatcgatcgatcgctgcacgcggctcgcgatcagccaagtggacttacgccgtcagttcgtctccaatgccaaattgccaatcaaaatgcagttggatcgatcgatcagttcgtaactcaaagcattccagttaatggggcataataagccaaccaatcatcaatcaatcaatcatgcatatgccgtgctgacgctttacacgaccgtgcataatcgatgattagtgtacggttaagtactcaagggagcagccatctctacttaattggttaattatagttagcagcagctgaagctgcgctgtactgaagtttcccttgccgatgtttctcccaacaagatctcccaatgcgatcagacacaggtaattaagctagccatgcacgcatgggtagatgtgtgatacgcaatgcaacaaattaaactcgagatctgctgctactgatcggtgaggtttgcagtggttggggaggaacagcaaatatcaggccaacctggcaattcatattcaggcaaattggcgagacgagacaggggaatatatttgccgggttcctgcgttgcctgggtgtgcctacgtgtaactaacgtgttggtgctagtgtggttgctgcttgctgctgactggtcgggcgagagatctcttttggttcccgtgctattcttgtcgcgccatggtaggctggcatgggaaattctgtcgtctcgctgctgcaagctaggccgtgtcagcagaggttgagccggaacagatccaaacatactggagaaacacaagtggtgtggtgtggtggtggagttatggtgcatatgacttcacccatcaaagtttaaatcatggtgtccacagatattacgtgcatataatatgtacgtgtgcgtctgtactctatcgtataattttgtttaaaaaaattcaaacatactccccgtccaaaataaaaaggcttatctcttaaaaaaaattagtaagaaagaaagaaagtgtccagtattaataagaaattaagtagagtatcgatgggtactaagtagataacatatactcctattaaatagacaaaact

SEQ ID NO: 16799 - DNA, 4719 bp, Oryza sativa
agagtagagcggaactaccatattcattaggctaaactccaaaatttacatataatttcctactagcaattgacatcggaagtgaagtgttaagtgggtttattcggttgaatacggaatacccatgttttagaaaatagctctctatttaaacttaaaactagcgagatatatcttattttcatcactgatatattatagtataaagtttgaatagccaccatcaaaatctaccacacgcctctagccaagccgccaaggtaaggatggactcaacattcaggggttcataaatacagccacgcaagtcaccggagatgggaggggagatgccatggcagaaacattgttgggtaataggtgctcaaatttgtccctttttagtgtgtagatcaagtttgaacttgagtttttgtggagtgaagaatatcactctgcattgtcaaatttatttttgaaaattttcacagccattcattcatatttaatttaagaaaaaagaggtatatgagggacatgcactcaagtgactaaaatccattttatatccaatagtaaaattcattgacatggtcatactgatttaatatgatcattgccaggacactcggatttgacgttgtacatacatgatgcgcttccaaaattaagttacatcgaaatgatgatctcaaccaaataatttttcttatcctaacatgggtggttccttatagaagtgctatttattcgacgagggtgaccgattaacgtagggttgggttgacatttatatttggggctttattttccattcaaccatggacctttctggaaaggattcagaattgattgtagttttgataattacagttcaaccatacggtatataaatgaaaagaagtcaaagcaaaactgaaccacaaaagtcaatcaactaaaaaaatgtccagagtgatatgcagttaggatatcacttgaacaaccagatggggagcatggcaagtttgttttttctttttcgagggaatggcagtttgttgctgcaaaatatttttcaatttagaaatactgaacccctgttggatcctagtccttactgttactgtaacagtaatattttagagttttaaatttttttaaagcaataataaaagtaccaagtgtactcatgcgtagggaaaaaaatcacagcaagaaaaagtatccattattaacaaaggagttatgtaatttttttgtaggaattttacatgaattccctaggagctgagagacgatttgatctcatgatcatctaactggagcataaggagagaattaaccttgaatgagctagaccagtcttatctgtattaatttgtcgtctctccaacatgtgagagagacaaatttggttacaaaactaatggtacaatagataaatgaaacaagtgtatgtcaccacttaatccccataatataactacctttgcaactgataaatatgttttttttaataatttaccaaaaaaattacttatacttcctttaatcaattaactaactaattaaccaaattaactaaaaattattgctgttcttgctgctggcagctagcttgttgctttgttccattccacgtgtccatgaagcggcttatcctgtggagtgcaagatccagcgtgtccaagctcatgttggcgaagcacaccctgaaccagccggcctccgagcaatggcacgacgaccccggcgagatgttcagcttcgcctggcgcagcagcttctcccacagcctcagctcgccgccgacgccgccgccgccgagcagcagccgccgcatgtccatccacacgaacagcccagcattgccgcgcaggcacggcacgccggcgcgcgccagcccggccaccacgtgctcgtgccgctcccggagccggcggcggttggtgcggatgtactccccggcgaacgcctcgtcggacagcatcgccgccagcgtcttctgcgtctgcgacgacaccagcgtgaagctcgacatccgccgcgccgccgtcacgacggcgtcgttgtaggagtagaccacgccgacgcggaaccccgggaggcccaggtccttggagaggctgtagacgatgtggacgcggccggcgatgccgtcgccgccgcgcgcctcgacgagctccgccacgctgacgaggtccggcgcggcgaagacggagccggagtagatctcgtcggagatgaggtggatgtcgttgcgcgacacgaagtcgaggatgtcgtcgagcatcttgcgcctgaccgtggtgccgagcgggttggaggggttggtgatcaggacggcgcgggcgcgcatccccaccgcggcggcctcgtcgtacgccgcctggagcgcggcgaccgtgacctggaacccgttcgcgctgtcgcaccgcaccggcacgatgttcacccccgtcctccacctcaagtccctgtcaaacctgcacgccatggatgtcagctcagcctgccactctgctcgatcgatcccaagctagctagatgcatggcaatggcaatggcaatggaacagtggcttacccggggtagtaaggggtagggatgagcagggcgtcgccggggttggcgaggatgaaggtgaggagctcgttggcggcggtggcgccggcggtgagcacgatgtggtcggggtcaaacctcgccttgccgccgcgtatcttccccatgaagctcgccatcgcctgcaagcaacaatggtggccaagcaagccgccgccatctcgatcagtccaccatgcatggcgttcgagccaagcaaagcaagaattgcaaactctctctctctctctctctctctctcacgtaccttcctgaagctcttgaggccatggtaatcctggaacagcgcgttgtccctgaagctaccggcgccggcgccgccggtgctccagccggcggcctccgggtggtcacggaggtaggcctcgaggaggtcgaaggagacctggttctcggcgaggcccatctgtatgacgccgtcggggttatcgacggcgtggtaggggtcctcgtcgtaggccttccacccggcgaagtacggcgagtcctcgccgtgcgccgccgacgttgccacctgcgacagcggcggcgccgacccggcgaacgccgcagcaggcaacagcttgccacccatgatgttctctctcgttctctcagactgaattaatcttgcagtgcaaaatttatatgcaatggcagtgtaggaagcaacactgcagtacaagaggcaatcaagcaaattaaggtttttgggtgtgtgagatgagatgatccaaggttccaagtgtgggaggggtatatataggcaaatggaagtatatatacctatgtgaaaaccactcatgatcatgtgattgagatgtcagaggctgctcatagctgtatgcatataggagggttcactgttgagagatgaccggacttttttagctttcagaggattaaagaattggagctcgagcttgaccaacctatactaactactaagcttgatgattctttttgcccaatgattgattgctcactctctctctctttctccctgactgacctttcagtaaaggaggaagttagcaatacagacagtgtagcgtagtacagctgtaatcagaaattcagatcgtcgtctgcaaattaaggcagcttccgttgtcgccattctccggctgatcgaagaaattcaacagatgcagcagcagcagcagctcaagccgtcaagcccgtgcgatcgtgtctacaggtgttacgccttatcttctcctttaacccaaccctttgtttaatccaggctaatgcccacgtcgtcatcgtcctcttcatcgtcttaacaaaaccagctaagaaaaaaatttatgactatagctctgttaccatattaagttttaatttatcgtctgcaggtttgatggttatgaatgtcactcggagtaaaggtaacgaaggcatttaaatattttataatgtgtttgacctccaaatgccagcgattaaacaaggttattcaaccctgtaaccatggacgacttgtctagctagctatctcgagctgtacgcggggctaaggattgcactgaaattaatctcatatttaaacaaaccgatcagcaatactctgttgagatgccaatcaaccatctctccctcgaattaagaatcaacatatataaggatggcctctgctcaccgattacgagaccagccatttgattatgcacctcatgatccacgaaagtactatgatagtacatccgttgccgaatcattgcatgttgcaccgcgatatatattcacaatcttttttcagtccaaaatcctgtttgctatatatattttgaattatttaggaccattattagttatgtattacaaggtgttttagttttatcgtaagttaaacttcttcaactttatcataggtcaagtaatatcgacaacactaaattaatttatttaaaaccaatcatcaactatatcttgatgatgtatttatttggattatcaatgtcctgggtaaaccttccattcataaatataacgtggtttacacataatgtcaataaccaaattttaacttaaacatcagatacttatgactgaaagaaaagaaaaaaaatctctttaataaaatttatgtctcgtgcagaatacaatacgatttcatctttcgtttcatcagaaaaaatctgggacgga

SEQ ID NO: 16800 - DNA, 8820 bp, Oryza sativa
cacgccccatttcgggttttatgcgacactaataaacagtattatgtttatttcttattcgtcaatcctacttcaattacataaaaatggggggtattctcttggtaggattctagacatgcgaataatatagaatccaaaaaatacattgatcattacatggaattctattaagatattatatgaaagtcgaatttcttccactctcatttgagagtacgaatacaaggaggtattttgtgtttgggaaagtccgtttgagaactctatccatagagtagtataggccatactttctttcttcctattttgattctcgtgaagtgtcctttcttcctacagctgatagggtaaaatcgttgttttgacgatccctatgtagaaagcacccttttctagtaaatattagaaaatttgatcctttcttatttttctttctatagtggagatagtcgcacgtaatgacagatcacggccatattattaaaagcttgtggtaagaaggggtttcgttctagtgcccggaaataatattccaaagcctttgtgtgctctccattgtttgtgtgtataaggcctatgttatagagtatataacttcgatcatagggatcaatttctagtcgcgtagcttcataataattttgcaaagcttccgcataatttccttcggattgagccaacacagagtaaaatctactaaaagtaccacaaaaaaatggaatttcatcaacatctgaatttttgtatatatattatttattttattgttttgtatctagcaaaattgtagggtagaacgacataatagatcctggcttctccatttaattcagagaaaaagaggtatttttgttcatggaatattgatagagaaaaaagccgactatcggatttgaaccgatgaccctcgcattacatttatagtgtaatgtgatgcctccggtactacttgaaccgtaaaatttctcaacattgaaatattgtttgcatgcttggaaaatgcagcgtataactactccctccatttcaaattgcttgtcattatagctttattagtttatcgaaattcctatagtttaatatcataaaattcatgtttttagattcactaaaagaaatatatttcatgttgttaactatacgaatttataataattggtcaaagatatatcgtttgacttaggataaaattaaaatgataattaatttaaaatcgatggagtagcttacttggaccaaacctgtcattaaggagtacgaaactttattacaacactgaacctaattgaaaaccagaaaagcttcaaaacctagcagctggaattggcacaagaatggaaacaccgcggtggttttgcaaatcagctttggcagaagaaaagagaaaaccacggaacctcttcgacggttttgggaaattgacatgttgtatatttaaatattccgccgtgcctgattgaaaagcaacagcaaataatcgacaaaaattaagtggctaaccccacgtcagcaacataagcatcaccggcgttggtagcactagaaaatggatggcagatttcggcaatgtttgatgtctccttgttgccatatatggttgcacttttgggggggtaattaaacataacaaattgtagttaggtgctctggttagtttaattcatgttgccgtttaaaatgtccatatgcaacatgcatggtttccttagttagactttgagaaaaaaaattcttgagcattatattaattagcaaaattattgttttcttaagtaagctaaattttgtgcatgcgtgtggcccttgaaaatgtaaaggtaatcttaatcgtccttgaagatcttgtttatttaaagacaaaaaaaactctttttttgcagtgtttttggtgggctctgaagggagaaatgtggattagtctaatgtcagacaacaattcttcaattaatccctgcagggagcatttcctaccttataagcagaatcaaatcaaacatgacatctctgttaggtgagtttccagctgatccctgctaattccctatggatccaattgctagcttgcagaatcagatcatgataaaaagtttcttgattacaatctcatcttcttggcattacctaagatacattacagattgtcagttaggtgccggaggagtctacgcataattttaagcaagaaatgcattattattgtacattatgtcatgaagagattggctcaaacacaagctgtgatgtactaacaaagctgagtcttggagacacttggcagagtgcatatacgtacgaaatacgtatgtaaagaaaccatcgtataaacatatatacgtcgtacgttttgagttccagtcaatgtgcaaagatgtccatcagatctctgcatgtccattaaattggagctttgacatgtacacttatttagcttgatgccatgctaattaatctacagatagataacattaggtttaagataatgccataagcatcatcctctctctgattgatcagaccagtgtatactccaacagaattgtatatgtgctcatgtgcaccacttttgagaacactagctagctgtctggtgtgccgtgtgctacccaaaaggcaactacgacagagaaccagctatgctacaactttatgtatgcataatgaaatttgacaattaattagcacacgttggtggagtagttgtttacatttgattgtgtgattcagctggatcttacacactacagtacaagtgcagcacaccacttcagagtccagcaggcatatgatgttcctgcaaaaggagagacaaccaacaaacagagatgatctcctatagtaattaacaagacaattatacattattgtgctactgtcggcaactcggttaatttgtttacgtatcagacaatatgcagttcatgaacttggtcacttcccctttgcttggttaaatggaagtattcgaggcgttaacaagtgaacaagaagacgagcaccaagtgccaactgatcctataacttgaaacctgaatcggcgagaacttctgcaaattgcatcctcagctgcagtaaacatcgtaataatatttactgtaattttttatttatagataacggaatggaacctaccgtgaaagcagacggtcaaaaaagaaaaccagagagaaacgtgtcacaatacaaacagtatcagggtctcatcggatggtttgtttggctgaggcttgggcttaggcttttcagccaacacagaggggcccgcatggaagttggatcatatgtggtggctaattctaggaactctctagtggctgtacatggaaaataaaaatgccaataccacaaactaggagctacaagcaccggacataaaagatccctcatccaaccaattaaccaattaacccaaccgatgaaatggctttgcctgaattgaaaagggcttatttggctgatcagcctaagaatacaacttaccgatgaggacacacggtgtccttgtgcaatgtctatacgtcgcactccatctttaccgtgatttcagcacgaagtttttcccccaccttctgcagaaatggcacatccatcctaggtgttgtttatttcactgaagaggtagataaagttaggccatgtaaacaagaaaattattagcgtataattaattgatttttaattattcaaatttaaaaaataaatttatgtaatatttcaaaatgacttctatataaaagtttttgcatacaatgcaccattttacagttaaaatacgtgctaataaaaatcgaggtaaaatctgtgttttaatcagaacaactcactagactaaaaacagctatagagaggaggaaaaagaaaaaaaaaagaagaaatctatccaccacaaaagcatcacaagttgtctcctgtctttgtacaagaggggtttgcgatatatttcgcgggacaaagagacattggagactttatgttctctttccccaacttggccaagtggggttcaacatgtcggcgtaggataggaaatgcgatgtagtcctgtgtggcgactctccccggagacggtgatcgatggatggatacagcgatgaaagctgagtagttttggagacagatcgagaggctgattcccgtacattggaccgtggcagtgcaaggcagagcagatacatgaatctgattacgatttacgagttgccgatttcgtagctctaatttgcagccagccactacagtgaaatatagagaggaccaatagatgatagcagctgcagcctgcaggctcaactcctccaattggtcagataattatctcgacagaatgaacatggccagattcaacctgaccctctcccgcgacaccgcgaggccacaaaccgatcgaattggagggatattgggaggtaaggtggagcgagattcattcatcgccggtgacctcctagagggccttgaggaggaataggcattagggcgtggaggtggatggacgtacattaccattaccactgtcgatcgacaacaaggccaagattagcttcatgtatgaaacttgatgattcatagatgagggacgttaaatgtactctttccatctttcgatgagtgtgggatgggtgggccgtgatgggcttttaggtcaatctgctagcaaattactacggtttcagcccaatacatataaatgacttagggctggttttgtttgaagctaaaacttatcacaccaaaatattggtatttttaacggtaattttggcaatgtttggtttgctgccaatactacacaaaatgttgtcaaaatggtgatgctagcaaaaacttgtctatgttttgtattgccaatattttagcatggttataaccaagcaagcctttgtagattttgagctcctcggatcgtattgtatgtgctagtagcccaccaccaccactactactaccacttatacagtagtcataagagtatgtaggccccatttgtttctgattatgatgcacattttagctcggtttttattagcatattttttaaaccgctaaactttacatttcatatgaaaatgttctaattgctataaaataccaaataagtcattttttaatttttataacaattaaaacttaattaattatacgctcttacgttaccctacttaattctcatcttcgtctgttttatcaatttagccatagtgcaatactcagtactcaatcatttctattataattgtagttgtgagtttatgtagttcactcctagtactctccgtcctaaaaaaacaaaccatgggttttcgtgtccaacgtttgactgtccgtattatatgaatttttttataattagtatttttatttttgttagatgataaatcataattaatactttatgtgtgacttgtctttttaaattttttttcatgattttttaaaataaaacggacggttaaacgttggacacggaaactcacttttttttttcgacggagggagtactctctaagccgagtccatgtgcgcgttcgctgacacacgtctccaacgcaaaaaatggagtactcctaccggtagaaatgtacagtactcgcagctactcctgcgatactgcgaggtagcgaaacgccatcgtacgcacgcgccggtcgggcggccgatcaggaggaggcgcgacaggatgggacgcgacgcgacgctcgcgcacctcggcacctgtatatccggtggtcggcccgtgcagccaccgcgagcgtcctgggaattcttaaacgttgccacgtctctcggacaagatgggaataaaatttttttagtctctatcatattcagaatatttcgacactaattataaatattaaacgtaaactattaataaaacatattctatatcttgaactaattcgcgagacgaatctattaagcctaattaatccatgagtagcctatgtagtgctacagtaaacatgcgctaattatagattaactaggcttaaaaaaatttgtcacgtgaattagctctcgtttatgtaattagttttataagtagtacttcctccattcctaaatgtttgacgtcgttgacttttttaaatatgtttgatcgttcgtcttattcaaaaaatttaagtaattattaattctttttctatcatttaatttattgttaaatatacttttatgtatacatatagttttacatatttcacaaaagtttttcaataagacgaatggtcaaacatattttaaaaagttaacggcttcaaacatttagggaatgagggagtatatgtttaatactctaaattcatccgatatgacatgggactaaaatttagtccctgatttaaacaacatctcattgcaacgatgttactactactcctgctgtaggagtactcggcatggcatatgcagtttgctctttgtcttgcaaacctggatggcctcctccatcgttgtgcaatcggtgctgcacacaactcactctgccgcgtcctgctcctgcatgaggtctgggagtgggagggagaggctgctgctgccgctgctgctgcagaggctgcagctgaagaccgggcactcaggggaatctgggcggttggcctcctctgccggtggcagccacagccacaggagtgcagccgcaaactgacaatttcctgcactccactccactgatccacagcatcagccagccgttgcccagtccaacccctgcactttgcactgcatctgcatctccatctgcatgccacgccacgacgtgcctgctgcttggcttggcttggcttctgttgccgtttctctctgctgctgcgacttgccaaacccaaaccccagagacagagagagagaagagagagctgtgagattggttgtatcggactttgtcagttgggcaggagcatatctgtacgagttgatgcctctccttccttgtgtttcatggcgtgccctgcgactccagactagctctacagtagtagtactgccctccctcttgtctgtctcccggcccagcacgttcagatcatttcagttaccactcgagtaagagcaagtttaatagtatccagccacatgctctaaatcatctatagttaatttaatagctaataaatacaatagttacctataacatatagtacacaattaatacatagtttttcttatcatacgcacatgtatcttggagcccatgctacagctggctataaatctatagcccgctgctcttctctctcttcttttatctttttaaaatatatttataactggtttgtagtctgctattaattgtacctgctctaataatcatagatcaacgttccttctatacgccgcttttaacaatacacagcgtacactacaggagtattactcatgtactccagttcaccattctgcatttgtcttctcctgctctggtgcccggttaactggcctaatgtattcctatggaaactaaacgacatgcactgctaaatcaatcgtggcatatctaatggagttcaattacttccacggactaaggccataatattttctgattgagacgtaaatttcatcttgatattttagcatatgttttttagactcctatatatacaatgagttttagtaaaaacattctatataaaagatggaataaaaaattttaaagtctaatcatacattaataagttatctcgttttagtcacgctaaaattctactattatctttatcgaaacgtacgcttgcggagtacgcgcgggatgaatgtgggcaaaacacgcgattcacggtacacgtaatagccactcctcatggttgatgtatgtctattcgatcactttgagtactgacccctgatcactacttcgattctgacccggcaccccttccaatcgcatactacaccctacccaccgtgtactaatcgcggttgctctattaattcaaaacgagttttacacggtgctctgcaatatttcccatgtgattatatatatagcattttggcaagtgaataaaattgttctcttctcaaacacgtaaaaggtttgtacgtcaattcattaccaatagtaaaaagcaccatcagacccatcatttcggcgtacttgtaaacggaaaataatttgtgaataaaacttttatatacgtgtcttagcgatctaaaagcaaaaactgaaaataaatttcgatgaaaaaaaccccgaaatcaactctggatttaacgatcaaatattcaaattttagctgataaatataagcataagcaaaaagataaacccacaattctatagaaagagtagtaggagactaaaaataatgtggtattacttgtaatacacccatcatgttgttgtgatgggcttagttagcactaaactaatgacattgattgcattggcaatcaggcactgacacaaggatccgtatcctttgtcctatagtgcagtactcctagagaggtgaaggagagaagagaatcaaacactgatcagccatagctgccgcaacattctgcagcaacccaaccaacaaacccaccctccgctttgactggcggtttcatttcagcaaccctgcaagccgcaacgctttttgtcgccttcccaagaatagaagtccggaccattcaaacccagtccagtctccctctctgccacctgcccccacctgtccctgctgccacactgcgccgcgacgccatcggagagcagctcggagctcagagatgcttcttgtacatgtcctctcgctccatctcttccacttccacccaccttgtcttcttcctccacctcctactacttatttgcctcatcaccga

SEQ ID NO: 16801 - DNA, 5094 bp, Oryza sativa
ccgccgccgctgccgctggcggccgtggaccccgaccgccgcctgctcgacctcggcggcagcttcacctcgctgctcgcgccggcccagctgcacaacggccacttcaccaccggcttcctgctgggcaccatgtcgtcggcgccgccgccgccgccgccgccggccacttctacaccgtctcccgcgccggccgcacacccgccggtgtcggacagcatctgggccatggggtggccgcacctctccatctaggatcgtcgtcgtcgtcgtcgagctctgatcaccattggcaacaactcgccactaatctagccatcactcccaagtttcatctggtgtgttcgtagttgcaccaaaagttatcttttttgagaggtttcggcccagtagaagaagtcattagcatagtgttaatcgcctaggttaagtaatcaaagagggttaattaggagggtttactcgaattaagatggttgatgcatgatagccatgtcaatccgtgtcgtctcttgtatcaaagcttcagagcttgggctatgaacatgatccatggtggtttttaattaattgccgtcccttttttttttttgtcgtggttgagatgatgcatgcagttcatttcgatctttgaatccatggaattccggtttactgcttgcgttgaatgctgattgcctcaggccttcgagcccatcagttggcctaataagccaaagcaaatatcaaaatgatgtcaaaatattaaaatttgaatttttaacttgattttaaatttgattttaagatattttcaatgtatttttttattgttgacttttaaatcgctacgaataaatatataaaagttttaccatgaattaatttatactctctaataaaatggcttattagaaaatatggacaacctatacgactttttcaatattgttaccactagattatttttggatgattttcttaagtttggggttagacttgtttgatgtacagggcaaaaaccgcgattcaaatctgggccggatcactagtatagattgcggcccagactgcatatggactaaaaatccttccaaaaaaaaaaaaaacagcacgagctgcgctatcttggtttggttcaaacagcacgatgattttagtggctttgttggcgcgagttgggtggtttcccgcgctcgtagcgtggcaatgttgcagcgtgacgagtcaaccaaaaatagcttgggggtctcgaatcgtaccgcactttagccgcaaacggccgaccgactcgactcctccctccatttcgactcggggctccggccggcctcttcttcttccggtgagccaccgacaattcgattcttacatttcgtgatcgatcgattgatttcgtgttgtaatcttgcgtgatcgatcatggtgtgtcaattaatggcaagggcgtggtcatggagccccagcccggctcgccggagaccgccgagctgcccgcgcctatggtgctagagccgccgccgccgccgtcagatgaggcggcggcggaggaggaggaggccggcgttaagcctgataggcaatcatcttcatcgtcttcgtcgtcgtcgtcggaggaggagaaggaggtgtccaaggacgtcgcggtagagaccagcgtcgtcgtcccgtcggtggtcgccgcctcgccggacgatgaggccgccgccgtcgcttccggtgacggcggggacgttatcaaacacgacgatgaggccgtggtcagaccggacgattgggcatcgtggccgcagcagccggctcagaccgtcgacgacgtagcggcggcggcgacgacgacgccgcaggcggcgccggagatccagacgatgtcgctgcagccggcggcggtggcggggttcgatccggagaggatccccaagtccatcttccaggcgaagcccccggggtcgtcgtctcaggcggagtggagcgtggcgtctaacgagtcgctgttcatcatccaccacggcgcccggccgttcggcgacctctgcggcttctacgccggcgagagcaggtcgcatttcgactacttctacgacgaggccatggccggcgccgccggcgaccacacgtcggactggaagctggccaccgtcgccgaagggtcgcctggtggcagcgcgcggtcggacgccaccgacggcggcggcggcgcggccaagcaaaaggcggccatcgacttccgccgccacgagagcggctccgccggcagctcgagcaacttctccttcgccttccccatgtacgccgccgacgacgccattgtcgtcctcttcatcatcatcatcacgagaaagaaaactaacccccctcatctccattgcagattggcggagacgacgacgtcgccgaggaagagggactacggcgggatgtaccatccgctgaagaaggaggcggagcatcagcaggcggcgtcgccggcgtcggcgttcgaggagatgacgccggaggaggagcggcggcggcggcggagctggtggtgctgctgctgcggcgagtgctgcggctgctgctggttcgcctgctcgtggtcgtcgtgctgctgctgctgccggtggcggtggtgcagccgctgcagctgcagctgcccaaccttctgccgccgcaactagtgcctctctgctcctgaccaagacatttttggcgggaaaagatgaagggaaaaaaccgagaccaactcggctaatcctgatacagccatagttaaattaattattgctaccagattaggcatcactgcatgagaggatcatatcatatgtatgcatgtgcagatgggtaaaaagatgaagatgatattgttcactgttgacaaggaaatgttatgctaacctgcagatgggctgaggtaacaaacaatatcctggtatccaagagaaaagtacatattctaatgtaggagtatataattccaacattaagtaggatgtacaagcacagaaaacaaccaaaagttagttatcttggcacatttgcgcacagttgctatgggcaaacaaagccctatgagcaaattgagcatccatctgctcaccaacattaatcagtactactagcaatagcaagcctaacagaataacagcttgcaatactttagaagaggctactatgttaacaaaaggtgcgagatgtagtgttagtcctgtcacatgtgatcctttatcttcatgttgatgcacatatgcagggattagttccaggtaccccactgccatctgatccccggataccttagcgtccaaactgatgtcgcggcttggcggatatcatcgctggagtcggcatggaaaagaatggtcacctcgcaagatggagcacagttattaaacaagggtgcaagatgaggaacatccttcaatggcggtagatgaaacaggagtctcctcaaacagcttctaaactggttgctggtgcataacatcaggcaatgcgtcatttcacatgaaaaccgaggggccaacttgacttcgctgatgccggcaaacagctgaagaagatactcgggcttcactgcttcaaaaagttcatatttgtttgtagaagtgggcagctcaagctctaatgtagtgatatcatgattctctgcaaatacttgcaagagggactttagatccaatgactctatccgcagatttttcaaactcacaaggccatcggcttggacatttggtccaagtttatcaactgttaacttcagagtaaacatggatggggtatccaaaatgagcatatctggtcgaacacatttcagctcaagacgaaccaagttaggcgcacggattgttaatgaccgtggaacatttgatacctcccagtggcaagtctttagttgatgaaggtgaatcttagggtccttgagccctccaactccaataagattgaggatctgaaggcaagggaagcactcattcaatttgttgagatcctcatcatctaatctaatgaactcaagtgtcagatgagtcagattaggcattatctttagcccgtcaacggatagccatgcgttcttcagacgcaatttcaaaagactatgacctgcatgtatagccgaagtttcaatctgagaccataccaaggtggaccaaattgactgttgaaatatcaagaactggatgacatataaagtgtatgcacatttactatgcattccagcatcaggtaagcaagatcaagttttcacatgataatgttatgagtacaatagattctactacttgtttctcatcgttcatggccatctttttattcaaacttccaaagtgggctggtgattggcgagcagcaagaataagctaaattttcggaggataataagccacactttcttaagcattatgcacaagtgaaatacaattgcacacacaaactaaaatctaatataagagcaacaggtttaaccataaatttcctttgtgcaagcatttgcttatgtgagaagctaactctaccacgagattttcaaacaaacagagcaatgatatcatcacaacaaggaacatgaaacaagcagtaaaaaaatgcagagataagagagaattacagaagtgggagatgacaggaagcgcctccgccttccgccagcacgactgcggccagtagtcggcgacgtccacctcccggagagcgttgccggcggcggtgtccgcccacgccaccacggcctcccgggccgtgaggtggaggtcgccgccctcgtcgaactccccctcctccacccacgtcgcgtcgtccgggtggccccacccctcggacgcgtcgagctcgagggagcggaggtgcggcccgaggagggacgcggcgttcccggcggccgctcggatggcggagccgccggggggcccgcccccgccccctccggcgagggcgacggagcggcgccgtgcgagcgcggcggcgcggaggtggacacgggagcaggcgtaggaggcggcgaggaaggcccgcgaggcgaggcagtacgccgcgatgtcggccccgtcggcgacgcggccgaggacgtcggcggcgatcgccgccggtagagaatcgaaggggtcgccgccgtctgctgacatgtgtagcccg

SEQ ID NO: 16802 - DNA, 12317 bp, Oryza sativa
  unsure (1)..(12317): unsure at all n locations
accacattcacagtaaatgaaaaaaaattaaaaatattgaccgaaattatatcatatggggaggggggggtggggtttcgaatagaacctttccagaattttgaacatgtacatatagtcttttaataagatgaaggggcatgaatggtcaattgtcatatccaaaagagctggtaaatactacatatgtctcaaaaaatagaaatatttggtaatgaatatggataaattcttgtccagataaaagttggtgtattttggaatggaaacatccgtttgttaatatttttatgtgcatatgttcactctttttatgtcctcttatggattgtagagttttgaacaggtatgcaaaatatatacataatcgcatctctaatttttttctagttatttccgtatagaactgttatccaacactatatggactcaagattgaatacgagaaaatatatagtatccaaatctccttttcttttttagttcatatattcagttattcacacttcaggaagaaaaaggtttgcgataaaacgtacatctattaaacttgttacttttactcagtaaatagtctactacaccaatttactccgtaccaacaattaaattataaaatcatccatatagtgataaaaggatactctgacatagaaatttatcatattgagcggtgctagcattacttcctcaaacaaaaaaaacaatcctgagtactttcgtagtatcaatcaatttatcaatgacacagtgattcgtgtatcttctgtataatgagtttgtaccttaaagcttcactaatttatcaatctggaaatttaggggattcgacaaaaaaaaaatgcatactttctcaaactatcctgcattttgcttctaattttgctccctacaaaagtttcaaaaactcttcggtatagccatcagtgatagtttgagaatttagcattagctacaaattttcacacaagaaaagatctgacaacatttcattgacgcatgggtagctccaatcacaattgaggatgaggaactacatcaactttggtagtttggttgcctcttcccatctgcttgttctttaagagaacctctcttctcttccgcatgagatatgtcaattgaagaactcattcagctaagctgcgtcctccacaactataaaacccaatgtgggagtttcagtaaatgaatactctatatcttgtaaaaacaccaacaacatggctttgcagactgcgatccaatttccgacctgcaagtctaccataaaagagaaataaaaacaggtttctcaatcaggtgtgcatcacgcaagtgttcatcatctatactactattaaaagaaagtagtggtggtgctgagtcttcaaccatcactgacatgtgggacaagatattgggatttgggtgagtatagtcgaactgcagctctttaattttctaagcatagcatttttgtttgttctttaagatgaaaggtcttgtttcaaccaattaaaaatattttcaacaaggacttaattttgctatttttaataatccgttgcgatcaaagggcatttggctagtattggaaatgccagaacaaatacatcagtatgcaacttcgtgctttatatcacaaaggtgaaaagaatgttcttttccagtatatgaaaatctctgcaatcaaaggacaaaggacaacagtaaatatagagcaaaaggcataaataatcacctagttgtcaggaaatgagggcaagatgaagcatttgaaatccttgtggtttcttttggatgaacagaactgacaatcaacacagctccagcacgcagatacattcgatatgaggagtgtgggggaacatatctacaggtattacagtcttcagctcgtagcatcctttcaaatctttttcctcctgtagacaaattaagtatttaattgaagtggctatgcactaagaactaaaataatatgaagtaatgggtatcttcaataataggacaaaaacataccacaccatgacataagtaatccaaatcccgtgcacaggtagctggattacatgaaacgtacactattcgaggggctttaacttctagtagccacttgattagcttcatatgcatccctggccgattaggatctgcaaatttaatgatgtctattaggatctagcaaagcagtgaaagcattgtagattctactcatcagggataactcgaattgctacaaaaaatatgtactaacagatatgtgccaagacaaacctgatatgattatgtcaggtttcggaaattccttcccaaatgtttcattgattttattaaggtctccctgaacaaatgtagcattgctgataccattcagcttagcgttctttttagcatctgcaatggcttcaggaactacttcatatccatagacatgctttgccctggtcaaatcagaagaacatctactaatcatgcttttcaataaatgggtaaccgaatgacgaatgctcaaagttttgtgctaagacttgaaacaaatgaaaaaaaatggcctcacatagtagcaactgctctccaacagcatgataatagtgagaaaatttaccttctagcaagggtaagaccaatggttccggttccacagaacaagtcaaggataatctcagagccatctcccttaagcccagcagattccccaataagcttgtacagaacatcagcctgcagtacatgcaaccatgcaggaaaaactgttggaaatgctcaagcactagacaccaaaattttagcataacgtggaaataactgatacatgaactggaatgtaagtcacatgacatagatatgtcaatacttcgaacctaacagagcattaacaaacctgttttgtattagtctggaaaaaggagttggcagatatctggaatgtaagtcctctcaacatctctgtaatggttggtttcccatacaaggtatattcttcttcccccacagatgtattgccaacagacgtattcacattattcatgatactgacctacatcaacactacaggcatatcaatattgtaggaagaagtaattaattatttatttggcttaaaacccaacgggatttctgtacagtagaactctgagtgacataatagtcagtacatgaaaagtattttaaacattacactgttcgacatagtacacttaaaatgagaaggcaccaattacataccacttctggtatttttgtgatattgttaacaagaggctccaatagctctggcttataacatgatgtgacaaaattaaccatgacttctggagctccagtggtgatatttctggaaaattaacaaaaaaccaatgttcaaaagtgttcatcatgcaaaaaaaaaaggtaagaaaagaaatgttcaattggtaacaaaaggttaaaaatttatttgtttggggagggaaacaacatgacttgtttggtcatccctgtcctatcaaataaatttacttttaactgaacaattatagagaatgtgtttgtagaccgagatatttggcagcagctaatgaagccaaatgcactaacttcagtaacatgtttaaataccaaaatgatgctgtaccaatgatcgaaagatttgctctgttgtaaaagaagttcatcaatatcctagtgctagaaatatagtgcccatgactgtaaaccgaataacatctgcatgcactatagtctttatagatatactgctacatggtaaaaatgcaggagggcatcatacattcataggtggaactcacaatcagataggacaccataccttccagttcttatcataagatgtttgagaaatccaacatgcttgtgcacatcataaggtgtgagaccaagagctggatccaaccatgtttcttgaacaatggcaagaacctgtaaaaattagcagataataaattaaacatcaaaaggaaagtcctcagaaccactctgctcactagtttgacaattgcttccaactccaaataattagcacgatggtccaggcaatgtatctgtgtacgtacttaaactgactctcaatatgtgtagctttatgcggcatgacacaagcaatttagcttttaaataattatcatgttacacagttctacttatatcattttgtgacaatcataaacaataccatcctagcaacacaagtgaatagtgtttgtttgtccaaagtatgttattccaatgcacaatctcgttaattggtgtcaacagcatgctgcctaagctgctcttgttgggaagttatacaaaggatgtgttgccaatgcaacttcaagctagccaaccaaatctaactataaatgttaaatagtggtgatgctgcaaccaccaagtaacacaattcaacaaaatctaaattttaaatctacaacaaaatggacataatccaatacatcattattgaccttttcttttttaccttatctgccggctcgctctgcagcaagcatttctcgacatgcagcaccttgtcgaagaaccctggcgcgtgcaatccaagcgaatagccatcaccttcaactttttcctccttcaccacctcatcatccttctcctccttccactctctttgcatccatctctttgttccaaaagagaactccatctggaaacaagagaaaaaacaactcatcttttgcgccaaaaaccccctcctaaaccctcctaaacccccacaccagaaattcaccttgttcctgtaccgaaatatctcgtcgcacggcacgatgggtttcaagatagcatcgggctccgagctctccatcttccggggatcgaacttgccaaagttcacgagcagctcgcggacctggaggtgcttgtggcggatctgcgcggcgtacgcgagggactgggccttgcagccgccgcagtcggcggcgagcgggcatggcgcgtcgacggcgtcgcggtggggctcgagcgtccggagcttggcggcctcggcgaaggcgccccggcggatgcggcggacgcgggcgaggaggcgctccccggggagcgcgccgtcgcagagcaggacgaaggtggagccgtccaccctgcagacgcccttccccttgaacgcgagcccctcgcatgtcagctcgagcacctcgttgcgcttcgggaagtagcccttgcggggcgggggaggcggcgaggtggtgggggtaggcgcggggggttccggggagagggcggccgcgacggcgagaaggcggcggccgcggtggtgaagcgggaggcggcggcggagcggggagaaggcggcggcggcggcggcggcggccgtggccatgagggcggcgggtggtggcgcggttcggatggagaatggacggtggagatggcgcggagggagagaaaaccgacgatgatgctggtgtcaccggtggtaaggtgctctgtccaagagggcccacttgacagaatcacagaagtcacattatggccatgaaccctgctgtttagcaaaatcattactactcggagtactaccttttgaaatggggaatcttttcaaatactccaatttggattgtttaacgtgaagattccatgaagttacttgctcaagttttggtcacgctttctagaaacctctgctccctccatctcaaaatataataatttttaactctagaatttatcccaaaaatataacaatttatccaccaacattatcttcccaaccaatcgcaaccctccaccattcatttttcccagttcccacctacctccactactcatttaatcacaaccctacaccattcacttctatctactttcttaataacggtatccaattctaaaacttcttatattttgggacggatggagtaagtgagtttgagaggagaggaaaagagaagattgagaagatacgcaaaacgagatgagctattagcgtatgattaattaaacttcaaaattagattaatatgtttttttaagtaactttcgtatagatttttttttgcaaaaaatacaccgtttagtagttcgggaagcgtgcgcgcagaaaaacaaacaaactttctcacaatctccttgggccgaacgcagtagatttatcactaaataaactatcgtaaaacttcttagatttctcactatcgatcatgtgagaatgatgttactagatttatcactaaataaactattgtaatatgctacaccgtttattaaaaataattctctccctcccttcccatacgcatgcacgccagcgacgacaaccgaacgggagaggtggtggcagaggcggagagggtggagcgggagggtgtggtggcggcttgtcaaccaccatggcgtcgcagccacgctcgtcaccttcgtcgacatcaaacgcccatgtcgcacactctgctgcggtgtcctcgttgtctcatcctgcgtcgccaccgccatgctgctagcggtttccctcgatgaccacctcactgatgccgccatggagacggtctacactccctcctgcaccttcgtgtgctgctccggagctattgtttgtgcacaccttcggcgccgacctttccctttgcttcttccccgtgacggttggttggtctgcaatggcgttgtcgtagcgattcttggacggccacaatagccacgtcctacttgcagtagctcaccatcgccgacacgttggctcgtatcctgaggcgatgtcgctgctcggatttgacatcgtggagaaaggggaggacgacggcagtggccgctctacctgctcaccatgtgctgcttatgtgtcaaggtgtgggctggagcggaccgtcctcgcggctgtgcaaatccggcagctcagcgaaggatccatgctgcggcggagaaggaagagaccgggagattggccgctgctcctttcccgtgggccaccgcacgtcgctcctcttccacaggtcaccgtgcgccgctacctcttctcccgtcggccgcctgcgtgacgcgccctgtcccctcgccgatgaagagccggaggaaatggaggtagagaggggagatgtggaggaagtgggactcactaactattttttaaccttattagtatttgcctgacatgtgggtccagatattttgttttattttttaaattgttaaattttacttcatgtgccacgtaaatgcaatgtcagatgaagaccgagtcaaattagccatgtagataccacgtcagctgaaaccgcccttcaagccgtcttaagacttgttagagcaggtacaatagatgcttcaagccggtgatagctgtccaccgtggcttaaaaaactgagttaaaagcaaaagatgaagagagagagagattcagccgacgactaaattatcgtcaactcctcacgagctccaagacagtgcaaagcttcagtgattggctagcaaataggtgagcagcagttggccttgctatatgcaaatgaagaacgtgcaatgcaataaataaaatgaaaagtaatattcagaaatgtgtttactgcagcttacttttgtataatacgtctctaattatggctgtagatgacatgggattttttggagccaatagctagctatattattgaccttgctcttattttgcacctattttatattttaacagttgagaaacccgctgtatccgtttttccgattgaacgacgaaattcgaaattcggttttcgtaaaaaagaaacctgcctattacctgcgcactgaaacctccgaagacccacggcccgcacatcagcccagcaaggcccacgccacgccgcgtccgggattaccatcctactccttcctttgctcaacctaattttcaaaaagcacatttacacgtagacccctagaacaccacccacctcgcaaatccgtcccccatccccctcgtcgtcctcctccctctacttgtatccagcgcccgccaacgccaagccaccacaaaggcaaacgcaaccgaccaccaccacctccacctccgatccacccacgccgcgggaaaccctagcgccccgtcgacgacgccctccacctggtgcacgcgcgcggggtggcggcggggggcggagggacggacggcaccgcgcggtagagggagagcgggagcgggagcgcgcgcgtcgcaccggtggccgagccgggccgagctgcgtcgcggtggtgctcttccgcgggcggcgagattcagccctgatccgaggaaggtgaggggaattcttcgtcggggtgggggtttggtgcaatctgtgggggtgagatgcggtgcggggggatgaagaaggcttttcggggtttgggatgtcgcggggatttgggggcggtgggtggtttttcggctgggaattcgcggatttcgcggctgctcgtggtgttcccgtggtttttacgagcagatgtatgcttgatctcgtgcggctttcccctctctctctctctctccatggtttgctcgcgttggggggtttcgaaaatttttcctctagtgttagtcctcgagagaagagtagtggatgtggatggggggaattgagaactgcgaggtgcggctttgggtgggtggtttgttttctccttctccccccgagcagatgcttgcttcgtctgcttggatttcaggatttctggaagacgatttggtttccctccccaagttcatcgcgcaaggcgttcttctgctgcgaatctgtctgttttttttttggtgcgccgtgatccccgatgcgacgcttaccggatttcatctctggtagtatcccttaagatcgtggcttcgattttgcttggccttcccctcctcctccttgacttgtgctgcggcggcgtgggacttttgggggttcttcactgtagcttctccggttggcgtcatacaccacctttacctcgctaatcgggtctctaattaggtatctgctgcagagaattttcatttcccaccatatttctcatctcgtggttggggatccgtaattccgttatctactcactggcttgtctaacttgttccatgcaatgctttgaaccaacacgagtgtttgtttggttattgttggttctgcaaagtccaggctttcgctatgacttgtcccctggaaaggtctatttacttggatgtggactgagcggcaattttatatttcttgatgtttggatttgttggcatgtcaaatatagcttatgtgtaaatttcgatgatttttggctatatttataatgttctactcagagtttatgtgaagattttaccaaagtttcttgcttttctactggctgcccggaatctttttctttatgaagtccttgtcacagttgatgacttgcttaatctgattactaaatgggccgcatcatgagttttgttttaatctgacccttgtttaaatttcgtacttggacaattgacattctctttgcagcctggcattagtttagtttgcaaagtcttattttgcattattagagttaggatgtgaaacttagaagctagattaatataacttactaggagtaatatagttcatgttttagttttcgttgtagtctatagtccaatgtatatatgctacactaattattgtgttagtgagctttctttgtttttttgttttttttgggaaacatagtgttagtgagctttctctctcacttgcagcaatatttgttgggcctcaagtcaaggaagtctttttctctctaaaacaagccaaggaaaatttccatgggtccagcaaaaggttctcgcacaattaccaagatcacaataaaggggtatgacgatcgacagcatgacgaggatccaaatagttcaagcaaggttaaactaaaagtaagatgaattgatactttttagatgacacccagtaattgtagtctcttaaaatatcatccaactcagcaacaatgtgtagacatgatctttttccgtttcactaaaatgttttgattttgcagaagagaaaaatgtcagatttaggtcctcaatggagcaaggatgagcttatgcgcttttatgaagcctaccgtcgacatggaaaaaactggaaaaaggtttgctattcaattttccgaccaccattttttgtgttcatgtttcattggtgtctttggtgccaaagtaagaaagttgtttgttgactctgcaggtcagtgcatctgtgggtggaaaatcagcagatacagtagaagccctttacagtgtgcaccgggtgagtttgtgttctataattaatatgccctagctatttgcgaactttaccaccttgcatcctctacagtttacttggttttgtgaactaaagttgataatttgctcatctagaagactagaacaggacagtatattgatgatatattatttatgcagaagttcaagaatatttagttataatatataattcaccttgcagccatgcctagataaatgtaataggttaaatttgataatagaacctaaagtatttacacattgccatttcttgctgtagactttcttatctcttccagaacgtgaaggtactgccatgggatttgttgcattggtaactggtcatcacaatgtttccgtaagcttatgatgggtttacttgttgaatgtttattgaatatgcttctggtttctggatatgccaaatttcagttgtttctttttgagagttttcaatcatgtgcgaatatttgtactatttgaagctaccatgcataggtcagtttcgttatagcaaaaggccaagtgtgagcactcctgatcattgtggttcttttggatttagttataatttttattataacagtttttgccatatgatgatgcaattagtatattgtgacataagaataactatatcatgatgatggacgttactaacattgaaagaacaagctaacagccaatctagagtgcgttgactattgatagtggtgattgttttgcatttcctacatcacagtctctgaagaatgatgagtaccaatgctttgttcttcttatgttcgattctgaattaacctatttactgcaaggtctgaattatctgaatcgacatacaaattgccctactttttccttaaatcacttgaaattcttaaaatagcaggatgaatccaagagtcataaaggaagtgatcaaacagttagagcatctgggaaggtacggaaacgtgaagctacagggcagaaagagaaggaagcacctcatgctcaccgctcctatcatgaaagaagaacttctggattatcttctttcaagaaaagatactatggaggtaagtattgtaaagcaaatatatatatatatttatttatcccttaatcttctcttggcctcctcaaaatgaaattaccaaagaaagaagcaagagctagttgaatgcaagagaacatttctattggataataacttactctactggcctgcattgttttactaatttgtatgcttttccagaacttgtcaagaacattccaagacatccttcagggaaacgtactcctcgtgtaccagttatttttcctgcagacatgaatgttgctcatgctggcataccagaaacagaaaatgccatcaactgtaccaaaaaggctagtggagctaccaataatgagcttgaatgctcatctcatggaagtcctggaatctcagaatcagccaagtttgttcaaggccagactttcctggaagctaaaggaactggaagcttgaaaaagagaagaattgagcagagtatggaacaaggtcagacaattaaagatgagcataaaaccgcaatggtggctaaagaagggaatgaccttactgaatatcagagacttaccaatctattttccccaggtactttgagacatttctccccatcattgatgtcaaactcattgtttcgttgagttcatgtaaatatacgagtttttggttccattttctgttcacaaaactaagcaatatattttatatgaactacacattatttactctgccattgttatatacaatctgttcagcattttacattgtggatagtttaacatcttgatagctactgcaaatagtgcctaagattatcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16803 - DNA, 722 bp, Oryza sativa
acccatgaattcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattac

SEQ ID NO: 16804 - DNA, 867 bp, Oryza sativa
  unsure (1)..(867): unsure at all n locations
cgagcaaggcgggtgttgaaccaaggacctctcccccgacgagcatggcgcatgccgttgagccaaagacatctttttgtttagtcatgcccgatgtatagtagttacgttgtaactataatacaatgtagttaggttcgaaagttttttactcaaaaaacatggttcgaaagttttttactcaaaaaacatgctaaagacttttagacagacccataaatacaaatatttatactctaacagttgagtcaagttggtcaagctgagtcaagtcagagaaaatagaaaaaaagagaaagccaaccaaagcacaaccagagttctccgcggggtggagcgctaagaaagaaaaaagcgttatcgctatacgaaatgaagcagcggctagcacgctaagataaaccacttgaatatatagttttacgatagacagatcaaatacgcgtagttatgtgaaatttattctaaaaattattatcaataaattattcttttagtctctaataatcgttaacttgtattactccgttaaaaaagatacaaccttagccacgaagctaatcatatttatgtccagattcgtagttatgattgagttttttttttttaacggaggggtacgtaattaacttgcatgggcatgcccggaatgttccgcccctctctcaaaattcaaaatactacacgtactccacgtatatactacggggaaagaagagtcacgcacacgtgacaggtctcagctagtcaagcgagcacgaagccaaccgccacagttgggagacggcgccaacatctcgcgagacgatccaacggtaaccacacnnnnnnnnnnnnnnnnnnnnnnnnnnnnnnnnnnnnnnnnnn

SEQ ID NO: 16805 - DNA, 1365 bp, Oryza sativa
  unsure (1)..(1365): unsure at all n locations
gaatttttttttagattttatagtctttttcaatcttcaggctggacaatcaacaagaatgtgtgaaaatattttattcaaagagttctaactcatgttggacggtaaactttagttagaaaatagtgatggactcgtatttcctgccaaaatcactatatagaaaccatatgtcaaaatctgtcaaaactaggaactacatgcttcacattgttatcaacataatgaatgagcaagcaagatgtcaatctcaaactgaatgaatgacacaagcaagcgatcaaacttcatctagcgagtaaagagcccaaggcagctccagttcagaataaatgcaggcaagaccagcagatttgactgcccattgctaaaaaggaataacataaacaaagacaagtgaagaggcaggcagaacacaattatatcaatatccaaacggcagcttctcacataaataagataactgatagctcaaggttgagaatcaaaaaccgaaagaaataggttctttgagcagagtgcagaacataaacaaaaatgcctgttgcaaatgccaagactacagggtaaacttaaatgccatatgaagtttgtttggcagcataaaatgaaactactgtgataaggctactctctcactagtcatcttcttcntcgtcatcatcatcagcacaagcggaggagttgagagcattcaatctttcgacgagactggccttcctctgctcgtaggtcagcttctgaaggttgtatctgcaccatagagatggcaagttagttacatcatacatggcattcacaaatatcctttacgaaaatcatcagccagcttcatatacctcctgtgggtcgccggttccttcttggttgattggcccatggtaggatcagcacggatggcagcatggaccttcttgtacagtgattccatgccatcagcatcaattcccttcttgaggtactcactaaagtgggcttggatttctcaggttcctcctcagccatagactgcaacaagtacataagaagaaatttttatctgatgacaatcaaaataaagcagactgagctaaacagtaacaaataatccaaactttatataatgctttagtcaacgttataaacatcaaggcagctacataactcctaatacaacccatagcacgaacaattgatctaatagtgccagctcaccctcatgtagtcagccacgtgcccaccgtagatgtacttgcggtgaatatcagaatcaagctgcttctcgtccttcttgaacccagcaaacctcttgtcactgtgaggaatgtcaagaccaccatccatagctccctgcagaagaaaagagaagtatatccacatgagcta

SEQ ID NO: 16806 - DNA, 641 bp, Oryza sativa
cactttgtccttcaccaaccatcagtccatcatcagtgacctaacagagaagacctcggcccaccatcatttaaagataaagggatattcagagactagaatgttaaacacaaacttttacagttttactacactggtaattgcttactggggcctactgaaggacaaccaaagactgatacaacagcagcagcaaagaagcatggagattataagcgtgagggctgtaaacatgagtgtttggcattgattcagattttattggtatgggcaaacctctgaatttgatcaatgacaaactaaatagcacatctgagatgtatatcaatataagatacactattatgatgatgaatagatacactacatatatcaatataagatacaacaacagcagaaacgattactgtgtaatgttcctttactttcttcaggatggcctagttcatgtcagctttgttctcagcgtcatcgccctttaagaagcgcgagaaccaccgggccgatgctttgggatgccgggaaagcccatttttgtaatcaacataaacaatgccaaacctcttggtgtatcccatagcccactcgaagttgtccaggaacgaccatgcgaagtacccacgaacatcagcaccatccct

SEQ ID NO: 16807 - DNA, 306 bp, Oryza sativa
ggagacatctcctattaagctgggtcctgctgagaaattccttaggcagtccttgatatcccatttgctttcaaaagagtacacgcaatgctttacattgctaactttgaatcagaggttaattacctgaagaagtcctttgagacccttgaggtgagaatatcgtttccgagtttcctttcatacttattattatattgacatcttacctataactaagtacatgaaactttttttaacagactgcttgtgacgagcttagaaacagcaggctgtttctgaagctacttgaagctgtcctgaaga

SEQ ID NO: 16808 - DNA, 1182 bp, Oryza sativa
aattaggcttatcaatatttggcaattttaatagtgtttagtgtctatttggtttgaagccaaattttggcatgcctaagaaaataggccttttcaatagtgaacttagtctattttggcttcaatccaaacacaactttgccttaccaaaattagtcatgccaaaatttggcactgataaaatttagtaatacctatttaaaccacaaaccaaaccaaccctatgtctcacgagccatgatccaactctgcctgctggtacacagctgccttgtcctggattttttttaaatatacccttctttttacaaatatgtttacaaagaatggcaaaaatataatatcgttacaaagcaaggaatatacacgtttaaaaagaattagcaaaaatatactatcgttacaaagcaggaatgcgaactcgcggcggacgtgtgagttctcatattgtgatgcgaagtcgtgaccttgtttgtatatccacatacgcgagttcacatctccgctgtgcgacaatgatatacttctaccagtcccttcaaaacgtgtatattttaaaaccggtgataaaaagggtatatttcccaatttgttctcgatgtcctaagcttttatatcagtgttgggtgctaaccctaagactgggctgcttgccaaagaaacatcaccatatacggtggcttctaaagtgtttggactgagtgggcatatgggctacttcctcttgggcccaacaaagcacgcaaagccaactccagttggcacgggttgcatgggccgcatttcatataggccctgtgataataaaaaattggagagagagaaacatgtaatctagttttacgctttcctactaggcttacgtaacatgttgatataatacacacaatacgcttcaccactcctgtgatatcttccagggccattcactttaatgatattttcaaccttatcaaattttagtaaagttgctaaaaaagtggctatatttagttaactatataagaaatcttgttaaaattttgataatgctaaattttagtaagatttttttttttcgcatcaaagtgaacatgtcccggttccatctcccgcagcaaaaccccactccctccactccggcggtttcatcctcctgtcctcctggtaagcctcgaaaaaattcccaactttgcactagca

SEQ ID NO: 16809 - DNA, 1068 bp, Oryza sativa
atggaaaataaaatatggaattttctcagttctaaagaagtaggaattctagaccaaaattaaatctcttcctgtcagtctagcacttacaatataattgcaagatttattgtagcatctaacacaaacagacacagtacaaaagctgatgtttctcacaagctcaccagagaagcagagagcaaaagaaagcactgccccagaattgattggcagctgtgtcactgcaagcgtaccaaaaagaaattatgcttgttggttggcttttgacagctcatccatttccaattccttgactggtgctataaggcttcgagtagtgcctttaaggcataatccaccatcttccatttccttcaggagattctcagcagttctccagtccaaagccttgagacaaagtgactggataagtttgttgtactcatccatatttggctccatcccatcttccttcatctcctttaggcactccaaggccttctcaaactcctccatcttgcagtaaccacgaataagtgtgtgatatgtaaccctgcttagtcttggatgaatcctcttagcatcacgaagtagtgcatgggcttcatccatcatgcctcctttggcgtagccactcatgatcacactgtatgtataaatgtcggggcagatcccttggttctccatcactctcatcaaaccctttgcatcctccatttctccatttttagacaatgccgtgatgacaaagttaaacactgcgctaccaggagctgggcctagatttaccatcctcatcagcactttctttgcatcttccacgttgtttgtattacacaaaccatgtataaccgcagcataggactggccagcatccttaagagattccccctggtactcttccagcagctcaagagctgtattaatggtctcgtcattcctcgccaaagcgctaacaaggaaagttaaggccgaggtcggagcctgcaccttcttttcctttgcagttatgtatactgaatgtgcctcctcacggtcgtcttcccgcaaaagtacatcacaatgtcacagacgttctcgccatcg

SEQ ID NO: 16810 - DNA, 581 bp, Oryza sativa
ggctacatgtcaaagaaataaaagatacatggatccttcaaaaaaaagcaacaggtagatttgcaatgtaggagtagtagcaatctccacccacacaacacacatctgaatgtgcatctatgcagtgatctcggatttggcattcttaacattttcttcatctttggttgatgccgctgctgctctgtcctgctctttcttctgcgcccttatcagtacacgtcttgcccggggacgcatctcacgcacttggcgtggtggcatcacaaaaggttcaagagggcgatcatggaatggatgctcatttccagaaaatatcctcagtttgcgatccctgtcctgtgatcagaacagtgcatgcttaataagcaacaacagcattatatgaagctttagcaatttgaagacgagaattgaaggaaaatatagatgttttaccacacaccagagaggaaaagacttgatttctcggacagaatagagttaaatcacataacaaagaaacaccatgaaagatcagtatacaactatcatgtggaacatgaaccaagaaggtatgattggatttacggtatgttgaa

SEQ ID NO: 16811 - DNA, 714 bp, Oryza sativa
  unsure (1)..(714): unsure at all n locations
annnnnnnnnnnnnnnnnnnnnnnnnnnnnnnnnnnnnnnnnnnnnnnnnnnnnnnnnactgatccctaagctatacacaattatacatgggaagaaattaagaaatataggattgacctgaagtttagattccaggaatgagaggatgacagcaggaatgatacccttcaccccacctccatcaatactcagaattgtgatcatgtttcccttgcttggtggtgggcatgcacaattcttctccatggcagaggcaaacaagtcagctgttgatcacttgcaaatttctctctctggtggtctttctcaacaaaggagagctatttataggtgatgagggaaaagataactcaggatgaaaaaaaagtaaaatgttaactttgaaccacaagcaatgtttgcacgtattttacactcaagcattcagcatctgccaaactgctggcaagcttatccaagcttgttcatgcgttgtatgtatcttcttccaatggtccagtaagatatgaaagtctcatatcttcgaccatctacgtgttttgccacctttaaaacaccacttttatgttctaattttggctctagttgacaccccatatgagtacacacttttatgccctgcaagtcatgttaacaccaaatggaaactgacaatgcaagtaaacattcacacattctgtcacctgctccctcaccctgacctttaatgctct

SEQ ID NO: 16812 - DNA, 360 bp, Oryza sativa
cgcttaagatgggggatgccgaagctcggggaggtcgcggtggcggcgttccaactccatcaacgttgaaccagcgacgcacggtcaacaacccctgtgccgcatcctcccgtgccaactctgtgtctgccggcgtccatctccgtcgggatgccagggacgtcggggacatgtgccgccgaccacgccccaccatagtagaaaaagtcggaccgaggactgacccgatgagcttgtcggttcactggttagaccccggttcatcggtcggaccgtggttctatgtattaagtaaattagtgttcattccgttcagtaacataatcacatcatcttatatattcttatgggtattcaatt

SEQ ID NO: 16813 - DNA, 612 bp, Oryza sativa
ggctaaattgcgaagcgtgcagcacttttgcttcgctagctgcctctcctcaagtcgctgcgagtgcgagtccacacaacactgtgaactcccccctctcgagcaaaaaaaaagatccaaaattttttcgccctggggttcgaaatcttcgtgccttcctcctcctcgcggcctccaattcgaacgccccagttgctcgcgccgccgcggattccccagatcccacctcctccccagctcgcgcggcccaattcgaagccggttctagggtttcccggcacgaatttagggtttcgggggagcttcggggggtgttgttccttgttccgcctagggtttggaatttggggggcgtggagagatgggataaggagggtgttgggagggtgggagctttgcttggggtgtgtgtgtgtttgggtggtgctgagctgagctagggtttggtggtgaggtgctgaggaagggaggtggggggtggaaaatgttctactcgcagttcatcttggccaagaaggggccctcgggaccatatggatcgcggcgcatttggagcggaagctgcggaagaatcaggtcgcggatacggatatcggcgtctccgtaggtggg

SEQ ID NO: 16814 - DNA, 1147 bp, Oryza sativa
caactagagtatgttctggatactgaacagtgagtcgcagcaagaaaaaggaatataaaacagatatatgtgagcagcagtagaaaaattcagagcatcgagttcttagtgtaattccttaccttggaagaagtcctctagcatctggcatttctttgctataatagaacctgcttttttgggctttttgtcaaaaatcatccgcagcaagcgggcagcgacatcccgtttggaatttttcatccccaagagattgagaaacaggtcccgctggccatatgggtcgagcaaatgaatggatgagaccgtactgcagagccacatccgagcctcatacccacctccagactttataaccgacctgattataggctccaccttgccaagaagagatcgccttgcttttacagcatctgtatcaacactaccaccatctgtggtcccttgaaaaaagagttgaaccatcttcaagagagattttctacctcctgaaattgaaagttgcaaattgcaataacaatgtttcacattctccagtcctcattgaagtaacgcatataggtaacactaaaaccttagattgccaagtaaaattcaacatggatttaacttagccgagatttgatcccaacacctatttatctgttgaaacgtcataggtaattttaatcggaaaccctaaactgaaatgcaaaatttaaaagttcctggctaggaaaatagaaaccgaagcacaacaggtaccaactgagacctctacggcagcggggcaggttagcgtctctcacgattcacgaacacctccaggccgaccaagtcatggagaagaaggcgaggcggagatgggaggcgaggcggaagagcagcaaagaggaaggggcgacaaggaaaggccccctgcccgagaacggcgggaggatgtggcgtgaggaggaaggcggcggcggttgcggcggcggatcgagcaggcgaggagaggaaagcctcacaactcccccgagcaccacgatctctctccagctccaagaggactccgtgattgcgaccaaattctcgaccaatttgatgaacagattaggagcgcgacgcttaccagctgggcgcggcgggggttcccagttcccactagggcacgacgaggaagaga

SEQ ID NO: 16815 - DNA, 1516 bp, Oryza sativa
  unsure (1)..(1516): unsure at all n locations
cccctttttccgcaacatgcccacgcatcgatggagaaagaaaaccgcgacgcatcgggtgcccatatgaaatgaatgaatattccgccgccgctccagcttccggtgcaagccgcagcttggtgccaattttacggtgaggtgaccgttgctntccacagccccaacctccgcgcggcctcaaccctcacctgcggcgaggatcggtgctctactctagtagtagtactctagagtctagtctagtctactctagttgctgcgttcgctagcattcggaggcgatctgaggaggagaagtggggagcagcgaaggttttgatcttttggaaggagttggattcggctttctgggttctgtctgtcgcttgattccaattcggatttcttgctgttgttgttggggtgttcgcggccgatttgaccccggggaatcgctgcttttttatttttttgaaaagataattctacgcggattagatttggtcaagaagtcgtagtacgaacgcgaggtttgatcttggtttcgatccgaagggtctcggttggctgcgtgggaagggggaggaggaagaaggcgacctgctatctaatcctctaccccctctgctgcgaaaattctctgctgtttgctcaagcatcttgctgcttggagccttggatcgaagagagttttagttcttggagttctgagaattgtgttgcttgagccgaattcgatcccaaaaaggctcttttttgggaggctttgaggaggaagaagaacaacatgggggtgatgtcgcggcgggtgctgcctgccttgcacaacctctgctacttctgcccctcgctgccggcgcgctcgcgtcagcccgtcaagaggtacaagaagatcatcgcgaagatctaccagcttccaccggtatggcgattactgaatcctgtcttggcatttcagccatttctgatgcttagttgtagcctctgcgatttgggtctgtggtcaaatagttctagtttctgcgaattggagtctgtggtcaaatgtgtggagggagtttgttgattgagggtgtgatgttgttgctgtaggatggtgaaccgaatgataggaggattgggaagctctgtgattatgtctcgagaaatccgacgcggatacccaaggtaacacattttgatctcctctctgtttttactagaattgtcgcgcaatctgttagcttgaatagtttagactgaatttccagtatttctgaaagcagtctttataggtaccgagtagttaccacataatggctgatttacactgcattgctttagtgtgatggtgattccttttgccagagtacaaccgatcaactttcgctagcaccgatcactagctggaatgattttaggctgtttaagtaggacttaccgagatgaatgaatttgtggaactcggaactgattttatgtctgcagatcacagagtaccttgaggagaggtgctataaagatctgagacatgagaatttcaccttggccaaag

SEQ ID NO: 16816 - DNA, 740 bp, Oryza sativa
  unsure (1)..(740): unsure at all n locations
gatcattattccatcagttcttgtagttgaagaacattttattttcctgacagttttacattatacaaaaataggctgtgcaaggtggtgaagtaggcttggttgtcgattgtgaatgggcagagccattttcagagaaaacagaagatcaggttgctgcagaacgaaggcttgactttcagctaggatggtataatttctgctcatattacttgcgtcacagtttcccacattagctacctttggcacagtgttatgctgcaatattgtttctgaaacaagggaaagcttctaccatttttttcttcaaggcaaaaaatgttttttcatggtataatgttatgctttgcacagtattgtcctgcatcttttttttttcatgaaacatggggaaaatgctgaattttctcccacaaggcataaatgctttgtgtatacaccgagagaaattgtaacatgtttttttttcatggtacaatgctcccacatcttttggctcagggaggcttaggatattgcgtgtcatagtcttacataggtgctacttttccttaaaggtacctggacccaatatatttcggtgattacccagaaagtatgcgtcagcgactgggcgatgatcttccaaccttctcggagaaagataaaggatttatcaggaaccccaattgtgtatgttttaagggattcctnnnnnnnnnnnnnnnnnnnnnnnnnnnnnnnnnnnnnnnnnnnnnnnn

SEQ ID NO: 16817 - DNA, 213 bp, Oryza sativa
ccactgtcctttgcgccagaggtgccaacatcattgctgccatctgccataatttgggacatgtctagccgtacatgtatttccatattatgaatggtgggatgagcaacaatctcatacgtccgatattgcaaatcgattagctccttgcacatgcctagttgggacacaaacatgcatcagtagaatttcagagcatataactaaccacta

SEQ ID NO: 16818 - DNA, 579 bp, Oryza sativa
  unsure (1)..(579): unsure at all n locations
annnnnnnnnnnnnnnnnnnnnnnnnnnnnnnnnnnnnnnnnnnnnnnnnnnnnnnnntcctctcttttgcttattcctctcctcgccaaacctagctcatagtttattttcactttatggaaaagtaaaaacaatatattaatattgaaatttcttggatcccctagtacatgccctatggggcctatttataggttcatgtgccctagggttattaaatacatcaaaatttacatggttactcgtatgatatgagatatttatgatggtaattatgaacaaattagccttagggctcttcttgagctgctaagtgggccttcattgagtggttggccctttaaggctttgagtccttcggcttgggacaaatgtctttggctccacctggtgacttcgcccataacctctatctttgtgacagtcagcgctttaccgccgtgcttcgccctggcaattgtaaacctgtttctgtaggctcggtcaaaggccctcgtgacatgtctccaacaatatattttctggacatttaaatatttaatacaacttcatccatcagattgcaccaatgcctatac

SEQ ID NO: 16819 - DNA, 730 bp, Oryza sativa
  unsure (1)..(730): unsure at all n locations
annnnnnnnnnnnnnnnnnnnnnnnnnnnnnnnnnnnnnnnnnnnnnnnnnnnnnnnntacggtcaattcgctcggcgtggcggccacgtggatttatttggatgcggttaccgcgatggtcgtctcactgacaggtggggccctccgccgccaaatcagaaattactgcaccatttctgtttcagttagttacaagtgatttggtggttagcatttttatcgagagatatttttccgcaaaattcatccatttcaaactttcaaagtagtgggcttcaaatggattgttattcgctttgaagtattcgagttgttttctacacattttttctcagaattcatgtgaatttttttccagattggttaagataaagagccctgcaaggtgaagcaaccggaggctgattaccattttggcccgggatgccatggcatgtggatttggtaactttggaatattccttatatgattaaggccaaaaggtgacattaatcagcatctgatcaaacaaatcttagaacgcaaataatccaaggtcaatcagaaagcaggcgcttgtacagcgataggttgagatgcgtaaagtgaacggaacagagagcacgaagctcccagacttcagcgaaatattcgctgacaacataaacgctgtgatgtgatattcagcgaaaatattatagctgctgacaaattatgaaatctagcacaatggttttgacacaaaaaca

SEQ ID NO: 16820 - DNA, 434 bp, Oryza sativa
catggtttccgcagttaccgcgtggtaaccgtgcttaccgccagggcgcggtaaccccgaccccgacggtttggaaaccttgcttgcgacgcgacacgattcgattagaagagcagcatacaccagcatgaaacgagggaggattttgtatggatgagatatatatgtttcatttgtttaaaatcccttatatttatcgattagaagatcagcgcacacatgcatcgtattaatttgttttggaaaaagtatgaattgacctcctaaactatcgccgtcgatcaaattaccccatgaacttgaaaagcagacattttacaccctcaactatgcaaatcgaacaaattatcccctaactcaatccggtgtggttttaatcctacatggcagtctagtcagcaatttttttttgaaaaatcggtgggactcacatg

SEQ ID NO: 16821 - DNA, 1169 bp, Oryza sativa
gctgccgtggccatcacggggtcgcgacgcgtggacgcgcgctggagagcggatggatttcacggcctttcatgcgtccgcgtcgcctctgcaaattttacagaaaagccctctcttttatagatattttgttatacgtcctctctgttcttttctcggtttaaaatattgcgtttaggccctttgcatcctacgaaattcaatacaaaggagacaaaaagaggaaaaaaggactgcgccctgaatcctagaaactgaagggcattttcgcaaaatttccttttctttctctctctctctccccttcgcgagaatcccaggcgcgtaaaaaaaaaaggaaaaaactcccagccgccatgcccctctcatctctctcgctctctcctgcgcggcgcctggatttggcttggccgtggccgccgctgggtgtcctcccagtgccgtggccgccgccgggtgtcctccctacgttgctgccattctccgctcgaaggggatcgatgttgtggatgggtggtgtcctcgcagcgccctcactgccggtgctctccttgctacgccgccgctgacgcagactcgaaggggaggctgtgggtgttggatgcggcagccgcgatttctttgccagcggatccgggggctcatcaatggcgtccacaccagcggtttttcctcagtggtgagctccagagggaaagggcaagctaacccaccctttctttcttcacaatttccctctctgtctgatccagatccaaagctgatggaaagttcgatttaggacattcagggttgtcgggtgtgttgagctcggtggtggcggcagtagcagcttggcggcgatgggagaatttacatgcaggagcccaaagcattgatgttttctgctcttccccaccacggtttgccgctgccatggatgctgttgactcctcacatgtcaaccacgactaggatcctggtgagtttggtgggcttttgtggctgcttgccaccctatccgtttgatttaggggctgttggaaggcccacctcaatttaccatagttttttttaccaaaggtgtggcaagatgcaaattgtgtggctcaaaatttgatggccacacttgtggcaaactttggctaagaaaatggtctatgactagtgggaccaaaagagtagaaagt

SEQ ID NO: 16822 - DNA, 583 bp, Oryza sativa
gtgagtactatgaccagatggaattggaagggaaaggcaaactgcgggagtttggtgacagggattcgattttgcgtaattactcaactgtgctttatttcattctgaggctccgccagctctgcaatgacatagcactatgcccattagacctgaaatcatggcttcctggcagtggcagctcccttgaaggtatggcattttttcctgtttgtaattctggatttattttgtgatgatataatatggccataatacactcatcaaaattaaactgtgctgtttagattgaaccatcttgttgccaaagagatttcgcacactaagcattgtatgatagtagtatttcttttgatttttcttagaactgttccatcttactgtagagtgtcaaactagcaagttgagtgtaattggtttatctatttgaatcgacaaattgcatcagtacattggtgcttgccagcttaactttacaaacttgctacctatccgtcattttctccaatgggtcaactgctctgttgattatatcaatataacttagtaaaccgcagaaatcgctgcatagccagtgaaatca

SEQ ID NO: 16823 - DNA, 277 bp, Oryza sativa
agatggataatatatttgtgagcaattttatatgtcgaaagatgtttgatgatcgtgaaaggaatgcaaaatgtgtgaagatttttggcatggtgtgccacgtgacatgccaaagttcaggtttttcaggctgtatggtcctcggtttggacctgtttggctgcatttggatggatagtgtaaaaccatgagcacaggttcagtttagtagagtgactttatgtgcttgtttttactgtcacaaggttcctcgagcaacacacagtaaagtaatggt

SEQ ID NO: 16824 - DNA, 722 bp, Oryza sativa
aaaaggtgggatttcctctttatatatttcactttgtttcacaaaactacctgctgagtataatatggaagtttcaaaaagattgtttaatatcatgtgtcggttatatgaataagtaaaccagtaaggaataaatcaaagatctccttggatgcgatttgtcataaaagtctgctgttatgcggttaagaactttggtaagagattttaaatatttggcaaaatgatcgtgagcatggctgtcctggatttttttttttttgaaaaatttgaggtgtccatcaattaaagctggtaaatataaatagtacatctgtaagctacatcctacatgcactgttttttgaggctgtatggtacatattttgttggttaagagggaatggcgctgttgagtgctcagtggcatctctccttgaaacaggccgatctgattgcgcactaatatgttattggttactgtctcaggttggagcaacaaaggcagagttgttctgcaagacatttgaagaagcccataagaaacttgtatggacttgactcccagccatcacttcaataaccaccaccacgcaaaactgccttgagatctcacgatattgttctctgtgccaggtttacaaagagctgaacctagatgctgctcaaagatttctgaatgcctatgagaaacgatcatgaattatagccagatattgttcaaagatctgcagacgccaaac

SEQ ID NO: 16825 - DNA, 1630 bp, Oryza sativa
caaagttgcatgcgataattcacgacttcaacagcctgaagcataagaggtgaagagggttcaatcaactatttcatccaagatagatgagcgatgagcgcgatttatttccccaatcaaatgggatgaaagcggttatataattcaatcaatcaactatttaacgagggaatcatagtcacatccgcttatcgatctctccgcattaagctcgggtcacagcgacacatatccaaccagcacacagagaacacaaacatgcatagaagacagagcagattaaaaaggaagaggctcttcagatgcgttaacgtttactgaatttcatcgcaacagataaaaggaagcaacaatcttttgcaagttcatgatgttcttagccaaaattctacgacatcataaaagacagttgtgtctggaggattgtgtcccgtcgatccaatactaaaaaaacatgccttgcattagcgcaactgattactgatggcgttcatgacgatccaaatcagtccacaagggtgcccaagatgtcatgctctctgaagagaaggtacctggaattccagatgcaaagattattagagcaatggtaaaacataatttatatcatatactgacagcaacagtatcagcataactatcaggaacatacagaatattggatgaacaaaaatcatcataatagatcattttcccactcaacgttcaaccaatagctagcaacagcaagcattctaaatattgaactaccagaagaaagcagcctaaacgaggaagcacgtgtggttcccggttcttcagcaacaccaccaccaagtattcgatcaattcctaactgtagcactcacaagtacttcctctgtttcacaatgtaagtcttctagcatttcccacattgatgttaatgaatctagatagatatatgtctagattcattaacatcaatatgaatatgggaaatgctaaaatgacttatattgtgaaacggagagagtaattactacttcgtacatggtagccataaacaacggtgctatagcatgctgccgatagaggtcatgagagcctcattggttgcccatattcccttattagggaataaaagttaatttataggtaaaacttttatatatttgttcctagcaacttaaaaaccaatgctaaaaagaaattacgttgaaaatatcttaaaatcaacttcaaattcaagtttgaaaattcaaatatatgcttttgctttggcttattaggccaaccgatggggctcatacacattattgtactatgagagcactacaagatctatcatctatgatagtatgcaacgagtggtaattacattgccctagcaatatgccgaaaggtacattctcactaacaagtgaagcaatggagagatagttcacatactctttttcagcagcaagcttgacttcgagtccaccatattcaggcaggagaacagtgtctccttccttgagagcaacagggatcagcttgccatccttgtcacgttcgccagggccaacagccaccactttaccaaagttgagctggattcagcggaacattcagagttaaacaatcaacattagcaaggtgatgcaactagtgtaataaaacagtaaca

SEQ ID NO: 16826 - DNA, 614 bp, Oryza sativa
gattctttttttttttgaagacacatgacaaagattgctccttgattattcgacttgagtcgtaacatggctaatcagctactgtactagctagagatgtactcctcgatgcttgtccagtttcatctctagaattatattttaggggacaaagagaggatatgctcgtagattataatattattggtagaaagcaactgaagcattttatagtgattggctactctagtatagctagtagtaattgtatgtcttgtgtcgaagaaatgcgtggtcgctgttatggtgtgacatggatcgatcgatcgatcgatcggatcaacaccagcagctggcgattggcgagcatggcggcttcatgaccccggcgtttggatttatcaacaacacatggttaatttctaaagagatattgttcatttactcttaagctaaatctataagatgtagttaaaatttaaattttaaaactgatttgatggttttttaattatagttttatttcttttaataagtgttatagcttataatcgagtgcaggcgaagcgattgggctagcacggcattctcagagcgagtacaatagcatgatacttcctccgtttcaaaatgtt

SEQ ID NO: 16827 - DNA, 564 bp, Oryza sativa
tcttagatgggcgatagcggcgtccttgatgtcgtgacctccatgggggcatcgtttttggagtcttgcctttgtggtgttgttgtaggccgggcggcgatcagccatgcttaggggggtcattttggtgctcagttccattttcagtggtttgtgcttgtgtggttagcgtgtggttcttggaggtgccttgtgcacgtccgtacttgacaacttctgtcgtgtttttctttgtaactttactcctccttaatatactcggatggcctccttcggcctttcccggtgaaaaaaagataagtcaggtgagatcttgttcatcctttttatcaattcattacccctgaggccctgaattaacaatcagtgttgtccatttgtcattgtaatttggtttcttgaaacctttgaagtctgaactcccttttgcatttgcaggagttccttgctggtatccgcatgactttggacttatttcaaactgtgggaactgaaaacaaatatagactccaggcctctcggaagtgatgatgagagctgctctcctacacaccatgaaaatta

SEQ ID NO: 16828 - DNA, 592 bp, Oryza sativa
ggatcgcataacactcgcagccaactcgaagcagcaaggagaagcagcagtagcaccacgagagatcgagggggggaagaacagcgtgggggaaacctgcttggacgtctcagggaggaggatgccgccggcgctcttcttgggctgcaccagcttctccaccagcacgcggttcagcgacgggatcagccgcctcgccatcgccgccgccctcttcttcttcttcttgcgaagcaagcaaaaaagaccgagcaaaagttctacactcttcgatcgcctccgccgcgctcgtggggtttagggttttaaggtggaggcgacgcggcggcgaatttacgggcttgcccctctccagggccctctagaacgttccactcctactggaccggcccacctccacggcccatttcatttaagggaccagctaatacattttgtcataaaacctttttagaaaaaaattgatatatgtaaatataatacaatgtaattatttgtaaattgtatgtatataattataatacaaattgtatgtaacttttcaaagatcctgtgataagtgatacgtagtagcatactatttccatgaagc

SEQ ID NO: 16829 - DNA, 646 bp, Oryza sativa
aattgcaaagtggattccgcgaggccgtactcttttcattgcttcaaatgaaaggacaccaggcttcttttcacctctatcagacaggtaatcaacacattgtgtcagctgctcttcttgactcaccagcattaggatctcaggcacgatttacatttgcatttggtttctgcaatcaatttagatgtgactttagcgattcgtgttctcatggatttaccacggcacatggtttgtcttcttctgttatcaattacttcctccgtttcacaatgtaagtcattctagcatttcccacattcatattgatgttaataaacctagatagatatatatgtttagattcattaacatcaatatgaatgtggaaaatgctagaataacttacattgtgaaacggagggaatacttcaaaaacatccccattcttaagaaactctactagttgctgcagtactaatgcactttgtcattctggaatatttattttggttgggataatccatttttttatttatcacaccatggcttacccatagaaaaaaaccaataatatgtacatgaccagcagtgcaatgtcataccattgaatgcttataatttcatgacacaagctggctaagatttctattcgttttctttggcg

SEQ ID NO: 16830 - DNA, 681 bp, Oryza sativa
atcgagcaagcatggcggctgcaaagctcgctcacacctcgcttccctggtcatggacgccgtcgtcgtcgtcccggtgcgcccgcttcttcctgccgtgcagcgacacgccgaacagcttcaccgtgtcgccgccgtcggttgctggagtcttgggcggcggcggcgtcggcgagtgatcgggggagtcgagctccatcagcctgcaggaggcggcggctggaaggtggtgttgcgccgccgccatggccgtcgacgagggggtggtggtggtggtggtgaccggcgcgacgtggttctggaggaagtagatgatgtcgttgtagagcttcttcatgtgcgccagctccgacagcagcagcgagttgcgccgccgcagctgccggttgtcctccgacagcgccgccaggaagtccccgccttcgccgccgtctccggcgacagtacagtgcgccgtcgtggcgggctcttcttggattagatggtggtggtggtacgccggcggcggcggcggcagcgagaagggattgaggtggtggtggtggtggtagggttggtgcggcatcggcggcggcggcggctgcgacgacttccgccggtgaatctcggcgaggaggtgcttggctcccttcttgaagaactcgttggcgaactcccacctgtcagctactatcttcctga

SEQ ID NO: 16831 - DNA, 740 bp, Oryza sativa
agatttggcttgaaaaatactttcataaaaatatacatatataactttttaataaatatttttatagaaacaataagtcaaaattctgttgtgtccataacgactttctttacgagtacgaagggagtacaaataaatgaatcaataattataaagttgatataaaaaaattgacaagaaatttatacatggaaagttttttaaaaaatcacaccgtttattagcgcgggagtacctttgtgctgcttcttggaacttggaaggaaacttgagttccaccctttgggagttggggtccaaatgaatgaccttggacggctgaatttcggtggatagaagtcaatccggtccattcttgtggatggattccaaattcaagttcagagtaagaatgagcaggctttgtgtgaacactataaactatttttgcggctgttttgacccccccaaaaataaatccaaacagatcatattcattcatttcattcatcggccatgattcactcatgcagcagttgtgctgttgcttcgaggagcttgctctacttgcgttagcactgtacgggtgactgccgggtgggccccagttctgcggcggttaggtatgggcccaccgtcagtgtcatgtgtgtaccacgtcggggggtgcgtttaaatatggagggaatggacagcattgggggggctctcttggctgcttcaaagttcgaagcactgcacttgtggcgttgaaagttccc

SEQ ID NO: 16832 - DNA, 539 bp, Oryza sativa
ttgaaaaggtgtcaatgaaaaagttatggcagggaaatcatcagaagcatcaatgcattcttctaaggttgtccatttagtgaatgagatcatcaaagggttcgtaactggcctatatgttcagtttgcatatctgacagagaaggagtcaaagtagtaaaccttcccttcctgtagaagagtcctaagcttaatcatggcaggtggatagatttgaacatggatgctattgccctgcatattgtgtatataaagcaccttgttagtaccatatttgtatgtaagtattaataaagaagaaatgagtgttaattagactataaccttttcatccagcaagacaagatcagtgtggaagatttttgtttcatcattcagatcatggtagtcccattgcctagatactcttgccttgaactgtttattagtgtccccatacataaggtctgaaataagcacgtataccattggaagcctgtaattaaatattgaagatatttagttttacgtatatataaagcatcaatgtaatgaactaa

SEQ ID NO: 16833 - DNA, 658 bp, Oryza sativa
ggtctgatcactcacttccatcatcatccataccatcgaagaacttggaaccttggttttcctgaggaaaactcagagggagctgtgtcagatcataccaaccagatatgatttcggatggatgtgccgacaattccaattacctcagataggcggatggaagtgctcggcgtagcgaagagagcgccctcatccatggaaggagaagagagcccccgttcatcctgctccaagccagagggatgcatggattgaggagtatgatctgtgtatcatatcattgcagaatgcttaattctctactaaatcatgatacagaggttgaaacttagaaacgatgaactgttcttgcttgcttcctacctacaatggcgtcgcggctgctcatccactcatcgactatgcgcttccaacctctgcattcgattcgcaaacaaacatgtcaacgaatgcaactggctaagaaaaacaaattcgatttgaatatgaacaatccaagacgagatgggaacacatggccatactcgatgagcaatcgaacaaggtgacgaatctgcttggagttgtgcttccggtagctgctcaccgccttcccaatctcggtaacctgcaaagacgaatccccatgaacacactagtcaacacatgagcttggttt

SEQ ID NO: 16834 - DNA, 733 bp, Oryza sativa
accgcccaagggaaatttaatcatccagccctagtatcattgttctgaatctctctacacctgtaaagtgatcaaggaaattaagaaacacggtgcactgatgcatggttcatcaactaactctcagggaccagcgatgatgcagacgtaatatactccatcatgcatgtgatactagcaattctctcttccattcactctctcgtctagtacatttgagttaatcagtcagtttggaatcactttacaacgaagttaatcacagacaaattcaacatgcttaaggacggacaaagatgattatcaaagacattaaactactactctttgtcatctgaggatactgtagttttatactgcaattgcagcaacattatactattaacgagacctgttttgtcattgcgagatccactccaaaattttcaaatgctcgtggttttgcaaacaaattgtaaccgaagacagacatgggtgtcagagctgtcgccgttggaaggtgacatgatcgcagccgtccactccatcggccgctggctaaccaaccaaccccgtccgccgacatgctgctgtccgcctcctgccgacttgttcttgtcttcctcctatgctcttaactctgaattttgttaagagatagaaggacctgtagtaattatttatcaataaaattttatcaaatttgtcatatcaaacatctcgccacatatttcccacaatcagagccctttga

SEQ ID NO: 16835 - DNA, 572 bp, Oryza sativa
agtgtatgcactgtgcaacggctacaaaaggtactgcagtgaccattataactgcaatggcttacaaaaccgaaaacacgcatgtaccaagcgctaagtgtcacaggtaagctatcaatatagtaacaaacaaagcaccataaatgcacaatatcaaaaagaagcagaaaatagtgcaaaatagtaatcaataaaccgaaaaggaaatattgaaacatagtacaagacagatgggaataccttatacgaaacagcacccagtgagttgacaacgcggcagaagcaacgtaaccaagaaaatgccacgcaagacagatacccacaaaagacaaagacctcgaccaagaaatagaagaaagtctaggaaaggatagtcaccaataaagttgaccagagctgcacaatagaaagagatcattagcaaacataaacctgatacagaaggcacaacaaatacatgagatatttctatatcgtttaaagcaaatatagtagaaataacctaacctgcctgattgaaccagcagccccaacattcgctggcaaaatcaatcaagaacccttgaagcatc

SEQ ID NO: 16836 - DNA, 725 bp, Oryza sativa
agtttaggctgtaattattttgaacctcgctagactctttacccctctaattatggaagccgcctttggtgagattctagacaagttatagagtacagttccagataagatgtactccagagtacatgaaatgcaagctatgtggaacacaaacccagccaaatgcaactgcattttggattctagattgccttcatatcaaaattttcttgtcagtgcacgctatatcaagaacatgcacataattaaacaaagtgagcctttattaaaagaaattgtcagaacgaaaacagaaacaagatttctgcccccatcaaagtggggagagagaagaccactttaggtgctcttgcattttttaaacattcttgaactaaattggtttatgctcttgtaggttttctttttgtcactctcatacaaatgtacctacatttgtgtgtaggctatatgcactaactcatgggccctttgttttgctgttttactgggtgcaggtgtaaagggaaacctgaagagacctttgaaatttcatgcgcaatatcctcacaagcgggggggtgaaacaatcagcaggagcgataatcctatggacttgcatgagccattgcaactggatattggatttggtttgggaactaaagacgaaactgaagacagcgataatcctatggacttggaatagccatgcatgcccctttggagtgaaactaaatgggcataaa

SEQ ID NO: 16837 - DNA, 980 bp, Oryza sativa
gatcagtcaagacaacttctttgcaaaaacggctgcacaatatgccagtaaagcctgaagcaagtcaccagctcacaatactgtcagattttccaagatcacagagtgaagtaaacatgagaggagaatgccctcaccaaccccagatcctagctcaattattgaatgatccttcacagtctcaggatgttcagacaagtaggtgttcatcagaactgcacctggccatactaactgtccagtaagatcataatcagctgccacaaatcattagaatgtttgtaagtgttggccccatgataaggaaacagcaaaaatctggcgttatgaagtgcaatgcagcattgtgcccagagcaaaaatacacccaaacaagttaatgtactgatgagaggttctagtttgtaaataagattgttcatatttgtccactgcacaaatagaaataaacttgagtatatcatgctcagatctaacttttgtgttccacggaagagctatctccagataaatgatagattgatagttactatgttacacaaagcagcatagcctcctggttatagaagcagacatgaaggacagaatgaaatggggcataagagttacatgacgacatatatgcacaaaatgaaaaccccgccattttgtttgatcctgtgaaacatggaccattcattgtactgacgtactagaatgacaatgtctgagttgcaagtggttcccaaaagggacaaggtaaaagtggtcctaaaactacatgattagtgtaatgaaaacccagtttggtactgcccaagcaacagttatatatgcacagaacgtatcacatttttcagttgaactcatatgtaacaccaaattcagagatgatggagtaatctatagatggtagatgctatgctatgacctttaattcatgatcatcatgttaaaaaggagtggagacagtcatttagtatctagtcacagctgatttt

SEQ ID NO: 16838 - DNA, 38392 bp, Oryza sativa
  unsure (1)..(38392): unsure at all n locations
nnnnnnnnnnnnnnnnnnnnnnnnnnnnnnnnnnnnnnttgccatgatcaaagattcaaaggtagcttcagtattcaagtaacggttttgctatgatccatcgtttaggcatcccctagctaaaaccacccaaccaattagtacaaactcactctagattacatcctcttgtggcggcatcctaactagtctctacaagctggccatgtcggagggcctaaggggagaggagttccattcttctctctcaccctctctccttaactcctgaatacttggatagagcggggctttgtgttgattgtaagagttgggttttgggcgatcccgaccgtgttttctttgttggcctagcggaggtcggccacggttagtggtggccggtccggtgctagccttctccttgttcagtgttttggcgttgtcggtgtgtgggtggtggtatatttttccctttttcctagttacaacttccagggttgtaatcttataatttttcttctgctctatcaatagaacttcgcaccgtcttatgcgagtcgttcaaaaaatattataacttgtatgtaattataatataatatgtatgtaactttttatgtatttttaatctggtatatttactttaagactctgcaagcgggaaaggaaaaaatcatagcgcaaccacgggtgatgcaatttggtcacgtgtactcctttagtggaaataatgtgttaaacaaattatattatagttatgtgtaagttacactataattatattacaattttaatatttacattggtaatccctttcaataatactttgctatacctggatgagttaacgtttttatgtaatcaattaatttaagtgttaagcagcaggacatgcctaacgcatttcttggctcttaccaacaacatgagaagggttgcgttctgctatagcattctgttagcgtttgcaatgatcaaagccagcttcagtatttcatcaacgctgtttgattacatttccaaacagttgtagtactgatcacttttgctacagatcacactctctatatttcagttactaccttagttttttaaatacttgataccattaactttctgacaaatgtttgaccatttgtcttagttaaattttttatgtaaatataaaaaaatatgccacacttaaaaaacattttagcataaatcaagtcgcaataaaatgaataataattacataaactttttaatatgacaaatgattatacgtatctaaaacaacaacaacattacatattaaaaaagggaggaaatatgtgactagataaattcagtagattcagaaaaccttttgctgcaacgaaaaaaaaaaaagctaggtgcgaattgtggtgggcctatgcccctcgagtcggcttcgggtggcccggccggccggagatagcgaagctggcctgctcgttagcccgcccccaatgcggcccacgtaaatcctgacaatcgcgacagataaccgttttcacgttaactaggtcaaaagttaaacaaaccgttgacaaaccatactttacaataatgtcaaaatgttcaatacaaactcatgattatctgtagtacgctgtacacattagtcgttgttaccttgcgagatcaaccgtcttccaagagttgcctgtgcaaatttgacgtgctcgctagtcgctagttgcccgtccatgtgctaataaaaagagaaaattccctatatacccctgaaaatttactcaatcccttcaatacccctgaatttgacattatcccttatatacccctgagttttcattttgatctcctctatacccatctccgttagttgaccattagttgaccgttaaatattttaaaatgactatattacccatcctatacatatgtgtggtacctacccaataaattttcatatgaaaaataaacttatacaaaatacaagcaatataatcatttaatgcccaacttaaaaaataaaacttattattttttattttttaaaaattatgattaaatccatacattagtttcaccagaaaattaagagcaaaaactaaatgttatttaggtttaaatttttgggaagatatacgaaattcatcaaatttgatctgaaatttatttaaaaattttaaatttgttttctaatttgtgataaactaattatatcccctttgttttttcacaacgaatcttttttcactaaatatttgttgaaaagtaattttcaaatcttatgcagaacttttttttacaataaatctttttttattttaatgaaataatgttttattttcaaaaattcataacaaatatttagtaatttattccttattggttttcacaactcaaaaaatttacacataaaacatttctagcttttaacaatataacaaggacaataaagtaatttctacaataactaacggtcaaactaatggtcaactaacggaatgggtatgtaagggatccaaataaaaactcaggggtatataagatatcaaacaaatttcaggggcgtagaagggattgggtgaaattatatgggcatatagggaattggccctaataaaaaagaaattggtgcggtctttggcacgttagctagttagcccgtcccatactgtatacatatgaatatgtacatggattcgtgtatgaatctatcgacaatctaaaacgtcgtataatgtgaaacagatgaagtatttaacagagcttattaataatacttttgttatcgttttccttttagataattttattttcattttatttttttaggaaacacaattttattttctagtgtaacttacagcacatagtatttacctcaagatttacaatatccacatattgtggtgagatttattgtatttgaaaaaaaatgataatagtttccactctaaatttttatttaaaagtataaatgaagcacacaagtaaattggtgtatgattagattaacatgttaaatgtatatgagactgtttagtagaattccaacacataaatttagctttaggagttagatctaaagcagagttgtggaacagcttaaatccagctccacctctatagttcagccttgtttggcaccgtttcagctctggagcccagccaaacaatttaaactctagctaaaatgggagcggagctgggtggagcactctcacaaaatgaactgagaagtggagctaggtttcgactgctccacaactccactctaaacccacattataaagctaaatttaggggttagagctctaccacatacctactccctccgtctaaaaaaaaagacaaaccctgagtttccgtgcccaacgtttgaccatcagtcttatttgaaaaaaattatgaaaaaattaaaaagacaagtcacgcataaagaattaatcatgctttatcttctaacaacaataaaaatattaattataaaaaaattcatataatacagacagtcaaacgttacatgaaaagtcatggtttattttttttcgatggatggagtaaaatactgtattccgctccggttcggcgacactccacgttccagtcgtcgcagtcccggtgcgcggcgcccaaccggccaacccaccgacgcggcaggcagcgagtcagtgtgcgtgcggctgtgcggggggagtgcgagtgcccatccgcccactccactccactccactcccctctcccgcacttccatccccaaccccgcccccgccgcggcgccaccttccccctctcctcttctctctctctctctctcatatggtctcccgcggcgcgccccgctactgtccatcctagcgcggagccgcagcttccccacacgtccatggccgccgccgccgccgccccccggttcttgcccgtccgcccgctctttctcctcctcctcctcctcgtcctggccggcgtcgcaagcggcaagacggtcaagagggacggtacgtagctggctgctccgctcatccttctctgcacttcttttttttttctttcccccccgtgaattgagcgagtgatactggtctcgtgatgcgcgattccgcgacatggaatttgggaaagatttggtttctttggccgttccctgctggagatctgaccatctggtgccttgcattcttttatgctcatggctgtgaattgggcacctgctcgatcggttagctgcctcatttggggtgtgtagcattgggatctgttgttggcttgtgtcttagatgtctaaattactctgtgattgtatacatgtgactatctagttttgccatttcctagctgtatactaattaggctccacactgactgacactgcatcaggtggagaggtttatctcttcatagagacatggatattagtctgacttaacaatgtttggcggccattgagtaatttcatggttcgtagaatgttggaaccgactgaaagaaaacaattttttatgctgcagtgaaagcattgaatgagatcaaatcttcgttaggatggagagttgtctactcatgggttggtgatgacccttgcgggcatggtgatctgcccccctggtctggtgtgacctgttctcagcaaggagattacagagttgtcaccgaactgtaagaaacacgtcttcaatttcttgatcttaaaattttctgctgacatacataaggatctgtaaggatttttagattgttatgtattgccttttctatgtgaaagaatacaaatctgctcgtagattgattgtttccgagtggggaaaaacatttgtcacttatggtctccaaggtcaaaacttttgtcttgcttggctgctccaacatccgaaacactcttttactccctagttaattaaaagtgcaatgatatttcttgcttgctgatttgatgtggaaactagctgattaagtcctttatcttcatgctgtagctgtctgaggaatcttagtaaaaggctcaaagctacacaaaattcataattttaatagtttcttgctgagtcttaaatatgcaacctcaacctgaagaactgtacctgaccacgctttcttgtgtatgccagatataaagctttggtgtatgaggccataaaatggattagaaaatcctcttacatgatgccatttcgttccttaaatttcttttctgtaaatgctttgaaatagttggcaagaataattcttaactgttctaataccaatggctgctgcatatggatctcaactctattaaccgcaaaatcatgcaacttatgttaagctatattatatgtttgttgatgtacaaatctgagtaactatattgcttatcttatttcagtgaagtctatgctgtatcaatagtcggtcctttccctacagcagttacaaaccttttggatttaaaaagattgtaagtatgttttccttgtcaccactgctttgttcccgtattatgtacaattatcttgaggtgcatgtgttggtactttgtaattatttggtgcaacctgagtggagttaatgttattgtctaattagttaccttctttgcaacgataataaattatacgtttctggtcttttagagttttagtacaaccatcagcgaaattacaatagaacacatctgtgcagatgtatgcgctcttgtaaatttatgtttccatgtaataggctgtgtcatgaaaaatggatttagagagaacattagccataatagaagaattaatttattctttaaatcacttcagcttataaaatatggagcttttatattgcttgagttgcagaattctatgtacaaacagtttcttccatttgcatattgcagcggatatatttgagtagtattttattttcccaaaaaaactatacaggaccaattcttctataaaacaagtaccttaaagggtgtaagtatctttgtaatttgaccatatcttgcatatttaagcaatcctttaaaccatgtgaataatgactactccaactacagggatctacacaataacaagttgacagggcccattcccccacagattggacggctgaaacacctcaggatattgtaagtatggattgtctttgtgtatgcagagctagattaagatatgcttgtcatcctgagaatagatactggctctggaaaacattttaatttgtgatgcataaaccatacttgtttatgctctttattcctcagcctcagataatactttattgaatcaatattactatgttggttattggctagatagctgcctgttcttgagtacagattctattcagctaatcaaattgtctcatgttcttaggaacctgaggtggaacaagcttcaggatgtgctcccacctgaaattggtgaactgaagaaactgacacatttgtaagttctttttctttttggaattcttgagtttatatggaaataatacttcattttttgtgcctctaattgccattgaaaatatgcagatatttgagcttcaataacttcaaaggtgaaattcctgtggagcttgcaaacctaccagaactgcgctatctgtatcttcatgagaaccgctttactgggaggatccctcctgaacttggaactctcaagaaccttcgtcacctgtaaacatccatcccagatccttttactgccccccaactattgacatgcttgtctattgagttgtcttactgaatgctgaattccatttttgcagggatgttggtaacaaccacttgataggcaccctcagggatttaattggcaatgggaatggtttcccctccctcagaaatctgtaagcagattttttacaagctaccatatccattccttctctcctgaatggcaaatgctgtcttcctaagcttactgtaaactgtgttctacaggtatcttaacaataatgatttgactggcgttctgccagaccagattgcaaatttgacaaacctcgagatactgtaagttttcttaaactttgctgtcaacactgtatcaagaccctgtaaccatcacgtcattcttttacatatgtatactctgcaggcacttgtctaataataggctgattggatcgatatcaccaaagctagttcatattccaagattgacctatttgtgagctttactgcttcgatttctatatttatgtaaagtgaaatatttgatcagcttgggtctgatatgtcatatgtctcattttacaatggttttacagatacttggacaataacaacttcattgggaggattcctgaaggattatacaaacatccatttttgaaggagctgtaagctggctttagaatttctactctcacgacattattatttcatacttgaatctgctctgttttaggtttacttaggcgcacacttttttttttttttgatgcaggtacattgaaggaaaccaatttagaccaggaagcaaatcaaaaggaacgcacaaggtgcttgaattacctgatgctgacatcttagtttaacaactgtttattctgtgacgatagcagagcggctaccgttctacatctcctcagcatgcaccaacaaaaatgtatgcatgtttttaggatatatacgatatatgtatcagtagtacagacactgtttctcacagcactgttcgaggacaagttcacacacacaaaaggccacttgcaaaccagaaaaagaaaaaaaaattgtaaagtccagagcactgctgctatcctgtcatccaagagtatgttttcattagatgagtgtacaggttgtattgcatttcttgtaacttagtactactgtgtaatggagatgcagttcagctgtattgccagcacatttgcatggcaccgacagtcctggtgtaatgtaaccagtgtgctcaatgatattttttcttataccactggacatgatctggccttttgcaagcaaatttagggccatgactaatcgaaatcataggcatgtggggaggagaatatgccaataataacaggctggatctgcctatacgagggagcactcttattatgagctaatgctcttgaaccctttcaatttcatatctacagaaaaaaaagccagaaaataaatgtttttttaaaaacaattttacaagagattaattatatataaaaaagaattgggccatgcactcatgatgaggaaaaaaaactgaagtgaaatctaggaaaaattgtgtggtgtaggagtacaaactagcagtctagtaccatgtcatctccaggcgcctccagtgcagaaaaaaaaaactgacatgtttataagctcagtttgattggatgagtgttgcagtaaggaatactgtcaagggcacatgcatttcttacaccatttagcatgacacctctgctgggatgagtggtccatactgcatctggtacctctgctccctttcaagctcatactatgatgctttttcaagggttatgtttgttgctagtaaataaaggatatgaaataggtttgatgaaatgtaaaatacttgtcctgattgatgtcaccaatgtagcatggttagattgtgctgccaccctatccaataccttggtacatgatgccaaatatttgctgcattgctggaaccaatgtactgccaatgtaaatctaacactgttattttgtaccctatgaaaagttcctgtcctgttctctgaattgctgtgtgtttagccccggcactcttgatctgtttgccacaagcaaagtttttcttttcttttctcttcagttcttctccccacatgaagtgtcactgtccagtgtccacccccaaaatggtccttgtttgtgctattttgctgttcccatgtaagcaaagcctgtgctatattttgctggatcatatgagctactcccatggagtagtatatttcagacttggagatgtcctagtctcccatgcttccaagcacatctgcacatggagaaacattcaccacctatgattaaaaagggcaagaactcactgaagacaaatgcttcatgagcaaagtgaaattttctgtttcaaaatatgaacaaatagctaagccatgttcataccacagtgccagaggcttgtgacacatcctgcattcttcagatgctgccctcaggcatgtggcccatctaatgactagcggctcaatcatactttgcaggatagtcaattgtgcaggcttttacactggttttgcaagatgttcagtacttgcaaaatgaacagttacttgatgttgcatgattgaatcttgaaagagaaaaatatgtgattatatgattatgtatccatggatcatatctaattgcaaggttcaggaaaatctcttttacataaaatagaaatttagaaaattagggcagtgttgaggtgttaggttcaccgacaccgttagggggtgatgtctgctaagatttttgtgtggttatgttccttccattatagctgtcaattgtcaccttattaaaatctgaagaaacactcccctttctcctcctttgcattttctgaagaagctgagatatgaacaaacatgccgactgaatttcactgaatttctctgctgctacctgcccatctttcatccataaaaaaaatgtaaacagttaaaaatacagtagcactgtacctgttcttgggtgtatgatactaaattactaatatagtataatgattcccattcctgtagcctgaggagcctgtcatttttgccacttgtttttcttttgccctctctgcaaagaatcaatcagagaacacacacatgagtacatggcacaagccaagctgtgcctctgcatgcatgggtcacctggggtgctggagcatgcagatgcagcagctttgccactgtttgtttatttcaccaaaacacaaaccaaaaggcatcaccaaggcaaccaaaccaaaccccatggatggtccaaggctgtgagtgagtgagtcccagcattcatcataattttgattctgctcatccggatgtttctctgaacatgacaaaatgaatgacatttcctttatctagaccatcatccctttatctgaagaactctgctttttttaatccattcttgaggtttggtatggtttgtggagttgttcagagaacagctcaaacctggactctactgatgatgctctttccaaaataataataataataataataaaacctttagagcaaaattaggaggaataatttacataactcaggaaagaatctataaatgagctatatacaaaaagctcatcaatcttccaagtgacctgtgacactgctgctctattctataacaccataagtgctaccaaaccacctatcaccaaaaccacctccaccaaacctaacggccgacctcccctgggacgaagaagaatattgaattcgttccattccatgtcactgaatttgtgaaacactatttttaaggttcattgattatctgtttttttaaaggttcagtgaaagcaatggacccagaatcacttgttcagtactgaaatgtcactacatttggagctcattactcaagtgagcaaaagtagagttgagaccacatcaacttgatgttaaaaattaagaagttttaccaagtaaagaaaattaggaacaggtactgtaactgcatgtggggtgatggtagtattatcatatagtagtagcacaattagcaatgctatagtataacaaagaatccaaaggacactgtattttaggctgcaagcacgtggttagccaaccccaatctgattagctagatctgagtgctcagaagaggaggaacatgcactttgtagtttgcaccaattgagcactgcattatcccaaatataaaatggcaagatatctgcttcagcttctcttccttcttcctttttttctctttctttttttttgtttgctgggagagctcatgagaggatggcatggcagcatgtagatgaagacatgcaagtcacctagatgccacttctttaaaaaggttaggtggtcactaacttggacaccactccttcagtgagcaaaggggagaattaagtaaataatcagcactagaattcactcaattatctcatgtgttcttacttcgtactacacattttgataatattttcagcaagatatgatagaccacctatacttttgtcactgacaaatagccatttgatttttttccccgggaaaaaacttttttttgaaagatcatgaaaagaccattttcaacatttattctggtctcttactacctttgtatttaaatatatgatactgttgattttattcgatatttgatgtgcaaccttgatcactatttttctattagaatataacgataaaacctaataaaattgtaacattataaaagtatttataaaaaaatctagatctttatattttcaaactaaatatcttaagagctactcatggtcaaaatttcaaatatctgaaccgaataaagtcaaccgcgtcacatatttaaatatggatgaagtattatatttcagtacacacacaaaatccttccattagtttagtgatatgggatcgcaacctgtaaatgagcagaacaaaatggcacgctcagcttaggtaagaagttccactcacaagtcaaactctgagctctcacgaaacatacagctccttgatctccagaacaacaaaccaaaaaaaagaaaaaggaaaacaatgactcactctaccccgaaactgtcggtgcaaataatcgccacgcttttcacaacgcattagcagtaacagcaacagcaaaacgtaattaaaccaccaccaattgcaagcttgcactgacccgagtaataatttaaggtcctgagtttaaatttttataagagcagttgtttgcgaggctaaattactaattcaaataggtgtatatattcggttggatgtcgagtcctgttaaaaaaaatacccttctctctctacaaaaaaagctagaagcttaatcactagacggagaccaagagaaaaaaagagaggaaaaaatgaaaaaaaaaagtgaacaagaaagaaagggagaaaaacgaaaacgaaagtacgggcggatgtgccgtgcgtgcgcgtcttggcagcggttgatgaggagtagctgtcggagaggcgagggctctgaaagcttcaacgccttgattgtttagtcccacctgctctgctccttctctctccgtacgttggtttctttcttcttccattgcatctccttccatggacgtcggagacgacgaatctcactcagtgcgtcgtcggagtggaaccgttcaattcaaagatcggtgggtggggattggaaggatcggatcgggagcagtgacgccaagtcgcgcccagtggcgatggccagaacgtcaattgggaacgcgagagtcaatggcttgagctgagttcaaaccaattgggtcagaacgttgctctatagcaagatttttcattaatattaatatataattaattaagtattagttaataaaagttcgaaaaatatactaatatagtttttttaaaaaaactttcatatataattttttaaaaatacgcgtgtgagaaaagcgagagatgacttacgagaaataacaatgttcatctagttggggtttctgaaataatttatatattcaataaagaaatgaaatataaatagaacaacatcatgctatataattacactgaatgcatgtttacaaacacccttttcatctagtctagaaaatgaattatgcaatccattgctatggaataaaaacctcaccaaacaccccgcatcattatgttttgatctttaagcttttgtatggctatttagaatggcaattccacctttatattcaatacatttgctatagcaccaggtttctattacgttagatgctattgccacattcaagatttaagaggtgacttgtgaggaattaccatgtttaatgtttaataaacaaattaaatcatgttaaatattatgctatacataactcaattacatatgtgttcgaattgcttcaattagtcatatagaaaataagttacgctaaccactgttgcagaaaagaaacctcaccaacaacccaatatcaagccaaaacaataaaaccgcctagcgattccgagtcccattggttaccttaataaaccaaagcaaaaactaaaatttgaatttttaaatttaattttgaagttgattttaatatatttataaactatctaaactaaaagtctataaaacaacacctccttaggaaaaaaatatttcaaaaaataaaagaaaaggagggtaaaaacaaactttttttttaaaaaagagctgaagaagaaagaaatgaacaaccaatcgaaatcacctctcttctttttttctctcctcttttttttttctttctcctcgcggccggaagagggaagggggaagcaagcaagaaaaaaaaaagaagaagaaggagaagccatagccgccgccctcctccacactccatccgcttcttcccctcctcaaaaatcccccaatctctcgagctccagaggcgagagcccccaaaatcccccgccaaattagctgttaggcccccgagctaatcccgaattcgctcgcggcgccctgcattattccatttattattgttattattattattcccatctcttttttagtttttttggtgttattttggttgcgtatttagtatcaccacccgtgcgattagcatgtctcagcccaatgccaccgcctcgccgccgtcgccggaaccctaggccgccgccgccgccgtcgccgtcgccggagccggagtcgtcggagctcccgtcgtcggcgggggaggaggaggatgcagctgcggatctcgccgagcatgcgcagcatcaccatctcgagcagcaatggcgtcgtcgactcgatgaaggtgcgggtggcgccgcagccgcccccgccgccgccgccgctcgcgctgcagggggtggtgacgccgggcgcgggccgccgtggcggcgggggagggggaggtggcggtggcggtgggtggtggggggcggggtggtactggcgcgccgtggcgttcccggccgtcgtggcgctcggctgcctcctgcccttcgccttcatcctcgccgcagtgccggcgctcgaggccgacggcagcaagtgctcctccatcggtaagatcggcgtcccgcgatctggggcggcgttttctgggcttggttgcagagggttgttgggttgttgatttggctcgttttggggggcggcgaatctcggatcttagtgctcttgggcgtgcgattttgcgatgtcggtgggaatgtaggtccgtggagatggttccccgacttcctgtctagatttcctgctgaaaacgcgtgattggctctctgatagacttgtttgttgagctggattcgaggtatcaggttatgcgatcttgtttatgggtgatttgaactggaaacatgagagttagacgattcgagtttatggttcagctcttgctggtgagttatttgttggatcccgggcagctgattttctggtattgaccaaaaatgtatgattcgaactcagctaattttcgaacatctggaatgagtgctatcagctgcgatgttgatttggaagtattcttttatcctggttttgcgctgaatcttgcaaaactggagtagaaacactatcctgtgctggaactgcttagagggttagcttacacaaaatcgcaaacaattgggacattggggatggatatgcaagtaatgcaacctagagaaacaatgcaacacccttgatgcacctggctgattgatttgttgaacttataatttgctttgcttctgcgcctatggcagcaacattcttggccacccgactcttacttgataaattactaaatcaggatcacttaacagttctctcctactctcactataaatatgttgtcaccaagcccaagcaaccatgttgtttatgtttgatgcttcagttattgggatttaaaagctgctatcttatgtgctagacttagcagttgtctccttgaatgtagagatttctgtaatataagtttgaatgctgtttatataccttagacaggttatacacctctcaaactgatatttacaattcagttgcttgatgcatcaatttgttctaagtattgcattttttgttttgcagattgcttggggaggcgaatagggcctagtttccttggtaggcaggggggtgattctatggtaatttacttgattcctgtgcttctatttgtaggtaaaacatgatctgtgttttaccatttctattaaagaaaatgcaaaatgtattgacttcttactcaatatgcacagaggctggtgcaagatctgtataggatttttgatcaggttaacaatgaagaatctcctgatgataaaagaataccagaatcattcagggactttcttctggagatgaaggatagccattacgatgctagaacatttgctgttaggttgaaagctacggtatggaactaacaatcaaagttttttttttctttgaaaacttagtggtgcataacttctttcattaaagcagctaacttctaaaaccaaattgattttgtgatgcacattttgtagttgacagtagcatattgtctgaagtctttgtgttcctggacaaattataggaaaataatgcattattaattcatgataaacagctgcatgaggaattagatatttagatcaagtgcctgatatccaattatgcccgctcagccacccagatgggccttaaaattagtttgaaggagagagtgatacaagagtgacctttgcttatgaaccatgactttgtagcaacattttgttttcaaatgtttttggtagggatgatatacttgttgtacccttattttttgaaagaaattatttcgcttgtgttttatagtgggatgtcttgcagctattggtacgtaatttccattacacacatctcacgttttacatttttggtataaaatttccattacacacttctcacgccgaacatttttggagcatgtgattctgctcctaatgtattttgcagttttgctgctggtggtcatttgatactgtcatactggtcgctagaattttgaacttggctttggtggcaccacatagcttattcatgtcttatatactgttaaccctgatgaggcactctgatgtttgcatcctgcatgtgaaatatattgatcactttatgtgcttctttgtagatggaaaacatggataaggaagtaaagaagttaaggctggcagagcaattatataaacattatgctgcaactgctattcccaagggcatacattgcctgtctctgcgtcttactgatgaatattcctcaaatgctcatgctcggaaacagttgccaccacctgaactgttacctttactttctgataattcattccaacattacattctagccagtgataatatccttgctgcttcagttgttgtgagctcaactgtccgatcttcgtcagtacctcataaagtagtatttcatgttattactgataagaaaacgtatccggggatgcattcttggtttgctcttaattctatatcacctgctatagttgaagtgaaaggtgttcaccagtttgattggttgacgagagaaaatgttccagtactagaggctatagaaaaccatcgtggagtcagaaatcactaccatggagatcatgcggcagtttctagtgcaagtgacagtccgagagtgcttgcttcaaagctgcaggctcgaagtcccaaatacatatccctgcttaaccatctccgcatttatttgcctgaggtactttgtcctcaatattctctattgcggtataatagttcatcattatggtccattggaatgtcaatttatttagtattttctatgtttggaggattttgccagtttagacatttcagttttgtgaaaatcccctgctcatgatacacatttacagagtgcattaggttgtgcaaatgtctgcttggaggcatcagatgattaattgagcttggaaatgtcatggtgcaatctttcttacacaggacaaaggaacttagtggaaagtctacagttaaatgagaaaaaaagtggtccttacttggatcaacttgaatgttttgaatatgctttgatttgaaaatattaggttatgcaatcactaagcaaaataaccttgatatctgattaaaccattatttttattttgggctatccatgttatcaataaattagaatgggctgaaactggataatagctgtgttacttttacagctactgacaaatgaaagatatggcctacccatctttctttagctgatgatattatttatttatacagctttttccgaacctcaacaaggtggtctttcttgatgacgacattgttattcagcgtgatttgtctcccctttggaagatcaatctcgaagggaaggtgaatggtgctgtggagacctgcagaggagaagataactgggtgatgtctaagcgcttcaggacatatttcaatttttcccaccctgtgatagctcggagtcttgacccagatgaatgtgcatgggcatatgggatgaatatatttgacttggcagcttggaggaagacaaacatcagagagacataccatttctggttgaaagaggtaaccttttttgtccttacaataatctctctctcattaatcagatgggtgctttgatcactaagcatcagtgctatgaaaaaagtgccttatctgtcttggcataaggtagttgttttgttaagtgctggaagtcttgaactttctttcacctggcttgcttctagttaagattctgtttccaaaatgtatcctctgctgcttttgagatcaacaatactattctggatgtacctattcgacatgtagaattttagaatggttcctcatgtagatgaagtcttatgatcaagaagcttcaaagtaatattgatactgatgaataattaaagttcattccaagtgaaactttcatatgtacagtaggcatgcgcataagacctgatttaagaatatataaggactctgacctccaaaccagaacctccaacaggttaaactgggatttagctgatgtgtctattagagaattttcttgaaagtgacggctaatctaaaatctagatcccataacagagcagtcaatgatattcttcagagtattacgagcttaattgtttggtataacttttgtatatttcttgtacagtttcatctgatgtattacagaatctaggcagccaacattgtattaaaatatttttactggtgtgcttctgacatttttgctgccagtaacacaaacacaccccgccacatatattctcacttatccgtgtatatttattgtgctaaaatgtgtaacaagatcataatggtaataccattactgctaggattctacctggtttatatttgccattatgtgctatatgaaatagacctaagcaattaagctatattaaaagtattgctagccactgacatagagaagattttagtttcatctttgtaaatacctcaggatggtaattttataatgctgaaaagtgaacagtatggcattgtctatgtctttgtttaatttcataataacctctgcttcttttgcagaatctaaaatctggtcttactctctggaaatttggcactttgccgcctgcgctaatagcattcaggggccacctgcatggcatagatccatcttggcacatgcttggcctaggataccaagaaaatacagacattgagggtgttaggagatctgcagtgatccactacaatggccagtgcaagccatggctagacattgcttttaagaacctacaaccattttggacaaagcacgtaaattactccaatgactttattagaaactgccatattttggagccccagtatgataaagagtgacttctgggaaatggggtaggcgcattggagtatatcataccggttgtgattcatttgttcactggagaggctgattgctgttggatggtgggaagattggtcaattcgttaacaaccagaacacaatcagcactgaacatacctgactatgccctggatcgactggcatgcaaatactcgagacttttcatctgtatcatatatggctacacgattcttttcatctgtatcatattggcgcatcattcttttcgacactatgaactgcgaaggatagcttggtgaagtctccctctgtgggattgggctaaatccttgaccgcagaataatgcagcggagggtagcacagattgatcgatcgatcgattaattgatcatggcgaagtaagagaaggcagccactatgaggtcgcgagagtttatatgttttccccctcattttattctttttttccttcttgatatactcgagtccttgaaattttgttctgttagttttgtggttgctttggtaggttggagatgattgtagtagagatgccattgtttgtgagtaacctacaggacattgttacacttgttgacatattgaaaatgtgcagataattctttcaagattatttgtgttgattttcccgattacggaactgaggcactacgaatcattgcccagattttagctcgattcgaacgtcacgtttttttgttcacaaacgcagacgcttatgtacatgtgatgtgcacgcatctctattgacttgtaacatgacacgttattagcctagacagcactgagagtgctgctgctgataattttcggacaaatgtttacgtattcaaagggaaaaaagggctaaacaaaactgagcgaaagttgttcgtcctgcagggtccaaattttaatctccgaccccattgactagttaaaatgaccgaccctttggattcgcgattaaaattcagttccctccttaatcctcgttgattaatctctaaccccaatccaaaacaaaaaataattccaactttagggggttcaaaataaatccagccctgagggtttgttaaaatgacctatctttcgaatcgcgattaaaatgacctaacaatctgacaatctctaacccctcctcgtctcgtttgaaaaataaataaataaataatccggtctgtgttcggagtttcaacctgcgtcccccttgaacgcactaaaaaaaatgggcctgctagcccagcccaatatgatttcggcgtcacggaagcactactagaactagcagattttagtcccacctcgactgccaagcgagaagcgatgacctgggaggtgtacaaataggtggccttggcagtcggtgcagagcatggagctgcgtggtgaacacaaagcgaactattctttcgccttttactaaagaataccgtgtgcgcgccacattaagcagcatacctttatttttggagggtgcttttcctatcaggaaaggccccaacaattccaaacttcaaaaattttgctcacaattcaattgttatttactcaaaatctgtttacattcttgtaatttactcacaatatgtttaaattcttgtaatcgttctatgcattctaaggtaaattcttgtgatccttcttgtattcgaagggttttggtacattcttttacattctaaaggctttgttattcaaaccagaaaacgaacaaatggaacactccattcttttacattctaaaggcttacattccaagggttttgctatttaaaccagaaaagaacaaatggaacattctaagggcgtaatactcaacaagaaggcaagattgatcactcaagaacaggccttggcctcaaacattggaagaactacaaaggcgatcgatgtcggtgccaggtacaccggcgagttgacagcaacgagcgcagggctcatggccggaacgccgccgtcgtccgagagttccagcggtgcgccgttgagcagcatcgtcttgctctggaggtcgccgtccttggccgtcaggtggtactcctccctcctcgcgacgtcgcttgacggcttgcgccccagccatgaaaccgctcttctgaggctgtgtgagaaagaattgtgcttatgaaggctggctgttttgtcaaggctgacattgatgtcattctggagggtgacgttgtatccggtggtattgctcaggttgatcaacaggagggtgattccttgctgcatgttgaaaataagatttgtttcagattcttacatggaagagtggctaatctagacatttacctcacttgaatttaacatgatgtttacatggaaatacggcaattttcggtcatagcaaaacagtcagcggtaacgggaatgccataatttgcgaagtcaagaaaagaaaaaaaaaagtgtgcaatttgtacctgctgtttcctgcaatgagcataagcacgcagtttacgcggcgcattgatatcaactgaaagaacttccctgcccataagccgatgccatagtagagcactggggacaaaagaaggtttaaacagtgaaaactttgtaccgtaaaatgctgcagtaaagtctaaagatgtagccttacctatagtaatcaggatttggcaaaaaagtttgggtgtcaagtagaccatagtggccaccaatcagagtctgcctgcagaatatttttgtattgtacttagatgccattccaagctgatcaagatacctgtttgcattgaaaaaccatcacaaattcttgctgccacaagatgctagagtgtagctgtgaatttattttggtgtctgaccgcatgtaattgtgaaagttcatgagaaaatattgagagctgaccagatgctattgatgaaagtgtttgacacaagttcaccgccattgttgaatacacctccgctttcgctgacccaggcagaagcccatgttccatgcctttgaagggtgagttgcatatccctataagtatcttctgaacgatctaaatactttggatctaatatcttccttataaggtgggcatcattccctgaaaacatggcgtcgccattgatgaattttgcttattaattacaaaaagtggactaataatgataaaataacctggatttccagtgaatcacgcttatatatttctgatcaaattaaaaggactcaaatccaacacaaaagatgttcttaacatgagtaagaaaagaataaaagcctgcaagaaactcatgatttggcatttcagaaagaccataacacaactcatcgcttaacaggacagaacccttttttttgggaaagttagagagaattagtatgattgaaaaatgtgaaacaagtaaaagtcctgcctacaacattcttgatcattccctcaaaacgtcaagctacagaatcgaagcacagaaacgatttttcagatgccactagagcaaaagtagcatatcacatacctccaccaagattataaatatgatgcgtcaaagcactgacaacgccatgaccagaagtctgaagtagctgagtgtaccactgctgatcaaagaatcctccaggggctaacagggatggctgggagagtggtgccttgtacaactgttgaaagatggatttaagttcaattgcatcttttccatacagtgtagcatcgactcttgccccaattccatgcccgctcagttcattacctgacaaaacaacaaatggcactattgaggctcacattcgctcagcttacttcatgttccagaactccgaataaatggtatgcaatattaaatgaccaagtataaaaaaaaataatacaacagattaccatattcccatgagtcaactggatatccctttgagattgtgtattttacaaaattatatgcatttgtagagttccatttgctagcccagaaagaacgacggacattgtacctcccatagagcgcattcagaccaaatgtgataattgcactggagataaatgtttttaacacccattagctagctctgataaacaagtatgagttgcatgattgatgcaaaagaagattttggaacttcatgaagaaaatgaaaaaaaaaatatgcataattttttagggagagttttttatgcataatagtcatgtagttaaatactcaccctgttttttggaatagagcattcagtttgtcccacctatccatgcttagacaaccatctgagaaaccaaataaaccatttgacatgtttgtgaacggggcgcatggactgtttgtacccacatcataaacaactcggtcttgcaaagagcctcccagtctaatcctcaaattatcaaatgctgcagagagaacagagaaagagagaccgtgagacatttagggaatcaattgacttatcattgcaattgaataagcatcctgcaaataaacataattgtatccaccgatatggtgcagccgcagatagtatcatgtcagattttgagtagtatttttttctgctgagaattgatacaacacagatagtaggaaataagatttaagagcttctttggaatatcatctcaaaagagagtatacaaaatctttgcaatggaaaatttatagggatccgactaaaagtagaaattgcattcttgcaaactacaaactaaagtagacgtgcttcctaggctgcaacaatgtttgaatataaaaggacttattgcattagagatgtgtgtttgcaattcctttttgtctttaccgcatcactcacctatatacgaaagttctcctctgataatccagacaaacccagcagaaatgattaatatggaagcagtaatcacctaatgaaatccaacaacataccttgaatggcttgagccaggaagggatgatccaaatcctacatgaaccagttggtggaacaccaaatgagaagtaagcccatgaaccaatgcacaataacagcatataaaagtagtactactccaagggaagagcataacaataccaagtttagaattgacgattggccccatggacactgattatagttacacttctctggtggccaccaatcgattgtagcacatatataatttttattcgtttcagcgatttttgtcgatcccttaactatgaccgtcgcctcctctggctgctgagccgaagccgcccaaagaagagcatgcagacatatgaacactagaagcagcagcctcacctccatgcctgccacctataacaaatcacgatcaaaatttgttctatgcactacaagagtatccattttctggaatattatgaatttcttatataaacttttgcggggattggaagattatgagctgatatgataactgaaaagtatgcataattagccactcagtgactgatgcgaaaatttctaaatttcaccagaactatctgaattcaacaagaagacatgacatactaagcaacggtaactgaattaaccgatcagatatagcaagaataaatacttgtctgtgcccaagaaagatttttttcttttttttttctcacttaacacaaaacatgccatttctaacctggaaaaagacgcggagaccccacacttgcaagctcacatctgcaagacaaagatgccgatttctaagccggcgaagcaagcggagatcccacctgacctggcctggacacctcccctcctccgccgccaatctccgtccctcccggcggcgcgctggctgcgaggagatccggcagttggccgccggcggattcggagctcacgggggggcccaatcaggccgccatttcttggctctcagggtgggtggtactggtagctcggtagctacaaccggaagaagctgcctttcggggatacaggtgatgatgatgctgccggtagagctgcagggcacggcgagctgagctgcttcttggagcaacgtggcaggacaagggaataaacagtaggtatatcttgaggtgcgtgccttctccttctcctactactagtactacttctctgtgctgcagcagagtttgcttgtgtcggtgaattgtgtccgattcaggagatgctgtgtgtgtgagatcagtgactgtcactgtgagaaaacaaatttcagaagaaagttgaataaaataaatccagtaatggaggtcagtgaaccagcttgttgaaacagaggactcttagatctgacttcggtaggagttaatactccctaagtaccataatataatagattttgattttttttattgtattgtatgaccatttgtcttattcaaaaaatttatgtaaatataaaaaacgaaaagttatgtttgaaatactttggataataaagtaagtcacaaataaaataaataataattctaaatttttttaaataagacgaatggtcaaacagtacaaacaaaaagttaaaatcccttatattatgagacggagagagcagtaaactccggtatagggcctgtttgaatccggagggctattaaatagccatccgaaatcttgttatttagaagtattaaacgtatattactgacaaaacccattccataacccctacgtctcgtaaaatagtctaagggttatggaatgggtttttattagtaatctatatttaatacttctaaatagtaaaattttggagagatatttaatagcctgaagatccaaacaggcccatagttgtggtgataagagcagcccgatagtgacagtgcgcccaccgcgaagctttgctcgtgtcatgtgtcaaagcttattctttttttaaacacctccacgtaaccacctacgcctacccgtagcaaccgcaagaaattctgttcaccaatattaagggcatgtttggagacttctaagattagagcaagactaataatatagccagctgctgactgtatagatctttatagcatatctctcagctcacttatataatggttagctcttttctgtaaacatatgttccacctgtctgtctcacaaattttcttgattcctatgcctaagccggttataaacttacagtccgcttctcatctctctcctctcctttctcatccacctcagcattcagccttcttataacccactattattcttgctcttatgagaaacaactactcactccgtccaaaaaaaagacaaaccctagctatgagggagtagttggtagccagcttctaagaatctgtaaaaactgggttttccagcttctgacttctagtttattttctgtattccacaactataactttttaaaatttggataaaaactagactgtttaggagaacttctgattctgagagaagctgcagcagctagaagcttctctaatcaggccttaagtctcctgttgttgcatatacgagcagcgatacggatgcaacagcgaggatttgttgaaggaaagcactagaccaaccaaacggccaggggggagacgcggcctcgtaaagcttactgaagagactaacccgtgctattacgtgctaaaccaccacaaaggcacaacgcggccgcaaggcatgcgactgcgccaccgcatttttgcatgggatcccggccggaacatcgcgtcgcgcgtcgataggcacaggctgcgttcggcacggaaaacggagccataattagcaagtaattaattaagtatttactaattttttttaataaaaatagattaatataatttttttaagccactttcgtatagaaactttttgtaaaaaatacactgtgtagcagtttgaaaaacgtgcatatggaaaatgagaagtcaggaacatttcacggaacacagccacagttggtcacggcacaaaactttggtggtgtttgagaggggagggacttattttagtccttctcacaatataagtcccttctctgtgacttatacttttgtgagacctaaacaccaccttactcactcatatgcggatgcgcctccctatcccgggcaaaagctagattcaccgtgtcatctactccctccgtctcaaaaaaaaaaaagaagcaaaccctagatttccgtgtctaactttgactgtccgttttatatgaaatttttttataattcgtatttttattgttgttaaatgataaaacatgattaatattttatgcgtgacttgtctttttaattttttttcatattttttttaaataagacggacagtcaaacgttggacacggaaatcagggtttgtctttttttaagacggagggagtacatacatccacagatctacccgttgtttgtacgaggaacttgtgtgccaaccaacccaactattcgtcttcgtcgtcgtcttaattaacgtaagcctccaagtccagtctgtaagcatggcgagaagggcggattcaccttttaccgacgttttatcagcattgtcgcgcgcataaaatagaatcggacacaagggttaaggggttggagttttaatctcgtttgggaaaagaaatccgttgaggaacaattttcccagtaaacataggcggacacagtcaaaagaagaaaacatggagcaatgtcaccatatcgtatcacataatcaccacgacaacgtacgctggatggtcatcgccggatcatttacacttctttttttttttacaaaggaacatgtgtaacctaactgttcgtcttcaacataagcccagggtttacattaccatcagcaaccgcggttaccagtcttaccgcggggtacggtaatagaaaaaccacgataaccttcttaaattcaaataaatttagaaaataatttgaatttttgataaattttgcacggtttggtatggtttttcacagttaccgcagtaaccacgcttaccgccggggcgcggtaaccccggccctggcggtttgggaaaccctgcataagcctccactttgtttgctttagcatggcaacagctaaaatgagaactgcttgattcagaatagtgacagcaggttacatatagtggtgtgatgcttcgtttggatctgtacagctactgactgaactacaaactagtgttttctcagggacattattctgctagtagtcagtggctaaattctgcagcatgaacgacctggtcttgccatctggtttcaacccaatgctccgcattttcgtgtatactttcctcgctaatctgatcttgcctcgcagacaaagcccgtgaattaccgtgttgtagaccgaggagtctggagcgacctcctgcaaggttcaaagttcatataaggtgaaacgaatgaaatatgcgattcggtccatttggaagtatcaaaattgcacagagtaatatgtcatgaaagttgaacatcatgtatttaaatgctaccgtgggctaactaggtacgattttacaaacaccaaaaaataggaactgcagaaatttaggcatgctttatccttaatgttagcatgatgaatgggtgaggaaacaagaagctatatgtatactgtatgttttagcatacgtgttattctgaatcatggtaacagaaacattggaaaccggaaaacgtcaaacagacgtagaaaacattagttacggttcgctgggctttcaggacaaaggcagaatcataggaatcacttgccttaaccaatcaaaatattttttcatattggcagcaaaaatataagagcttgtttagtgttttcattttctttgtttctctgcgtggaataatggtactgcaatctacaacatgcttacacctaggaacaggaatttttgccctaaccaagcaggggtcagagtgccactaattctgttaatcatgctttaggtaccagcatggtagactaacgcatgctaagcaatgagaaatcccggggtcagagtgccactaattctgttaatcatgctttaggtaccagcatggtagactaacgcatgctaagcaatgagaaatcccattttttttggccatctgaacagaagtataaagcaaagaaaggaagtagtacctccaatatatcctcaacttcattccaaagagatccccatatgcaagctcttataacagataaatgtgtgaacgtgtctggtgaacaccctcgatgagtcatacgccggtacactttcagagcaacttttggcatcctagcaacttcacaagcacctatcacatgattgtatgaaaccgccgatatttgaagtccacctctttccatcatccataacaattgcaagccatgttcccattgaccaagtctttcacaagacatcaaagctatgttgtacagatggttatttaagagtgctgaatgcttggtcttaattccttgaaaaagatctaggacatcccaacaacgaccagacctatataacgctgacagtaaagcactccatgtatattgatcaggcttaaggcctgaagatgttagcagatgatacatcctaaaggcaagttcatcttcaccggccttaccaagtgagttgattatggaattgaacacaatgatactaggtttcattccagcactcaacattctcctgaatgtggtaagcgcaaactcccatttcccttcttttgtacatgatgcaatgatggccttcagtatatcttcacttggatcaataccacttttgaacatttcctgataagcatcaactgctaactcagactgcccacactggacaaatgtgctaactaacaaatcataagtcatcaaggttccactcaaagaattctcccctagccttctccaaagtctctccacctgcctccagtcttttgctcttccgcacacagatatcaccgtgttgtaaacgatcacatcgacattcttcttatcgctctcttcaatttcatcaaacattttcagggctgcaaagtagccctcagtagtggcaacagccttgagtatcaaggtgtacgaatgcccggttgccattcctttccccttcatgaactcgaataccttcatcgcatcggcgaaagaaccccttcgcacaaaacaagccagaagggagttacaggcatgcgcgctcggctgcaagcctgaggcacgcattgaatcgaacagctcggtggcactcctgaccttgttggactggctgagcttgatcaacctcctggacagcatctcctcatccctctcctccaagaagtgcagcctcgatcccccgacctcagatttgctccccgcggctgacgccgacgccgacgccgcgcttcttgctgcggcgacggggccttcctccacagcagccggcctcaccgggcgccgccgcagcccgtgcctccggtgaccatcagcgaccggcggctcatcgtccatgccccaaaccgccacaccgacctcctccttgccggcgacgtcgggttcaagaacgcatggagccgccgccctgcacacgcgcacgcgccctctggcgaagacaaccacggtccttgcagcttccgcatggcgggtggtggcgtctctgcccgctcctccgctccatggatggattcttgccccatcaccgccccttcttccacgcgggtgtgggggaagttcttggctgaagctcgtgctgcagccgctccacactgcagccatatatgcccgccccgcaaatgcaaacgaaacctgcaaaaatctctcaacaagacaaagggattctggaaatcacgctggaagagggattcggctggctcatgaggggaaaatcggcaggaaatctggtgagaaatttggtccctcgctagaacggataggagggtggagaagaggaagagggagaagagaagaggagaagagagagcagcaatggtgggagcagagcagcggatgaggggattagaagatggagggctcgttaaatgggccgaagtttcctttcatttaagatgggcctaattcttcgtcctgacggcccgtgagatcaagctcttgattattttcttggcccactaatgctttcttatttattttagaaaaatgttctttttaactttttttagtaaattttataaaaccataccaatatggtctaagttacacaaaaccatagtgattttagcacatggaagtattatggtcctgaagtttcacaaaagcacaccattgaccaattttacatattcctatattcaaaatttaaaaagctttacttacatgcacgtgatatttatatgatggataaaaaattcatacatttgagatattattatacaactttaaaatgtggttgatcaaagtcaaaatgtttaatagtgtggtttttgaaactttatagccacaatatttggggttaagtgccatgccaaaatcatgtggttttgtgcaacttgtaccaaaatatttagggttattttttatttatgattcttattgtcgtttactgttcagtcttgtcactagatttttactagtgcggaaaagatgaacaaaaatgcacacacgagaactgatgcttagtggactggcatgtctaatctttcaacctgatagctcctttgcaagaacaaaatattggaaatcagtatcccttctttggacaggatgcagtttaacctttttcctttctagcaacctaggcactcagaataaagtagagtaaaaatctagcatccaactagaatcacagaacagattctgcacttgtgagaaaaagcacattctgtttactttgctcctccaatagggcactgaaaactgaattttgcaagaaacaggtttgaacactgaattgacatctgtaactgattactagctacgtgcagagaacaagaatatttcatattaagagaatgttagacaaaaatgatgctgaattgcactaaggaaaatattccctgaatgtttttttttcaaaatttattaggcaaatagctagctatcttcagacttaagccaagggcaagaagagcaagagaaaagcacagggagaaagaatagcacatgctaagcccaaagaacagaacaaccaaaaggggggtttgattcttgaagatttccatgggttaaagcaatcccatatccattcctcttgcctttctacaatacaaaaaatggcttccttgttctctgcctctcttcaccacctatgaatacaagcaaagcaatatttaaaacgcaggacttcgcttagttctgaagattgttcttccttggagctattcgttctctacaaatacgttgggcgccatggacggcgacttgaagaagctaaggtatgcaaccgcatgaaacatcttgaggtgaatttggtgaaagctttggattttactttgtttcgtcggcaaaagggtaaacttttcaatggcttaattagtttcgtgtcatctcaagactgtagctcatacgagctactagctcataactgtagtttttgtgcccttttgccccttgtgttttgtcgagaacttcaaatttctgcaagaaaatgtgttgtcatctttcctcccttatttacttgttcagttcttctcaagagcagccatgttttatttaagttcctcaatatatagctggatttcacattggcgcccagtgattagtgcagggtagtagcatcagcatcaaattaaaatttcagaacatcgctcttgcgcagggttcgatttcctggattaggaaagggaaacaaaggtggcagacaggctccaacaatactgcaagaagaagacacatctcttcaaagaggtaggtgatcaagatttcatctttcagttttaacgatgacataatcttttatttactgttgatcgctaccagcagtttgccattaaatttctgtcctatagcactatgaacaaatcggttaatcagcattctgcattgtaaaaaagtaatttctgctatcagatgttcagatgtttgaattaaaaagcagatgttgaaaatagataattgtcaaagatatatatatccggtttagtttgtcaaagatgtacttttctagttgagccatttattctgttgaaagaaagaaataaatcaggatagaacacacaaagcaaaatataagaagaaggaaacggaaaacttaataactggcagtgaaacttggcagcaccgatgaatagcagcgatggatatgatgctgcatttgcggccacaattgctgcagcagcatatgcaattgcttcgcaagaagagaagctagcagctcagaagaagcctgtccccattcaggggcaatctactactcctcctgtccagtctccagtaaagagaggtgaaagcatgaaaaaacccacaggaggcagcaagatctcaagatggtttagtggcaaagagcctgctgaagacaatgacgatggaccaggtattctgtaaatatgtaactccatctttattcaattttactgtagcaaaacctgcaaacttcttataacggtgctgaaatgcatttcagccaatgtatctgtaaggaggccacttaaaccagcacaaagaaagcaagaggacatagcttcagatcagaaggtgccacccaagatggttgattcttctctgagcgcgaagaaaggttcgggttcctctagcaaattgcaagacaagaaagggagcaagaagtttgagcaagagcaggtgattcagaagaccccatccaccacaaggccagcaacatcgtatcattctagacggaatggagatggtactgttggattaactgctgttggcccagcagacaccaaaactaatgaatgggagaaggcgaagctcgctagcattacggaagagtaagtacaattgttttgaactatatgcatgactgtttgatgaaagcagaattaactcgctgtcaaaattttaggtataagaacatgatggataccatagctgaatgggagaatgagaagaaggtgaaggctaagcgccaaaaagagcaaaaagaggtttttgtttattattcgtaatttaatagcatattacattgcttgttcaatataccctctttatcttttcctggatataaactctttatgttttgaaatgtcgtgatttatgtagcatgtcaaaaaaatgtttagattgacgatactgaaaactgaacttgctaatttgcagaaagtgttggaccaaaagagagcaaaggcactagaagaatacagccaggaaataacaaggatcaacaaaattgctggaggagcaaggacaatggcagaggaaaggaaatataacgatgagaaaaagatcaaagaaaaggcaaataaaagacggttatcggaaaaggctccccgcgcatgcgcttgcttttaagatatttccatatgatgcaatatttgaatggaatgataggcgattgcaagattgtaccctccaaacaacgatgtattgtgctttataatgtgtattggtttgatgagtgtatagaattttatccagcatgcaaaaagttggcatgctctactaaaaaaggtacagcttttgcataatcaccaagtgctttcaaaacgatgtgttgtgctttcaaaatgaagtagacactataagaaaagagtatatgttcagtacaataatacaaattcaggaacttatcggtgatgtgtctgttacatacaaatacacatcaggataacaaaaaaaaatacttggtaaaagttcttaaaaaaacacttggtgagccagttgtagttctcttctagaaatgaataacggaactgctagctgactgtcgacagttttcatgagtaaaaactttacccaaagtttcatatatgaagcaagttttcaagaaactgctcgagttttagcaaaagctgccttaataaaggggctcccctccggatcacagatatcatccccttcggaaaataaccctctttcagtttttttgcgggtctattgttttgtgatagaccctgtatatatatccgcactgtgaatttactccttctctattgataaaaaagagtttttttacagtccttgagggaaggcagtatcatatcctagccgttgatttcgcgtgatctaacggctggaaaacctcggtaccacgtggtaccgcgtttcctgtgagaggaggtaccgatcagtttttgaggtgggagggtatcatcgtaatttcgcgtcacttctctcgatcgacctaaccgcgagcgccgctccttcaagctcgtcgctgcgcggtggaggcggcgcgacggcgatatgcgacggcgggcgcggcgcgacggcggggcgcgacggcgagatgcgacggacggcgggatgcgacggcagatgcggcagtgagaaggcggcggcctcgatgcgatggcggccacggcgcgacggcgggcgacccaagccgagacgacgacgacgacgagcatgtgagattgatcgatgcggccacgatgcgacggtgggatgcgacggcggcgacgacgggatgcgagggggacggcggcaggaggacggacgcgcggcggctggataggggctggacggcggcgggcggacggacgcgcggcggcggtggcggctggacgcgcggcgacgggggcggctggacgtgcgatggcggcgggcggctggatgcgcgactgcggcggccggctagttgcacgacggcggcagcggcctcgattggcgacgacgacagcgggctggatgggcgacggcggcggccggcgggatgcacggcgacagcgggctggatgggcgacggcggcggccggtgggatgcacgacggcggcggcgacgtcgattggcgacgtcgacggtgggctggatgggcgacgtcggcggccggcgggatgcacgacggcggcggcggcctcgattggcgtcgacggcgacaggctggatgcgacgacgcggcgggctcgacgaagagaggacacctgttagtccgatcatactcctgctaaatcaacggttagattagattggtagctcatggtacattccttatgggaaaaatgcaagagaaaaataaagagtaaagtggctcctgcccttggttgtgagagagagagagagaagtcaaccagaaagtgactacagaaatgcttgtaaacaagctccaagccatcacctctcttatagcatttgcaaatccaattacaagtaaagcacacttggttttataacttctcatttgatttacaatgaaataaacctgacatcactatttacaagtacattgactacttattatactctaaacctgttgagaaaatattacttgttaaagaaatttaatgtacaagctacacaacatcctctgcattaatccagatcagaaaaaaaaataaaaaagaagaagaagaaagctgaaaacatgaccgccaagttggcaatgttaaaaaggcacacatgatctatgcagcttgctcagatgcatttccctcgtcatcatgaaataaatgtggtgaattgccagcatgtggtgtagacgcgggtttgccgtcctggagcaagatcactgtttcaaaagcaccaactaaagcctttaccttgcttttccgggactcgacaagtttacttgcagtttcttctataacattattaaacagcccctgtgcatctttcttctcttgtgtatcttggtgtcgcagtttcacaccaggagattccacatctaggttagaaggtccagcatctattgtgctattcatcttatatattcttctagctgacaggccttcactgcttgaaaattcacttgcacttcttcttctaaatttgagttttcttgggccattactgtctggttggagttcaacaattttacctctcttaaatttcaatttgtaaggtgtggcactatcatcatcctgttcaagcgctgagattctttttggtcgttgtccatcagcctttaaatgatcatagctgtttttattgatcgttggtccttcatcttctgtaccagattcatctaattcacttaactcaaaatcatactcttcgtaaaattcatcctctgatagttcttcaggtgactgttgaaggaaaaaccctggtttcagttcatcctgttcaaaggtgttgccagtactagaaatcactaacccatctgtttgtagagtagaatcacttggttgaatttgcacagactttggctcccccagaagttcaccatctgatgaagtttctgaaattggttggcagtgtgaaggactgttattagtccaaccctcaaatatttcatcagccttgacatcttccactgtatttcctgaggtggaaccaagaaaagatccaggctccttagcatgtttttcaccgagtgccaactgttctatagattcttgaaggccttcatgggcttcctcttcttcattaccttcagcgtcttgagactccatgctagcgttggctttcactccatcagcttcaatttctgaactattttcggttgatagagagtcgcccagaactgcattttccacagctatcgagtttttagatgattggcaaggagaagcatcgtctgtttggttttcttctgcctctaaattgctcagtgcattcttgagttgctgatcatccgatgattgcagcaagcctgttacaatggagctctgcaggggttcttcattccctcctgatgcttcattcttccgattgctttccatcccatcatcccctgacacaggcctaattatttcttctggtgctgatctagattcatcaacacattctgtggtatctgaagacactcctgccagtgtcgactccacatgaagacctcttatgaatgaatcttgcacatcatgttcttgtattacaacagaaacatccatcttcgattctacagagaatgatgatctggccatatgcaagccttccttcccattgatacttggcttgcttgaattcatcgaacttcttccagttttatcactgttacttcgacgcacaccagtaacagttgctggtgaagatgtaagctctccctttacagtacgtttagcttttgaagaaagtagatgactagaaacctgagatggcacgggcacttgcttaatcaagttaagcttagtaggcaatgaagtcggtctcttaattgatgattgcttgaccgttgtgaccttttccatagttctagattcctccagttgtggcatctctgccagcttcaacttggcaggcactatggttcccttaactggcattgctgattttttgtcaaatttaggaactccattggaagatcctgaatcagctgaagtcttctgtgcaactgttagatgcttctttcttccatcaaggttcacgtttttatgatcagctgatgaagaagtgcgtgtaatcaaatgatcagaggatcctttcaaatttgcttgtgttttcttgggagcaatgcggtcagattcacccagagatatactcgacttggctagagaaagatttctctgcctgacatcctttgatctatccaagatagctgatctgtgcaacgtcaaattatttaaatgactaggaagtttctttcttctgcctcctgaagttgaaagcttcttctcttcctcaaaaggatttttgtgtccatatttgcataaattatggc

SEQ ID NO: 16839 - DNA, 46672 bp, Oryza sativa
catgcagaaacatgttcttatcatcacagtcgcacatcgcaaaacagatttgtatcaaaaaccataggcaaaatgagatggtggcgctgatttagggggcaaaacaatttatctgtagcaaagatccagtacatttactgacatagctaagtgttagatggtttccatggctttgtacgctggctagtatgccactctagtatcccagtttcttgcaagttcctatcacctcacttcattgatgtggcttagtacacaaaagtatgaactaaatgaaaaacttttcagtgggttcatttttttatagaagtggcagtgtatttttgtagtatcaatccccatcatcaaaagcaatgaacaaattgtgaaagaagtgtttcaaagaacaatgtatttttcattagtgtgtgattgaatcatgtttagggagtttcattgtgtattctataaagaacaaaaagctacagggggatgtaggacagttcattggtaagttaaatgtgattgtacaggatgcctcaactatatattggtgaagaaaaaaattggacgtagccacacagattccatttctatggtatttctctccatggcaacagctgtgatcttggaataacaagtacgctataatagaatttccataaaaaaaaactataggacaactccactccaaatcaataggttggtattggttcattgagtaattgaatagtaaatacagaaaaaattcacatcacatctcagcagttcaaatcaaaattagtttttcttagttgcgtaattactactgtccacaaagttgaagtgcttgaaagcaagctgcaaaggtagaatcagaaacacaaactgagaaaaaacacacaaaatacatctgcatcatacctcctgaaagcaaatatcctccaactttatgcttctcaggcagcacttatcggagagtgtttagcagttttcaatataaagaattcgcctaaaatttgacaggaaagaggtcaaggagacatgaacaatttctggatgaatcatgaactactctggaacaaaaaagtagtttgaccaattgaccattcaactggagtatttgtcaaacagaaaagttttaaaagattaattgggcagagacaccttttgagatcccattcctctgggaaaaaaaaaaccaaactagctggtcattaacacaagcaaccttttactagccaagctgttctagatcacaccatacaccattattcgttccagctagaaagaccaaggattggatgagtaaaagcacaatatgccaatcaaaaccccccacggaaacaaaagaacacctagtgatgaagacattaaactaaaagatggcatcttttcatcggcatatgtttactcttgacactcaacacactactaatctgagcaaaggtactcactggaagcgaaatttagaatgccaataatgttctgaagattgccagtgcaatcgatggataacaagaataacttaataaaatggtaatgatcaggtcgataaaccgtacaagtcaacaatttgacatgagaaatacacctttttcgcatcaaaattctgtcctcgtttttctttaaaaaaaagaaagaaaaaagaaaacgcatcgaccaaattgatccccggccgcggccagatttccctgaacacaatcaatccccaatagcccaaaaaccacatcgcgggatccagacgaaaaccctcgtagcatccaaatcccaaacaactaacgcgaaccaaaatcaaccaaagcaaaacaaacttgcaccaaaatcctcccgccaagatcgtacctctcggaacaacggattggcggcggcggcggacgagccggaggaggatgaggaggaggagatggtgacgacgcagctgggctgggttggcttggctggtacgcgggttgccctgcctctgccaccctttttctctcctctctcgaggagggaaagaaagggaagtcgtgcgcgccgcaactagagaaagaaatcgagaaatacgcgcagacgaaaccgacgggagcggcgcggccgttagcgtccgctgcagtgtttcgccgtcatatgttgcgcgccatcccgtgacgccgtttgtgcttctcttctctgccgctttctcggagaccacggtagaatggttagttttgccctacttttttgagggttgctaccccatgggataccgtggaaatagtacactcacgggataattaaaaaaacaacgacagcataaaggaacaccccacagaacacgtgatttgtctcgatacctagccattgtttgctcggtatcgtcgccggagcagtggctaccttacctcgccggcgtcatcgccgaagtagcagctacctcaccgcccaaaaattctcctcggtatcgcgcgctcgggtgatacctcgccggcatcgtcgcccctgagcacccagagtagcagctacctcacacgcgatacctcgccggcgtcgtcacccctgagcacccagagtagcagctacctcaccgccaaatcctcctggtaccttgggtaaggtaccgaggtggtacctggtacactggtatcggctggcacctggtaccctgggtatcgagctggtacctaggtatcagcgtgataccccaagagagaggaggaggaggaggaggaggaggaggaggagaggaggaggaggaggaggagtcgcggggtcgggaggtcctggtaccctggtatcgactgatacctggtaccctgggtatcgagctggtatctaggtatcagaccttggtacctgggtatcagcgtgataccctaagagagaggaggaggagaaggagtcgtggggccgaggaggtcgagcagcgaggcggcacggcggcggaggaagaggaggcgacagatctggtgcctagtaccatgcctccccagcctcctcagccggctgtggacgacgacgtgctcggcgcacccctgctgccggccatggaggtcttcatcaccgacgctgtagtagatctgcttgctgccggccatggaggatgtcgccgcaaccgcaccccgttccggctccaccgcaccccgctcccgctctccctctcgctcgccgccgagctcctcgccgtcgcggcctccctcacggcggcggccgctggctccggtgagcagtgggcgacggcgatggggagggctgcagtgtcgtgtgatttgggagaggagagtaaggtaggaggagaggattcgaatgattttggggagaggagtgaggtaggaggaggggatcccgtctccacggcaggatgccgtggtgtaggttttctgtacttttttttcttgtttcttttctttcgttttttttttcttttgcacggttcaaaaagctttgtgactgacttcgtgcaggtgtaaaaagatgccagggaatgccagttcaacggcgcgttcctaccagtgagagcaagtgatatactcccagcctatttaaccattcgtcttatttaaaaatttttgtgaaatatgtaaaattatatgtatacataaaagtatatttaacggcgaatcaaattatagggaaaattttaataattagttaagtttttttgaataagacgaacggtcaaacatatttaaaaaagtcaacagcgtcaaatatttagggacggagggagtatattccttcgaatgaacatagtggcggtgacaatgaatatgtcatgttgtcatctcacttttttttaacaaattttgcaaatagccttggtgaaattcttaatattaaaagcaatcaaatataaatggatagtcatatgactcgtatataaaattgaagtagggtgaatattccctatagtagaaagacaggtaatacagtatataaaaaatatgttttatttatattatattatattttcttttatacgtatcaaagcatgtgcatttagctagtcgcaacaaatgaaacaagcagcaacaaggtgaatggagtactgcgtaagtcttgtaaaaattacagtattgagagttgctcaattttttttctcatacattgcaaaattacaagctagtagagactcctacattggattaaacatactatctgggaccaaacaaggagaaaaatactgaaaaagataacgggacgacgggaaaaaaacagtgaggatgaaaagtttttttttttagaaacaggaggaaaggttgatgtgccgaaagcagcagccagtgaattaatcacaacaaaattgtgcgcacatggttagttggcttggattaaattagcatattaatactagtttgattacgattactcaatcaccaggacgcgaaatgattagtccggctccggcaaaagtaccacgtcaaagaatcaaagaaagaaagcataaacttacttaaagagcaagcaagaaagaaaaagaagggaagaacgggtctcgagaattagttcggttgatcaaccattcgatcgtggggtcctggagaccgatgcaattcctccccttttgttcctccgcttcatttattttttctttaattattagttggtgatgaatcattgctcttcagtaatactacgcgtctaaatgtctgacagcacaaaagaagacctgaaaaggccttaatccagaaacaaaaggcttgatcttgggtccctgagtcgctttgcgttggcatgcagattttgttgctgtgcagagaaagatctaatgatagatcatactatcatcatcagtctactcattcgcactctgccacaaatccaagcagcagaaagttcagtccagtaacttgcggactgctgagtggtactgaacactggttagctagaatactctgaatatgtggagtgtaacaatgtaaaataaatctgtaatttgtttcatcgatcagtaatttcagtactgatcgacgaaaagaaaaaggatgttgagacagatcgtgcacatatcaataggaggactggacggttggttggaccatgcatgccggttcaggttctggatggaagtatgaacagctaggcaattcaatgatccagccatggcagcaagctgcaagcagatagacccttctggtctctctgacaatgaacaggcccctctctgacaacgaacaggcccatcgatcgatcgaatgatcgatcagtggtcgatcgatcggccacgcggcagtgtgcatcaaattctcgctttttctgggacaatgcaggccacgatgattgaaagcatgcaggtaagggaagtaggagaagctgactactcccttccttaaaaaaaaaaaacccaacctaaacaatgatgggacgctacatagtacaatgaatctggatatactcatgttcagattcgttatactatgtagtgtctaatcgttgtctaggttaagtttttttttttggaacggagagagtagctgtgacgttgctccagtgtggttgttgggtgatgggttattgattgatgcttgtgattcatggcaatcatcggtgcaaacaatgcgaccaaaccccgtagtagatggggtaggggattgatataagatcgttggatttctagagatcgggatcgaagttttagtgctttctttcctccatgagacgctgaagctggcgagatatgcttaatacctggttgtggagcttctgtctgccgtggtttctcctaaaatcttcagttgctataaactcttgtacatatttttttcacgtaaattttaagaatttgtagttgtaaaattataaaaatgaattagggttttctaagttctccatattctcacttaggctgtgtttggaactccaagttcccaacccctctccctcgttttccgcgcgcacgcttttcaaactgctaaacggtgtattttttgtaaaaagtttctatacaaaagttgcttaaaaaattcaaattaatccattttttaaaaagaaattagccgattcttaattaatcacgcgctaatggaccgttccgttttccgtgcggggagattgggttcccatcccgctatccgaacacagccttagtattcttctgcagcggccgacggcgtgaggcagtccaacttatacggaccgcatggaggccgctgtccagatccggcccagttctggtgggctgtacggagcccgcagtgaatttccatttcgacctaactgaaatggtgagatctgctcggtttaggccggagaattgaaggccagagctggcttccagttgggtggtgaacccagacggctgcattatcgtctgaagagaaccacacgtaggctgtacgtagtgctgtattccaaaaattttcgtttttttaaacgtgtgctagtgaacacattcgccggtatatgaatgccgtgtacgtgtgcggtggtgcgtatgcatctttggtgagaagaaaataataggttgtggttggattaagtttaaatttcaaattgaatgtttggatttgaaacatatcaaaagtttttttttcagtgttagacaactcacaacagaaaacacatgaaagcattcggtagtcggcggctggttgatgcgcgagtccaattcggaaacaaacctttgatcacacctctctagttctacttcgaaattcgaatccgattcaattcaggagacatgccgatctatctactcctgttctttcggagcgacgtcctcaccacgataaatttggccggaatttatcagcgttaggcacggacacagcagtggagtgcgcgaacgccggccgccggttcaatgtcgaagcggcacagatccgatgacgacggcggcgagctcgagtccaggcggccacactcgcgccaccgccgccgccggcgacggcggcatctctacgtcgtgctggacgactggtccaaggggtacagcgtctacaaggtggacgtcgacgggttcgacggcgaccccgacgccgacctggacgacgaggccgtgcgcctccccgagccgccggtgttccggctggagaccgccgactacggccgtttcgggatcttcgtggcggtgggaagcagaatctttgccactcactacagcgaggacacgaacgcgcgcgctcccgtgctcatgttcgacacggtgaccggtggcctcgccgtctgccccggcgtcccggccgagctgtgtaaccagcccatgatcttccccgccggcgacaaggtgtacgccatgggcaggagcaagatcaagatggacgctaggggagagtcgcggaagtacttggaggagctcgcggccgacggcgagggcagctgggcctggagcagcagcgtcgacgaccgcgcgccgccgccgccgttcgacgtcgagcgggcccgatgccacgcggcgcacccggacggccgcaccgtcttcttctccgcccacggcgatggcacctactcgttcgacgccgggacgcgcgggtggacgcgccacggcgagtggatgctgccgttcgacgggcaggcctactacgacggcgagctggacgcgtgggtggggctctggagcggccactcgggccgccgcgggcgcgtctgctcctgcgacgtggtggatccccgcggcggcggcggcggcgagcagccaccgccggcgtggaagctcgccgtgaggagccacccggcgtggcgcgccaggtcgaggttcttgagcgtggcgctggcgcgcatgggcggcggcgagttctgcgtggtggagtggaggtcgcggaggggcgtgagcgaggaggagctccacgagcggtgcctgctgtacgcgaccacgttccggctccggtacgacagggacgggtcgctggaggccacggatcgccgcgcgcgcgccttcaccgcgcgcaagaaatcggacgagttcgaatggtgcgcgtttgggatctgatcgtctatctgaacatcgagcgcgcgcggtgtctgacttgaaatttgcgttgaagatcgtgtttgaatccaaagcacatttttaactctcatataattcattttagacttaatccagaccatggaacaactcaaaacaacgttacctaatgtagtataaaaccttacgtttgacttgttattagctctccgtcccaaaataagtttattaagtttatttttcatgcatcccatacatacaaatagaacacctacaatattataataccactttattaaatcctctttatctactctcaatactccctccgtcccaaaaaaaaagataaaccctaatttccgtgttcaacgtttgaccgtccgtcttatttgaaaaaattatgaaaaaaaataaaaaaaaaacaagtcacgcataaaatattaatcatattttatcatcgaacaacaatgaaaatacgaattataaaaaaaaattcatataagacggacagtcaaagttgaacacagaaacccagggtttgtctttttttgggatggagagagtacataccttactttcacaaacttattttgggaaaaatgggaaaagctaaaaatgaacatgttatgggctagagggagtatttactactccagtacaacattggcagctgataataatatacaacgtcatgatggtctataaagtatataaaccatatgcaccagaaagataataaaaacactagagcaaaaaatcagacattgagatgtcacagtagtgcttacttttgattttcgcaagagtagcataacatatatacatcgtaaaaaggtagggtcggaaagacagaattacagtaaaacctgagtgattcatgtatatcaatgcaataattagagttccatcttacaactactgtccctgaaggcctcaatcgaatggataagaaatcacacttgacatcctcccccagagcacatgagattgcaaatgctaaattttctgctgctgagttataaactgtaatgacatggagtacaatataactcaattgaagatctctctaacgagccaatccaaactgggataagcaaagtagaggatcaaaaaggacggcagtgcaaacaaaactgtaacaaggacatacaatactagaactgctacgcttgcagggacagcatatagaactatcagaaggaaaattatcacgagtggaaacttggctgtcatctgaacaaaagacaacattatcttttggagagatgcactgatgctgtaagtattgaaaacgttgccagcaacactcctttctctgccactggcgctttctgttcgtggagcaggtcttcgatggtgttgactggaacttgggccaccaccagaagggcataaagaatggcgctcttcatgactaggggaatggaactttgctctctcgccattcatgctctcaaccatccatagcagaaaatagttcttgcgtgggaacttgaggtttcccttgtaaactagccggaaagataacaggttacaccatggacatgagatgaagagaggcagttgtataggaagggttgggaacttgacgacagcccattgaagacccaagatgcaattcttgcacattgtatgaccgcaccacaagacatagggaacattctcaacaaggttgaaggattcccaacatattggacattcaaggccttcctctctacttgcacatgaagaaacatcatcatcagagcaatcaggattggattgactgcattttgagggctgtgcttttttccttatgcttccagctatggcgtttgacgcaaaactccacatgttgaatgagagagagctggtacactatatcttgtactcctgagatcctgctttacagaagacaaatcataacatatatgttgctccactaagtctagccactactcctatttatgttgataaaaagaaatccaagtgcaaaatgctctcataaagcaaaagaaatagcagtagataaagtagcatcatctaacttaacagatataaaagccccaaaaaaattctaaacatgttcggtagaagacgcatttccagtcaccaaatcatagaattatttcatattgtatagttttgtgggtagtccagtaatacagtttcatagtgcagtagtgattgcgaaaatggggaaacacagaatgatctgaaaaaaatgtaacaatatctaagcaaatacaaatgtactagcatgtaaggaaatgaagaagatgtcatggatatgttgttagaaaccatcaagtacagatcacatgggctttactgcacaagtgcacaataaattgaagaatcaaatagacaatgcaaaagttcatgcaggctcaaaattttaagctatgaaacgatacccaactgacagtcaacttggagacaaaaccgtttgccttctcctattacttgttcatcatcattttagtatccagagcctaattggtggagtctgagatcgataaatgcatgcctcctcaaacaaatttggttacagtttacagacagcttctagacgaatgggtttcacccagattaatgagcctaacccaatcccccagctaaatacacagcttaaacagtgtctagaactttagataccacaccacaacttcggagaatttcagcggacatgattaaaaatcataagctcttaacaggcctgcaggtgcattaggaaatggccctgatcaagatcccaacctatttgatcacaaaagttccatgggattacagcatatactgacaatactatctgctctattggtggccaccagaaccacatctgctgcctctgcttcaagtctgaaacattgagttgtcctgaactaatcaatgtccggtcatgtgtccctccctaaccagtgcacaacaacagcgcagccgctctcttgagccgcacccagtgacaagtgacaacaagatcacccgcaacatccaaattacaaaccgtatggaaattgtaagttagcgatggtcgaggatgttgtaaattatttccacagcagaaatatgaacatcaatatatccatagaaactcaaatcggcgatgtgtcctagactgtagactcctagttccatatccaagaaagacaccaactcttcaacctcaccaacaacgagcaagcgcctcacgcagactagcaacatgaaattcccgaccagcgtaagcccgcgggaaggaatcggacgcgaatcaggcagttccactcgaggattagggagtagcggcttaccgagaagagcccggatctctagcagcgcaagggcatacgggagcgccccgggagatcgcgtccggttgaaggggagacgctcatcccggcaacgtcctccgcgccgatgggtggggggaagggggctcgccggagtcgggggagcggcggcggaggagaggaaagggaagaagaggtcgtcgagaggaagaagaccacctggttctccttcgatttctcgtgtgtgaaccccccaacctgtggtaaaatctggaccgttcgctcgcctggacggctcggatggagccatctgcgtatctagaaggaattgatcatctcctctaatcaaattttaacaagacctttttattagtggcgcacttgatataatctagaaaaaaaatgatgctggtaaagctggagtgatgtgccatgtaagtgtttgttacaacaacacttcatccaacttgaaattgaactttgcatccacaaaatataaaacggacgttgcatcatatcatttccccttctcccttgacaaaaacgtcgggcaaaaataacgtaaggcttaacgacctgccgttgattttactcgacggctgattgcatcatcttgaggtaccgtggatgagagtagtatgggctatggaaatgcattggttcgccgacaaggatatgtactccctccgtcttaaaataaagcaacatcgtactggataagacacatcctagtataacgaatctgaacagtgatatattcaaatttgttgtactatgatatgtcatatctagtacaagattattatattttaggacgaagagagtatctaacgtatagtatacagagagatcgccgcaccgacagcgaggtgtaaaagatttgcgcgatagaatggcctcgtcttattcctggaacagagacgagagcaacagcaaacggtctgcttaattcccattgcccataaccataagatactcatatcgatcggagtcaccatgtgagattttgggcattcagcgattgcgatttgcagtatacgttttctgcctgaacaaggcaagaggattttgatctctcgaggagatattccatcgttctttacatgtcacttaaatagctattaaaaaattagaaaagatgtattaacatgtgatatatcacaccacaaacatgcaagtaaaaaattcaactcctacatctcgcaacgaaaaaaacaaatttgactccgaatatacattaactagttgcggtttaatttgttttttttcgttacgagatgtagaagttgaatttgaaattgcatgtttgtggagtgttatatcacatcttaatacacattctcattttttttaatttttcttataaccatttgagtgacatgaaaaaaacgaggtgatatcccctcgatggattaaaatagtttcccctcaacacggatgcaaacgcgtactaccaatgaagcaacccaattctgacttcctcgtttacacgcatcaacttaggccctgtttagtcccatgcaaaaatttttcactcagtcacattaaatgtaaataactaattacacagattgtgtgtaaattacgagacgaatcttttaagcctaattgctctatgatttgacaatgtggtggtacagtaaatatttgctaatgatggattaattaaataataaattcgtctcgtaatttatagacggaagttttgctatcaaactacattttaatactttaaatttatgtccgtatatccgatgtgacacgccaaagcttttcactgctgataacacaccccttaggcaaaagaaatgcccgttgcgatcacgatcgaagtatacaacacgtaagcatgatggtatcacgacgactacatgatctgcagcatggctcttcttcctaggattcaggtgttgttactgccgtcttccgacgatggcgagaacacgacggcgaggcagagaggcacgacggcgtaggcggccagcttgagcgcctcctcggtgtccttggagatggcgccgatgcgtgaccagtcgccgctgtacctgcagcaaagccgccccgaaacgggtgagaccgaccagatcgaccaccggtgcaaaacgcaatggaaatccgtcatcagcgcgcgcgcgcgtgcgtgcgactcacccggcgtcgacgaagccgagcgcgaagagagcggcgccggaccgcaggagggcgcccctggtgaccacgccgccgccgccggcggtggcgcctcgctcgtcggtcccggggcccttctttgcgccgcacgggcggaggcgacggcggcctgctccgcgcgagtgcggcggcggcggcgtggacggggacgggacggccttggcgacggcggcggcgggccacgccggcatgctgtgctgtgtgcgcggtggtagttgggtgtttgggtgtttgcttctcgtccacacgtgcgttagcagcagaacgtggagcgctgcacgctctcggggtgcgaggtacggacaaaacttggcactcccgccgatgcaaacggttcctctgctggtactatatatttactatagcaaaatgctactagctatgttacccggggatgcggatagggatacgtgatacgggatacaccattttctcaaaaacaaggatacgggaatacgcttatatatatatgtgtaaattaaaaatacagaaaatgaaatattttttaagggaacaacaataatgtagttttggtgcagcctatatgtcaatctaattcctctgaatctcacttctagatagttcaagttagcaaaacaattaatcttgccgactgacaataatacatggtaaaatcatacatgtatatagcagaaagaatagtgaactgatacatcatgcttatattatcaatttaagtgtaaactgcagtattgcacaagtagcatcaccaactcactaaccagaccataaaatgcagattaaacatcgaaggcctgaaaaggggatttactcacaagagaatgaagagaaaattgttcggtggctatgggttgatgctgctgcgcctgttggctggtggcagaggcgctgctgtagtgttggacacggagctgctgtggcctgtgtggacggccggcggccggcagacctagacccggagcccatgggcagcggaggtgctgccctcggctgcggcgcgcccggtcgaggcgaagctgatgcgcccggacgcggtgtaggaggcgcggcgtgatgcggatgggcgtggtgccgctcccacgtatcacggcgacggcggcggcatgggaagagtgggagcgtgtgaggcggccaagtagtagttggatggctgggttgggtgttcgacgtatcaacgacgtatccataattgttttatttatctgaaaatcgatgagtcgctggatacgtacgggatacgtatcggagcgtatccgatacgtattcgtatccgtcggcgtatcagatactgatacgcgacctgattgccgtataacgctactagtactattccgtgacaatgtatagcacgctttgcagccaaatattgttgacacagtccaagtttaatttcaaagtttttttttaaactttcagcttttccatcacatcacaactttcctaaacacacgaacttccaacttttccgtcacatcgttctaatttcaaccaaactttcaattttaacaactaaacacactcacaatagatcgagtttatgtagctcacatttattcaccgtattgttgaggttacccgtttcttgattatcactgagccgatcgctcatccttgcgttgaaaaaaactgggctgagggcatgttcgtttggacaaatcaaccattctccattagcacacttcccactaaacgatacgttttgtaaaaagaaaaatctatataaagattgtttaaaaaattaagcatatgtatttaaagtttgtaagtaattaatactcgattaattaatgcgttgaagaaccttttatttgttctgagccgttaatggctacagcactatagctaattcaaactcggcctaagtcgataagattggcctaatcctttccgacaacaagcttaaaccttggtggtgttgcaaaagaagtaagtcagtgtttggaattaatgcctaaataaaatcatgcatgagcttggattacagctagaaaaaataagcattttgccttctttttaattacatgatattgtctccttacaattattgctattatattattgcaaattaaaaacatatcaatatcaatatttaatttgtttttgtctttgtttgggttttgggtcaaaatttgaggaccaagtacaaccggtacaggctccgatagagcttcagatgaataggcttgtaaatggtaggatttgtattccttctcaaatatactctttagttgttttaaatatattattgagcatttatttctagggcctatctgcacgacacgtatccttgcaaaatcattcggattttcgaaccgcatggttagcatccaacggttccaagtcattcccactttagaataaaaacctatgaaccctaacttctaacctctccctcccactccctctcgagcatcgccgcttatattatcctaaagcatatcaatccgggccttctctccaaccatcattgctggctaggccagttgagctacctctgtcgatgctagtaatagtaagaagcatcacgtcacttgccatgttgtctcctacaactttcatgagaagctatcatgtcggtatcgtctctcgtatccagtagtccctttttagatcggctttgtagccttcctcatcatttcgttattccaagatgaaagtcccaatcaaaaggttcattgggaattggcgtagatgctaagaaggatggggtatggtgaggatcttcagttgaaaaaagaggttatagacctgaattattattttccaaacgaaatttagaacaaacgcgttgattgtttagtagatttcaattgtattgcatttatagatctattcttagtatactggcaagagttagtagtagatctaagggcacccgcaatggttatctataggctctctataagagatccatgtcagcttattttcctacttggaagatattaaatgaagagagagagagcaaagctatctactaacttagagatagtctatagagaaaaacgaggtaatgcatgagagagctatagatacccatgtagacatactattgaggtggtttactattaatctagtctattgctgagatatacatgttttatagagagcaccttactttatcattgcgggtgctctaagtacacaattttttaggtagcaaaagttgcaccaaagtttactaaaagtaatattggcttaaaaatgggtataacatttttcacctttcaaactatgtcctagcaacttgtctccatataaggtattatataattgtagggcaaacttatcggaaacacacaaatattgttgataggaaaaaactttattaagagtacacttataacgctttctcccattgcctctaggattagttaaagtgaactcctcataactaaactgactcttagtattttcgagttgaattgaaatttcaccatcagccacacctagaatgattgtggaaacatcccaagttgcatcaaccgtaaaccatggtatgaagaaaatccgcatgtagtaattttaaagtacatacccctctgtaaaaggatttaccactgcattaacgtacccaagctaaacaagctacgactaattcgttgtctatatattgtttagtacaatccaactgtattgtatttatagatctattctttatttataaattagcaagagttagtagtagatctaagtacacgggtttttgatagcaaaagccgcacaaagctgacaggaactattgcatatgcctcaactctaaaagtaatatcggcttaaaagggggtgccactatttttcacctttaaaaacatgtgctagcagtttatccataggaagtataccaacatcatggttggacaaacttatgggaaacactcaaatattgctaatagcaagaaattttactgagtgtacactttaacattctctcctctagcatcaaaagcattcatcgtaagaaacaagttattccactggtggagaaattgtctttactcccggtttataaacccccttagtcccggttttccaaccggaactacgaatctgggactaaagatcgctatctttagtcccgggtgaaataaccgggagtaaagatcaatctttagtcccggttggtaataccaacccggactaaagagagggatctttagtcccgtttggtgttaccaaccgggactaaagagaggatagggacagtcccggatggtcccctttttttgttactttttttattttctcccgaatcggatggcatgcacatcccaaatcaaaccccaaatccctaaatcaaagtaacatcctaaatccacatcacaaatctcaaagtcatttatacacaccaatataatacatcacaaatcctaaaaaatttacacacaaatcaaatacaacacagattatacatcttaaatcaatataatgaatcacaaaattatacatctcagtgaatcacaaaatatcaaaaaaaagagagagaaaacaagctgccggatgtgctactactcaagaaatcaatcacaaaatatcaatcccactactgccggctgccgctatcgttactattgcgcgcatgtgcttcccctgcaacgcacgtttgcgccgcacgccgcgcatccgtccgtccaccacgtccgcgcggcgcggcctcctccatctccaggtgagggaggaggaaagggaggggaaggaaggaggaagggaaggatctgtgtaagatccatctccaggtgagggaggaggaaggggaggggaaggaaggaggaaggagaggatctgtgtaagataggagaggggaggagggagagaagagaggaggatcgatctgtgggtgaggtagtggttgcgagtggaggagaggataaggactatggattatatactacgtgtttaatttattaccaaccaggactaaagatctaaatgatctttactcccggactaaacccggactaaagtggtaatctttagtcccggttggtagtatgaaccgggactaaagattctcggccccttgagatgcctctgacaggggatgaaccgggaccaaaaatcatctttaatcccggttggtgtgatcaaaatttttttaaccgggactaaaaatcgtatttagtcccggttttaaatggaaccgggactattgtcgaatttggtcgaccgaccaaagatggtttctccaccagtgttcatatctaaactgaggttttctttcctaaatgaattttctaattcaccgtcaaacacctagaatgaccatggaaacatcccaataaacggggctaagatttacctaatctgacccgaggacaagctcaagccttggtgtttgaaaataagtaggctggactttcaaaatcttttttttaacaaaaaaaatcaagcctgagctcagagtagagctttgttattttgtcttctttttaattacacaatattaccttattattgttattgctatcatattattctagatttaatatatatagatataaatatttaatttgattttgtgtttatttggattttgggtccaaatttgaggcccaggtacgaccattacagacttcggcagggctatatcaattagcttgttaacgatgggattattttattccttccaaaagatatttgtagtcatttgaatatattattgagcatttattgcttgggattatctacacaatatgtatccttacaaagcattgggattttgggacgtgtgattagcatccaaaggttccatgccatttacattaaaaccccaggaaccctaacccttccccttccccctccccctccccctcccccctcctcctctagcgccgccgttgatatcatcctaaagcataccatactagaccttctcttcggatgtggatgttggttaggtccgtcgggctaccttcattgatgctagtaatagtaagaagtgtcacatcacttgccttgtcttctacaacttttgtggaaagctatcatgccgtatttcttgtatctaatgatcttttttgagatccacttcattcccttctcataactacagcttctatgcttctatattgcccgtcacatctgtctcctagatctatcggcaccaaaattgtatcattatttcgttattccaagatcaaagccccaatcaaagggttcattgggatttgccaatgatgctaagaaggatggggtatggtgaggatcttcaatcgaaagcaccggttagatatctgaattactattctccagaacaaaattataacaaatatgttgatcgtttagtatattcctgttgtattgtgtttacagatatgttctttgtttatatatttgcatgagttagtagtagatctaagtacacggattttgggtagcagaacccacataaaatttacaagagctattacgtctttctcaattctaaaagtaatactggcttaaaaggaggcacacaatttttcagcttttaaaccatattcgataaacttgtgggaaacacataaatattgttgataacaagaaattttagtaagggtgcactttaacattttctcctcttacatcaaaagcaatcaacttcaaaagtgagctcctcatagctaaaccgaggtttagggtgtgttcgctattcctagttggtaacttggaacaatactcacagaaaacggagcggttcattagtgcatgattaattaagtattagctatttttttaaaaaaatagattaatttgattttttaagcaactttcttatagatttttttttgcaaaaaaacacaccgtttaacagtttaaaaagcatgcacataaaaaacgagggagagaggtttaaaaaagtgggtgccgaacacacccagtctttgcaagatgaaatgaaaatccgcatcaaaccacttagaatgaccgtagaaacatcccaaagtgtcatcaaccgtaaaccaaggtaggaagaaaattctcactaaagtagtagtattagtaaactacacacccctctcaaagaatttaccactgcgttagcataccgaaactaaccaagctacgaccaattcgagttgtatgcgatcgcaatttctgagaaaatccaaatgctccaaatcacacgcgctgcaaaagcccgcgaccgcatatctcggtggctggtcgagcacgcctgcatcgcatccccattcccccacaccgcggccgctccagcacgccacgtctgaagtgtttcagacgccgcggccaccgtgggatcgaggcatcgacctcctcctcttcgcactgcgctgcactctctctcgcggtcgcggtcccggtccaaaccaacccaaaccaaaaccgaaccaaacaccgacccgcaccgcaccgcaccgcccatttcgctttgcacacctcaaccctcccgtcccctcccctcctctcctctcctctcctccacgccgaccactccccatccccatctctctcccctcaccgccgccgccgccgccgccgccgcagagcaggacgcttcgggtggcgcgggggagggcaaggccgatccgaagctcatcggcgggaggttgcccccccacgcgatttccaccggttccgggggtgggggttcgatccgcgcggagccgacggcgggtgcgggggccgtgccgtgaggtccgccgccgccgccgttcccggggtgtagggtttttgggttcccggcccggcgagcgaagcattggttggcgtggccgcggcgggttgttttgtttttttgctatggggatggtgcccaacgggctcctgcccaatgcgtcggccggggtcacgaggcggctcgacggcgagcggtgggccgccgcggaggtgcggaccgcggagctgatcgcgcgcatccagcccaacgccgactccgagcggcggaggcgcgccgtctacgactacgtgcggcgcctcatcacgaactgcctctcgtgccaggtatagcgatggtgtttgactgctggattgattgttccgagaggtgttacggattattagattgaagggtttctctgcgtggcttcgtgagcagcgagtgagtagagcacagccgttcacctgactcggttgtagtggaatcgaccggattaatgatattggcataagaggcagattgatttctatttctaagtaagttctatttgagcaagggacactggttagtgccctattggatcgttttgtgctttttgttcaaaagtcggaaggtcttgcttccaatagcacttgcatacaagcacatggggggtatcttatcttcatcattgtttgagatatatgcttttttttttctttttgcttcagatcatctgtttatactctttgaaacttgtttacacgccttgagttctcatccagtggagacgatgacaaggattaaactgcattttgggagaggagtatgattttgagatattcgatagtctattgttgaactgtttttcacagtaacatccatttccctgcaacatggaatgcatcagagtagcagttatcatgttaacgaaaagcttgtggaactacaacattgaccttagaggaaggtgatgatatgataaaccggcaaatcttcaagattcaaagtcgtagtcaacccatatgcatatgtgatgagcgacttgattggctgattgaatgaccatttttagtaggtgtgtcgggcgatagcaacgtttaaatagcttcttgtttcttgagaaatggaaagaaacttgttccatcatctttcttccttaagtccaaaagagtattgcacgccttggagctttcgtggtcttaagtttatcatttcaagtgtgatttttttattgattatatacacctgacagaagttatctatttgtgtctctaggttttcacatttggatcggtccctctgaagacttacttacctgatggtgacattgatgtcactgcttttagtgatagtgaagaattgaaggatacttgggctaacttggttcgggatgcattggagcatgaagagaaaagtgaaaatgctgaatttcgtgtaaaagaagttcagtatatacaggcggaggtagaacccttcctctgaatttttagttttggaaaatggctattgatccgtcatgtagcagtcttgattttttttgcagctcagaattattgttgttcctttgggtacatggatgttaaagttactaatgattattttttgcattttctgccacatgaagcaaattagaataagcaaaatatataatacacctatctaaagtgctggctatattatactcttcattttttgctgatggagttttacatgtgcttctgtttctaaaagaagatagcgtggaaacttgaaactgttattttttcagatgccatgaaattttaggcgatccactattgtaggacctgctagcctataatcctgttactgcctggtgtggacattcaagaggattgtttaatgaaagatacttttagcatcctactaagtacagggaaacacattcttttgtttactcatttttgttttcatggtttataatgtgtcaactgtctcactctgttgtcatctctttggtattgttctcatttatttgtgaatcatgtccaggtaaaaattattaagtgtcttgtggacaacattgttgttgacatatcatttaatcaagttggtggattgtgtacactttgtttccttgaagaggtgcgctctcttgttcaaatctagctgaatgtatattgctgtttggttatccttattgcatgtgtttggaataaaaattatttgatttttctgccttacttgcttcaatggatctacattaggttgatgccttgatcagtcagaatcatttattcaagaggagtattatattgataaaggcatggtgtttctatgagagtcgtattcttggagctcaccatggtcttatatctacctatgcattggagaccctggttctgtacatttttcatgtgttcaacaattgttttactggaccactggaggtgactactggttcttgcactttactatcccagcacgagaaacaattcttatttgctacttatgtgtttgtaggtattataccgtttcttagaattcttcagcaactttgactgggagaaattttgtttgagtttgtcgggtcctgttcctataagttcacttccagatatgactggtaatctatatgctgcttactatgacttctatatcaaagttgtttatacgattgttattttacattttttttcaacgttattttgtgcagcggagccaccacggatggatgctgctgaattgttgctgagcaagtccttccttgataaatgcagttatgcatatgcagttacacctcgcatccaggagagccagggtcaacaaccatttgtttcaaagcacttcaacgttattgatcctttacggacaaacaataaccttggaaggagtgtaagtaaaggtaactatcgagcatcaacttacatagtgcttctcttattgaagtgacatgtaccgaacagagttcagtcctggtggttttgtatattactatactatgaatgctaatctatatttttgacaagttaaagatgttttgacttcctaagaattcatatcgcaaacatgctaatggctatttaaatacatggtccttgtaataactgtacttgttttctctttcttttgtggaggttctgttttgctgacataagctgtttgacaataagccaacaaacagttctttctatattaaatacttccagattggatagtgagcacttttctagtaactcatgaaactcatcatttgctggattactgggattcatcttgcgagtataaaaattccttattgttatgaacttgtgatgcatctcttgtcaaatgtacactcttcaatatgttggctttgtggtcattttgatgctgtggtcaatccagcgtcaagtattgaactgtaacgggccatttgactgtatccagcggaagttctatttctgcagaaaaaacatagtacatattatgttgagttgatgagcttcttcttttgtccaggcaatttctttaggatacgcagtgcgttttcctttggggcgaaaaggttggcaaagttactcgaatgtccaaaagaagatctaattgctgaagtaaatcagttcttcacaaatacatggataagacatggtagtggcaatcgtcctgatgcacctacactaggtctggttcatcagcatcatctgaaggttgtccctgctgaagcatcaaatagtcagagaagtgcgatggcactcaagaaaaacgctgaaaatcctaatattcgtgctaaccaggataatctcagtgaaaatgctaatagctatcctgaagctacttctcagccacttcagagaagtgttctacacccgagaaattcactgagaacagtcaacccttctgattctcatgctcatcaccaaaaagttcatgtgacacatgccaatacaaaggtctctgagcagcttgaaagaaacagttctgatggatcaatgcaaaatgaaaggaacaagacagtaccaaattctctctttgttaatgatagaaatgggcaaaacaggtctcggtttgcaagaacccgctctagtcctgaactaacggacccttctgttgaaggatattctcgtggaagacggactggagtggttgaaatggacaaatctttgaaggttgattacaatagcagaagaaacaacttggctccagaagtttctagcagccacatcactaagtcttcacaggatgagtcagtgtcttcgatgaacagttcatctcactatagtgggaaagcagcttctgactcaaacagtgtgtcaagcagctaccgcgaagataatggtttcataatgaacgaagaacttccttctgtatctgaggcatcagataaacagcaagaggagcaagtcctagttaatttaatgtcatcagctaaattgcatgacttcaacgggcaagttcaattgccaatagaaatgccgcctcatttttcggtggcaccctcccctttacttgcaccagcagcttttcccccaaaacattttgctggaattccaccaactagcttaattggggctccatggtccaatatgcatttgatccatggatatgtttcaccacccatggcccattatgtccaaaaccatactttcgcaccaaacatcgaagaaggtaacgagagtgagaaacctattacaccagatgcgagtcgtgatgatggcaacaattggcatgagtatggtgttggatttcctagatattttaatcatcaaggaagagatccacagatgcgccactttaatggaaaagagcattcctcttcacctaacagtgtatctggtgccccctttgaaagacagggagagattgctgttgaggataatggagcagtagaagagaattataccaacatgtttcaaaaccaaacaagtagacaagccagcataaatactcgaataggtagtggaaatgcaagaatcccttcttcacaatccggtttgtcaagaaacaaagctatgcctgagaattcatggggtgaatcagctggaaatacaacaagatcattgagggacaaatggggaaaaaggcctgcctttgcagcacctgacacaactacacatagcaaaaataatactggttggcagactggaaatgcttctgagcatatccccccagaggttgatgatggtgcccggaatggggttatagtaccaaacattagacatgaggcctctgacataataacagggtctggctcaacagcatcaagaactagtcaagtgccaaatgattttgaaccatcacagattggcatgcctaatccactgtttgcacctctttttattggatcccctcagcagagacaatctggtaatggcggactgacttttattcaaacaggtccagcggttccttttttgatgttgccatatgctcctgggaatgatggatctgttccacagtttgagaggaatgaaggggttgatcaacttcctgtcaatattgctgtccaaaattttagttcactcaacaatgttcaccatcctgatatcaatgctacctcaacagcttcatccagtactgcaggtgatccatctgaagagcaaaagcctgacattttgaacagcgattttgatagccattggtgtaatttacaatatggacggtcatgccaaaacccgcgccccatgaatcctgtgttatacccctttgcagtgccaccaatgtatttgcagggccatgttccatgggatgggcctggcagaccagcttcaacaaatgttaactggacccagatggtcccccccagccaacgaatctatcctatgatgcctctacaaccttcttctgaaagaattactggtggtccacagcaccacacggaggatgcgcccagataccgtggtggcacaggaacttacttgccaaatcctgtaagatcctaactagctgctttgatatcttaatgcatagataacatgtttagttgtttactattggtatattgaaaattaaaacatattctatcacatatatagaactctaatatgatgctaatctattgcaaaatggtcttatcaaccatagcttctaaattatatcactgattctagcttttgtaacagctgttataggcgacaagttcacagctaacaagatgctactactcttgtaacaatctagtggaaatgcgttaatcataaaaaataaagtctgtttaatttgcgttgaaattgtgatagaatctaaatctaatagaaaacgaaggtgataaaggaagtaacaaatttgtaggaatgtataatgacaatggacaacattcacatattctatgtatagcaaactagatgtgagattcatggttcactggtgaggatggatactcagctacctggatcaacatacttattagttgctgaatgatgaaaactcttgagtttatttatggttgaatttaaaatttttcaggatgatggaatttaggcctagcggttgtatcttaagtgcaataatttatttcattttctataagaaataaaattcattaagcaatcctttatgaatttgatagtctaaactttttttttgtttgaaaaaagacactttaagggagccccccgcagttaaaactttattcaattatactattaagcattaggttacaaaagttcaatccagttttctaatacatctctctcatgagctgataacctatataaaatcacgaatatagtctgaactggttgatactaattcgtcaattctatctattgcttttcttcttcagaaggttccatttaaggaccgacactcaggctcaagaaaccacagaggaaattataacactgacaagggtgaccataatgataaagaaggaaattggataaattcaaaacaacgaaatcctggccgcagctatggacgtagccactcagagaggtctggcatacgatcggatagacaagcagcagatgaaaaccagtatgataggcagcggcgatcttatagaaatgattcatacaggcatgagacaggcgcccaatcttctggatcaacaaactatatacgcagaccagggaacatgacacatggggatccatcaccatctgcttcaaatggtatcggtgccctttctgggtcttcagctccatatttcatgtactactcatgtgaaccaggcacaaatcacggttcttcatctgaaccacttgaatttggttcacttgggccagttcctacagctgatggtggtgacatgccacgacccactcgccaagcaatgcccaatgagttttatgggcaaaggcatgttgcatttaggggtggctcctctcattcatctcctgatcaaccatcatcacctcaaactcgcaggtaatactctcttctgtcccctttgttgtatcatggtgtcggttttcagtctttgaagtttgattatctgaacaaaacaaaccaaatcattacttgtactacagagtttatcctatttctagaaaacttgtggttgttccttacttaagtgttgcttcctggtagtcaacctagctaaaatcgacaaagttgtatgcctgctaaataagtcaaatctgttagtaagtgcttatgtgttgaatacactggcacatcacgtgagatggatgcagaaaaaggtaggaaaactggcattgaagagaatctgcttcatataatcaggaaagtaggaagttttagctcatttaatttttgctcttcaaattccttttttgagtttttcactaggtacagaagttcttgaaagtctgaaaattgtttgctagagatcaaacttgtcttaattggacaagacacaaaaaagacaattaccagagccttttttgtgagtggcttttccacggggatatggaccaggaattgtgggcttccaaatcagaccttcagtgaacaaaacttgacactgtttactaagtattcatccttttcaaatatatcaaatgaggttgactttggtcttgaaatttttcatgagtgcagactattgaatatgccctagtaattttttagaacttatagacctagtcaaaatggattttgcaacacatgcaatttgcgcagtacgtcccataagcacttccctcttccagtagtattgatgctattgcaagctaatttacaacagctggagtctgttaggaagctttaagttcagtagttaacgtgtcaaaatgaacagagtaaatgtcctccataacaattgctccctccgtttcatattataagttgtttgactttttctattcaaattttgttaagtttgaccaagtttgtagtaaaaattagcaatatctaaaatattaaattagtttcactaaatctaacattgaatatattttgataatatgtttgttttgtgttgaaaatactactatatttttctataagcttggtcaaacttaaagaatttgattcggaaaaaagtcaaatgacttaaaatatgaaacggggggagtaattaaattgtttcctaatattaccatatgtaactttaacctatccagctaatattttgctatcaaactataatgtttttttctggatatatcatgtaatgcactagtacctctttgatcatccgctccattgacacaaaccctctttgatgcaaaaaatctggtgataacatgaatggcatttcccattttagtacctgccttttactcattattctctatgttcagtttttgaactttggctgcattaattattctttgtgcttccatgaattgctttcgtgataattacttttactgatatttttttgttatcatcaagctgaaagtttatgtattttattccctttcaaggtagtccgttctgatctcctaatctgatggctggtcgcattgaatccggtgcttatggttggtttggtgatgagctacccagaaagcaattgtgctctggcagctgataccgaatacttttagcggcctcaccagaatttacttcagtccgacgatacatcagatttatcatagcactacctgatatcggcagcaccaaccttctgatttctgaacaagccatacaacttggaaccctgaatatcttcatgaagaattaacctaaaggataagctcgaggattaactgagagtgccacccttctctgtaatattaccgtcaaaagatgactattaatgctgaaggaaggagaaggattggcttttcaaccttgaaaagcatggaaaattattggtggacaaatgtaactgaatgaatgagatattctcttgtctacaggtagaagagagatcgtgtactctagtttacatacaacaaaacttttcacattagatgtactagattttaggcgaatcctcaacagcaaattgaacggttctgtttctagcatcctttgactcagtaaaaaaattaaagttggtactcatttttctggtgtctgcttgtttattcctggtgcttgcttttaccttgggtaatctgatggtataatttattcctgaggttgcttcatttatatatgctgtcactcgttgaaaccttgatggatgaaaaactttcagaactgcaggccaccggcagttgtatatatacttcccttttgggcgaaccaccacaaaaaaagagaaggaaagaagaacaggcagagtgcttacggtaagacaagaaacgaaaattttaggaagcatatgagaggttatttaacatatgtgggcgcattctgaaatgtctgattacatctaatgcatcgtcggatttctgtactgaatctgaagaaaaaagaaagagtggaattgtctttgagtgtttcagactttgttccttcctacaatacagaacctgtgctaatcaggctaccaagagtaaaatgccattcctggatctaaacatagtggtggtactggtctggcaacaaaagctgtatatatgcagtggcaaaactccaccatggtggaaaatggtctacacatttttcactcttgtccagttcttttcttcagctctgcgatgaaatcctccttctcctggtccgacatcccctccgtcgagcagtccccgacgccccactcggcgccacgcaggcagtatttatcctgaatctccctctcattcctgcaattttttgataaattgttcagagacccatggcaagaacatggctgcaggagagcttcaagagaaacagggctagcgaaaattggggtacttcagtttgttctgcttggacttctcgagcagatccttgagcacttgggaagacttgaacctggagtcgaactcggcgtacttcttctggttctccgcttgagagcaccaaattaagagaaagtttttttttatcagcgaattcatgtcacaacagaagtgacaattggcaggaacattacaggaactctcagcgatcgagattcgagagagatatggcatgcatacatacatacatatatataggagagtagtagccagtttgctaaccattccatttttccaagaactccactcgtggcagatctgggcctggaaccgattccatccctttgaaccctgacatgatgccagcatgtactgcagaaagaaagaacaatcagcatggctgtgcggtgccaattgtgtcttgtgtgttcatccattgttccatgcatcttcagttcatgatccaactatctaccactccctctgttctatatgttctatattataagtcgttttgactaaatttttagacaaaaatagcaatatctataacaccaaattagtttcattaaatgtaacattgaatatattacgataatatacttattttgtgttagaaatgttattagttttttttattaaaattaatcaaacttaaaataatttgcctagtcaaagcgacaatacgaaatgggaaacggagggagtagcgtatacactaacactatcaccgcttgcttgcaagctgttactagtcacttcagctgtgcctgtgtgccggtgtgtacctggactggaccagaggacaagtgagagcgaggcggcggccgctgggacgatggccagtggaagccggccgacgtggccagccgtcttctccggcgccgacgtcgccgcggtcgcggcactgcaccgccccctacaccgcggcgcggtgacaggtgacgcggcgacgaggccgcggaggccaagcatggcgataactctaactcgcctgctggttttcctcctgctccgctcagtggtggcctcgcccagcgtagagagaaggatggggttagtgggttggagactgggagtagtcaggctgctgatgggaaaagatcgaaggatgggtgccgacttgttctcttgtgagccactaacagcgagatgactgggtcttgcctctggggctttgccttgatttttttttaaaaaaatagtttttaatttattaatagatctttccaaaaagtatttccgaaaaatgccccttttggccactccagcccgtctggctagccaaataattttgtcacaccacacgtggctggcatgccggtgacagcctcttgccacaccagaaggttcagattttaaaatacttttggaaaaaggtctattcataaaattaaaaaattaaaaataaaaaaaatattttgcctttgggatattttttttactcttttctcttttgaaacagattattgataggttattgtcatatattatccatttgattataatgatatattaaatattttacaaaacaaaattaataaaaatagcttagaatagagtctaatcaatgtggtggaagaaagtttgttgagaaagtactatattttatattttatagatgtggaccagataatccgtgatagtagtccgttcaaggttttaaatttttaaatattttaaaaatatttttaattaatacttaattaatgatgtagtaattaatcatttcgttttacgtggacgggtgaaaagttttcaactcttgcattccaacgaagccttatagatttggccttgtaaatggtgtgtgttttttttcttaaaacaaagcattatgattttgctataaatctgttgacaaatttcttccttagaatttgtcgatttttgaaccgcttgatgaacctcgggattcgtgcttttgcgtcgacgctttgatttgtttctttcgatggccgctggctaccggcactggcgcggctcatgcacgcgtagatgttagacgaagggcagagataaagcggcagggcatagccaaacatgcatgcatgaatgatggcctccacacgcatcgtacaaacagacattgacattgcgagttcgtaatgcctctttcacgtgagcagtgccaaacataagttttataaaggtacatctcacttatattatagttacaatgtaattacatataaataaaaatgtaattattatagttacagtgtagttatactaaagttacagtgtagttatactatagttacaatgtaattacatgtaagttacagtgtagttattctatacttacagtgtaattacagtataattatattgtatttatatttaataaatttttaagagaaaatttgtcgacaaatgtacaggtagtcctaagcctataaggcctccgtatgatttggcctcgtgtaacagatgacagaacatcgcgaccgtccgtgtcttgatcggacgtttcagatgcgtccacccaacgctaacctcaacttgaaagctgatgaaaccgaaactggattgattcgcctcaaaaagcagagtaccgtgtaataacacacttgacagttgacgcggcatcgcgagaaatttcttcttctccttcagatcccgagctaaagctagctagcttacccagctcgcgcgaatggcctcctacgacggcggcggcgacggccaccgcggccgcccgcccccgcagcagcaccgcccgtcgtccggcggcggaggcgggggcggaagcggcgacctggcgtcgagcgccaagctggtggcggaggcggccaagtcggtgttccaggaccacaacctggagaaggtcgacaagggccgcgtcgcgggcgccgccgccgaactcctccacgccgcctcccagtacggcaagctcgacggcaagcccgctggcaactacctcgagaaggccgaggagtacctccaccagtacggccgcaaggagggttccgccggatccggcggcggcggcaagtaccaggatgagggcggcgagggcaaatacaagaagaagcccggtcatggaggtgggaggtacgaagaagaagaagaagaagattacaagaagaagcctactagtggtggtggtggtggctatggaggaggaaggtatgaggaagaagataattacaagaagaagcctactagtggtggtggtggctatggaggaggaatgtatgaggaagaagatgattacaagaagaagcctagtagtggtggtggtggtggctatggaggaggaagatatgaggaagaagatgaatatagaaagaagccgagtgggggtggctatggtggggggaggtatgaggaagaagaagatgattacatgaagaagccgagtgccggtgcgggtggatatggaggtggtggaaggtatgaggatgagtacaagaagaagcctggtggtggtcatggtggagggaggtatgaggaggatgatgagtacaacaagaagcctagtggtggatatgggtatggtgcttcaagtggtggaggccatggtgggaggtatgaagaagatgactacaagaagaagcctagcgcgcactccggtggcggcggtggcaggtatgaggaagaggaagggtacaagaagcctagtgcccatgggggagggaggtatggtaaggagaaagaggaatatgccaagaagaaaaagaagcatggcaaggggtcgaaggccggcatggcatactacctgaaattggcacaaggtctcataaagaagcaagccggtaaggggaagaccggtgccggcggtatgggtgactacttaaagcttgcgaaggggttcttgaagaagcgctgatttgtaactgaatctatgatgtctcatgaattgtgaaggaccttgctgtgtttggttagtttcctgttctacttaatgcccaaatggtgtgaaatcatgtacgatctccatccggttatacaataaaactgtcttggtcagttggtcatgttgtctctgcattgtaacacgaatgcttagggtgctacccatgaattcgggggaataaatattggatggaaacctgtgttgctcatgttgtgtgtgccattcctgactataattaagtattataatgctatgcagatgcatttttcagagttatttccttattggttcatagttcatagttgacatattactaagttatgttttcagggaataacaaattagccgtgttgtggagtatgagggtaatctatcttaccatactggactatcagttaactaaatttgggttgctattaaggtttgctgggctcaatagaagaaaatgctcttttttccctcttccagaagtgttttcacttgattgacaatggtttcatctttacaaaaatccctttttgatcgataggctgaattattgttgttatgcaagttatgttcatatgattcatggactattcctatcctacctataagctcttatcttctagagacagtcatcaactcctttgttcactcctttgtttttaggctggtcactgaatattgatgtctcaatgctaaatggttttatgcctaaacgattcagtatattgttcaaatacttagtgataaatagttgtctaactagaagaagtatttaatctttaactcgaatctagtgataaactatttaaagtagacaatggattatttagcaaaaacattataaattctgtttgaactctgttatttcggctgtttataaatcacatattgttaacaaaataaattcgaagatgattgttgaaacacatcctcagctggtgggttagtccagggcagaaaataggtggttttagagtgacttgaatgaaacggtggtactattcttagaatacaacaaagctttaaaggataagattcaaaaaacagaaaagaaaatgcagactggataccagctggttcccaactgcaggccttgttcttgaacttccatgatctaattattatgccttcttccttctcccaattccatgataaagagaaaaagcaccactcaagaagaacatgaataaatggtcaactctagtgttacctttacaagcacaaatgtcatctccttccactatggttgaatatctctgcaatgtccatcttaccttatttgcagctgcaggtgcctcttttatgctgtgtgatctgttggtactaattccaaagcttttcagacaacctgaatctaattgatttgagaaatagaggtgtgataggatcagcaatcacagttggtgcttctgccatcttccctggagatgtactgtctagcgctgaggtggtggcagcagctgtatgttggcttaccaccatgagttcagcaaagttgtcaagcgctgcgctgctccctgctggttaaacagctgacctcctcagcttcccattgacttatggctagatgcatgaaggagaaattcttcagtcgttacatcgagaacgctgagggttacctatacccgtttcgatcttcatcaagggtatgtgtcaacaaagtctgatgatgaaggtggtggaatttgcgtctgaaacagcgaaacaaccaaaaaaaacccttccatcagtcttcaccagaagaacaggaatggcttttggtacagcaagcctggtagtcatggttatttggcttctgataatttctttggtgatggtggtcatgaatcagaggaaggcgatccaggggactacataaagtttgacacagatgttcttgaagaaacaaggtcagtatgctgtcatggaggagtcacaggatagtttgaggaactacctgaactaaccaaggctcaccaggaaatactgagctcatttccttgatccatggggtgtcaatgttgcatgccttcatggaattggtattgatgtgctcaatgtttggtatggccaaatatctaaggtaagtactacgctttaggtgtgtttgttttgagtcaacattgcagctgctgatggatttcagtaccgaataatgtaaattaatggaacatcatgtgttcctttctatatcctgatttaaaatattatgctaaatattatgtgttcctttctatatgctgctagccactctgccaaaattagaacgtcctaaacctagatgcatcattgttttttctccagaggtttatattttcaataggcagccaggcaggttctcttcaacttgggcatggttaagcatcatcaaacaatcaatggatgcgtttatatgcgcaggaaaattccttcgtgtctgaatgctccatgaaagacgatacaacttgttcagcaaaaggacatgcaactcagcagacaggcaccacccaaccacatgcaaaagaccatagacgaccggatcacatgtcccctagaaataggcaattcagaacgaaaacacatactaaaatgttcacattgctaggacatcatccatgtgaaggaccggatgagagaacatgcaagagtgtcttttgtcaggaggaacaaattctccatgtttccaatatacaaatctgctgaatcacagcaccagaaatcaccaatgtgtcctccagagaatcacacaccacatggactcaaaaaaaatggtaagaatgaaactatgagataacactgatcaattcaggttcagaactcctcaactgcgatgccttccctggggacctcataagcatccttctgcctcagcttcttcacgccggctatgaagcagatcttgtcagacctgaagctctccaagcttatgctagccaccttcacccacacaaccaccttggtcttcatgccttcgatcgcggagagcttgcctcgagacagagtcaccttgacacgaggcgcgtaccgtatcacggatgaatccttgaagctcacctcacagggcttagacaggtgcacaacaagcttcgagcttgtttgatcatattcgtagcagatgatattccgagggaagaggcctggaggaaggttgtactctcgcaggagatcagagagtgacttgtttggtttgcctggataagagaaaatggaagtcaagtctcttagttcccactcttatgtaaaattcaacttctctgcagatctaacatactgataggcaaattcagaaggcattctgagctattcagggaaattcaactgtggtgaattctgagtgaaatacaaaggtaaaatctgcattacataaaacttgaatatcatttctatgaacaaaattgcaaccaaagtgcacaaattcatacgagtctcaattctcaactctcaactgtaggaacaaacaacaaccttggcagaacttgaggagcagcacacaatattgcatacatctgttctctaaaaaaatagaaaatatataactagaagtgtcataaaacacacaaatagatctcctttgcaagctggcatactttcttttccccaagtcaggcaatgtattaaaaatatgtcatttttatgttttcatgtgagcaggtagattaggatactgattatgctaactttttttctccactgaatacctactggagtatatatcggacatgtatgaaacagaatatgcattacagactggcaagttgcaaatcagctggttggtgtctcataaaaccgtgccatacttaacacaaccttgctaataccgccaaagacttcaagaggaccaaggcaaagattgcaagtaaaacaaggtgttaggtgaacaattctgttagacaaatcccctttcctcttaggagcttttgcataatgtcgtcaacagaaactggacccattgccagccaaagcacattggtagaatgtcacaaaagtcttcagtttggcccccccatgtgcattactgtataactttgtagatcaaaaagggatgaaagaaaaataaagaaaagctatatccgaactccatgcaagaaaagcagaaaagttagaacaaagcagatcactttgcattgttttggatttacgcattaggcaagaaaagcagcattagcaatttggcaccactaataactatgtacaattgtactaagcataatgatttaccaagacaacacaaaatgcacacatcaaggtctgcttcctgtcttaaaactcactcttaatttttatagccacaaatagaacagaattgaaaggaacagtatacctttgagcttgtcgaaaacccatttcgccttctcctcaacagtgctcgagagacgctgaaaatcacaacagttaggtttgtcagtgtgatgtgaatgtcgaacctaaagtgcactgtagcagaatttcctgtgatttgaacctaaactgcattgcacagaagtaaagtgcagtacagtcgaatcaacagggtcattttcatgcatctcccacaagaaaagtgaagcaaaaacaggttgcagaaacatctcgaagaactccaaatgaatcctaacactgacaccaacaataatgtggaagaacaaatcgtgcattcgcacaaccaaactgttaatctccagaaaagaccagatcatttctagacggcagcttcctcagattgtaacagaaaacagcatctccaagaagcaagccagcgaacaaggaaaccaagaacggcattgattgatttcagtagtccaacaaagattcaccaagcaaagaactagccctgatataatccaactcccaacagtctcaacaaaccaatcaaacagaaaagcgaagagaaggcaagtaatacttacggagatatcgccgccaatggcggagagctcctgcttggccttccgggagatggtgaagctgccgatcttggtgagcgccttctccatgggtatcccttctcgtcgctcttggccggaggctgttgtgtggagtgtggacgtgtagacgacgacggacggcctctgcagtctgcagtctgcactgcgattctgcgaatgggtggtggggtgccgcaggatgggcgacacagaaccgggttcaaagctctggcaccctcctcctccggatgatcccaataaataagcagccggctcggggatcgatttggtggtggtctggtggacctacggcgccggatcttctgcggccaaagagttgctgcactgtttgctgcgtcagatggcaggaatttgctcgctttttgttgcgttttactcggaggagaaagaaagccgtttgtttgaactcgtactgccgcgaaatgcacagtggatttcggccttttcggtcaatttaccgatcggcgttcggtacggggaaacgtacagcgagggatcggtaaattgaccgaaaagcctcttttcccaactcttctccctcgttttctgtacgcacgtatttcaaactgctaaatggtacgttttttttaaaagtttctatatgaaagttactttaaaaaaatcaaattaattcatttttttaaaaataattagctaatacttaattaatcacgcgttaatggatcgtcccgttttccgtattactgtaccggttgggaaccgcttcggcgaacacaccctgaatcgtccaacggccgaaccgaggcgcgagccggacagcggtaggagcggggcgcatttggtgcgtgtgccgcgctcatcgcgggtgcggggtaggcgcccgcaccgcaagcgaaccgtgacacggacacgcgctcgcggtggctcgtgtggcctcgtgactcttggcatgcgcgcgcgctgggtgctggttggtttggccgctggagcggacgaacagcggcccggcgcggcactccgcgcgtggtgtgtgcgtgcgtgctactgtcgatcacgccgcgcggcacgggggaccgaccagcctcgtaccgtggatcgggtgggatctcttcgtggtgaaatgctaccaaagctatcggcggccgtgacagagaacggtgcgcgtctcgcagtactgcgcatcaactggtgagggaaacagtacactctgcactgcatatcacgggtcatcgtttgcacgtagtagtggtgtagtgggaagttgggaaccgaacctactactctgctactactactagcaatgaacagaacgaaagtacgaaagctacgcgaaacccgacctggtcagtgagacggtcacgaaggaagggcattttgaatcccagaattgataaaacagatgaatagaaaaaacgtaggaattgaatgccatatttattggatttttatgggattttgaaacacaggaaagtctccaaactatcgtttgattagcacacaggaaaaacacaggaatcttagacacatgaagaggaaaacatgaggtgagacctcatgcttatttttctccaaagttactcattccataggaattttaaaagaattaataggaaataatcctttgtttcaaatgactatatagaattatttttcataggataaaatcctctaaaattcctatggttttgcatttgattcaaataggccgaaatgtgtgctcggagaacaaacgggatagaaaaggataataagctcatggtcatcccgacccatacaaatcgacgatcatgcatgcctccaccagctcacagatgcttcacgcttacaccgattacatgagatcgagctaaggtagtccttgtcattcacgctagctgtcctccacctaaagctaatgtgtgccattctccattctcgtgaattccccttggtcgtgtactcgtgtggtggctctgagccgctgcctgctggcttcgcagccgcgcaccgtacaatcgcctcagatttttggtcggcgtctcgcacgccgatccagtagattgataaggttccccatcgtgtagcgtacaatattacgagtctgtttggagtgtttaatattttgggaaacaactgatgataaattagctgacgataatctggatgagaacccaacttttagcttacatgagcctgttcggggagattatgtagctacagcttttttcaggatcacaagcttttcaaaacagtctagttttccgttcccttaaaagttagcttttcgtttagattttaagaaaatatagttaaagaatccagaaaataaaataaaagtcagaaattgaaaaacacaacttttccatattatcagaactggctactatccagatgattctttagaatcttaagctctccaaacatgtcctattttattttctagaatctataactatggacttgattccgagaaaaaaaacctagattattaaaggaacttctaaccgatagagattataaaagaagctgcggatgggagaccctaacaaaccctatgcgcggggccgacccgagcagagggagacggcgaaacgggcccttggttggataagacaacgtgggccgcggcaaagcctcccccgctctcattgggccgcggagaaacagaaatttgggccgcgtcacgcagcccgcagcgggggcacacgggctcctctccctgtacttccccgacggcccacctctccgcgcccccccacctttcccacgccgctgatactgatagcctcccaccgatccaattccaaccctaaccctccgcctccgcctcgcctcgccggcgccgaagccctcgcccgctcgtcggcgacccctcggcacctcatcctccccgacgcgcgcgcctccgctcgccggtgcgtgctccgtgatttatcctctcttgttctagctcttttacggcttcgcttttggtggttttttttggtgtaattttttttatcagccttcgccaactgttcccccccgtaggggcgagagggattcgtcggccacggtccgcagccgcaatggagcaagatcagggcgttgctgccgcggcggcgtcggagaatccaagcgccggccagggcgctcacgattccggtagcgcgggggctggcgccgcagcctcttccattgcgtctttcgattcggccactgcaaaccctgacgcaaacgtttacagtcagaatccgagctccgtcccgcaagccgatggcgctcagggagcggatgcctccgtgtaccccgccgaccacgcgccgctaaacgggacatcgggccaggtggtagattaccagtctgcgggggctgcagagaacggcgccgccacaaacgagatgggtgagccggttcccgagcagtcctatgcggatggtaatgtttcgcacatatgaacactcttcactcgctatcgggcttgattgtacttgctaattcattgtttcttttcgcagctgtgctttcagcagaagaagcaaggttgtggaatgccgttacagcgaattgcttagacttcaatgcttggactgcgcttattgatgagacagagaaaactgctgaggtaatgtttttactgttgccgtcaccataaaatctgttattactttattctgcaacttgttgtatgcataggcactctaaatttgtaacttctcattttctcattcattcacatgaatgatagatttaccttatgattatatgcatctatatcttggagaatctggttccatgaatctgccttgtggatttgcatcatctcatataggtaatctatgtttatataggttcacaatgcttgatgtgttttggcatagtttgccatgttgagctgtcatttgtaactttactttcctatctctcttattgaaatggtagagctcttatccaagtttctcagggaaaaaaatgaattgttatcatttgtcctatgatagtttttgtaaatatttgttcatttatgttttagttaagtaaattaagtcggaattatatggcaagagtagttctttttgtgctaataattttttttatctattcttgcccagagcaatatcttgaaactaagaaaagtgtatgatgcattccttgcggagttccctctctgctttggatactggaagaaatatgcagatcatgaagcacgtcttgatggtgtcacaaaagttatagaggtttatgaacgtgcagttcttgctgttacttattccgtggacatttggtataactattgtcagtttgcaatttctacatatgaagacccagatatcatcagaaggtagcaatcacactctatctattcctatttgtttcctcttgtagctgatagctgtgtgtgattcatgtccattttttggattgctgccaaaaatcttccctaccaagtcttttgccaacttaaatagtattgcacttgtttgaattgaagccaattttggcaaccctaccaaaatttggctcctaattagtagcaaaccaaaggacacagttgtagcaaaactctacccaccaaaatttggctgcaccaattcttgcctaggttttggcagtaccaaattttgggagggtagagaactaaactcaccctataggaaatctatgttggaatgtttgatatatgtgccttcgaatatactagcaatttataagtaaacttgggacttttctgtcaagaatgatatgatccttcgtggatgtaaatgtaggatgtagataccactgagtgcagcagccggccatcattcattgtaaaagattttatttctacattaacaaattttctcacattgtcttttacagactgttcgaacggggtttggcatatgttggaacagactatcgttccaatattttgtgggatgagtacattaagtacgaagaatcactgcaggcatggagtcatctagccatcatatatacgagaatattggagcatcctataacacagcttgatcggtatttccattggtaagatcattgggtatttgtgcagtttatttttgaattgtattactttttatgaataagtcgttgattagtggtctatcaattgtcagggtgattaaggaattagagtcatataaaccaattacaacaaaagaaatagccatataaatgtaacgtggtattttggatgataattgttatattcttaatgaaacatagtgaagtaaattttatacttgtactaatggtcatttgttttaatttctactcagcctaaaggagttggccgcaacacgaagtttatcagaaatacttacctcagaggaagctgccatgtattctgttactgccgagaacactgctcagacgcttgatggagagacacaacctggtgatgtagatatgtctgctcaacccgaaatttcaggttcaacagaggcagataacctggcaaaatacgtttctgttagagaagaaatgtataacaaggctaaagagtatgagtctaagattattggttttgagctagcaattagaagaccatattttcatgtcaagccccttgacaatccagagcttgaaaattggcacaactatcttgatcttattgagaaagaagaagacataaataaggtatgcttttgcaatggaaatagtcctttactttttcattcagtagacttcatgcagtacctggagtcttgtaacttacaattttagtcttattggctccattatatgctttaacggctagtatttggacgaagcttcctttgtaatggcatattgaactgaggatagagcatggacataatgtttggtttcgatgaggctaagtactccaaactttcatttgtcagtggccgttctgggttaatgatatgtgctaccaaatatcagttgtttgaatttttaatctcatatatgcaggtaattgcttaatgctctccttcttaaccatctatctatcaggcaaggatggtccctccttatggaggggcctccctaatcagctaatggagtaacctgtgtgaacttcttctgtttttttgtcaatattttattgttattccctttatttcctttattacttccgctcaagttttctgatgttacccaatatttgttttcaggttatcaagctgtatgaaagatgtgttattgcatgtgctagttattcagagttttggatccgttatgtgctatgcatggaagctagaggaagcatagaactagcaaacaatgctctggctcgtgccactcatgtttttgtcaaggtatcacatatacagtcagtataatttaccttttaccattatgttttttctcctgcacacttttttgatatggatcttgtgtatatccttctatctacatgccactaacatcatcatacgatatcaatcagcaaggtctgacaactgatctaaaagttctgtttctcatttcatcttgtgttctttcactgtcaaagattctgtatctgcgaaatgaaaatcttgtgattcttgattctatataggtactctgcatggagataaataagaaatataagaaagtggtctgaattattagtttgcaggctgcttaacgcatatctaccctttacttgtaaattgcttttgttattgtgatttgagtagacagtagactccttctgaaaccttgtttgattattgacgtgctgaaaacacaaagaataaactaatagcatctgtctgtcatgattaccatttgccattgataatctgattggggcctgagactgtatcgacaatcagtattttatttattgcaacgtaatgcatgtagtttatactgcaatcgttttagatttactgaataacactgtttcttctattctttaacagaagcaggcagagatccatctgttcagtgcaagattcaaggagcttagtggagatgtctctggagcacgtgtagaataccagcatctttattctgatctgtaccctggccttttagaagccattgttaagcattctaatatggagcaccgattggtatctcccgaatcaaactacggcattat

SEQ ID NO: 16840 - DNA, 15707 bp, Oryza sativa
agtttttacctcaggacctttaaaactgcaaattaaagatagtttatgtatgttttgttttttgtttgcctgcctgttaatgagatactggagacctactagtagctacggcctcagtactagtttgtctagcagagaagaatggatcataattctctaggaatatgaatcaaatgattgcactgcttgtacttcttttcctaatctgaattgtcctgcatggcagcatctgttttatttgttcttttggttgacccactacgattgctgagttagtgacgtgtgtttaaattctctacagtttttggatctatttggggatgcacaagcgatcaagaaggctaccaatcggcatcttactcatttttcgcggaagagaagcatgctgtcatcaaagaagcgaagagctgatgatgttatcatgtcagacagagataaattggctaggattggggatggtactcagccagttgtgggaactgatccaaatgctcataatcctccagtttggccagcgacatctgaagcatcggggcaacaatggggagctgcttatgcaccacaggtttttatattcctataatcctaccaatcatttatttatgtcctgaacgtgtgtagcatgttttctatgctgttgcaaaaaagtgaaaatatattttggtttctttaaacgtcttctgagttggtagactttcctctactgtttatatcctcgcttgctatgtctctgctgtaatctgtcacttgtactatctctctttgttatagtatttcttttaactatttgttgatgcgattgactcttaacctgtttgcattgcaggccacttatcctgcgtatggaacttacgactacagccatcaaatgcctcaatctgctcctcaagcagctgcttacggcgcctatcctccaacataccccgctcaggtactgaagatgttctccatctaaacttgtagagtacctctggatttgaactgctttgtgcttagtaatctgatcaaattgtgctcgaaattattttaggcctacacacaacaaacctatgcacaaccttcagcaatggcggtggcggcaccagcacccgcagtggcaccggcggcagcttaccctcagcaacctgttgcagctcagcaaccatattatggaacaggaacatactactgatctgtagactgattcaagagggtgctacgaaagtctgtttatttgttctcgcgcttgtatcgctgcagcctaaattagcatattttactgatgatactgtaggtcgaagccatggcaggaccctttgtattagtactactagcgttaccagaagactagttaagcacatgatttgtatagcacctcgtgacattttcctgctagcataatggtccattgttttcatctctaaatggtcgttctgttggaatgagttatgcatgtgtcttgtcaaccagccacgttggccttgtctacttgttctgccatgcatcaatttgcagaacaccagaatccattacgccgcaagcatgtttctgtgtatgtgagcgacggccgggaatggaataagagcgggtacaataatatgatgatatcatatttgtgtttatgtgaacaagatgataacatcttatttgtgtttatgtggaggagaggagagaggaaaaatgggctacatatttatatagccacctgtagcatgaccaatagtgtagtatgtgtagtatgtatataggcctggttagatcaatttgctgtggcaaattatttttgcaaaagttttagtggtaaaagatttggcattagagttttgctagttggtgtttagattcacggtaaagttttgccattttactagtaaagatagagagagcgcggctcccaacatactttttagcaaaatttgctactttagcctcccaaataacaaatgccaaatttgtcaacttttgctactagtgtttagatcatttcgataaaaaaatgctccaaaacaacaaaagttttgtcattttggaggaactaaacagggccatagttaactagtattgtatttattagtatgctactaagtttgatatagatgatgtgttaattatattaataaagttagtagttggcttatattattaaactgctctaacggataaaccgcggtggtggtggcggtcgtacgcaccgagagcgggagagcccacgacgagcgaaacgatcgctatcctccggtaaatacgctcgcaaactcctgcacattcctgcgttggtggtggttccaagcccgaagcgtgccgcctcctcgtgtccctttctcttccttggatcggcgtctcgtctccttgtttgccacgaacccacgacgccctcgtcgtctcgcgcccatctcacccgcctctcccctcctcgcctatatcaacaaaccaaccggtttcttcgccggtgaggctatgcaccggtgattggctgctctgctcaagccaaggtaagccacggctttctttcattcccactggtattatctctctctatccgctagtaaattcaacttggtaaaattgctcggtaaaagttgaaccgacatccgacatgtgtgtaaatctacagttctatccggccttgttcggttaatcttcatgagaaagggatcgaaggttgaggtgtggaataaatactctccaaatctccttcaattttcttagaggaaggattaacccaaaaagaccttagtgtgttaatacttttggtaaacttcagattattgatttttagcttactgtattacgcttgattttgtttagtactacatcgaaaatactgatcgatcgacggtaagagtgcaggttatcgatcgtcttggacatggccgaaatcgacactaggccgcttggatctgtacgagcagcactgacccacttccagcagagagctgatcatcacagcaggtttagcccagatagaaatgtgcgtaactgaactgaaactatccacaaaagtacaaaactgcaattccattttagttcctggattccatctcttctcacacacttgtcaattgtcaaatgcagctgcaggagatcgagatcctgacgaaggagctcgcgagctgcaggatgcagctcgaggtgaaagagaacgagaagatccaggccaacctgaagctcgaatccctccaaaacgccatgcaagaatcgtccgacaaccggatgatcgcaaggcagcaatctgaagcttctgaagagtgcaaggcactgagggacgaactgaccgtcgtcagaggcgagctcgacgccgtcaggagctcgaactcgtttctgctgagagagatcgagctgatggagacgaggatgatcctggagaaggagagcatcagggactctctgaatcacgtgctgcagatcaacgagtccgttctttcgtctgctgtcgccgcgatcagggcggaggaggagaggtcggtgttcttccaggagatcacgctcgagttcttgagctctgacaagaaccgggaggtgatcgaccggcaggtggagatgatcaagaacctggagagtgagctgatggcgaagacggtggagatcgcttacctgcagtcgcagctgcagcaggtgaaggagcactgcatttcatcggaaatcatcgcagggaaccaagaacagcaagcggaagcatcgctgacgctgggcaatggcgacgcggaggctgtggtcgtcgccggcggcgggtttgtcgcggtgatctccaaggaagacgacggcggcggcgaggagttctacacgaaggagatcgagcacgatcagcagcaggcggccggggcggcggggctcgccgtcgccgatgggtacgtgctcgtggcgaagagcgacggcggcgacgcggacctgaaggggaagctggaggcggcgcgcgcggagatcggcgacctgcggttcagcctggaggaggcggtgaggcgggcggagctggccgaggaggcgaaggcggcgctggagagggcgctcagggaggagatccagaggaaggcgcagccgcggaacacgccgtctctgacgacgacgacgacgactccggcgaagccgccattgacggggccgagaggaggcgacgggaggccattgcctggaggctgcctgacactggggaaggtgctcaacatgaagtacaagtaaaactttttcaggttttttcaagcaaagcatgcatgaattcaaagatttcaagtgatgctggtgtatgcctatgacttgttatgattacattcatgtgcttccttaattgtctacttaagatgtagtatgactgtaagagcactcaaatggatgccatatatattaaactagctgggtggcccgcgcaattgcacggctagcacgcaaacaaaatcatatatttttccgtatgacttttacttaaaatttattaaatagctatcttattgtcttaagactttgaaagaccaaaccttatcattcccgtatttctaattatatagtttttaaaattcacactagctgctaccccttacttctatcatatccttctttatttgcttgctcgatctgccactatttctattcattctccttgaaacctctaaaaaaatggatcttatagtttttagaatttattgtctcgttaggttttgtttttataatttctataagttccgtcaaacgctgccattatactcctctacggcccatccattgtgttttctttttattgtcattgagatttaaaaaatcgaacataattattgttcaggttcaattttttactttctagaagtcccgccaaaccgtcagcggctttactactgtacttctttatggcccgctgcctccactctttattgtcattaagattttaaaatcgaacatgattatcattggttttttttttactttttagaagttctgaacctttaaaaattggatcctgtagtttttagagtttattgtcttgttgagttttattttttataatttttagatgtcccgttaaacgatgccactatactcctctacagcctatctgccacctactctttattgtcattgggattctaaaaattgaacataactaccgttgaaatttattttttattttctaaaagttccgccaaccgcctacactttgcccgctgcttcttctttttattgtcattgagattttaaaaattgaatatgattatcactggggtttattttttttgtctttctagaagtcccggcaaccaccttacccgtttgcttcacggcatgcctgtcgtccctccttttaatcgttattaagattctatttggtgttttattaacggtttttatatgttgtatcaaccgccaccactctacttctttataggcctgttacttaatttatctcgtcatgtgttttacatggttttcttttaatagtctttatttttttatcaccaattttaattatttataaattatattcctaaatgattctttttctttttctaattaatcgtgtgttaattgtttaatgacgattaattgtatatgtgcaaccgtgcaagctttgtttatttgacagcacaactcttgtctgtgtaggtttataattgaattagattatatgtgtactgtgtacaccgccaaagaaatagaaaaggaaagactcatagtatgtaacttacacagtacatatatatggacttatcttttctacaacaaatctatacagttaaaatctgaattgaatcaaaggttttaattaatctcgtattgggttcttatatggactcctcttacaatattgcttatttctaatttcgaatttcagctattttttatattgtatttctatttggactcttcttttctttttcttcgattaatgtgggaatttctagcctccatagcgaacgtgatgcctccttttcgagctgtcttaataatataatagatagatactgtttaggcaggtatttagtttgcattaacatttcatatctcaatatttttataattttatgaatggttctagcactcttttttttcctgaatttagaactcattgcctgatgatttatggacacctccaaagatgaaactcattttcattattctaaaaagactggaatggtatttcttggagcaaaggagacattatctcgggagatattgaagaatttctcctttctttattcacagctttatatacatcagacaatttaatgggtaccaaatcttatactgctaaagttggagtaggatatatacccaattaattcccatattaaaaaatccattaaatttctgcccgtttgagccacaccattctcatctatttaaatgccttctccttgcttgtcatcgccattgccatcgtcatcacagcacaaatcagtcaaatagtcaaacaaaacacacaccaccagcagcagctagccatagccatggccatgacgacccgcaccctcctcctcgccgccgtctgcgccgccgccgccttgccccgaggctggagcccgataaagaacatcgacgacccgcacatccaggagctcggcaggtgggcgatcacggagaacaaccgggtgtcgccgagcgacgagctcacgttccacagggtcaccggcggcgagcagcaggtggtgtccggcatgaactaccgcctcgaaatcgaggcggcgagcggcggcggcgacgtcaccggcagctacggcgcggtggtgttcgagcaggagtggagcaacacgcgcaagctcatctccttcgacaagaaccacaacttctgagctccccggagggcgatcgatagctctcgatcggcaagatttatgtgttgaatagctcgagttgttttgatgtaaccattgcgtggatattttgtccatccaattgtttttcacatcgataaaaagccagatttcttctgatctcaatctcttttttttgaatgaatgaggaaaacaaagcttttcaaacaacaccattaattcctcacagggcccacatgtcagtgaatattgctgtatatgtaataccacagaggatctggattcgaccgccccctccttttgttctagtactaaactataaacgcatgggtgacactatatatatatatatatatttgtcaacagatatgacattgctctttggagacattaaggagatgttctttttgataagggtacatggtactgaatatgttacctctcctcttgtactttttggcaatagagtcgtttcctctcctcttgtactgaatatgttaccctttgagtctaaatcaagcaacaattcgatccccaaattcactatttgacacttttaactgccccacgccggcaaatgcatgaatgggaaatcacataaatggggaaaatacatttttataggaaattaaatgcatatgtaaagttgataattttaaaacaaggagtaggaagaatacataaatataattctttggatggttaacaacactggaaaatagatgaaagaaatatactgaaatatgaaagagatgtactgaaatggaagcttccaaacgattggaccttctgctatcctttttctttttagaaaaatcatgcattgtgccattgcaaaggaattttacatgatttggaagcgctagtattttgttctaaaggtcaaaggagaaattttcctatatatgtgactttgttaccaagggcactttatcaaccttatgtgaaaagttcattttatcccgagcagtgcatctcacctttgggaagtgcttcatatgttctggggtaagataactcttcccgtgaggtcaacaaagtgcatttggctaaaggctaacggcgatggtaaaaagaaagaaaaaaaaaatactctctccgtttcaaaatataaacattttcagtatagtgataagtcaaatattttcaactttaactattaatggtgagaaaataaaaaagatcagtcatgtaaaattgatattactatatttatgttaaacaaactatctaatacgcaactcttttcatttgaaatatcttacttttatagatattgttgatcaaaatagtatcttggagactgtgtcagagtctaaaaatacttatattttaggacggagggagtatatgttatggcattttgtaaaactcacattcatctacggctattttgttgaatcaatcacatgtcagtggcaaaaagtagaattgctcccatcccgtcaatacacaattgcatttactgtatcccaaaaattgcctactattttgctctcagatttcatatctaaataattgatttggaaatcatttagagatcccaaactatatgtacttataaccagatagagtaacatgcatgagagcaaatcaaagcatatcccaatttgtaaaattacaaacctgccaattaatttcttcttatttagtgagcataatacatatacatgttaagatatcaccagcaattaaaaggatgctaattgaatcatacaattggataggtagcaattagcagcctataattttctacctgttggcagccacacccttccatctatttaaacgacctctactttgcttctcttttcaccttcacccactgttaaaaaaaaaagtttaaccgcagcagctgcagctaagctactagccatgaccatgaggaccagcagcctcctgctcgccgccgtcgccgtcgtcgccatcgtcgccggcgccacggcggccaccgtcgggtcatgggagccggtggacatcaacgacccgcacgtccaggagctcggccggtgggcggtggcggaggaggacaggggggtggcggcgggcgggctgacgttcgagagggtgaccgacggcgagaagcaggtggtcgccggcgtgaactaccgcctcaccctggaggcgtcgagcagcggcgccaaggacggcaggtacgaggcggtggtgtacgagcaggacccgcggagcaacgcgcgcaagctcgtctccttcgagcccatccactgatcgatcgagcagctagctctgcgacggcgaaactccggcgatcgagattgctttgattaattaccaaagtgtggtgtttatgtttttatttatttactcctgcatgcgtggataggcttggcccatccatgtagcgtgattgcgtgagatactgagatcaataagaggggagatttatattttcttatgttcgtaaggtaaaattgttgaatgaatggatggaaatgaaattgttgaaacaacattgatcatttatctccaggttcccttcgttctgccagaatccaaattaataaggtttcatttcttcattttttttaaaaaaaagtttttgagctctttagggtcacacacaaatacatgtctgtaatacacattgtcaaacttaacaaggtcagtcatttcctagcgaataggggccgtagtgttggccgttctgagttttggccggacgacagttgtaaccttatctcacacctggtgagtgtggacaattcagtaatctaatgaattccctttccccgaaaaaaaaacttaacaaaaatctaaatatttggatcaactgacacatgtataaatcacatgacaatttccggtgttattaaaaatttaaaatgaaccgtaaaaattttgacggcataaaacacaaagcatgtcacatttggatattataaaaaccactttttccgggaatccatacaacatattcctgtcagtagtgtgttcagttgacaggtttggtatctttgatcttatagaggttgggcttctctatactctccaatcacaacacttggattttctctacttgtggtctagaggtgaaagggttgaggatgaatgagtaaaattttaaacacacaaatacaactaaaccaatcacaacaaaattacatatttttagtaagacagatagttaggtgtatgtagaaaatattaataatattagatattaaaaacagagaaagtccgtaacttttgaacggtagatggccgaattttccattaagtatctattacttattgcatagagtatatacatattgcaatgcaccagccaaaaaattaagaaattgattaacaaggaaaaacatagatcaacaaagagtaaaaaaagacagtatttcatatgcgtaattcaactattttaattgatactaaatcatcatacatcaagatggatttggatccaataaatttctacctacttgaggccttaccattccccttcttttaaagcatgttcgagatggcgatcgaacaggatcctaaaatattaggggacccaaaattttcatactttaattcatgctaatatgttccagcatgtttaagacatacgttccatttcgtttcattttgtaaaagctttgctcttccttatttacttatttggctagaatagacttcttttcttcaggtccaataaatgttctatagtaatgcacggccattttaaataactatgactaaacatatatacaagttcacattctttggatctacctatctattatagagtaaatagttcttttcacaataagagttatccatacagtgacagtatttaattataaaagttaattggctaagtagctgaccctattagtcagtttttttaagataaaggaaaataagcctttatctttttattactattttctccgcttaatgaatagccgtttgctaccaatgggggaatggcttcttatttccaatctagatgattggatttgtaccaaaggaaaccagaaatttcatatatagtagaaatctgggatagagaagctcgtcctattcattggtaccgatcatgaatactttaaaaattgtcttatttatttgaacccatgatcaggttccatttttttcacttaatcaaaattaaatgactacagctagacaattcttcttggcaattgaaacgtgactctagcttgataaattatgcaaccttggtgaatacatatttgtgttcattcattaagtctattctttaatctacatatagtttttttaggttattcctaaatgatctacatatttgtattcattcattaaatctattcgttatttgtgcatttgagtaaatggacattgatgcatgcatcgatgcacacaagtatttataacccacatgcaatatatttgctattggctagaaaatagtggggatggtgcatacatggagtttgttgctagagtaaatatagtatgagagagttattagcttttcttggtcttggtgtacctgtaaaatatgtatatcaatttggaatggaggagtatgtattatgtgaagtgaaatttactcttctatttcttagcattttctaacattaagtcttattttatattttgcaccgggtctcaaatttgtatgtatggccctggcgccctcttctaagttatcctcgtaatctagttcaaacactttcacactgccatgaggaccgtagcatcctcgttgcaaccgctgtcgcctttaagatttttaatatcttaatattgatttgaaaatgtagaaaagatttttaatatcttaatattgatttgaaaatgtagaaactatatgtatttataacaagatttgtagtaataacatgcatgggaggggagcaaatcatgcatatcccaattaatttgtagacctgacaatgaatttcttgttgcttactaagcatattgtattaccaacacatcggaaagatataaagaacaaaataagtggggtacttcatatgcaatcaaccaacgatataataatcgtatgcaatcaacgatataaatggatgctaatcactaaaaatcatacaattattttttgaatctaaaaaaaaaccatacaattggaaagacagcatccaataattttcttccaacaagagccacactttattccatctatttaaacttcctctcttttgcacaagcagctagcctttcaccttcacacacactgtaaaaaaaaaaaaaagctcacaatgaggaccagcagcctcgtcctgttcgccgccgtcgccgtcttcggcgctgcctgcacggcggcggccggcgacgaatcctggaagacgatcgacgcgaacgaccggcacgtccaggacgtcgccctgtgggcggtggcggagacagactgggcgtcggcgacgggcggcctcacgctcaacacggtggacggcgccgagaagaggtttgaggccggcgtgaactactaccgcctcaccctcgaggcgtcgagccgcgtcgtcgccaagtacctcaggttccaggcggtggtgtacgaggagggcgacgagcacaagctcgtctccttcgtccccatccactgatcgaacgctagcagctagtcactccatccaaaaaacgaatctataattggatatgacacattagtacaacaaatctacacacaagtatatcaaaattcatagtactataatgtgtcatatccagtactagtttggttttttagggatgaatagagtatctgaaactatgagaggctgcgaaggcaaaattaattatggcaagatttattctttttcttgtattccctgtgtggatataccacacacgtccatgtccacgtccacgacacgatacacatccatccattcatgtattgtgacgtcgatcagtaagatgcaaattatattcagattttctattttgttgtcaataaaaaaatatgggagaaatctgttgatttttttttatcataggatatcgatgcacaccaatgttcgtgctggtcgttgggtatattcgtgcgcaacagagagaaaattgttgtgtgcgtgcgggggctcgatcacgcacacttgtttcttccactaagcagtggcatgcgtgtgtaatgggttagagcctttaggctgccctttcacaaactatcttagactcttagtccttaaatattctagcttaaaattttactaaatttcagcccaatccttatattttgtagactaagaggtagggctcattaccacccctacacatgcctacaagtgtacggactcgatcccacaaccttactatagttaaccttaaaatattaagatttttttctgtcgaaagttgtatagataattccaattatatttcttcacgtcgtataatctaagattgatgaatgcaatcgattttgctaaacatccgtcgggtgatttcttctctcatatttgatgttttcttggccataggattacaccgagattagtgcaggaatgatgacgtttctcgcttccatatcgctctctctctctccccctttcttttctaaataaaagttgatttctttatatgtcaaaaaattaagacatttgaaactaaaataaagaatgtaaaattaatcctattcctatataactaaaattatatttgtaaattcagttgatatgatatgtaagtccctgtataaaaattgttgtgcaagtaaatatgtatttgctattttctttaaaatataaaattacagtcatatataactaaattacatttgtaaattcagttatatgacatgtaagtacactatataaaaaagttgtgcaggtacatatgtattggttattttcttttatagtctgttggatgtaaatgtaagggtaaaaaaaaatctgagtgattttttttttagaaatcacccgataaattccgtcgcccatacgaacatgcaagaatttgcctcttatatatattgatgcgacgatctgtccacacaggacgagtacatgaaaaaggaaaaaaaaaacttcaacaatcttggatcatctgtccgctacgaaggagacgagcttgcgcgagttgattacggactacttgcgccacggcctcactgtccggcctccttcgccgtggcctccttcgtatagccgtcactgcctacttgcgccgacgacgacgggacgtacggccgtggtgttccgcgacggggaaccgcacacgtcccgccacagcgcggtggtcggcacggccatggtgcggctggtcgacgcgctggtgcacggcggcggcgatgacgatgacgacgatgacggcggtggcgggtactactacttcgccttcggctgggagtgggagaagccgctgctggaggggacgctggtgttcgacaagtcggtggcgctacagggggtggcggctccgccaagtggcggatccaccatggggtctctgaggtttcgagaccccactacccgtattataactatgagactctacaaagacctcactaaaattttctgtcatacgtcttttagaaaagagggctataattttatataatttgttcagaccctcctgttaatctttcctagatccaccctggctcccggagccgggggaggccgccggcggcgcagagccagcgaacgtcgtgcgcggcgtggtgcgcgcgcgtgctcatgttcttgacggtgcagtgactaccggagctcgtcgctgcctagccgcatttgcattgcatgctgtcagcctgcatagaacattcgcaatcagcaaggactcagatcacccgttttgtttgctctatgaaacgaattgccttcaaacttttggtttagctcaaatttactattgtcagcaggaaacttgacactatataagggtgtcagggtgatagacaaagttgttctgatttaattatgttatctggtttggctccaatttacaattgttatcatgaatcttaagacttagggtgatagacaattgttctgatttaattatgtttctttattgtggcatttggtactgccagtgttttcagaagcttctctctactatgctacaggaagccccacggagaaagatacaacctcatctctttgcttgtgtttatgcttatcagccaaaatttgaattttcaatcttaaatttaaagttgattttagggttttttttcatcaaagtttatttttcagcctttgcttttaaatcgttaagaacatgtatataaaagttttattcacaaactatttttcgtttgcaaatatgccgtttggcttattccctcgataaacgaaacaatgagggacctagatttgagtcaaccaaaataggcccaatttagcactgctatatcctctgctgtgggttctaacttttgccaggttggccgaagatgtggcggacgaccaatgtcattaagattgggaggaaaggaagtacaaaatgtgtgttacattgacaagagaatgtcgagtaggtccgaggcaaaatgccccggtcccgtgaacaaagaaaggcccaaaatctgcgcggaaaaaactgtagattcacttaattacattggggaatgattcctgccaactaaaatcttacatattgtattccgttttccaaatgtcaatggcagttgcatcactgcattgggttttaagaaaagggactgcatttatgacatcacattttgtacaccgtagattaaaaatcttacaatgtaaacttgcactgtaattaggataaaaacgattgattacctaaaggaaaagataagagagatagaaacatactcttttttttaggggaagatagaaacatacttacatataagcaagatagcaattaataagaagaaagtgactgaaatccagctaaaaatgtgatgtgtttttagcgaaactgtaaaatgggtaaataacaaagtcaaagggataccgaaaataatcctgaaaaaactttgcagttgatttggtaaaagatcatactacctccgttttttaatagatgacaccgttg

SEQ ID NO: 16841 - DNA, 2630 bp, Oryza sativa
aataagatgaatggtcaaacatgtgagaaaaagtcaacggcgtcatctattaaaaaacgaagggagtattaaaaaatcaagaaaatttcactcttctggaaatcagcaaggcaaacattaaaatgtctaaagctgctctaccgatggagtaagccactgcagcaacacgtatacgccaaaaaggataatgatatacagcaggtaattgcttctgtacagcaggaagatatgatgaaaccctcaagttaatgggcgtcgaatgcagcaggtaattgcatttgcaatagcactgtggtttaactattttctacatgaaatggtgcaacccggataaatcaatgtcgctgcaaaattacttatgaaacatcgtggtaaaaacaagacaacctgataaatttacagattacgtttacctagaactatggatatttgtccaatccacgatttatgtaaacaccaccagcatcctcttattttcttgcatgatgacgcatctcggactgggtaacctccggtaaggttacaatattgcaccacccccatcttccagaagcaggatgtgaaatagcttgtgtagcgtccatcatatatatgtgcatcgctcacatttgacacttgacagtacaaatatccgtagcctgagaatgatgccatgttaaaattctaacttctcatgtggagtctttctttggtgctggagctgtaggccctggtgggcgagccaaatttaagttttgcatctcacttgcaagaatcgccctcctttctttcaaaaaattgagccggtttgtcagcttggctaatgcaaatggcactgccccagattcctgaaataatagcaagcacatacaacggtcatcacgaacttcaatccacgaaagtggcagtaaataaccgcatttctatagaggatactagcagtatacttataggacacaaaaaggccaaagaaacatacattactatatcttgccgactagaagtgatatcggttgaggggtcagtgagattacctctgttctagtgctcgaataggcatttgatccaagcctgcctaacagtggattgtttgagtattgtttctgtgcaaggttccactttgatgtaaatgatccatcttggccatccttcataatcccacccttagaagataagatcctttgagccctttggctgatggtacttgattgttcattggatgcaatacctacgcaaaatcacatatttgaactactaagagtgttgtttctttggatttatttattttttaaaaaatgagcagggattatatttatcatattttgttgataattagtactcttttgatgcttgtggagagttggcttgtctatggaagaagatgaatgttgtgtggtttgcttccttgattgctcaatatctgcctgaaatgtgacataaaaaataacttaatgatagaattgagaccatgaataactaaaaacacacccagaactgactgcacactcattgttaactccatcgagctggatatttcctacgcaatctcgtctttttgcttggttgtctacagcaatgaaatatgcgcgattgtgatgtaacaaggatatttactttttttttcctgcacattttttactgggcacctctgcgcatattcaggcagacataactaatgtgactaactttgttacacagtttcaaaaacatctactactatgagacatgcacatgcaatagtcgtcctggatttggtgttaagggtataatatatatgccatgggcattttagtcttttccaatctattgtacaaaatatatgttcactgggcctaactcaattgcaatagaattcattccccattcctctcttcttctcctaaattaacatgtgtctctaatagtcttaccatgtctgtagccgatgccatgtcagacatagaattgggcccaacatttgatggtgaagtattctgttcatctctgcagaaaggtagcccacaagtatgttcccttcacaattctaattggacaacaaaaggctacataaagtgctaaaataccacagaacgctgaaagatattcttactcgaaaagcttgtctgtacttaggagtcgtttgttgcaagagtcacataatgaggtggagctcatctggacattgttgttgagttgtccacggagatcagaaaccttttgcttcaagttcaaaatatcagcttcagcagtagcaacttcctcaagatcagccttagtctttcattagcagaacaaaaaaaataaaataaaatggtgggaaaacacttgtactttaactcgacaataaaattttaaaaagaaaaccttgctatcaattgttgatgggaaggacacctgtcctctacgcaaattcatcagcccagactccaatgaggccctcaattttctctccttctgtagctgatcccgcaaattttccacctgttgtatgaaaaacaatttccgtttaacagagatttgcatatttcagccagatattgaagatgtataaaatttctggtgatcttaacataatgtaaggatttcttatggagataaagagacttaatcataaaatctacctggatgttctgtttctagaaaaaaaatactttcccatagtttgagctctt

SEQ ID NO: 16842 - DNA, 6563 bp, Oryza sativa
tttcttgctcgtctcatcggctactttcataatatcgtcttaaaccaatctattaaaccccatagacagtattacaaccgattgggcgtgtttagggtttattattccttgatatatccagcacatagcatatttggtctaactccatcggctgagactatcaactatacactatcggctaatcaactatcgaacgactaattctgcttatattctttcttgctgattgtaggatcaaatcagttgggacgcccttgacacactcgtggctagcagtggacctgcattgaagttaagcagatctcccaggccatcgtgttttcacatcaacaaccacctaggagtgcttactcatgcccccaaggtttggagaggtacaggttgatctgcagagtcatagggtgcgagaacttctcaattcttgtggatgacatcaaactagtgctggaagccgagaagaacactacttggctaaagttcaaggagagcttcggctatcctgcagccgacgagggcaggctcaagcgggcggctttcaagaatataggcaattattggaaaatcattaagtccaggctggtcgccgagtacgtcctcaacccggctactccgaagccatatgggctcttcccattcatcacgccaagagtgtgggagcagttctacgagaagaagtcgacacctaaatcccgggccaaaagcgaggcttatcaggaactctaggctaggaacttgcactcccaccggcttggcactgcaggatacgccaggaaggaacaacaatggtaggaggaggatgaaacggtaggggaatcaaacacgccgccggtgtttggcgatatcccacacccatgagcaaggaactgggcaagggcaaagggtcacaagaacgacgatgggacaatttcgtcgccaaatccccaagatcaacaagtgtacgaaaatatagtaagtgtctcatctcaatatgttggcatagtttccatcgtacttttgatttaacacaaactcaattgtactgcagaaggagttggttgcctcgcaagaagcctcgtaagaggcttgctcttaaagacacgaggacgtatatttaggcatatacgtgcttgcaaccacactactagctcagaatcaaatcctccactttactcaccttgcttcttgacgtagtctctgctactaccttatatatatcttagcctaagtctgaatatgtatgcgaaggtcacagagcataacatattattgcaatatgcatgaatatggaagaaattgggtccaagttgtgcggtagaggatgcgacctcctactttacgacatgaaaatacttttgagaatggaaggcattgggagttattaacggagattacatgttcatgtcagtaactatgactggtttgaattcgtgacaatttatattgtgcgatgacatcaatcgtgatgaagttcaactgatactctttttggcttttttactgcagagatgtccaatcagtgcagcttttacatgctggtggtgtgttggtcaggctgaccgtaaatggggccgttgccatgcggccggatcaccatttatctccagaccttctgggaggacattttttcgtgtccaacacaagatcaaaatccattgatcaaaacaagctagtgaagctaatttcgagatcaattcactttcgtagaatcaaacgactaatttttacgataatctgacctgcccaaataaattacctactggccaaaatatgccacaaacactggttctccgcagcaaggcaacaatcttctcagcgaaatgaccccgatgggcagcattgtttggattaacaagccgctcgaccacagtacaaacgctgcgaggcagccagagaaggagatgagagttcattgttaccaggcccatatttaggggagaactcagatggaagaccacacaagccccattttttgttccttttcaattcaagccaatatgcgtttcaatatgcctaagagaatgttcttgcttcatttctttcgaatgaactctttttcttccactggtatggttgcaacacacttgttttccatagctttaataagcattcaataatattcatgccttataaaagaattgttacccatagagatgatgactgaatgtgcattcttgacaatgcaggttccattttttttgcttgctacgaaaattaaatcggtgtatatggacacaattctttgtgtgtacctgtttctcgtcgagtacaggtccggctctaggcctaggtcggttgtgtgatcgtctcaagcctgcagcagatgggagcccatcaccacgcaaaaccccatgcccaggccttagccctcaggctgaatagactccaagcgaacatcccagaatggaagctgcgtaggtggccactttaagaaggaaatgtggcaacagcacaccccacaaacccgttggttcgtcttcgatctaacgatctggctccttgtgcccgcggctagcgctttctctctgctcgacagcttcctgaccacgattgcaccatgcgacgagctgataagtcgagagtgaggggagtctagacaatggatttggacggaagctggtttgtgtgacgagatctaacagccatccagtcaccggcgtacttctgtactgtcactgctgtcatcattgctttaaccttgtgttgagggttggcgtcatatagtggtcaggtacagtatccaacacggtaccaaaaggggtgactgcagcaacagcattttgttctggcgtgacgaagacgttgtggttatcatggcgcgtctggatgatgttgttgtgaaccgagcgcccttgactagctagatcacgttggtaatcgtgatttaagtgttcttcggcttcttttcacgtaggtgttcttcctgcacctcccttcatatgaggcttctccgtcttcaatcgtagccataaagatctcacgaggtagagaaaagtcatctgaacaatccaggatatttggtgctccccatgctgcaacaagcatagtcatctgaccactcggagccacatatctcctccatgatgctgtgggagtccacaagtgggccaatcaaaactcgctacccctcccagggcccgtgctggaacggtgtgtgtgaaaatgtgaattaccagtgcaacaacggtgtgtgtaaaaatgttataaagcacataatcagtattcggcaaacccacattatcgccacaaacaacaatcttattcgtgaaacagtcgacggtacaagcaaacctgataagtgtttccatggtggaagccgctgtcaagggctaccatcctgcacggcgcatggcggcggtggcctcctacgcgaggagacaaatggcagcggcagtgcacggtgtggcgcggctgctatgcggtgtggaggcacacagtgctggtggcttcctcgggtggacgcagccacctctgcgtggaggcggatggcagcagcgatgggaccaggtggcggtggcggtgcccccacacgcatcgagctagacgcaggtgcgaagctagagttactcattggggtcagtagaccacgacgattttttgcgaatatcttgtaccagcactaatttaccggctatgactccagttaaggaaactactagaccccggtggtccaatgccatttttctgttcaagctcaattagcaactaaacaatactagtaagtagtaattagaaaattagctatcgcatataatacgacagcccgatatacatatgagatttgagcccagaaggaaagcaactcacacaagtccacaaattgccttgttgcgctgctatgtattcctgctttactccaaaagacattattttattatattatggtcccgttcttttctctagcaagagttggatgaagattaagattttcgtggtacgcttttcaaactgtgtaaacagtgcgtttcatacaaaaaaaactttctatatgaaagttgctctaaaatatcatattaatctatttttcaagtttgtaataattaaaactcaatcaatcatatgttaataccaccttgttttgcgtaaaaatcttaatctttatttttatcttcaggagaaaagaacaccacctatatggtcgatagttttgttttcggattatcttaagattattataagctatagtcaattaaagattattataagctatagtcaattagtggtgaccccggtgactatttttctggcttcgccccctggctagacggtggccaaatcacggcttagaggagggctgagggcctgaggcggcggatgggaggtgccaccaagaatcaggctcgagatcgatgcgacgaacaatcttcccattttccacgcgtgaaaccgactgaatgtagaactaaacggctgggcggctccacccgcgtgaaatcgattttcgctatcggccgactacccgtcagcacaaatgaattattttcaatggcttttggtcgttggcgggatagccagccgccagcgaaaacccatcttagccgccaacaaaaacacggttttttagccccactaaattttttacgttcggtcgtgcatttttaaatccaacattagttttcatgtttccactgtacacgtgatttgcattatatattttcccgtgaatcaatacatctaaagcaactactaaaccgatttttacgtgccatgtgaaaaacaggtgttgtacataggtccctgaattaattccactcgagaactccatgggagggttctcatataaagtgataccaagacaaccatgtgaaagaaatagagaatcgtgtcaggattatcaccccacgaaatcgatgtattgttagaggagaggctgatatattggttgtgcgaccgggataagtaaatcgtccgtcggagactggataggagggtgttccccaagcagttgttactattttcgagttcctgggagttcataccatgttctcaggaataatacacaaatgtcccaataggaatctcgtttgttgtatagtgatgacgtatatgttagacatggaaggcatcatgaattctaggtggccacatttccagagatctagttgataatttccaaagtaggattaatgatcgacaaggtagtcaaaagtgaccatgctatctagctcagtgatataatcaacgtgattttagaaacatttttttagtagatcatattattcacagaagttgggggtttatctcatctcgcatttttttaaagctcttctatgtttatttctaaactttttggctgtgtacctacgggtagatgccggagatgtaatccatttctattattaaaaaaaaaatctagctcagtgagcttgaggcacttcactgggcggctagatggatgaaatgaagctgcaaagaaatatcttggcgcgatatagcaaatgagcaaaaaattgtttttcttgttaaaaaaaattgtatgcgggaatttagttaatagtatttagtaacaccatgcatcatgcttgaagtctttatatatgcaatttgatttggttgccgaagtagtattggctgcacctagcataagacaatatgatagtatcgaccggcatgtagtaaaataaaatactatgcccaagtttttttaaaattcaagatgcaaatctggtgctctctctgttttttaaacctggggtgatcttatttgacaaagggattaagaatgataaagttttttcgcgtgtgaataacagcacaactggaataaccgcgggttcaatatgcagtaccatttctatattcagtaaaagaaaatcatagtgtgccgtgtgcgcatatatatacatctcgttgattctctttccaaaagcggagctcaaaagctcaagcccagtttcccatctcatatatatagtttatgttttactccagtacaagaacaacattggtgctcctcagacaaaattatcatctctgctgagagtaatttcgttgtgagttttggggaagtcatatcatggcctgaatcgaatttgcatatatgaatatcgggggcggagatatatgctattgctaggcatggaaggtatttggaattttggtcctctagggtttatttacctgagcatctctgcttcgactccctggtgcttctggtctcttggcagctgtgggaggtatgaaactatagggttttcgaccccttcccgctgcttggagtttgtgtctagccgtcgtagtttttttaaggttcaactttttattttgcttttcctcacttcccctggcataagtgttgtgtagctataactcttttcttctaatatattggcaatgcaatccttttacgcggtcacggaaaaaaatagaattttggattgtgaacattttagcacaagacatcacaattttgaaagttggaacgatgcttatatcaaccgtggtgaagcttgtggcaaagaaaaaccacaagacacattttccggccggttgaccaatcacgccaactgggcggaggtagtatatgttaggggggtgcccaggaatccggtcaagaaaatttttttagctatacctcatctatttca

SEQ ID NO: 16843 - DNA, 1750 bp, Oryza sativa
cttaaaattaagaaccggtagctatcatcagtcatcaatacacgtttataacagaaaccggcaccaatagtccctaaaatcatagagacctatggacaacacataggtgctataataaaccggtacctatggacatagctaggtacctataagcgcgatagtatagataccagtttttatgttgaaacagcatatatgggtatcacatatgtgcctcttgataaaaaccagcaattatgagcacatagatgccagtttacagttaaaattggcacctatgatgacgtagttcatatatgtgtgtttttttatctaactttttcatataaagttgaatgaagataaactttatattaaatttgtagagctcaacgagatctataatttaattttgtaattgatgaccttttgatttaacgtcatttggatgtccgaaaatgtgttataatgtctcggatcaattttcgtaagagagtattcaagaaacaatctcagatggagaaaaatatatgaaagtagaagatctagatgaggtctacaatcttgtactccctccgtcccttaatatttgacgccgttgacttttttaaacatgtttgaccatttgtcttattcaaaaacttttgtgaaatatgattggaaaataattaataattacttaatttttttgaataagacgaacggttaaacatgtttaaaaaagtcaacggcgttaaatatttagcaatggagggagtagttaacaaaattttcgttcgagctcgtctatagtgttaaatatgaattataagtttggatcagagtggtctgaaaagatgcatttgtttccaagacaactaatgtttgagagaggtctttagttccaatgttgcttgaagcatatctatgaatatgggttgtaaaaatcatgggacttgtggaagggaaatattactgtataggtaccaaatattctttttgggatttttagcacctgcaaaaaactaaaatagttgcaaccggcacctatagtagcacttaaacaggtaccaatgacttgggtcattggaagttattggtgctggcaccggaaccagcacctataagccctttagaatcggcaccaatggacttttgtgaagttgtgttatattgcaagaattcagtgttttgttagtatgtatgtacgaggacagcattttttttttctttccatcccctatgtcattgtcatctcagaatggaaacaaggcattgcaaaacatggtgatgaacaggtatccgtgatttagtggtgagaaatatattgatcaagcttgaaattcttggacagaactgtatataatctgaagatacaaatatttcaaaatgacgaccaagtgcaacgctgaagtgtcattttaggaagcgagaacaatggcaattggccccgccgaggtcttccgcaccctgctcaatgccccttatgtcacgaagaggaccagactatacaacatcttattgtttcttgtgtgtttgctaggcaaattttggttcattatcttgcagcgcgttggacttgcggtgcttgcgcggttgcgccacaacccacggagaactcatttgatgattgttttagccgggccaacatcttgttacaaggggttatcagcaaacgattaaatagtctaatcattcttggtgcatgaactatttggaaacattcaaaacgactgtgttatcaacggggctgccccaggcgtttcagcttgtctagttcccgcaagtgagg

SEQ ID NO: 16844 - DNA, 15272 bp, Oryza sativa
ggagaaagttggtagtctggagaaaaagttacgaatttatgtgtgtaggaaagtttttgatgtgatgcgatgtaatggaaagttgaaaatagggggaaactaagcacggcctcagcaaccaggacaacttttgccaaggtcaaaggaaaaggaacgaaaggtgctagacgaagcctcctcgtagaaacaagtggcaagtgaagtctatgaatgctaattatgcttttaagtctaagaattcttgtaattgagttgatgaggccccaattttctcactgaacgttctagtgaacgatgtaattatgtttccagattaataaagcgcgccaaatggcttcccttaaaaaaaaaaacattgatgtaggtagaagaccagtttagaggcatctgctcggtttagggcagaactgtaatctaccgtctatcatgtttatctatagaaggcatataccatcaccagaaaaagctctctctggtatttattcgttacgccgatcctacaccaggccatcttgttacaactgctgggctttgtttcaacagtgtgtaacgaccagtaatcctgcacgagctagcacagtttccatcaagacattagacatactttctcttccaaggcgctgtaggcttgggaggaatcatgaacgatcgctggacatgctcaaccgaaggtgctacagagacatcaccaagaacgaagtacccattatgcagcttaatcttcatcacgacatggagagctgtgcagctacctcctttaggaaatcttccatcttctcgcctagcatgaccctcccttgttctctcttgccgtaagtgaggtactgatcagggatgaactagatccgttacaaaacgttgctcagctagagaacttatcttcgttccgccatatatatcactcggctgcacggggtgacggaaatatatatgtaactcgtttatctttttgaaaaaagaaacaaaaagtaccataaactggtatgaaagtcattatatcgtcagatggccgtacttcctatccatataatatgtagtcgtaatcactaattcctaatacgaaaaagtacgaattaccaccccgaactatcacggtcgattaaattagcccattgaaccacaaaaccagacatctttcacctcaaactatacaaactagacaattaacccccctcagcactgttctgagcaattttttagttgagcatgcacatgtacggcgccaacgtggcgatccaatcagcaaagaaaatgaaaaagctccatggacccacctgtcatccctctctctctccctctctctctcgcgcgcgcgcttgggcaaccgatagtggaggaggagctcggccggcttgcggtggaggcggaggcgaagagagctcgggcaacaggtggaggggtgcgtcgaggagggcgctgctgcagctccctactaacggcgataagagggcctctacagaccgcgaggagagaaggatgagaggggggagaggagttcgtttggccggcggtggagcgagccgcttcccccaaatccagccgccgccgtcctctaatcccctttggccatccgcgagaagctcgggcagaggtgggtagagctcgcccggacggccggcagcggaggtcctctcgctcctctccttccttcttctctgcttctctccttcttcaatctccctcccactcctcttctcactcgcgccaaagccaaggatggcaatgctccttcgcctccgccattggcgcccgagcgatctccgccttccccaccggtgcccgagcgacctttgcctcccccgccgggggaggccgaggaggagctcagctcggcagggaaggagactcacgaggagatgctggggcgtccctcgtcatcatcgtcattgtctgaggccgcggcttctccggtggggttatctcggggtggtaggtgaggagaaggaggagggggatggtgggagaaggggcggcatcgtcggcgaccacggcgagtagtggttgtagttgcgtccgtggtggagagaggtggaggggacagatcagacagtgggccccacccatttttataaaagaattgcttactggattgccacacgtatgtcaagcaggaccaaaaccacctcatattgagtcggcgggcttttttgtcctgtttacataattgagggtgaaggaagtctggttttatggttcaggggataattcgatggaccgtgatagttctgtggagtaattcgtactttttcatttctaataatttgttttggccaaaccggagaggtactgtcacgcccggaaattcactagtaatttccgaacttgtttgtgcataaaatcctcgtctaggaatcagccgaggtacacaaactgacaatttaatatacagattcatcaaattaactaaaacgataaatacttacttaagaggcacttagtcctcaccatgaagaaaactgcagcggaaaataaaatctagcgaagctccggctccactcccacaggcagctcaactggggtataagccaaacgtcttctccttcgcaacttgtcttcaactgaggttgattgattattgcaaggtgagcatatgacatactcagcaagccacacagcaaatatgcaagtgcacaaggataccaaaggatggcgtagtataggctcatttgcgaaagcagcatttagcaaagagtttagagtagtaaaacagtagagtaattaatcagaaattttaatcaacactgaacagcatacccatgctgtacaggcccaaccatcctgaacaaccatacccggctgtacagatctaactccaaaccaggagctaagcaaattattaccagttataacatcaatacttattgtgagaggtgtgggactaatcacgaaaaacattgctcaactcgcccataaccgcgggcacggctattcgaatagttttactctggccagaggtgtaccactgtacccacaagacacagcctcaacatcatgtctacgatgcgtcgcgatactagaaagtacccgaatagaggctgtgacaataccctctgcataacacaactcaccacagtgcatcattcctggatcataatcaccccctcaaaaaccagaggcatggactccccagcgacccccgtgggcttatctcggccacttctcagtctggtgctccgcaatgaatcatgctatacaaaaggtaaagccgttgcccacgctggcttgtggttggcacgattaatgtttcacaatagtagctcgcgaaccggtccttaattgtcatgagcacgactctcaaaaccatgtgctcacaacccaccattatcaagttttagttggcaagtaattaaccaatcactactgaccatcgtgagctaccattaaatataaccataaatgatagtgaaacattagttatcccaattgtgtgctaatgtttctaagcatggctaagcaatcatatctaatatctagctgaaccaatatataaagctcaactagtcaagttataatctcccaaggtaacaaggaataaagtaatcaagaacaaaagggccatatcaaagaataggttaattccacccaatggcattcgaaaataaatgcacagttgaaataaatagagaatttaaatataggatcaacatgttcaaaggattgtgtttaggatctgtgtgacttgccttgcaataatcggtcttcaattaatcttcttgaacacttccggcgcactcgcaaaccttcgcaacgacggaaacgacaagctaacacgcaaaacgaagaaaaagactaataaaaaccaaataaacaatacataaaaagtaaacaaacatgtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatataacttttgcaacttgaaccacattaaactgagttcaaatgaattagttatgaatttttaaagattaaatcggattaaaacacttatattgattttaattgaattatgacgcaataatgaattaattttgaaaaggaaaagaaggattattgcgtcagcggctagggtttgcggtggaccgggtgcacggcagcggttcacggaaacgaacggccgagatcaactctatccaaaacggacggccgagatcgatcggtccacgaccggctcacgggagagggcgacgatgacgtcagcgatgacgtcaccaccggcggcggcggctcggcggctcgggctcgcatgctcgccggcgaacgacggcacggcgacgcgaacggagagcaccaggacgtagaggacgacgcggcgaactcaccggtgaccaaaggaacggcggaaaagcaacggacgacgccggcgacgaggatgaagcggcggcggagatcgggtcgacggcggcgacggtgctccggcggtcttcggcggcggtgaagcggtggacgaggacggcgacgacttggcgaccacgatgacgacctccccgagcgacggcgacggctggagcgacggcggcgcacggctggagcggcggcgacgacggcggcacgagacggcacggcgctagggctctacggacgacgagaggcgaaggcgagggtggcgacgggtagaggagagctcgggggtccttttaaaggggctcggaggcggcggcaaaggcccacggcgaccggcggcgagaaggaaaggttgggctcgaagagaggaaagccgatccgattcgaactcgaatcaaactcattccaaaccgatttagccgaagtttccaaaggagaaaaggtagaggagatcccgaagattgtttcccctctattgatttcaccggagaaggaaagacgcggctgaatttggaaggagaaggcggcggcggccgaaggaggacgacgaacctaacaagcggggcccacctgtcagcggctgagagagagaggagagcggcggctcggcggactgggccggctgggccgagggaaagagagagagaagggttttgggccggactgtggagtaattcgtactttttcatttctaataatttgttttggccaaaccggagaggtacactatgccatgattttgtaaattcaatttgatcgtagacattaccagcttaagaattggagtggctaacggatatgcagttacaaaagcacaaaataggtcttaacttattttttagtacttccacgtggttctctgtcagtatatatagtacgtactgtactatcagtattatcactagtaacaacagtgctctaaccaattatttatcagttctacttgcgtaaaaaatattgttccaatgattaaggtggtaatgtaaatatatctgctccatcgaatgagaaaggatgaaattgcgctcgagattgattctactgcatgtacataacacagtgaaattggtgattttttcagtgtaagccatatatgcaaagtttttgcaaggggtcaggttgcatatgtatggacttacgagttgtgatggaacaatttgacaagataaatttatcctaaacttatccattcactacttcagtatctaaacttatcctcgttagcttgcaattacatagacttcgactaccttgataggttactgtattgaaagcaattcaataaattgcttgagaatcatatcatcaggtcttgagagttggaatcctatatatggagactagcagggtagcatttaaaaatcctctagtggtttttgaaatgcagtgggtagaaatctggggtattttttctgtacgatctgcaaattaaaactggcgttatataccattaatttttcaccaaataaatacacttgtcagtgctaccaactcaaaaaaaattgatgtattgctggagaaggacaagatgggtcatgctactacatgagggtgttcgccgcacatatgttttctttccgagctttccaaaaacggaaaattggaatcatgccattgtaataattttacaaaatttgagatatgccattctgacccacatatcattgactcatgtgggtcctatatgtcattgagataccgatggcatatctcaaactttgcaaaattataatggcatggttctaaattacccatctgaaaatcacatgccatgttctgaatccaatttgcccatgagctttctgaagctcgtttgggcggtgtatgtgtggttaggtcgttaggcacagaaggcatcatgatttctagatggtcatatactgtggccggtagttcaaatttgaaagcaaaacgcaaaatggagcgacaagatagtgagttcgtgagtttctggtgctgcattgctgtttttggaggtttattgggagtgtagtgtgcctctgccccccgtcccgctgatcggagttgcgtttagccaccgtagtagtttttcttttcctacctatagttgttttttgttttgccttttctttgtcacccggcataggcatgtttggctaattgcgttaggtaagaaaaactcttctaccttctaatatattgacatgcaatcattttgcgtgttcgaaaaaaattgtttctggtgttgcagtactgcaatggactgaaggaaacaccgattttttattaaaaactaggaaggtagcccgcgcattcgcgcaggcatgtatcgtgtgctgcatttgaaaacggattatatttatcagatagcctctgccatgttttggaagtacatttcctcagcaaatatttttcgttgacatcacgttgataatttctctatgctatatactatatagtatttaattaatctgtataagcaattatctatcatcttcatcatcatctaaaaaggagttagacctagtttgtttagaaaacatgtttattaaattaaaagcaaggtgtttttttcttttttttttgttgaatgctttgggccctgatggtaaaaacataagacagctaaattcattgttccttttcccctaccatacgattttcatgcagctcctagtcaccgtgttgagatgtggtcattgcacctatggaggttgtcttgtgattcatcgtacttgtgatcactttttttgtcaagcttagttactcctattttcatttcttgttatatcgtaaaatctaaatggactccaaagttaatcattaaagtatatatgtacaacaaaaatatatttgcagacaattaatgttcatatatagggatgattcaccttttgaatgatctatgcacaaagaaaataaacggaattacccgaaatgcttagaaggccagaacaacacacttgaacatataacaatgatatactaattaaaagtgcattaagcaccatctaaagtcaattagatggtaacatagtttagagcagatacacgaaagatcatttagcttgcttggattattttagcacatttttaaaaaaaatcatgaagtaatcagatattctctaactaaagccattggattttcgatgcattggtgctttggacttcatattttagttagtcctatttgcttagatagtgtatatctaatttagctatgcatgtttgacaaacaacatatgatgatgcaacctgtattggattatttcgtaattcttttacagcaattcaaatgacatgtaaaagggcagggatgttcttccttaataaaaaatgtttcatagttcactttgaaatttttgtttggataactattgatttaatttagctatacatgtttgcagaatgatgtatagtgatgtaatatgtgcagcaaatttgttttgatggtatgcaaagcgcgcgggatgaatgtggctgaatgtcatattttgtacataggaaaatataaggatacggatcttaaattcctagtttaattataaacagagcaacaattatattagaaatcaggcgtagattaaaaattatggttgttttaatatattaattatctctcttttagcttactcatacccaaaaatagggatgggattagcagtggtcttcacgcatgtgaagggggcgaggaggtagatgcgatttgtttttataacttctccaaataatgtaacttaaaaccaatgataacaggtttaattttttctcaaaatttctaagattatttatgattttcaggacaagacatgtggcggcgtaagattttttgtaaattaaatttaatggttgaaaataatggtccatgaatttaattgaaatattttataattttaaaatgtgacatatggtgacttaagtgtgctctaaaggtgtttaattggtttttattacgtagactgatttaatatgaataatacatgttttcattctattataatttttcattttcattcagtttccatgcaaaggagtattttaatttttatatagtaaaatacaactataatggatattgaattattcaattaattttaaataaaacaatagttaaaataaatgaaaaaaaataaaatataattttagaaattataagccatttagctttttttttaatattaggttgttagataaaaaatataaggcgagagattagaggaagtatatgtatagcaggacgagagatagagattttttttctgagacatattccaacggatcctagtctttagttatctatttttaaaatatagatataattttagatctattagaaaatgtgttgggtgttgtatttactaatataagctaaatgttgccaatcatatggtttaaaaatctaattgtatcgtgtgaccaataggtagttgctagcagcatatgacccaaagaaatacatttattttaaatgtagttaatgtaggtattgaattctaaattttattgtaaataatctcatgctgtgcatagataaaaaaaattgctatttagatggtatagttgttgaaaataatttattacaaaatatgtttttcaatattaattaagaaaatgcttgaaaataggagggcatgtcgccctcatgtattagggtgagggcaaggatatatgatacataactacgtacatatacctaacgtaatgtaatggatggcagcggtggggtgtgggcctttctttttcttttttttttaagtaagtcctatggtagaaaatatgggtccactgtatattagtgaaagtcgatggctagatgttttgttttttctataatttgctagagtgagacatggtgagatgagagcatttgtagaatgccatatttttaacggtttaagagtgtttctaggatgtttaatagacttttagtatattatagattatcaaacaactaactattatatatcagccccatacgtcgtgatgtatttaggaccacaatataacttttataatttaattaaagtacaacggaatcacaaattggatatataatttaaaaataatttagaagatagttcgaggaacattgattggatattttatattattattatagatcttagtttaactatatatatttatatttgtgttgtagtttttttagaaaacagatcatcgatttttatgatgtattattttattatcttttctatgtacgtgcgtactgtttttttcttttctttccagtgaacagtacgtaaactatttgttttgtttttgtgtaggtaagtacgcacgggagaaggacgtggtttgcatcgtatcaacttgtacgtacatggcaacaatagtagtgcttaaatcatacaaagagaaagttattattttttaataatagatctaatccaatggtgtaaaatggcggatccaccaatttaagtgaaaatcgacggtgagatttgataatgccatgtggcggtctaggagcgtttgtaggacaccacgtggcggcttatgagcgtttgtagtgttaaatagaccatagaatttatatactaaataaaaatgactatcatattcaaacagaaatcactttgtctcaattttatgtaaactcgcctatcaccatcctccgcaagatttttttttcttttattatacatctaattcacctatgtatgtttatgggtaatatacgaaggaataatttatattgttgaaattatttgtgctaattgttaatgctatttacatgagaacgacataattaaaaatgatattatatggggtagggtatgcgtatatgtattcatggagtgagtatgtacacgtttatatgagcgcctatgattacctttacaatattttaaaaaatctttcaaaaaaattggtgggatggcgtgaagtggcgccatagcggcgttgattctttgataacatcgccaggagtggttgctatatacatatataatttgaagaaaaccttaaggctataaagagagaaacagaaaactaccaagatgggacagatcgtatgcactcttctctttttcttcttttcgatatctcttgtgtgcatacgtacatagggatagattagctgatttttagaagcaagggattagaatatatctaatctaatggttgaaaatggattcatcggtttaagtgtaaattgatgaccagatgttttgcctttttttcttatatttagcatcacatagcatcttaggctgtgttcggcagtgactgttcccatcctctcctcctcgttttccacgcgtactcttttcaaactactaaacggtgcgtttttttacaaaaagtttatatacgaaagtcgcttaaaaatcatattaatctatttttagaaaaaaaatagctaatacttaattaatcatgcactaaatactgctccgttttgcgtgccaggtagtgagggttgggaaccctcactcccgaacgcagccttaggagtatttgtaggagtgtaggaatgctattactcatactcacaatctattgtagtcaactattatttgatgtggcttggtggcactctctatttatctatcatttgttcatacatgcccttagcctgagtttggaactgagagttcccagctctcctcactcatttccgcacacacgtttctcaaatggctaaatagcgtgatttttgcaaaaaaaaattctataggaaagttgctttaaaaaattatattgatatatttttcaagtttttttaggataatacttaattaatcatgcgctaataaactgctccattttccgtgccagcgggaaacattcccaactctaacgaatgaaaagcagcattagtattgtcctttatcctctgtgcttcatgacaaacgtgttcattggatgtcagctaattattagacgcaatgtgcatggataccatgtaagcaatatgacttggcaattggtggatagtggtttgtatatagaacttagggataaattagtggggacattattgaaaaattatatattgtatgctacatattagttttagtacatacgtaatatatttatagttaagttctaaaacacttatctgattggctactcactttgttattgtgactacgtttaccgaattgctaaatggtgtgtatttgaaaaatattttctatacaattttttttcaaaatcaaataaattcacttttgagtttataatatttaatacttaattaatattgcgctaataacctacatcgattcgtgtgccctggacatgctcaaccaatgagctagatggaacgaaggctaagtaggagataaagaacatcaatatggtgtcaaaagaatatatttattctttaattttctaataatatatgaatagagaaaacacaaaatacatgaaaagtgaaaagtacatttatgataaatttagaagtgtcattttgatatatgtgtattttttattgttggagttatttttttcgaaaatataagtcgtatctaatttaactattatataatctacatttttcaattcatttatgtttttcatggatttttcgatgacatgtgtctaattagaatacaactcgaaataacatattccctctatccaaaaatataataatttttcactatgaatcgggactaatacttgttcagaattatagttaaaagttagaatgtagtacatgaaatagcatagtacatgtgtattattattcattatggttttactatatttttattgttttgttgttatttggttgtcacgcaaatgtcaaaagtatgtatatctttaaagttagaagagtattttcttatatgtggatttaatggtttcaccggttaaatgttatggatctacagatttaaatgcaaattaatagttaattgttttctttataatattttttttaaaaaattaaaatattagatagaatataggaaggtgagagagaggattattggacgatggaggaagtgtgcgtgctcatgtgcgtgcacggggtgttcggagggattagtatgcttttgaactaatctaaataggaaaaaaaaagatgtgcaaacgggagtacataagtacgtacatacgtttgtttttcttttttggcaggaatactatgcacatacttaattggtagtttctgatagatattttccggaatacttacgtgtattttttagtagatgtcgatgtatatagatctaattaaaattggtataaaatatcaggtccaccaatttaaatgaaaatcgacggcaagtatagatctaatctaacagtataaaataacgggtctactaatttaaatgaaaatcgacggtgagaatagactgtgccacgtggtggactaagagcgtttaaagatagaacgtttaaagagtattgattggatactttatttttatattaattttcgtaaatttatagagtagtatattttatttttaaattgtagaaaatcctaatttatgtaccatcgttttttttaatgcactacgtacctatgtttactttttttttattacgcagcttcttttcctgttgtacgtaattacggaatactttttgattggatacgtatacggagtttttgtttggtttcccggcccacagtaaacatgagaaaagtattagtttctttaagaaaataatacatccaatctaatggtctaaaatatcgggtccaccaatttaagtgaaaatcaacggtgagattaaacaatgctatgtggcggtctaggagcgtttttaggagcgccacgtggcggcttaggagcgtttgtaggaagtttaatggacttttagtatataatagaaagaatagaatagatagaagatagatagatagatagatataatagatagatagatagatagatagatagatagaagatagatagatagatagatagaagatagataatagatagatagatagatagatagatagatagatagatagatagataaccgatcccttcataggagttcagttatagtaatatttacttgcaggatactattctcattgctgcagtactgcattggtctcaaactctcaatggacagaaggaagctcagattttttttattaaaaaaatcgatcccttcatgggagtttagtaataatatttacttgcaggatatatactattctccttgtttgcacttcaaattattttgcacagtctttagactagcatcgaatatgcaaaattaatggagtaaagacctccataatttcaacaagtgactagaaaggcattacaaattcacgacgactacttaaaattttgttgttctctaaagttcagactaagtgcaaaactaaaggtctggttttgtatctgatggcgctacgaatcaagtgcattcacaatataccaaccagtaatactggtgatataaggtttggttttggttttggatgcagttggtgatgtaccgcaaaagcccagagtttcgataaaatattactactgaagaatacatatgctttcctgctctcagtgacaaaatgagatgcacataggcagatcatgagctacactgtcagatcacgagatcaccgaacatatcctcgttaggtagcgatacgtagatctgactaccttgataagttgttggactggaaacaattgaaaaaatcgcttgagaataatatatactccctctgtattgtaatgtatgacgccgttgactttttaaccaacgtttaaccactcgtcttattcaaaatttttatataaatataaaaatacttaagtcatgcttaaagaacatttaatgataaatctagtcacaataaaataaattataattacataaatttttttaataagacgaaaggttaaacgtttgttaaaaagtcaacggcgttatacattaaaatatggagggagtaataggttgagagtagggaaactttcagttggtggaaaactagtggaaaaattttttgggtgcgaatcagtacataaaacggacgacacgaacatgaatttcagtgaggaatcccatgtgaggattttcagaaaataaatatacacttatatggcaatgtgaggaacggtcttgtcagtactaccgtcttataaagttttgctggacgaggatcaggcaaacatgttttgctggacgaggatcaggctcatgctacatatgttccccatacatatgttctctttgggagttttctgaaaatcataccacgttctaagttcaattttcacatcccaaattgcatgtcatgcagagatataagtgtgttaggcatggaaggcatcaggatttctatattctcatatactccggctcatagttcataaatttgaaagcagaagaaaaagtggagagagcagtcattgagcttgtgagcttctggtactgtggtactctctccgattcaggttataaaatattttgactttggtcaaggtcatactgctccaagtatgaccaagtttattgaaaaatagtaatattttcgatccaacataaatttgtttttgaccaagtttatttacgatgacgaggcgccaccgccgactccacgtgcacgcatgtaatgtcccgattttcgttcggtattaaaaatcattaaataatgcatttccagaaattatattaaattttaaataaatttaatcaagtgaattattgagggaattaaaaattttctttaaaaatcattggctggaaatattttgtaatattcgctgtgccctaatatactctccggatttttccacaatttttcggagctcaagaagtaattataataatacaaagggcttgtttggtacaactccaactcctaaatttagctctaggagttaggtctggagtggagttgtgga

SEQ ID NO: 16845 - DNA, 1950 bp, Oryza sativa
gaggccgccgcctacttctccacttcctgccccacttttgtccaaaaggtcggcgtcggtttgaacccctcatgctgaacatcaccaccccacgtcgtcggccgattccgtctcacccgacctcgattccacactcttgcgcccatgaaaagcatcccccgaccatgctctctcgtttcccctccccgcccggctttcccccgcactctcccgttctccccacgcgagcacaagcgtcgtcgctcgccatcgacctctggacgcacgccaccgccgctagggtcaccgccaagccacgccaccgccaccattgtctccgccacgccgagccacacctcggcatccgctccacctctccccgtatccctgccggaaccacctccgcaccgagcacccgagccacctccaccatcgccacctccagccacgccgcgccgcctctcatgtccacatcgcgctgcgtcgtcgccttccccagcaccgcagccaccgtgcgcagcccgtccacccctccctcctcgcgaaccatcgcgggagaccgcttccctccgtccaaggtgagctctgccgatccttgccgcttccgggcgccatttccctcggtgccgggcctcctcctcgctccctaaaccccctgtctccttccccaggttcttccggccgctgtccgccagttcccgctcgcggaatgccgccatattgccgttgccgcgcctccccgaggagcctgccgccgctttcccatcgtcttctcgccgttgcgcgagcacggtgagcacccctccctctccctctatctccccttcgttggctgcctcgtgcgcgccgccgccacaggtggccattcagccaggctgctcgccgtcgtcccgcgccgccagtggccgcgtgccgccgccgtaccatggctcgcctgggccagtgtcacattctgatttttgtttcagggtttataaattatttaataaattaataatagaatttatattaagtgttctttaatttgcaagtgaagtaaaatgtgggaaataaaatttcctaaatataaagcatggatggatttaatttttattaaattctccatgattaagtcaactctctgaaattttctcggatttttcagagctcaattcctaaatgatacaaagaacagttcagtaattatttgatcattaatgatctaattataattgttaagtgcttttcttgtttaaaatccttaaattataaattgttgtttaaaaggaataattagaaataattttaaaagcttaaaagagaagatctaattttaatttgctaaatctcaatataaaattgggctagataaaattttgttaaatactttgcttaattctataattcctagatttttctgggatttatttgagctaaggaagtatttttaataaatggaattgcatttaagaaataatttaaattgaaaaatgtttttaaaagtctgttttggctttgggccgaaagccggcccaaaacctctctctttctctctcttctccccggcccaagccggcccgcagccgagccgccgctctcttctctctctctcagtcgctgacaggtggggcccgtctgtcggtttcgtcgtcctccacgcgccgccgccgccgcccgaaaccctagccgagcgccgccgccgtctccttccaaaattcggtcgatcctttccttctccggccgtatcgtttgatgggaaatgatcttctcgatcacctcttccttttctcttttggaatcatcgtctttttcggtttggaaatccgtggattcgaagtcgaatcggatcggcttttctctctccgagcccgacctttgcctttttcccttttccggggttttccccggggcggtcgccgtggccttcgccgccgctctagcccctttaaaagacccccgagctctcctctattccgtcgccacctttgcctt

SEQ ID NO: 16846 - DNA, 980 bp, Oryza sativa
caacggctttaccttttgtatagcatggttcattggagagcaccagactgagaagtggcggagataagctcacgggggtcgctggggagtccatgcctcttgtttttgagggggtgattatgatctaggaatggtgcactgtggtgagttgtgttatgtagagggtattgtcacagcctctattcgggtactttccagtatcgcgacgtatggtagacatgatgttgaggctgtgtcttgtgggtacagtggtacacctctgatcagagtaaaactattcgaatagccgtgcccgcggttatgggcgagttgagcaatgtttttcgtgattagtcccacacctctcacaataattatggatgttatacctggtaataatttgcttagctcctggtttggagttagatctgttcagccgggtatggttgttcagaatggttgggcctgtgcagcatgggtgtgctgttcagtgttgattaaaattcctgattaattactccactgttttacttctcttaaatgttttgctaaatgctgcttttgcaaatgagccaatattatgccatcctttggtatccttgtgcacttgcatatttgctgtgtggcttgctgagtatgtcatatgctcaccttgcaataatcaatcaatctcagttgaataaaaaggatctcgaaggagaagacgtttggcttataccccagttgagctgcctgtgggagtggagccggagcttcgctagattttattttccgctgcagttttcttcttggtgaggactaagtgcctcttaagtaagtatttatcattttagttaatttgatgaatctgtatattaaattgtcagtttgtgtacctcggctgattcctggacgaggattttatgcacaaataagttcggaaattactagtgaatttccgggcgtgacagtacctctccggtttggccaaaacaaattattagaaatgaaaaagtacgaat

SEQ ID NO: 16847 - DNA, 15931 bp, Oryza sativa
  unsure (1)..(15931): unsure at all n locations
gctaccgcctccaccgtcctcctccgatgctgcctacccgcatccgcctcgtcttcttcctcctcagatgcttttctgcccttttccttcttcaccagttcaccaccaccctctgcattgagatcaaggaatgaccacggatatccacttgttcaggtaaaaaatctccctgttataccagatccatgatttgtttggtctgaaatgagtgaatgtatgcatgtatgtatggattgtttcatgtgttaaattataagtgaatgaatggacaaaataaacaaggagaaaatagcgaacgagagattatctacctgcttggctgtgacagttagatcctatgcattgtcagtctgtcacttttcttcctagtagtaccatgatacacttattattatcgtcctgctcacaaaaaattgcagagttcatcatcagggatagataattagaggctttggatatatagcattgcaatgtcaatgttgcatatgcagcagtgtgcaaaccaactttttttatgtggaggaatcttgtctctgagcctgtttggtcagttatattgttgagctagacatgtgtgagaaacagtatatgttgagcctgtttggtcaaatatttattttaagtgacattataatctatttccaagtttgaactatttggctctatggtgcagtttagtcgtccactaccgattttgctgcaatcaacctagatatcatccaaggtgtacgttgctgagcatctaccgaacagaagtcccgaacaacaaatgtacaaccgttagtatcctcctgcttgccatgagtactgtgctaaaaggctgaaatgttatatcctcatgttatatttttcttgtgcaatgttttttatctttttcccatgggcacactggtgagtacttgtacttcacgcacaaaaaacaccactgaaacaaactaattttaagtggcctctgaaatttgattgtcaatatcagctttggataggagatggatggaccttcctaggcacaatttaacctgacaatgaaattgaatatgtagaccaatgtcctgatttaggtggcggcacaaacattactattgatccaacatatgtttctcctgttagatcaggtataaatggaataattgttaatgcaaatgaaaagagaaagccatttcaccctcttctcagacgcaatcttttacttttctgttgttttacagaattgctagatttttgttagaactgctattagaaaaattgagtcacttggtgaggaagtggaaaagttgactgaattacttgctaattctcgagatggacaacaagtcaatgtaaatcccttagtcatgtcaacttcttcaacaacttaaatgaggtaaataatgcgatgaatacagttctattctagatgatcagtgcctgtttccgtttcattacttttggccaacaatttgtattggttgaacaggagagtacaaatggctagctttttgttagagctactgatgctatcctggacatgaagagttgcatgttgaaggtggtcgcttgttggttgaattatttcatctacacatcggtggaccatcatcatacaagagtcttgggaatttttgctaattaaatagacttgttttgtatgaatgctaagaaaatgtactcgtatatatgtacactgaagcaagtgtttgcacactctgctgtgttggatataactacttttgatcttgtggaatcttaaagtcagtatgtttttttgatgcaacttaaagtcagtatgttaaacctgagttgttgaatgcacattgaaagcctatggggtattgaattgctgaatgtgtgttgaatgcctatggagtttgtactgattttgtgggctgatttggtaccgatctgaatttgtgtatattggacccattcgtactgatttggtccatgattgaaacaaccaagtgccagtaaaactactaactgtcaggctatatgccagggatgctctaagcatcaagggcagttaattgccacggatacaactatctgccgggaatactctagtgattctagggcagttaattgccaggaaaaaattatctgccgggaattctcttttgctacaggactttatagggcagtttttaagtgccgggaatagttttcccggcagatgaattgccattcaatgcacttatctagggcagttgcaatgaagggaatactaggtcatggtgtagtgtttaggctgcctacctcgggaataaatagagagagaaaggatgtagcctcccggtatcatttttgagagagtggagtttagagaaaagttaggctttcgagtttagtcgagatttttgtgaggagtactgttgtcgcactttgtaagcaccgagagaagtaataaaattccaatctacttagggacatcttccatttgtgtttctccgggtttcggtggtcacaccagtgagtgcatgaattgcaccattgcagttagactggcggcggcgacagtaggaggaggagacgctagcagttggactgggtgatctataccgatcagactgacggcagaggcgcgatcagactagcagatcaactccgattagatcgaccaccatcgaattagagggtaacttttaattccactaaaagttacggttttcgggtaacacaaccattcaccccctggttggcttagttattgctattcgatcctacaaacagcacatcttcgatcgaaaggtgtaaaatgagagttttattgcccttgatatttgcactcattcaacaattttacagtaataactactaatatttgttggaccgaatagaaataaccaagcaaatcagtgaaggatgaagggtagattacgtctacaaaagttaaataacgaaactttgatgatcataatgctaatgatcgatgaaattattttcaaaaggaggagaaaagatacaaaatgtgcatatcttaagttgtggggacatttctttcttttcaaaagtgagacaaatttccttttgaaattttgagcacttgatgctttttaccacttctttgtttttatttttccaaacaccaaaacaacatttttgataagtttgctaatatgtttattaaggggaaattgtaaaatgaaagtatgtttgatcgataggcatgcgagataattacttttgatatttggatattatttggcaaagtggtttgtagatatgtgtgttttttcagatgatggacaggattttgttgactgtttggtccggtcatgatcaggccagcatgtgttgcgcagtcggactagctagcccgacggtctgacctagcggctctgtgtcagttttggtttcaagttgcttatttggatactcttgattaattcatgtttatgacttatagatggatactatatgtatgtaatactactgtatgctaattttgagtcaagttgcagagatatggtttcgttgtttattcatttgtaggtgagtctatgcgttgggacagcgttgctggtgatagatagggattcaacttggaagaagatgacaactggacgattagcatattatgcgggatgcttcggctaatgatcaatgcatatgattggtgaaaattccttatggcatatatacgatggagatattgtgtagatgcaaagtcaaatttggaaaaagtccaaattcgatatgattaaagtttgtcaagtttatttcttgtaagagattgtttcctaggggttgggacttcttgtgcaagttcgagttgtgtatttaggctgtctaccttgggtatatattgaaagagggaggatgaggtcttccggtatcgattgtgtgagacttgagtttatagaaaagttaaggttttgagtttagtcgaggttttcgagaggagtgctattgtggaactttctaaacacgaatagaggtaataaagtttcattatattttaataaatcatcgatttgtgtttgctcgagttcgacgatcacatcggtcagtgcacgacggtcagatcagtggcggcgacgacatgaggaggcaacgcgactcgatcagatcggttgcacagacgtggtcagaccggcaaaagacttgtggtgagaccgagcttcatcgatttgagaataacttttagtttcgctaaaaattttggtttttgggtacttcgaccattcatccccttggttagtttagtttctgctgcgcaatcctacactattagtagtcaccaatgattaaataagggaacgccaaacaagaatctcgtattatcatgttttaattatttcatatttagaaaaatgaatttaagtaacttgtttataaaaatttcgctcaaaatacatggtttagtagattaaaaggggaacgactctcggtcgggcgcccgatcgggagtggtaaaatcgagcactgacgtcattctatttacgtgcaaaattactttaaactgatttttctcttaaattacttatccaaatcataattcgattgcaccattaaattcgttgtaattaaatcttcaaaacaagaccacatatggatatattccgacgaaaaaaaatttagcttattattgaattatttttaaatgttgcacgatgttccaccaggtatgtcggaattgtttcactaagtagatcgaaaatgtttcactcatttaaatcgggtgttgtttcaccttatataaaaataatgtttcagcaaatagcgaaagaatgtttcagttcactgtaacattagatctatacatagtgaaacattgtgagtacactaggttttttagtgaaataaaaaaataaactaaatttccttaatagggggtttccaaaatatgtgggttttttttgttgcaatggaatgtttcgttcactgtaacattaaatctatacatagtgaaacattatgaccacactaagtgaaatatttttgctggaaaaaaaaaccaaatacccttaacagagtttctaaaatatgtattgtggttaatttgttgcatgtggggacaagcactgtgatgggtccagcggcatgcaggggcaggggcgggggagccgcccgatttttgctcccccgcctggccgaccgattcgtatcattatccgattaaaaggtgccctaacgaaacccaatgaaaaatctgtcttaccttaaaaaggaacgggaccttaaataggttattttttttaataaactcatccttaccacagttacttttagttttatagctttaggaacacagctcccagtttcttttctttctgaatcacacatatctaccactccagagcaactcgtttttagtggtaaataggatgcataattcataccagttaagaacacagcactattagaacacaacttattcatacacagaatagtagcacatacatatttttccatgatcatagccacagttcatactaagattttatctatttggcccatttcatggaaggttcagacctgcagagttcttcagaggaatatactgaagttcatgctcagaagaactgggcattcactcatccttgatgtcatcagagcgcagcgacgttggatacaagagcttctttccaccagcctcagccatcttcttgctcggcgcatcagcttggctaccaccatggcggtgcatgtacaggaggcggtagcagaactcgacgacctccggtgcgaataccctccacaggtacattgtgctgaaccatggtggcacggtgagacaacgcttcccttgccgaaccgcttgtaccatggcttttgcgcaattcttcgcgtactccacgggaaataaaccaatttgagcctgaaaatatatatatattgtaaaatatttcattccagctgaactaagggtgtgtttgaggagaaggggattggggagattggaaagatacgcaaaacgaggtgagccattagcacatgattaattgaatattaactattttaaacttcaaaaatggattaatatgattttttaaagcaactttcctatagaatttttttgtaaaaaacgcaccgtttagcagtttggtaagcgtgcgcacggaaaacgagatgcttttctctctcaatcccccagattgcccaggaacgaatgaagcctaagtttagatttctttgtatgcccccttatagtctagaactttgtatgaaaaaatgttcaaagcagtggtactgaagtctgaatcttatgttgtgatcaaggagcctagtgtgatttcagaaggacttgtgaaattgacaagtgggtgttcttacatctcgcatttcttgatcgacctccatttcaccatgatccttgagaaatttcccttttgacatctcagactcgatccacccaggtgttacaattgtgattccaacttggctaccaagctctgtccgcagcgtctcgtagaagtttatcagtgcagcattggcagcctaagcagaggagcaaaagacaaacatcagtctcaatactgtcacatatgcattttcactaagactgcaggacattaatttacattgtagaaggtcattcttggaacaggattccatccggttgccgacgcagtaacaacgattcttcctcggctccttttcagatgagggagagcttcaaaagttgactgaactgaaccccagaagttcacatcctgaaaatgaagtagttcataccagtggttaatttacggatcttgaataaactacacactgaactgataagaactcatcaagaattatgttgctcttacaaattgagagctgtagttagtaacatctggaatctcctgaaacgcgccaacacttgcgatgccagcgttgcacacaagatggtccactgaaaaacaagtgtaaagctcaatgaagtactgaaatgatacttttgctgaagaaatttactgaacaaatcagtgatattggagacttgcatcgcccgtagtgatcgattgcggtctgaacaaatcttttgcagtcttcaggattcgcaacgtcgcccggaagaatgatcacatcaggtgctccaagctcgaacgcttgatcggcaactttacgcaggctccattctcttcttgcaacaaggaccaatgatgcccggttcagagcatagttgtatgctaattgctgcaaaaatcatcacgtgacatacgcaaataaatcttcatctcggcatacagaaataaacagagaattacaacaacctaaagttgaactatgcacaaacatatggtggtactatatatccttcgaacttttacaaattgtacgcaacgcgcctaatttgggatcttcaaagtaacaacatgctcaaactattttactctgaaactgtcagacagttatcatagttttggaaaaaaataatagaacaaagatgcgatactacaaagcaggcacacgaacacaatggcaaaacatgaccaaacacacaaaaatcagagcaattaattcaaagaaaaacagtcagcctgcaaaaagctgatacacagagcagagcccgtggccgtcagtcgcctcacgtcgccgatgcaggagaaggggccggtgatgagcacgaccttgcgggcgaagtcntcngngaaaggtangagggaaagagtggacngtcttgaaaggtagtagggcgggtagaagagcagcagcctgtccaccatggccggcgtcgtcacccagttgagcacgccgttcaccaaatgcaccatcgtcgccttcttccttgcttccttccttgctcctctgcaacctcgaccgatcttctcttcgatcgttttcagcttcagacacgtatcagagcagagcagggtcgcaagaacacaagtttggcagagagagagcaaagatttgcattgccgctctagtattttgcatggataggaggttgctcggcttggggacacgtaggggtggtgcgtgctgagacgtggagggcagcgggagcgctttggttggcttgctccacgcatgaagccggcttaatttgtcctcatcctttgcatctgaggccctgtatagattccacctaaaatttttcgccatatcacatcgaacgtttaaatacctatataaaatattaaatatagatttaaaaaataactaattatataggtttagactaatttgcgagacgaatcttttaaagtctaattgctccatgattttaatgtgacacgctaaaactttacactatgatctaaacaccccctgaacttgtaaattacaacctccgtcccaaaatatagcaacctaggagggaatgtgacccttctaagttgatgtatgtggactgtcattccttcctaggttgctatattttgggacggagggagtaggcgtaagcgaagagagagaacgtatatgttggcagatctcacactcacggcttgtttggcaacttgagggaagaggattgggagtttacacgagggaattgacggtgagattaagatgggaatttgatttttcatcccagtctcttgtttggtagaggtgatagaaattgatagggagtttagttggagattagatcattaaagaaaacggatggctgagatttgtttacgcgaagtaaaggaggaattccctcccaattacctgcccctacccagatattgaaaaggagggagttcattcctcaattccccatcctcatcccaccaaaattcctatgtcccccatctaaacaaaacagttaatagccacatccctctagactctaaatccctcctaaaaactccgtccaacaaacagaccgtcagctcacttattactgactaccttcgccggttgggccctctgcacagggccggctcatctacctgggccgatttgctgtctcgaccggtcatgcaatgggtccaataacatttcagcgtacaaaatgtaaaagggtgagcttaatttctatatatttttagtcaaaagtgtttaaggattataagaagtatttttgaaaaaaaaaactcatgggccttaacccattatcatccctagccataccctgccccagcagtcgcatgggctgcttggcaggagggctgcttgctagtgcatatgcgctgtgacagcaagtagtgcagcccacatgaaaccattactgacgtgcacaactgcatcacgacagcgcgtcacccctgacactaagcatcacgtttgatttgagagttttttttcgatgcgtctctatcgtggtgaaacctttcaactccgattacagaactttcgattcaattctgcaactttgaatttagaaatctcaaaacatcaaaccaaaagttacaaaaaaaaaattggattcataatctaaaactttgtactcatgttctgaaattttcaattcgaattgtaaaactttgaatccaaaatataagacttttaactgatagactaaaactttctacgtatacactaaaaatttcaacttgaatcacacaactttcgattcaaaatctaaaactttctgctaagaattccgaaacttcataccaaaatccctaaacttccatatcatagtatccaaaaactttaactcaaaaattcaaaacttcccacacaaataggtacaagttttctagatttgaatttgtcaataagaagccgataactcaccgatgtctcactagggcggaggaagagcagcagttggagcagcattcgacagaggtggaggaaaagatgatcccaacctcgctgggttcttgtcgaaggagaaggaagaagcatcgtcagctagagaaacggataaaagtgagaggatgttaatgggccttatgggtctagtgttcgctactttgctaactagcacgtgtgcgcgaatttgcattccaagcctcggcgcacctcttcgactctcgcgtgcgtacaaatgtacaaatgctgagtttgtgaacacgaactatttggtgattagcaacttagccttgcatgagttcagttacgtacggctccaaattcccatgacatggcaaacgaaaacaaatgccatatcaatgtatctcgcacaataacttacttttcttactacggattgaagtctgattattttgacttatagcagttgcattgattttctttaatgaggttattaataaattacgttctttttttagataatggaaatggattacatcttctaacttctgtcataagacaaacaaccatacgtttaatagtaataaaaaggtaagataaaagtaaatcaaaatgagaaataaggtgatgggacaaatccccaactcccctaaaattacggtctactagcagaatttgatgtggataccatgcgttatctttaactactttaaatttaaaatcaaagccatcttcattcctcccttcaacaaaaaaaaaaaaccgctagctccatcaaaaaccacccatctttaattaaaaaaaacaactccaaaatagaaaaagaaatcctacccattataaatcggcataaaaagaaagtaagttatatttgcaataatatcaaaagatatggcaaattggcccactaagaacctatttgatatggctctagctctagctctttctcttctggagttagagctcaaccaacactactacagaaaccaacactactacagaaacataaatagatatataccggttgagaatcccacataaactggcaccatgcatgaggcacacatgaggaggaatcaaaggtgccggtttaagaaccgtcacctttgaggtttcactaatccgatgccttgcgccaagaactgaatcccagaaacaacagtatgagatttcaacaatataaaaaacatcccgaacaagccacaaccgaatcttaaaatcaaccatacccccaccccagggaagaaatcaagaactcaggaggggagaaggcacagtgccagtggtgtcggcgtgggaagctaatggagaggttgtgtagccatcgctcgcgaatgaggatgcccgccgccgttggatccacccaaaggagggcatccgccaccgctggatccgcacgcgagtcaatgctgccaagagagaatcagtcgagagggagggccagggaaggagaagggtcgagggcgcccgccgtcatcattggatccacgtgcgcgagccttcatcaccaccgtgtctgcacgcgtggaccctcagccgcgcgtcactaagggtcgagtccaccgtaaaaggaagtgcagctggcaggagtgctctcataaaatgaaccataaaggtggatgtgggtttaggctgttccacaactttactccagacccaactcttgaagttaaatttaggagttagaaccctaccgaacgggccctaagcttaatatgttggcccatcaaatatcataaggctaatgaaaatggttagaccaaaaccatgataaagtatatcagtaacatagccaacattgtcctctatgtctacgcaagagccacgtttttatcttgcctcccacccatcacgtgcacgaaatactagatttcaggtgaatcaccttcaacctagcaccccgctttggaggcagtcaagagagaggcaggataggcagcttcccaacgatgacggcgtcatttccagcgatggcaagctcctcctcttctctagtgacagtgacacatccagctccaatagagaacatacggattgaggcttggggtttagatcagggtaggaggtggtacttggtacaagagaagaaggaggtttttctggcacatagaggaatgaccattggtggcggtgtgaacgaggcagcgcagcattgtagctgtgggacgggaagctggcgatgggcaaggttaggggcaacaataatggttaaagatacagtggtggtggaagcagatggcacaagctgccagagatgaggaaggaccagcggggataggagcttgatgttgccggacttgaagaagaaaaatgttgtaggacggaggaagatagaggagtacaggcttatgtaggtgttgtgtgagtaatgggaggagggaagaatatataatgttgattactgtagcacataagtcttgagcaatctaagccatccaaacttccctgatctttcttatttttaattttaggaactaacaattagacagccccatcgcatgcacatgatcgaccactccatgtccctgaaaaacggcccaaaacccttgtccttcatcgggaaaacaatacaattgataacaatagtgcacatactataatgtatctgttgacataaaattctaccttctatctttcgaataatggaccgttagatatactttaagattcatgtagaaccctctttacctagggtaaaagcggttctgcatgaatcttaaagtatatctaacgttcctctcgcgcattccgcccttccgcccgcctcgacgtctaaccagaaggtgtcaacgaagccagcgagccccctaccccctggccggcccttgctcccctcccccctcatagacgcaccgccgtcttccctgtctctgacaacagggcaccaccactaaccacctcctcctaacagcccttctgctttgcccccgccgcctacaacagcccaccgccagcttccgatcctacagctttggcgttgtcgtcgccgtctctccgcccatccgattcgctgcccactgctgcgctgccaccttccatggccatccctctaaagctagagaactctcccgtcttctccctcccccaccccacccctcccatcctcaccttaattatcctgcgaccctaacccgtagggtcctctgctggagtctagggtctcgccggcgtcaaagaagaataggaggtcgctgaaattggagaaggcttggagcacgaatctcgaagttcatccagtggcccaaaatctgtaagattggaagatagattttctattgacaaaaggatagcaattccgtactacttccttcgtttctaaatatttaacaccgttgactttgtagcacatgtttgaccgttcgttttattaaaaacttttgtgaaatatgtacaactatatgtttacgtgtaaatatatttaacaataaatcaaatgataggaaaataattaataattacttaaattttttaatataagccgaacggtcaaacatatttaaaaatgtcaacggcgccaaatatttagaaacggagggagtataattgagcacacgcatgttaatttggtgttgcttgcgagttgcgacttccggtaatcccacgtttctcacaaaatcatggagatatcgaaggaacccaactggaaacaccaatctcgtacggcaggaacacaccgttaggcccatcacggaactcgctgaagtcctcgccgagcgcacggaccgccatcgtccgccggtccagcaagcagagcgtccccctgagccggagcaccacggcgccgctcgcctcgccggaccacacgaacacctcgtccgactccggcaccggcagcggcggggagcatggactccggtgcactcccgtcgtcgtcaagtcgacgaccctcgtgcacgacaccgacaagagacgcggggccgacctggcgctggcgccgcagccgccgccgaagttcatcgcccagatctccacctgcgtcctccggccgacgagcagcgccaacgacttcctgtcgccgccgccgcacgacgacggcggcaccagcaggagctgccccggcgagacgtctgcctcgcccgtgcacgacgatagcagccggagttcggtcggcaaccgcgtgatcgtcgccggagatgttgcactcccgatctcggtttcgccggagacgtcgacgcagaggatgaagtagtcgtagggcaactggcggcgctggtattggaggtcgaagacaagcgatgggtggccgccgaggaagtaggcgacgccgtcgacgacggcgggcgtgcggatcagcaaggcgcgcgggctgccgtactcgccgccgccggcgatctcgacagggatcgcggtggttgggccccacgagccagcgtccggggataaggcctccatctctacgtgaatccgccgccgctcgcgccccgtcccggtcaggtgaaggctcacggagagaagccggtacgggtggagctcggaggtgactccggcgtcgtcgccggtgagcaggaggtaggacccggacgaccacggcctcggcatgtcgatgcagcgcacgtagcccgtcatagggttgcacactttgccggaggagtcgccggtccggaggacgacgaagccaccgcgcgccgccacgggttcgatgcgccaatggatagaaccatacacgtggtcggagctggacacgaaggaccgtatctgatcggcgccaccgccgccgccgacgatggcatggccagccgcgacgaaacgtagcggctggtagtcggggtcgggggaggggcggcgagtctgaagaaaaaaaccgcggaggaggccagggacgaacccgtcggcgttgcgaaggcggaggttgcgggaaaagccggcggcgccgcagatgacgcggcggaggtgcctgcacgcggcggcgcagcggaggagcgtgatggggtcggagcgctcggcgatctccacgaccatgtcgagcggcagagccggcgatgacaacgaggacggcggctcctccatctcgatctgatgatctctgtctatcggcggatgcacgtaagatgaatagtactctatgatatgtagtaacgggccggtgtaactttattcatatcatatgtaacgctggctaaagaaaaaaaaacacagacatcagagaccgaatcaaataagaaaataagagctagatttaaatataccgtgatcggttgtaagaaactaagaattctatttggattgcccccgagccccaccagctgcaaataaaaaggtgaaaaggcgtcgagaagaggtgacgaaccagtagcaaaaccagacatcggcttcaattgcttcatctcaggtcagagaattaattttcgtaatttaatgtgattgtttataggctaaagcaatatggtcttgaattagaacttcaatattgtggtatcatagcttaactttagcctactcaattacttattcacatcatcctagtgattagaagcagtcggagccatcttgattcgacatgaacaattttgaattaaataagtttaatataatctagtttaatctaatctatttagattcttatctttactgcttagtgaagattttctcttgttcaagttcaatttaagttaataagattgagtttgagttcattatgcacttctatgtttagacttattttaagtttcaagttttacgtccaattaaccttcacttagcagtggaattaagaaattgaagggaaggaaataatgagatcaatcggtttcaattttgccgaaatccccaaattgaatagaaccctgagctgcaaaatccaaatcaaatccaaatctatatctatatttatatctatatctatatacctatatatatacctaattaaaaaatatgtaatgattccagtatttttttgtccgtcactttttttgcgtttttttcttttttttttggctattttcgccctttttttctttttttccattcctcctcatttttccgttttctttcctttgaatcaaaatctaagcgaatctataaaactcgggatacaaacattgacttttaaatagagattagattccataaattaaagcagaattgaaaggaaaaaaacattgagaaaaatgatggagtagtagtggagaatcgatttttcaatcaattggaggacggaacgcattaggcatgtgtttggttgggaggatatcccgggatgggatgggatcatcccatttttatggctgtttggttgagggactaggagggataggatggttccaaaagagaatattccttcaatattcgggacaaccccatccggaaaaaagtggcggaagaaacgatcccacctcgcacctgtgacttgcgacacgcgggcggt

SEQ ID NO: 16848 - DNA, 2278 bp, Oryza sativa
ggcgcgcgagcagtacacggcggcgctggacctcatcaccttcaattcgaagtgttcgtagccaccaactgcagatcggggttcccaatctccacggtaaaaagaccctaaaccttggatgaggatttcgttttcagatctgtgcatatctgtttttgttgaagaatgtgtgaaatccctttatcaattgcttgacagtagatgttgtccatgtgtttttttttgttgtattgtagatggacaagaggaccaagcttttagtttgtattgcagctacaaatttattgttgtcgatgatggccatgattattaggtctagaaaaagaaagaggtgttcaaggagagaaggtattagatatggcccaatggttgaaagggatagaaaaagaattgagtacctagaaacgaatatttggtggaacgatacaacttgtatcaacatgcttagacttagaagggcaagtttctttcgtttttgtaagctttttagggatcgtggtttacttgaagataccattcacatgtgtattgaggaacaagtggctatgtttttgcatacagtggggcataaccttagaaatagattagttcgtactaattttgataggtctggagaaacagttagccgttatttcaacaaagtccttcatgcaatcggtgagctacgagatgaactaatcaggcccccctcattggacactccaactaaaatagcaggaaaccctagatgggatccttactttaaggtctgagattcatccctatctaaatttatctttatgtgaacattgatatatggtccctaatttttaatgttgttgaacacaaaataggattgtattggagctattgatggcacacatattagagcctcggttcgtaagaatgtggagtcttcttttcgtggtaggaagtcccatgccactcaaaatgtaatggcagccgtagattttgatcttcggtttacttatgtcttggctggttgggaggggacagcacatgatgctgtagttttaagagatgctttggaacgtgaaaatggcctccgtgtcccacaaggtaatagattacaaggtaatagtttatcaaattatccatgacaaatgttgatatttaggaatgtgaccaacttgtcgatcatataataggcaaatactatctagttgatgctggatatggagccaaacaaggattcttgcctccttttcgtgctgttcggtaccatctaaatgaatgggggaataatccggtacaaaatgagaaggagttgttcaaccttagacactcatccctccgtgtgacggttgaacgtgcatttgggtcactaaagaggaggttcaaagtgcttgatgatgccactccattcttcccatttcgaactcaagtagatattgttgtagcttgttgtattattcataattgggtcgtaaatgacggaattgatgagcttatagctccgcctgattggtcaagtgaggacattgatgaatcgttaaccggccaagcaaatgaccatgcattgatggttcagttcaggcagggcttagctgatcagatgtgggctgaccgtaatagccatcatggaatgtaatatgtagctgggctacttgtatttctaccttatttacaatatttcattagtcaatgaacatttttatgtatttcatttgtatggacagcttgttgtagtccatttgctaaattgcatttgtatggataaatctattgttgtatgctgaattatggtttgatgaatgctgagttggttgacatattgttgaatggtcatttcattggttgatagttgaatgctgaatttttttgggttgatttattgctgaatggtgaatttctgggttaacatattgctgaatggacaatttctgtttactatattgctgaatggacaatttctgtttactatattggtgaatggtcaatttctgtttactatattgctgaatggacactttctaggtttacatattgctaaatggatattttctggttcatttgacagcaggtagaaaatggacaacaatagtggcaagggaggaagcacccatgcttcatggacctcagctatgtcatctttcatgctcaaacaccttgccaatcttgtggccggaggcacaaggacctcatctggcttcaaggcagtgcatctcaatgcatgtgctagggctgtgaatgaaaggtttaacagcactctcacgggtgagcaaattaagaatcatttgaagacatggcaaagaaagtttacaaagataaataggct

SEQ ID NO: 16849 - DNA, 17729 bp, Oryza sativa
cattaatgagaagttttctggatcaatgtagcgttgttagatgagttgggtagttcttttggtattatgtgttgccggtgggcccatgatcatgtatgactttgtactgccaatatgtttaaggccgagaattcttaggtgcaagacttaaatttgctattatgtgtaagaccttaatttgctattatgtgcacgacttgaaacttcttattatgtttggcttggactctatgtatgggttgaaatgggatcagatgtgagctaattatgtgtgattgttttttgaggggttgattatggaactgctagtattgttcattattgggtagcttgtcattattctgtagcttgtccaatatgctgaaatgaagttgctggagcttattttcaaaaatagtgatatggagggtattttaattttttatatagtgtggtcatcatgtagaaatattattttgtagtttgtagactatgagaggtaacctcaccaactaatgtgtggaggtaattgtatccaagcatcccatgttcatccctccatccaaacaaaagataggatcattccaacccatcatatccctcaaaccaaactaaaaacagggttcgttctatcccttcaaccaaacaaaaaaacagaaccatcccattccaaaaaacagggatggaaccaacccatcccatcccatccccaaaccaaacacatgctaggaggctgatctaacgtgacggccaaaaaagaaaaaaggatagaaaaaggaccaacgaaaaaaaagggtttgaagggtttgaaggcagtcagctagctatacgagttgagcctatagctccccttgtgggctatgtcaaagagaggtaggtcaagcacagaaataacgtactaggctgggatcgaaaatgaagaataaatgagtttttctattcgatctcctaaatttggttgagggtttttatacacttgatctactatttccctttttatcaaaatctgagcaaattggtaaaactcggaatataaacagtgacttttaaatagatattagatcccataaattaaagcggaaaaatgaaaagaaaaatcatgggaaaaatgatagagtagtagtggggaatcgattttttaatgaggagggaacgcattagaggcagatcaaatgtgatgggaaaaaaatacggagagaaaaaagactgaccaaaaaaaggaacaatgacaacaaaaaaagacactcttccggtgtttgaagattgaagacgtcaatcaactagctatgcgagttgagcctatatctccccttgtgggctatgtgaaagaaagctaggtcaagtaaaagagataaggcactgggctgggttttgacccaaaaccaaggagtataatgaagtgtataatgtatagcgatccaaataggaataagttcaccggtggtccctcaacataatagcgagattttttaagatccctcaaccacaaaaccagaaatgttcgctactaaactcattcaaaccgttcactggaggtcccttggcagtatttttgccctgttttgctgacgtggcatcctagttagcaaaaaaaataaaaaaattaagtggggcccacatgtcagcttcacatatctttttttctccttctcttcacttttcttcttctcctcttcacttttctcttcaccggcggagcggcggtgggcgagcgcggcagtggagcggcggctagtggtgggcgagcacgacgacgggcagagcggacggcgaacgagcacggagccacagcccacaggtcacgagaggttcggatgccggcggcgccggccagcgacgcaagagaaggggaggttgttgtcgacggcgggaggtggccggaggaggaggtattgctatgttatccattgttgaagacagcagtgggctatgctagttgggcctacaactttacctgtgggctagatcaaagagagacaggccaagcaaagagaggtagcgggctggcctaggactgaaatggaacgaataaatgagcttttggtccaaaacaaatagtataatgcatacgatccaaaaacgtttttacccgttgcaacgcacgggcattttctctagtccaaatcaaattaagaaaactaagctcgagttcagattcttaccggatttgaagccctaattctaccgggaaaccccactgctaggaagcgacaccaccgcacctttacctccacaaaggtcgcgttggtcaccctgtgcgcgcgccgtcttggagttcctccaccgtcccatgcgtgcgagttggcttggcaccccctcccccgcccccaccccccgccgacgaagcccggccgctctcggtgcccgtcaccgcttgcacgcccgcttcgtcggaccgccgacgctgtggcttggcttggcgccgcccttaggtgtgcctctcagccggtgaagccggagccgctcgctgccgcgtgcctattccttgacggagttattactcttttatggccttacccttaaatattactctttatcgtcattgtaattctaaaatatcgatcctaatagtcattagtattatgttttatagtttgtagatatcccatcagccgtcgacataatgcttctttatggcccactcactgcacccctctattgtcatttgccacccctttgcttgctctatcacgccgccattttctttcgtgattaaagttcaattaataaattatttctagaaattttattaaaatttcaagcaatttatgaagtgaatcaatgtgggaaatagaatttcctttaaaaatcatggttacgaatttttttttcaaaattttccacgccctacagaacaccacaaacatcatttcaggaattaacttgattaaacttattttgttttcgtaaaaggaagtagactcaccacatactctcaccgtcccaaaataaacgtaacaatgagttttcatgcccaactttgttcatcttgtttcgtccatcttatttaaaattttttatgattagtatttttactgttattagattataaaatatgaataatactttatccgtaacaaaagattaaagttgggcacatgaaacaaatggttgcgcttattttgggcgcttatgtactagcaccaaccaacggtacaggtgcgcagatggtgacttcaagttcccccacgaaactaatcatggagaaatcgagggaacccaactggacaaaccgacctcatacggcagcaacacatggcgacgcccagagcgaaactcgacgaactcctcgccgagcgcgcggaccacaatggcgcgccgccgccggtccagcaggcagaccgtccccccgagccggagcaccacggcgccgctcgcgtcgccggaccacaggagcgccacctccgactccgacaccggcggcgagcagggactccggggtactcccatcaagtcgacgaccttggtgcacgccatccggagcaaggccatcccgtggcaggtcagcttcatcgtccatatctccacctgggtgcttcggccgacgagcagcgccaacgacgacgacctcctgtcgccgccgcgccacgacgacggcgccagcaggagctgccccggcgtgacggttgcctcgccggtgcacgacggggcacggagttcggtggtgggcaacggcatgatcgtcgccgccgctgttgttcccccggtctcgccgtcgcggcggcggatggagacgtcgacggcgaggacgaagtaggtgtaggacggcggcggcgagtgctggtatggtgggtcgaagctcacccgggacatccggcgttggagttggtatgtccggtcgtctctcccggacatctcgccgaggaagtaggcgacgccggcgacgacgacgggcgggcggaccagcacggggcgcgggccgaggcagccggtattgacgacggcgagcgtggtggctgggccccacgtgccagtgtccgtggtcaacgcctgcatctccacgcgtgtcctcgcgaaaaggcgcacggcgaggagcctgaacgggtggagctcggagtcgtcggaggtcactccgacgtcgacgccatcgccgccgtcgtcggcggtgagcactaggtaggacgacccctcacccttgcttgtcttcctcggcatgtcgatggcccgcacgtagcccgtcatagggttgcacaccttcccggaaaactcgccggtccggaggacgacgaagccgccgcgcgccgccacgggttcgatgcgccgacaaggattattctcgtcggagtccgacacgaaggacggtatctgacagttgtctccgctggcgatgtgatcgtggcggccggcggcgacgaagcggaggggctcgtagttgtagccgtggtcatgggggctggggcagcgaggctggaagaagaagccatggaggaggcccgggacgaagccgtccgcgttgcggaggcggaggtcgcggcggaagccctcgccggagatgacgcggcggaggtgcttgcatgcggcggcgcatcggagtagcgtgatggggtcggagcgctccgcgatctccacgacgatgtcgagcggcagagccggcgacgacgacgaggacggcggctcctccatatcgatctgatctatctcggctgatgagtccgacgttaattaccaataaggttttggtcgtacctcgtaactactaagtccaataccgaaactatcgacaaaagcgaaataaaacggatcgaaaaataacctgtgcgctacaagatgtatgaatgtatgtgggacgcgactccggctctagcgcacacgcccgatgggaggaggttaaaaaatggtgtacgatttacgtacaaaattactttaaactgatttttctcttaaattacttatccaaatcataacccgattgcaccattaaattcgtttgcaattaaatcatcaaaacaagaccacatatggatatattccgacgaaaaaaatttagcctattattaaattatttttaaatgttgcatgatgtttcaccaggtatatcggaattgtttcactaagtagatcgaaaatgttttactcgtttaaatcggatgttgttttaccttatataaaaataatgtttctgtaaatagcaaaagaatgtttcagtttactgcaacatttggttcatacatagtgaaacattataagtacactaggtgaaacattttttggtggaacagagaaaatgaaacgaattcccttaatagaaggtatccaaaatatgtgggttttttattgcaatggaatatttcagttcactgcaacattagaactatacatagtgaaacattgcgagtacactgggtgaaatatttttggtggaacaaaaaataaaccaaattaccttaatagagagtttccaaaatgtgggtgatttgttgcaaaagaatattttaattcactgtaatattagatctatatatagtgaaacattataattacactaggtaaaacatcttttgtgtaacatggggagggacaagtgggtgggtccagtggaggtgcgcacatgcactaccagggaatggaagtctaccgtgtgcctaaacaactcggtaacagggctaaaactcacggtaaggtcgttcctgtgagcaaactctcgggaaggtgtactcggcagcctttcacctttaccgtgtcactcttcccgtgagaaactgcttgcgaacttaggatgtgctgaaagcttaccgtgtgaaaacaccctgccggtaactttccagttaacgacacgtcatgcatggaacggagtgaaacggggtggttggaactcacgggaagaaatccataaaacacaggaacatgaaacaccttaccgagagtttttagtgacccgggaaggttgaaatttttcccgtgagatttagcacatggtgacatttgagatgaatacacggtaagattatgtagctcattgtacagggtttcacacattcacgattgtactgcactgatacagtaggcaagcaactaacatgtatgcatatacatatcatccaaacatgacagacaagcatcacatatggaaccacacaaatgtcaggtgaacattaactgtatattatcccagtatgaatttttgaatacaatgatacaagaacacaatataaatggctgtctgaagtggctataatgcaatagtaacaaggtgagtctgagttcttacaacctctcccagggaggcaatagagaaatgttagaggctagtgagtaaccaactccaaatttgtgtattgacagcaccaatcaactgcaatcctttgcaatgatccaattgtatgcctgaaattttacgaaagtaagatgactgccaaatattattacagcacgcaactagtttatgaaaggttaattcttgtgcatagttgacaaaggaaatattcatttggggaggcacaggatataaaaaattggcattatagtctccatcaaaaaaatgaaccatgtaccttagaaatactcgtcaaataagatatccctactagtgggaacctcatcatcttcagcagatgaggaagtgcaataagattcatcatcctcgtcatcatcatcttcatcttgaatagatgatccattgagaagcttcaagtccttgtcattgcaaatatcttcagtatccctgctaatggcaacttgctcaggatcattgttgagttcttgaccaagatcaattacaaaactgccggacagaccatcttcttggaaatagtggacaacattgctattaggaacaaaattgtaatcttgatcattgggtacttgtagtctaccaattggctgcaccttatacacaacccaccaattagtgaggtcttgcacagatttacatgggtacggcatgtaatacacctgtgtcgcttgatgagacaaaacaaatggttcgaattttggaaggattgacgcatgagcaacctcaaccagaccatatcttggtgtatacctcactttgcttgggtcaaaccaatggcaattgaagagcacaagtgtgagaggttttctgccatcaaagctaatttctactatttctttgatgtaaccataatactcagttgtgtcactattttctccctgtcctatagtcaccaaaccactatttattgtagttgcatttggcctctcatgttcatatttgtgtattcggaatcgatacccattcacatcatacatattatatagcaagactcgagtgtggcatcctttagctacttgcctcaaatcatcactcatagtttcatctaacatactctagcagtgaaatgaaaggaaataatgtgtcaataaattgtggcataatgttctattatggcaatattgaaggttatgttatagaaaaacataagtattattaggttattgacacaaatgcaattaagaggcgttaaactgcaaactaatgaaaacagaaagaaaatggaagaaggcactattaattattgaggtcttgaatttcaaaactgaagttatcaagttattaattggctaggttctttttgttagtagaaattggcaaggattttattctttccagatttccgacctaacagatgatcaattgagaagtgtctccatattaatgacatgtacatacatgttcagtactattttcataatgcttgtaaaaaaattaactcagattgtagtatgaaaaagccatatgcatactaggaacttgcactaatccaaatgtgctttactattgtaggaccaaatttatagcactgatataagaagtcaccaaatttagagttttagcagtaatactttattggtttgatggggattacctaggttagttgcaggaacattcatgaaagaacttaatgttcaacagttaggaaagtatgtatacacatgcaagatattacatcgaagtaagctagctagatttcctaatctgatctgaaaggatatgcattgctacgcgtataatataagtaaagtctgggctaaagaaattacttgttgatagaaccaagatacgaaattaggacgatctctcccagcaccattccgtaagatattctcttgttgttgccttgttgggacacctcgtctagtccattcctcatctatgaatttcctgcaagataaaaatgcacacactgatttaaagtaaaattatatgcagctatgaactagaagtaactcatatcaatttcatagttaatacccaatgtagtcatccacttcagtaaggtttgtaagcacatacaacatggcagcattccactcttcacgagttaggtgtcgagggactccacgactagtagaatccccctaatagagaatagacttagggaacaatcagtagactgagtagcaacattgtatcgaggaacaggattgtgaattgtctgcacttgatcaggaaagtatatggatgtgaagtttgagatttcatctagtatgtaaacctctgctatggaagcttcaacacgtgctcggtttctaaccttgctcttaagatacttttggcctctttcaacggggtaattccatctaaattgcacaggtccacccatgctagcttcatatggtaagtgaatcattaagtgttgcattggattaaaaaatccaggtggaaagatcttttctaatttgcaaaccaaaacaattacttgagactgcatgtttgccatctctataggatcaaactgttttgcgcaaagtttgcgataaaagaagctcacctctgctagcacttcccacacatgagttggcaagtatccacggaacatgactggaaagatacgttccatcattatgtggtaatcatggctttttaacccattgatccgcatggttttcaaattcactcctctccttaggttcgacccatagccatcagggaatttcaatgtttgaaaccattctaatacttccttcttctgagctctattcaagcaaaagtcagctcttggctttacccactgactagatgcatgtttttggatgaggttcaattcaggtctattacaaagtgctgcttgatcaaggcgagccttgatattgtccttcgtttggtctggaatgtcaaagcaagtattgaaaattgcctcagcgacattcttctcattgtgcatgacatcgatgttatgaggaagtactagtttgtgaaagtacgggagtctccacaaactagatatatgtgtccaatggtgatccttgccatagcctacaaacttatctccattagcagcagggacaaggttatctaaccgggcacggatctcttgacctgagagacgaagaggtggttcattgctaactgtagtgtttgatagaaaagaatttgaatcacttctaaaactatgatcaattgggaggaactggcgatgacaatcaaagaatgagtactttccaccaaacttcaacctttttccttggagtgcctccatacatgttgggcatggcatctttccatgcacacaccaaccggaaaatataccatatgctggaaggtcatggatagaataaagaaaggagactcgcatgatgaaattcgtcttggtggcacgatcatatgtcaacacaccttgctgccaagcatgtataagttcatcaactaagggttccatgaatacactaatgtgtttgccaggataatttggcccaggaattatcaaggtaaggaacatgttgtgctgccgcatgcaaacaccaggtggaaggtttagaggaatgacaaacataggccagcaagtgtacgaagaaaaacccataccaaatggacagaacccatctgttgctattgctattctaacattgcgggcttccattgaaaagcctgtgaagtctctatcaaatttcttccaagcctcaccatcagctgggtgtacaatcttgtcaggatggtaccgatgaccattcttgtgccatgtcatttgcttggcctgcgattcagacatgtatagccgctgaattcttgggatgaatggaagataacgaagtaccttcctggcaacagttaattgtttcttgtgaccattactgtcttcaacctccacatacctactctctccacacttatcacagtgcatcttctgcgcattctctttcctaaagagcatgcaatttttaaggcatgcatctatcttctcatatggcatgttcaatgcactaagaactttctttgcctcatacaagtttgctggtagtttgtgcccttgtgggaggagagcacatatcacatttaaaagtgcatcaaatccagcaattgatatagcatactgagacttgacagctagtagtcgtgtgatagcatcaagttgtgatacctgtgtgtgttcgtggagaggttgagttgctgcagacagcatttgaaagaaagcttgcgctgtaggctccggatcttcctcctcaactgagacataagcatcatggacatcatctatcatctcatccatccgatcaatctctgccaccctatcttcatcttcagtgctttggcatatatcgctttcacgtgcaggatatgtatcaccatgatacacccacacagtatatgctggcctgaaaccaaatttgcaaaggtgtttcatcatcatatctcttgtttgaggacgtgtgttgttgcagtagttacaaggacacaacacaccagcacgtcctgtctccctgttgaatgccttgtcaagaaattctgtagtcttcgatatccactcagcagtaacttcgccacactttcgacggcccttgtacatccaactgcgatcagtttccattgtacctagttatgacaaagtgatagaataaattgatgttaggaaatgtccttctattcatgaaaggttcaagaataataaaggcctagtttagtttgtatgattaagaaataaaatatcaaccattagttcggatcatcaatcacccaaactttcacatggcataacaacctagttctgcaatcccttagtacaaccgcaacctgactagtaaattctagaactggtcactaataaaaaagatgatgaaacatgaaggccgaatgaggattccaggagcaagacaacaacacctgagacgaatcagtcctagggagggttgctggacgagcagccaatcctcttccgtgcgtggcgactggtggcgtcggcacggcggtgcacgtgcgggctggggtctcgtactcgaccgacaccagatggatgggcgcggggcgacgtcgtgggtttggatggggtgcgcggtggcggcggcctggactggctgcggcgcggtgatgtggccttgacgggacgcggcgcagcggcggcggcctggactggacgcggcgcggcggcggcggccttggacggcggcgcgatgtggtgggttgattgggatgagaggaggacagagagattggggattttggtgacttggccacacccaccagatttttggcgaccttgccgcgcgcctgcgagaattttgccgcgatttatttctgacatgtggaccacgagcgttactgtattgttttctaaccaaaacacacgataagattaggaatgcaaactaccctgttcgtccttttttctcaacaaatctgcaaactgaactatttacgtgtggattgcaaactgaaattttgtactaaatttcgtttggtcccaatacaatgtgaaatagctaaaaaaaaatactcactacgttttatattactcgacttgacttttttgttggtcaatttttttaaactagcaaaatgaacatgctttcatctaaattccatgattttcgcttccactcatattctaaagattgatgccgcgtgcccgctcgtcctctgcctacttggccttaaccaaggaagaagaagaggaacggacgtagtcgagcatgcgaacgtcgccattgtttcatgtcaaaaatgcctcgccgtcggccgccgacagccgactgccctccgcgcgcagtagccaccggcggcggaggtggtggagcagtcagtgaacaacatacggttcctcgccgtggacgcaagctatgccctcgccgcgcaccccgtctccctcgccgcggcatcccgtctccctcgccgtggcatcccgtccacctcgctgacgcccgtcccgtcctcgccttcaccacccggcgcaccgcaagtaccacgtcacgcaggacgacccgtgtgacgatgagaaaaatatgaggtgattaaaaaaagtagataagttttaaataagattataaaaaacatagcaacatttttttttacttaaaaccaacatattatcaaacaaatttgtttttgtagatgtagctaaatttttctacaaacttattcaacacctaaaaaattttgactacaaaatagtcaaagcgagatataatacgaatcggagggagtgcgtgttattaaaattagttaacaattcctttgattctgttatgatttgtagaatttttgaactaaattttgattgatccttgcattaagtgcctttgctaaacaaaaactatttcctttttaacttcgttaagaattaaactttggtttgctgtatataataagaatttatttcttcaattaatttaatcaaatttattcaaatttataattttgattaaaagtgttgttcagatgtctatctcagaatttatttgcgttcatttcaagaaaaaactttcgtttatctttaatttttcaacaagctatccaaatattcaaacctgtttttcttaggaaatgtttagctttatatcttaaaatgtttttaaacaatgaacatttctaactttcaactaaaaaagatatcagcttgttgtcatgctattgagattgggactcctatttaaaaaaatttcaaatggcattaatttgaaagcattcataatatataaacatcttttagtgataatttggttgacaatgaacaaaagacaatagtaccggaaagcactaaccgagcctagtttgttactaatttgtgcgacccttccataagttgccagatattcactccaaaatatgaaataatatcagtcatcagttttgttgaacgcgtgagttatatctggacagtggccactgccacaccacataagttccaagttgataagttccactgtatgccaacatttccaatcaaaagtaccaaacttccggttcacaaactccagagcacagcaacatctatgaccaaaagtacctaaggcaacatgcacaccgaaatagctactagagtccgaatatggactcaggttcatgcaagcccttaggaaagtaaacgtatataactaagaacaaaagactaaaggcaacagccacaaccaacagctactcaggttcatggccatgaccatctaggtcagtttaattacaaaacacatccacatgttccaggcatgtagaactagtccattctttccagcagtagcaaagtcataattatcttcagattgcgctcgctgcgtcaagctgaaccatctaaattgcaccagaaacaatagcagcccctccatggtcagcacagaatgggtttccattcagagccgaagatacagacaaagcctgttttatgttacaaacaaaatggttaatattagtcctcataagttatatggggaacaattacttcatgcacagctagactaccatgtatcaaatacttactgggttagtcaacatgacaggcaagggaggaggacctgaggctgaaggtaagtcaatgttcagcttaagttgtatagcctgcaatccatttcacatgtacactagttagtgcgaccatcacagaattcaagccctcaaataatgaaaacactactagatggatcctataaccacttactcttaaagcaacttcaaagaacgatgatttttgttcaaacgctatcttttccaactccctttccttgcgctctagctccctctcctttctatcttgctccttctctcgtgccctctcttcacactcacgctccttctcctgctcccactcctgccgctccctctccttctcacgctccctttcttcacgctctcgttctcttgcctcgcgctcctcttgtagttgccgctcaaggtcttcaatttggtttgtgttgtcaggatttgtccgcagtctcctgcgaggacgtggatcgttaagtgaactgtcaccaaagattgctgatgagtcaatgtgcccatcaccgatcatgaatcgaccatgtttctttccaccaccagccatgtgcacagccattggatcaatgggagaattgcgccaatcacttcctgctccatgcagctgaacataagcttcattataggcctcctacagtcagatcaaatggtgtattagtactcatgcacaaatgataaactaccactaaatattcagcacttacaagcttcccagttgcatgtgtgttacatctgaatcgtccatcctctccatattccccccttccttctgtgtaggcctccatttgagacactacccgctttttcttcttctccaaaaacagaacatgggtaccatatatattataccatgatctgctacatgtttcaacatagatgcacataccaaatttttttggaaacgactcaagttagcactgccttggcggtgagatggccatgtcattttctccctccgtatcctatgagcatgtgagctagcctgccattcaggattacaccacttcaatcgtatcaactcccgccacgcattttttgcctttaggaaccaccatggttctacctataggagaagcacagatttattaattactaatctgatcagtagatcacaacaaattatcaatgaacaaccatagcacctgtaggtactcttcctctgttagatatgtcctgcaagcaatatcccgagaagtttctacctttaaaatcttcctttggtaattgagcacggccaggatacgagtttcataaatcaggtccgaaaaaaggtgcttgatacaattgcggacaacctttctagcatcttgttccgttctctctgcccacctgaagtaaagctgcaactacagaaagttagcctgcttgacattgaaaagtgtggtattaagatactttagtattgtacagcacaaattggccataaactatgaaaactgaagacacaataaaatgcatagtgtacttcatatttggagaaggtaatgctctaaaacaaacccagaaatcttcctcaacacgatggagacggcttggcaagcgattcagtatagcgctttctggatcgtccggtgcaatcctgtaatgtttccaactccatgctggctcatctcttcctttaaaattgacaatgccagggaaaaaatgcttaataatcacggtcaggatgccagtggggaccctaatgttgcccccaaaatcattagcctgccattgcctgtgcaaatcaatgaacaaacagatcaagccttcatatttcaactaatgaaacataccaaaattagcctatttacctatctccttttggagtcagcacaggtttgtcctcatctcgggtaggtcgtggtggcatccgtgtgggaccacgaaaaaacatttcctcatctgtttcttcgccagccaatatctcatccaaattagaagaattatcaggttgttgggaacctgaggaccttgttctacatctcggcaagatagcagcgctgacagcctgatctgaaggattggaatcctccctgcagcccaagctcaatcgccgcatattgctacaaaattaagatatgcagtattatattaaacaggtcaaaaactacatagtagcaacatggtataataatgcctattataaaatgtcgatacaaagatgtagtacaccatagcattgcagatcatcacacaacatggtgctgtcattccaacccgattcaaccattcaacatcgatctaaacaagtagggccgtggcaaacactcatactaaccattatgttttctgaaaagagggcaagttttgcctaaccaatatgtatccatcaacaagtacacaaatatgaaaacacattattctgacagtgcaagaactctcacccacatcattttgtagtctaatattgtttttatttacaaagcacaacaacttattcatatggtacttgtggtattacaagaaattaaaatgagatacagttcctagaaatcatacaccgaactatttctagttcttgggagaaaatggatgggttttctagaaccaagacccaactttacatacgattcaagaaaaaactcaacatatacataccaccagctggatggaagatgaggtgtgctcaagctggacaacgaaggggagcctagcagatggacgtggacatgcagggagcacgtacggccaggaatgcacagcgttgctcggcggccgtgcggcggactgacgctggggcgcacagctatcctgccatgtgcgaagaagagaggggaaaaatcagaaaggggaaaagtggcgaggagaatgaggcggcagggggtggggaagtgaggggatcgattaaaagggctagggttttgttgttctctattttgggctgacatgtgggccttcggctgtaactcgcacgggattctcctgttactcgcgcggcaacgaaaatcaggcgcgccagccagccgcgccaacggaaatcttggcgcgccatccgcctgcgccaacggcgatcccgcgcgccagaccaaatattccgcgcgcttaacggcagaaactatgggtcccacacttaccgtgtttctcgattcgtcccacggcatttttagccgcttcccgagtttttccttgtacacacacggtatgctttaaacgttaccgtgttccatataacactctcggtaaccaactgaggtacacggtagtctcccactctctggtagtggtggggggaggggagcgatcgattttcctacctcccctagtcgaccgatcctaattgttcctcatgaatgtgatttgtgtgattatgtgtggatttgttgaatttgtacgcatgaatttgtgatctgttgatttttgagattctgaaattaattgtaataggaatttgagatcatgaaatttagtaattgtattttttagataattgtagtatctaatctcaagtatcactatcaatttatagaaatttacaatttttagccctaaaatgggcattagtacgattcttgaataggttgctagcctaatattaatgtccgataaaacaatagctgtgatatgatagggtttctgaactgctagtgttaatggttttttttggtagtgttgcacgggccatcgatgcatatgtgtgcatccgcttctatcatggtgtctcctacgtcactaacagcgtctttttgttattcctcctctgccaacccgttattatctctaccccaatcctgaaccctaatatacaatacgtgctgccactatcgccgccttcacttgagaagactcatgctttctagagtgatgacttatgaaatcaattaaaaaaatattttttttcatcggtttcacaggaatatactcgctcctccgtttcgaaatgtttgacaccgttgactttttagcagatgtttgaccgttcgtcttattcaaaaacttttgtgaaatatataaaattatatgcctacataaagatatatttaacaatgaatcaaatgatatgaaaagaattaataattacttaattttttaaataaaacgaacggttaaacatgtgctaagaagtcaatggcgtcaaacattgtgcacgccatccggagcaaggccatcccac

SEQ ID NO: 16850 - DNA, 7316 bp, Oryza sativa
agttggtatgtctggtcgtctctcccggacatctcgccgagaaagtagcgacccccggcgatgacgacgggtggcgggaccagcacggggtgcgggtgaaggtagtgatcggcatcgacgacggggagcgtggtgactgggccccacgtgccagtgtccggggttaactcctgcacctccacgcgcgtcctcgcaaaaaggcgcacggcgaggagcctgaaccggtggagctcggattcgtcggaggtcactccgacgtcgacgccgtcaccgccgtcgtcggcggtgatcagtaggtaggacgacccctcacccttcgccgtcttcctcggcatgtcgatgggccgcgtgtagcccgtcataggattgcacaccttcccggagaacttgccggtcctgaggacgacgaagccgccgcgcgccgccacgggttcgatgcgccgagaacgtttattcttgtggacgcggttggagtcggatacgaaggacggtatctgataggtgtctccgccgccgccgctgccgccgctggcgatgtcctccgccgccgaaagctgatcatggcggccggcggcgacgaagcggagcgggtcgtagttgtagccgtggtaatgggggctggggcagcgaggctggaagaagaagccatggaggaggcccgggacgaagccgtccgcgttgcggaggcggaggtcgcggcggaagccctcgccggagatgacgcggcggaggtgcttgcatgcggcggcgcagcggaggagcgtgatggggtcggagcgctccgcgatctccacgacgatgtccagcggcagagccggcgacgacaacgaggacggcggctcctccatctcgatctgatctctatcggctgatgactctgacgcacctcatgcacgtagctaggaagtccaaagcccaaacgagaaaccgaaactaattaaaaggttaattgaggcacttgggcgcccatttttttctgagataaatcaggtgcccacataatcatatgtcatcatgcttgcatatgccagcaaaaattcctaagcaaactttaaaactattttttcttaaattatttatccaaattatgatccgatggcaccattaatccatcgcaataaaatctttaaaacaagacaacacttggatataatccgataaaaaaatatttagcttattattaaattatttttaaatattacacattgttctaccaagtagatcgaaacttttcactaagtagatcgaaaaatgttcaattgtttaaaggctaaaacacaaccaaatcacctcatgaaacattttgctacaacatatgaaacaatagcttctcaaaaaatcgagcgttgtttcaccttataaaaaaataatattttaagcaaatagcgaaagaacgtttcaattcactgcaacatttgatctatatatagtgaaacattatgagtacgcttgctgaaacattattggtggaacaaaaattaaaacggattccttaatagagcgtttccaaaatatatgggtaatttgttacaaaagaatatttcaattcactacaacatttcatccatacatagtgaaacattataattacactagctaaaacattgttggtgaaacagaaaatgaaacggatttacttaatatgggggtttccgtaatatgtgggagatttgttgcaacggggtgcaagtggtgggagcgcgtgggaggcaggtggaggcgcacgtgggggagagggcgctgttttcttcgcggaggcgcgcgcgggggagggcgcccgatttttttccgccggatagggtacctgatccccagcattttcggctatgataagttgtttttctaggtttcctgtaacaggggacccgcataactttgagacccgcaccgttcaaccatcgggtggaaataatgccccgtttgtagcttcgtaggggtgagccctgtccccaatggggaaactaccacccttaggtctaagaaggtgctttagatatgtttttcttttgcctaattacaattattttaggccatgccatataataaatacagtaatagacttatataattattgttcttctagatcgtaagtatacaactagttgtattttattatactataaaacagataaaaattagaaacgttaatttattgttttagaaaaaataatgggctatatctcttcgttaatttgaagttaatttgaaaagttcagttttaaagatttttatattccgataaatatccgttactgtattcgctccgatttattttagcgctgttagatatgtttttcttttgcctaattagaattattttaggccatgtcatgctaattagagttatagatcaactaatataattcttgctcttctggattgtaaactatacaactagttgtattattactaaaactaataaaaaatagaaatgttgatttgttgttttagaaaaaataatgggctatatctttttgttgatttcaaaagttaagttttcggggtttttatattctgataaatatcttttgatatttgctccgatttgtgttagcttcgtttgcaggtttccgatttcgattctgaaagaaaatgataacagtataggtggttttcattagttttcgagctattttcattctacaaaccaaaccaaccgagcgaacacacgcaccatcgcgaactcgcatcatatgctctgcaatgatggtagatatttgtataaaatcggtgaaaataactgtatatatttatacattttgttccaaaattttttatgcagatgtagatatcgaaggaacccaactggacaaacccatttcgtatggcagcaacatatggcgactcctgtagcgaaactcggggaactcctcgtcgatcgtgcggatcgccatggtcgctcggtccagctggcacaccgtgccgccgagccggagcaccacggcgccgctcgcctcgccggaccaatgcagctccacctccgactccgacaggtcgcacggcctccggcgaaccgccgccgtgtccaccacctccgtcgcgcgcgcccacgccgacggcgccgcgagcatgtccagcgtgtggatctccaccctggtggtccggcagacgagcagcgccaccgacctcctgtcgcgcgacggcgtcagcaggagctgcttcgacgtgacgaccgccgccgccgcctcgctgctggtgcagcgcgagcacgacggcggcttcagcccctccggcgccgggatgatcgtcgcggccttcgtcgtcccgtttctaccgtcgccgccgccgtggtcggagacgtcgacgcggaggatgaagtagtgagacggcgggtgcgggcgctggcggtcgaaggagtgggacacgacgaggaagtaggcggcgccattgacgacgacgggatgccggccgagtagctcggcgcccgggtgttggtggatgtcgccgccgacgccatggacgggaatcttggtggtggggccccatctgccagtgaccggggttaacgcctgcatcttcagtcgaagccgccgcccctggttcgtcggctggcagagctgcacggcgaggagcctgaaccggtggagctcggagtcgtcgtcggagctcggtccgagtccgacgccatcgtcggcggtgagcagcaggtatgacgtcaccaaatccttcctcggcagagggatggggagcacgtagcccgtcatggggttgcacacttcgccggaggacctgccagtccgagcgacgacgaagccgccgcgcgcctccacgggttcgaacccgagggccagcgactcaacggcgtcgtcgcccgccgggagctggccatggtggtcgccggcgccggcgccgtcggcgaaaaagcggaccggctcttggaggaaaccgtgggctccgtggagaggctggtagtagaagccccggaggaggaccgggacgaagccgccggcgttgcgaaggcggagctcgcggcggaggccctcgccagagatggcacggcggagctgcctgcacgcggcggcgcagcggaggagcgtgatcgggtcggagcgctcggcgatctccacgatgacgtcaatcggaagacctcgtgacgacagcgacgacgatgacgacgatgacggcggcttcatctctgatgtcatcgtcttcatctctgatttctctcgacggaagagaaattaaacgtgagataaataatgccaaacacaatgggactttgttacgtcttagtaagtcaaaactagtactaggactgtaggagtccaagacccaaacgggaaaactgaaataaacgtatcagaaaagaataagtgggaagtagatttttgtggaaaagcctacaggtcggatgttcgatcctttggggaaaaatcagatgctgaactgacgtcagcacccgatttacgtgtaaaactactttaaactgatttttctcttaaattacttatctaattaatgatccaattacaccattaaattcgttgtaattaaaatttcaaaataagaccacacatggatatattccgatgaaaaaaaagcttattattgaattatttttaaatgttgcatgatgtttcaccaggtatatcggaattgtttcactaagtagatcaaaaatatttcactcgtttaaatcgggtgttgtttcaacttatatgaaaacaatgtttcagcaaatagcgaaagaatgtttcagttcactgcaacattagatttatacatagtgaaacattataagtacattaagtcaaacattttttggtgaaaaaaaagaaacgaattcccttaataggaggtttccaaaatatgtgggttttttgttgcaatgaaatatttcagttcactgcaacattaaatctatatatagtgaaatattgtgagtatactaggtgaaacatttttggtggaacaaaaaataaaccaaattcccttaatagagggtttctaaaatatatgggtgatttgttgcaacggcgcgttccataatatcaaaatccactgcaacatttgatccgtacatagtgaaacatcataagtatactagttgaaacattgtaaaactactggttgaaacatcaaaagagaccatatgcaatattaaaaaaaataataaaaaatctagaatatttttgtcgaaatataatcatgtgtggtcttgttgtaaagatttaattgtaatgaatttagtgatgcaatcagatcgtagattagataaatagtttatgagaaaaaaatcttttgaagaaataagagatggttgcatgtgagaaaaaattctttgcatgcagacgtacactggcaggcacaaaagcagcgctcgatttttctccacccctgccggtcgcccgggtgtgagcattttcggatttttgtgtgtgccaggacatcctttattttgtgtaaggcatttaaaatgtcatctactccctccgtcccataaaaaccaatctaatactgaatatgatatctcctgatataacgaatctagatatgcctctgttcagattcgttatactagaatatatcacatctagtcttagattcgtttttttatggagggagtatataatatatctttccacaaacatgtaagttaaaattcgacttatacaattttataacaaaataaatttaaccgtgaattacgtctttgattcataatcaaattagttattttttcacttatataagttgaatttaaacatgtatgtttatggagtgacatatcacgtaataatatggtacttttttttccaaattttcttggatgattttcaagcgacatgtaaaagtgagaggatattcttaaggaataaatagagtgtccccagtctttgctacataattcgcacggcttgtaatttgaaacgaaatctaattttatgtttgagaaaataattctgcctttttctcatgccgatcgccgttgttcattgtggcctcgaacaccttaaactcatcccggtgactattaatacctctacgtagttttcatgcagactccccagagctcgtgattctggaactaccataattattccgtagtgatactctgatagagctaagcaagtcacactaatcttgaggaaaaaaaattgagagaatcccttatacgccaatcaaatttgactagttcccttatatgccacttaaaattagcttctctcttttatgtcactggtttaagtttttccacctttttataccactcccagcactataacgtttgttaactgttagtccaatgttagtttttttttctaaatgaccattatgccctctcaactaaaaaatgtgtaaacttaaaaaaatcataactagcttattttaaatcctttttgaatgaacataattttgtcggaaccaatgaaaaatgctctttgtattaaaaatattgttggaaagctgcatgtttcgtgcttatattgaaaattcatttgtgatggtgatggctaaaattgcacgtgatgcaaaaaaaaatcaattttcatatgtcgtatgcattagctatattagtactaaaatgctatatatatacatagactaacttctctatcaaataaaaaaaactcattggttgtataccaaatctcaagggcaaatgcatctttttgctatgaagttaagggtcaactggcggaggattgacggcaatgacatagaagggaggacaaacttgaaccggtgtgatagaagggaagggctaatttgaagtggcatataagggaatcagttaatttggagtggcatataagggattctctctaattattaatttaatgaaactaatttggtaatgtaaatattactcccgccattccaaattgatctacatatttcataggtacaccaagaccaagaaaagctaatagctctctcacactatatttactctagcaacaaactcaatgcatgtaccatctccactatttcctagccaatagcaaatcaagatattgcatgtgggttataaatacttgtgtgcatggatgcatgcatcaatgtccatttactccaatgcacaaataacgaataaaattaatgaatgaacacaaatatgtagatcatttaggaataacctcaaaaaaaaaactatacgtaaatcaatttggaatagagggagtactatatttgtctataaacttagtcaaacttaaagcagtttgactttgactaaagttaaaatatcttataacctgaaacggagggagtatttacactactacgaaacctcttatagaggactcgataccgataagcattttctcacctccacattttgaaaaattatagaaccatcggctttgagcact

SEQ ID NO: 16851 - DNA, 29123 bp, Oryza sativa
cacttcccacaatccatatcctttccgcacccccaccccctctaaagaaccttccaaactcccaccgcccccaaaccattagtccataggtgtaggtgaaggtagagaacgtggtcaccgtggctgtgccggtgcagctgccacaggccaggctcactgactttggcgccgagctcgacgacaagtagtgaccgcatgcaatgaggatgctggtggtggcggcagaggaggagtgatggtggcaaggttgaggagcactggtggtagcgccgccctcgtcgatctgtgccactgcttcatcttccatagccacaagctcgtagtatatatatccaacatccacctccattgcctcgacccgctcctctaccatcactaccaacttgccccacactacattccttgccctgtttattttcattttctgttgcaattttgatcgattccatgaatgtgttcttggatgggggatgatggggatcataggggtggttattgggtgtggatcaggagatgctcgacgcatcggctcgaatgcatggagctttttttattgatggaactggttataagtgccggttatagggtaagaaccgccacctgtcatcttcataggtgccggtgtttgaatcggaacatatgcggagggcatagctaccccaaatttgttttggttgggaaactagcacctatgaaggcatgactagttccaaaccgacacctatgaagattcctgcaagtaatgttagttcaaattgttaaactggagtaggctaataagtatgtctggaccatcacacgcttgcatcgtccaaagaaaagtgttcaaatatatatgaaagagtctttggtgagattctataatctttgcgcaaaattgccctgatgctatgtcatgcaagaaaatcgatatctatgaggttttgcaatcaactgacgacatacttttgataggttccggccagggttcaatgcatcggaaagtggaaaattttcagggtttagttaaattacgaaatttcaaacaaaaattaatgttgaacaagaaacttgcagaaattcgaccaaggagagtgggctagcatcgagtccatctaaagccgggccaggaggttgaaactaagcataatgcgaggaccacgcgacttgtgtccactcatcgatcggaaatctgcggagcggccgccgtccactccagcttaaagccttctgccctaatccagtcttgcaagcagattaaagcctctattgtctcactggtcaacctgcttctataatcacttatgaccctctcagcagtggagaatgcactttctcaagctacagtagaagcaggggctgctaacaagtcacgcgctatgcttgtgagttggttgccttgcctttatggtgttttgctaattttcctattagcacagtctgaaactatcttaaaagttttcaactacacatgcatggtctgttgatttacgatagttggcatgtgactaggtgagattttctttgtgtatcctgagcaacgcgcgtgaaatgtctaggttgacatgctgcatgcatgcatggcattgacattttaatttattacaattactaggttgtagcccgtgggtttcctgtcatcatgacttctcttcttttttaaattgtttttctgatggtaaggcacgcaaagcgcatcttattatctcttttttatattgtttgcctgatggtagggcgcataaagcgctccttatacctagtgtgcttgaaagatggacaaatttttgggtggcaattttttgctctgatttcctgttagcaaatggtaagaatggtcacttgaaccatagtgtcaagctcatctacttagtgatgttgctgccacattgtgccactggtgatataaagtttggaagtttgaaaatgttcttttgatgcatttttggttcctgcctggcatttgcactccatgttgtcgtggaactgctgctgtatgcctgtactttgtagaaatgaagcatgtttaaatggcgtccataactttacaccacactttacggtcctgcatacaaatctgtatgtttaaatgctatatgcctatagtccgtagaaatgaagcatgcataggaagttactcgtatactttagtgtctaaattttagtgctatactcctatacattctagttcactttcttgtaccactttacttgctctcatatttttggataattgtttaatcaaatactattagtctagcgtcagttgcttgtttgcttggccaatgaaatgaggtgggttggggatgggaacattgggttttgttagtgcaatatattatggggacatcagattggtctacaaagtagacctatcattcaaaaactaatatcgtatatgtggattgtttcttgttgtttctctagcgcataaaaaaataatctaacatatggtactgtactatcaggttgctgggctcaaacatatgcgaacttcgatggaggagtggccaaaatgctttggtggctgctccagcattgtcacgtgcttttgaacaggttttaattatgttgtatgagatatgctcaaaaaaaatgttgtatgagatgtgaaggttggaatgtgtttttactgatctgtaactattttgttgctgatgatgagagaatgtaaattaatgatctgtaattaattttgctaaaattatggacgaaatatttgtattttgctaaatttagcagcagctgaattttacttgggctaaatctagtagtagcccaatttgaactgggttgaatgatgactaaaaggccgaaaaaataccccacaaaaaaacaaatcggcccaaaacaaaaaaaatctagctggtcataaatgggcataaatgggccgaaagctcctggaaacccgaattgggccacaaaactcgtgggctaaatcctacgtggcattgatgacacatcaacatccaccttggcgtacccatggcacatatgtggcgatttgaatccgtgacggaaaaaaagtcctatgtggcagctaatctgtgatggaaaaatgtctacgtggcagctattcatgaaggttatttttcgtcataggaaatgggcttggctagactaactagatctcgggctccatcgtgacggtttaaaaccgtcatcgattctgttaatctgtgatggttttcgacgaaccgtcacgcaggtcaatccatgacgctcaatccatgatgatttctgaaaccatcacagatgttgtttggtgatggtttttcagcgatccgtgacagaaattttccatcacggattaacaggattcttgttgtgatattagaatgtcctccagtattgcaagatatcaaaatcagtagtagcagggacattcttcctccaagtacatatcaagatgactagctttgcttcttagcttcaaagcaacatgctgtccccagtcagcccatgggttgtcgtcgatgttatcatcgtcaacttgaaactccacattctcacttgtttgatcattatgagcacttttgttcatatatatgtgaactatattcagcaaacaactctcttattttggtgtgcacaactgttagatacccgggggcaatattctcctagctttcgctgctcatatgcactaatgcagtcccccttgatggtagttttagaaataagttaaagcacgaattcaagctagcaacaaagctcttaaaacctagggtattccacaaagttataggacagctcatgcacaacaatcaatttaacaagttcttttctacataattcttgatcaaattgccaatccttaagagcagcagcatgtgaatgagtagatgacctgatcgagtacttccaccatttgacccaatctagctttaccatcacaactatccaaatgtctgtggcaattgctcctatcaactgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagtcacttgaagcatgtgtggtggagagaagaggggaaacacacgcgctcgctcgcctcgcctcgccggggaggcggcgcgcgtgcacgacgtacgcgtcgaatggtccgaaaaattggctcctcacccttgcgcagatgcagcttccttttgcagttttgttttgctgcaaattcggattcgtttttgttttggaaacgttccgaaaaatccggtgtgtgcaaacggcgtggagtccggataaggtacgcgcgacttatccggttcggttacgcgcagtagagatcgtgcgggcgccccgatcaagcgacccttctctatataaaccgacctgccgtcttcacgcaacacaagcgaaatcaatctagggtttgcctcctactctgtactgcgccgtcgctcgtagactactccatcccgctcgccggcgtgcaccgtcgatcgggagagcaggtctccggaacctctgccttcgacttcctgcaccgggagaaggaggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccgatctttccgtcacctcggtacgtgttcaatatgttacgcatatttgatctgttcatgttatactgtgtagtttacatgtatagatctaatgatgcgttcatgctagttttcatctgtaatgtcatgatttatttatgggatagattaaatcattatatgtctataatctcaacattccaaaaaccttattataggcactgtgattttactatggctggttttgccgatgcactgaggccggataaattcaccggtgtgcattttaagagatggcagatcagggtcactctgtggctgacagctatgaaatgcttctgggtgagtactggcaaacctgaaggagttcttactgctgaacagcagaagcaattcgaggaagccactactctctttgtgggatgcattcttagcgttcttggcgatcgtctggtcgaggtgtatatgcatatgaccgacgctaaggagttgtgggatgcactgaatactaaattcggtgctactgatgctagcaatgatctgtatatcatggagcagtttcatgactacaagatggctgacaaccgttctgtagtcgaacaggctcatgagatacaaacgatggctaaggaactcgaactccttaagtgtgtcttacccgacaaatttgtggccgggtgcattattgcaaaactacctccatcttggagaagtttcggtactgcactcaaacacaagagacaggaatactccgttgaggggttgattgcgtctcttgatgttgaggagaaagctcgggaaaaagatgccgcgtctaagggcgatggtgggcagtccagtgccaatgttgtgcacaaggcccagaacaagagcaaggggaaatacaaagctcagcagaccaccaacttcaagaagcagaagaagaacaacaacaatcctaatcaggatgagaggacttgctttgtgtgtggccaagttggtcatctggctagaaagtgtccacagcgcaaggggatgaaggcacctgcagggcagacttctaagtctgctaaagtgaccattggcaacactggagatggaagcgggtatggtaatttacctactgttttttcagttaatcaatctactaattggtgggttgatactggggccaatgtatatgtttgtgctgacatctcattgttttcttcttatcaggtcgcacggggttccaccgtcctaatggggaatgggtcacatgcttctgttcatggtgttggcacggtagatctgaagtttacttcgggaaagatcgtgcagctgaagaacgtgcagcatgtcccttctatcgacaggaatcttgttagtggctcccgtctgactagagacggatttaagttggtttttgagtctaataaagtagtcgtgtctaaacatggatattttattggtaaaggttatgagtgcggaggcctgttccgcttttccctttctgatttctgcaataagtctgtgaaccatatttgtggcagtgtggatgatgaggctaatgtttggcattcacgtttatgtcatattaattttggcttgatgtctcggctttccagcatgtgtttaattcctaatttttccattgtcaaaggttctaagtgccatagttgtgtgcaatcgaagcaacctcgcaagcctcacaaggctgccgaggagagaaacttggcaccactagaactcctacattcagatctttgtgaaatgaatggggtgttgacgaagggtggaaaacgatatttcatgacattgattgatgatgctactagattttgctatgtgtacttgttgaaaacgaaagacgaggctctagactattttaaaatttataaggcagaagttgaaaatcaacttgacagaaagataaaaaggcttaggtctgatcgtggtggagagtttttctcgaacgagtttgacttattctgtgaggaacatggcatcatacatgagaggacgcctccctattctcccgagtctaatgggattgctgaaaggaagaaccgcacactgactgacttggtgaatgccatgttggacaccgcgggactgcctaaggcatggtggggggaggcattgttgacctcaaatcatgtgttaaacagagttcctaacagaaataaggacaaaacaccatatgagatatggattggtagaaaaccatcactttcttatttgcgcacatgggggtgcttggcgaaagtcaatgtaccaataacgaagaagcgcaaacttggacctaagactgtggactgtgtttttctgggatatgctcatcataacattgcctatagatttttaatagttaaatccgaggtaccggacatgcatgttggtacaattatggagtctcgtgatgctaccttctttgagagctttttcccaatgaaggatacacatagtggttcgaaccaaccctttgaaataattcccagttcatcacaccaccagaacaaactgaacatacacatgaacttgtctctgaggaggatgtcagtgaagctcctcgaaggagtaagagacaaaggacggctaagtcttttggtgatgatttcactgtgtacctcgtggatgacactcctaagtcaatttcagaagcatatgcatctcctgatgcagactactggaaggaggttgtccatagtgaaatggattccattatcgctaacgggacttgggaggtgacagagcgaccctatgggtgtaaacctgtggggtgcaagtgggtgttcaagaagaagcttaggcctgacggtactattgaaaagtacaaggctcggcttgttgctaagggctatactcagaaagaaggcgaagatttatttgacacttactcacctgttgctagattgaccacaattcgtgtgctactttccctagcagcctcacatggtcttctcgttcatcaaatggacgttaagacagcttttcttaatggagagctggatgaggagatctatatgtatcaacctgatgggtttgtagttgaaggtcaagaaggcaaagtgtgcaaattgttgaagtctttgtatggtctgaaacaagctcctaagcaatggcatgagaaatttgacaaaacattgacatctgcaggctttgcagtcaatgaggcagataaatgtgtgtactatcgccatggtgggggtgagggagttattttgtgcttgtatgttgacgacatactgatatttgggacaaatcttgaggtgataaatgaggttaaatcattcttgtctcaaaattttgatatgaaggatttgggagtagctgatgttatcttaaacattaagctaattagaggtgagaatgggattacactcttgcagtcccattatgtggagaagatcttgaatcgtttggctacattgatagtaagccttctccaacaccttatgatcctagcttgttgcttcgcaagaacaagagaattgctaggaatcaactggaatactcccaaatcattggctcgttgatgtacctggctagtgcaactaggcctgatatttcctttgctgtgagcaagttgagccgatttacctctaatccgggagatgatcactggcgtgcgtttgagcgagtaatgcgctatctgaaaggtactatggaattggggcttcactatactgggtatcctgcggtactggagggttatagtgattctaactggatctctgatgtggatgagatcaaagccactagtggatatgttttcacactgggtggtggtgctgtttcatggaggtcttgcaaacagaccattttgacgaggtcaaccatggaagcagagctaacggcactggatactgctactgttgaggcagaatggctgcgtgatctattaatggatctgcctgttgttgaaaaaccggtgccgactatccttatgaactgtgacaatcaaacggtaattgtcaaagtgaatagttctaaggataatatgaaatcgtctagacatgtgaaaagacgattgaagtctgtcaggaaattaagaaactccggagttataacgttggattacatccaaacagcgagaaacctggcagatcccttcacgaagggactatcacgaaatgtgatagacaatgcatcgaaggagatgggtttgagacccatgtgagttatactatggtggtaacccagtctatgtgatcggagatcccgtgaattagatcctgggaagaacaaaccattaataaactagaggagagtaccaatatatataccctctccaagtgaagatgcatatactctcgtgagctgcaaggcaggttggctatgccttaatgagttttgttggctttaattagcgaagatgttgtcctgcagagcattcttgaaagaactcacctttgtgagcttgactgttggtcgcagtctatgaagattttgggtgaatcttctaggaagcttactaaagacctaggagtatgacttatacgctccacccgaggggtagtctacagacggtctagtaccagataagactttgagtgaaacttgcttgcacaagacttgcaattcaaggcgtagtccattgttcaagttgtgagtaagtgtagcttggagttctaggtggatgttcaaccttaattggtctccatcgaaccgctggtatataaacagtatattggaaaaggcaaatcttagtgggattttgagatttggtgagggattgttggaattaatgaatgggccttagcccactcgaagattaattctttggaaaatcacaaaagcccacctcatgggatggcatgcatgtggagtttagtaccaccttgcttattctaggagagggggacctccttaaaagggaggatgtcctcctagtcacttgaagcatgtgtggtggagagaagaggggaaacacacgcgcgcgctcgctcgcctcgcctcgcctcgccgggccgggccgggccgggccgggcaggcggcgcgcgtgcacgacgtacgcgtcgaatggtccgaaaaattggctcctcacccttgcgtagatgcagcttccttttgcagttttgttttgctgcaaattcagattcgtttttgttttggaaacgttccgaaaaatccggtgcgtgcaaacggcgtggagtccggataagttacgcgcgacttatccggttcggttacgcgcagtagagatcgtgcgggcgccccgatcaagcgactcttctctatataaaccgacctgccgtcttcacgcaacacaagcgaaatcaatctagggtttgcctcctactctgtactgcgccgtcgctcgtagactactccatcccgctcgccggcgtgcaccgtcgatcgggagagcaggtctccggaacctctgccttcgacgtcctgcaccgggagaaggcggcaataaggtttttgggaagcgcttcgcgcgactgctccctgtttgttcgcgacggctcgccttcctcttcgctcgcgtgtttcgtgccttcgtagacacctgcgaaaagtttcgaccaagcagccgatctttccgtcacctcggtacgtgttcaatatgttgcgcatatttgatctgttcatgttatactgtgtagtttacatgtatagatctaatgatgcgttcatgctagttttcatctgtaatgtcatgatttatttatgggatagattaaatcattatatgtctataatctcaacatcaacatccctatcagctttaaataatttgttgcattgaatacacttagctgcaagcaccaatatgccatcatatatgggttcaaagtctttccaaatctccgaagtaagttttctctttatagatctacgagatggacctatatattgccataaaatgaaattgacatggaatttcctaggaaaagattagggtcatgtcataggacaaaatcaaattgacactgatgtatggggcttttaactatttgccactcttacgaatggaccttaacgatttgccactaggcccacatgtcatagacacatgagggcccacgtgtcattgacagagcgtggcaaatcgttaattgctatgtcacaagagtggcaaatagttaaatttccccaaatgtatttgcacttaccatatccctgagaaatgttgtttgctcagatggagactttggcaatgttgtcgatgtggatcttgttactcgtgctagctactgattggatgacatcaacatggaggaggctaccaggccatcggacgtctgataaaaaacgaaatatcggacgcctctcatagcccttagtagcagcgcacctagcactatatttaaagcgcaagagcatgcagccacatgtgctagcctatgtatgcagcatgtacggctactagtactgtattataatgtacacatatatttttattctttgaactcttttctcttaaaatatatatttgatctgtgatttgattacatcattggatttgttataataaaatctttataacaagatctcagatggctatatttcgatataaaaaaactactgaaacatcgtgaaatgcttattgcaacaacaggtagtaccatatgtgacatttcaaaaacccattgcaacaaaaaaaaaactttaaagtgcaacatagtccaattctaattgaaacatttgtttctcattgagtcaaacactgaattttaacgattgaaacatatatatttttttcgtcataatataatcatgcaagatctcattgtaaagatttaataacaacaaatacaccacagtaatcggatcatgaatcgcataattagtttggaagaaaaatggttttaaagatcatgtctcaatttgcatgttcctatatacttgcatgcaagttgtgcatgcatacggctgaggaaaagtaactgggaaagagaaatcaggaaaaacaccaggaaaggtgaatcaactttagactagtatagaggaagctggcgtccgatgtttgtcttcccgtcggacgcgcgacacgaagcattttcccatcaacatccgtatcccaggggaaccgacaataggaataattggggactttagttgctttgctggtggggaattctgtccctgcaacacacgatgcttctgttgagttgccgaagatattccactaccgtcttgagcctccatgcataattcctacggagtaaaatagaaaacatcaaaatattttacaataatcctacttactttttttaacggtataagacaacaataaaatagctatccctgaaagtaactgtctcaatatccaatcaatttgcatcagtttttctatagagatattaatatactagtactagtttcatagagacttttttgtaactattaatttcagaagttcatttgcatatgaagagtatcgaaatgacaactattacataatttcagacctataatgtagcatgtgcggcggtgacgggaggtcgcactagaacgggattgtttatctgtgacgggctgaaagcatcatcactatcgggtaaggccccccatcacgatggttgttggcgctgctcgtcggccagagcacccaggtggacatctggacgatgaacctcctccacaggacggccttgcgccgaatggcgtgcaccaaggtcatcgacttgacgggagtaccccggagtccctgcacgccgccggtgtcagagttggagatggcgcgttcctgtggtccggcgatgcgagcagcggcgtggtgctccggctcgggtggacggtctgcttgctttgctggaccggcgtcggcgcgccattgtggtctgcgcgctcggcgaggcgttcagcgagtttcgctctgggcgccgccatgtgttgccgccatatgaggtgggtttgtccagttgggttccctcgatttctccatgatttcattcgtcggctggggaacgtgaagtcgcaacacaatttcgccacccgcagttttgcaccccaccatgcatcatgcatggatctatgggagtgaattataaactctcctaaaaatattctctccgtttcacaatgcaagtcattctagcatttcaatgtatatcaatataaatgtgtgaaatgctacaatgacttacattgtgaaacggagaaagtaaataaataacaataaataaatttaaaaaaaataaacaagatatattgatacatgataaatcactacaatacaaatttaacttctctaaattatatgatatatccatgtattaatccattcttcacatattacaaactgttaaatggcatatttcatgtaaaaactttgcatatagaagatgatttaaaatatcaaataaatatatttttggttttataataataatagctcaattaattatacgctaattcctttttcgttttgtatatgctgactttgtttccagcttaatttatttcaaattcctcctaaggagtttggactaggccgccaaactaaagatattttctgtttaaatgttatactgtctcgtcttcacctcttcaccggacagttcagatcaggttgacgacgattgtatcctacggaaaatttataactagttcaaatcaacttcaaattatgtgaaacttatttctaaaattttgtaaattccagctctatctgttggaatagaaatacaaatgttaacaagtatattttatacacaatatgcaaaataagccaaattggttaataaatggccaatgctaaaaatagcctttcatagctaagttttaatcctattaacaatactattgaatctaaaatgtgataatccatgctttaaccctaaaaacatgacacataaatgatctttaaagattaaatcatggaagaagcacatttgtgtaaaaaaaaagattccttaatcaattgtaaaactaaatgtcacgcctgaaaaatacctttccgaaatgccattttccttttttcgtggctggtggaagagaatgaaagtctagctagaatatatccttctgcagagaggggtcggccattgcactgtgcaagtgtagaatgcaattcaagtctacagatcacgtctggtttgcactataggcctcatcaattgggttattgaaaggcttatgctgatatatttatgccggtaattaatcaaggaaaagtgagcgatatcttaaaattttcacatggcattgtactacgataatggctctgctcatatgtattgttttttaatttagttcaaagttagctatatgatcatataaccgatgccaaaaaaatggtcctaaaattttgtggggtgccagcttacatatcaggttcacacaaaaagggaaacacccgccatctcaagcagccaactagctagctagtagtacttcttactactcggagctcaaagatttcttaaccaccatatcaattgaaggagccaaaacgaaaccttaggttacaggttccaaaaaggcctaaagccaccaacagagcaaactatataaaccatctcattttgtttcattgcctccatctgcattagcatcgaaatcaccctaaagataacaatcggagaagcggataagatcaaatacaacgaataaaagcttgcttgtagcattcaccaaacaaactatataatgttttacaaattttactattatcagcttttgggtttggtccagaacaagcttgcccagatttatgttctcattagttgtctatagattgattttatacatatgttctatggtaagaggtgtggaaagcagggtattaatcaatcaacaccaataatctgattagtgaagattaattcaagtagcattcttttggtgggagatactaatttaacactataacagttaagttagacagggaattgaagacactataactgtgaaactggaaataatctgagttggaacttgaaacacttgacagtggaactggactaactcacccatggcagcagagaagaggatgggactattctgaataggtggacgaagactggcctagtgaaaggagccataaatgttctcagtgtggtattgaagactaatatgcacaaatagcctttcgttcacgacacagtcctcacagcttctgaccgccagcacgtcgagctaacattcatgatgccttccatgcctaaatagctactttcccattgttttgtggcttatggaagatgataaaaatctagttagaaaatgtgcttttgaagcgagaggttggtcactgccagtgttgcactacgcaagtgtagaatgcaagtctatatatcacttccatcttacactgtaggtctcatcaagtgggttggtgaaaggcatgtgtgctcatatatttatgctggtgatcaaggaaatgtgagtatcttcagctttgcatatgacattgtactataaaatccgtccacatttataattgggttttcatagtcgtacaagaggataaccgcaaggtactataaattcataaattctagtaacaatatgtgatacttcttgatatcttttgtggtgttaaagtaagcggcgtcacaaaactaggacattgccacgcacataccctaactttacatatcctagctaaaacctcatcctcacttcagcccagaatgatttttttctttgttttggctctgcattgtcttttaagttgaaagtttgttgtgagattgcccaaacgtaagtaatgtttaaaaaaaaggtcatgctattttgtgggataaaaagataaagaggggaaaatatacggtggaaactacgtatgtatacatgtagtggaaacctggaaactattgttggataaaaaaatagactctgagatttgtccacgtcatcacgagtaaaaactttactcgcagatttactcatgagttaaaattttaccatggtgacgtggacgaatctcgaacatccatttccattttttgatccaatggtaatttccaagttttcactacatatagggtttgcactacatatttttccgataaagagatgccatctcaagctgccaactattcctactactaggagctcggaaggaggctgttctagagcatctgtacaaatacaccacacaaatatagccacatgacattggaaaatgatatgttcaaccaggatctccatgtaactatcaaaactcagagagcacccaattccttttcttttaaaattatgtagttcattgaattctgtttttaatgggtaatcataaaaaatgtttcattttcagtgaagaaggggcgtaccatatctctagcatagaagttgtagtcctgttagcgagtctgtccacttcaatatggtaatgtgccattttgaaaaatataacataaatcatatatatgtaaacaagaaaacgatgcaatcttaaattgtcatggaaatttagataaaaaaaaagacaaatggtactggcacggcatgatgaatcatgctgaacacttatctttttttcatctcgatatgtaggacgaatttaatatttaacttattttatatgtaatacatccattaattttgatggaatttttgaaatattgctacttaacatcgctaagggatactcctgaagaaaacccacgcacaataactgatttctctctgcattctctgaacccattgcgggtgccatcggcctaataactgatcatgctagatttgaagcacggcagcaaccaaacagagcctcttcacctcttgcttcgggtaatcaaggtttcaatgaattagttcactatcacacctttggcaattcagttgttgagctcttgtgtcgtcattgttggaatctgcggtctatgtgtctcgtcatgtcggtggcgttccgaacacgtcctacatgtcacatgaggaaaaaatcttctagattcttttctgtgcaacttccctaaagcccaacacgctcagtatcaaaatctggtgatctctctgagtttcacagaacagatgacacattgacactgagtgttgggcatctaaaattccagatgccctccatgtctagagtatactaccatctacaacacttgcacttggagaaggaatttatattcaatcacatcataccatatggttgcagaaaaaagaaaactgctatagaaacccatgcatgcattcatatggcaaacaccctgtgagtctaagatggacaatgtgtgctttataaagcaacagtgtttttgttgcctccagtaaattgtcaattatatgagatggctggttaaccctggcatgagcatttgtattcttggatatttgttaatcagctaggaaaaaagttaatcctgacatagcattgctgatcgagcatcgccaatcaaagtaatttcaaccattatttatgaaatctactagtaaaaaaatattttgccactggtagttgaggtagcagtacaaatatatatgagccattgaattagaaactatgaagagtcttgattgattctacaaaacacctcatataacatgttatatttccacaatatggtatcagtacttcaaaatttccgttgcagctattatagtaccacacccttaaacaagtattccgtcttaatcacttaattcttctatcaaattccaacagagcagcattactgagaaaacatagtcaaattaaaagcatctggtggagaatatctaaacatgggatgtgtaatctgagatgaacttggaaaaagtacgaattactcccctgaactatcacggtcggccaattaccccctaaacccgaaaaccagacatcgtttaccttgaaccttcaatatcaaacaaattaccccctcgacataatccagagcggttttgtcctacgtggcaatccagtcagcattttttttatggtggggcccacctatcatataaactctatcacctgtctctctcccccctctttcttaggccattgggcgcaggtcgagcggtgcgccgcgcgggggcgggtggtgagcacggtggcgggtcgacgagctcggccggctctagtggcagcagcgggggtggtgagggcggcgggacttggagcgaggcaacggcggcgggacgtggaacaacgcgtgttcgctacaatttcatcgctccatccatccatccatgccgcgtgtgtgctggatctgctggttgttggatctgctgctcctgcgacccgtggccgcgtgtgtgctgtcctctcgctggttctgacgaccttttcttcctcgatgccgctgtagatggccggcggtgagcaggaggaatcatcactggtgttcttatctccgaggaattttgattctctgtgtggagattatggatatcccatatctacacggcgatgatgtttgggctgaatataggataccgaatatagatagaatatcttatttgtatttcgagtttgtttctcaacttgtacatcaaggaaataccttgagacttagtcggttacgactgtattttatctgtatctgcctattccgttagggatatagattatcttttgtaacacggactccttcccatatataaggggggtccgggtgcctctaggggcggatgttgattttctcccaatcatccaatcaataatacactcggcggattcatccccggacaggagtagggtattacttcttgaataagaaggcctgaacctgtataaatcctttgtctccaaacccatacacttttccagcttgatagccacccccttttattattgccgaaatctagtttcgacagttggcgcgccaggttggggttgcgtcaagcttttcgccgatcagtgcaatgggttccgtctccggcatcgacgacctcgtcttccctcccgggcagacgtttcggttcggcagcctcgacttcgtcaccaacaacttcggcaagatctctctccttgactcggagtcgaaccagtcgggagagaaccggatctcagtcccgtttggattcccaaacgcggctgaaagttgcttcaagaccatctcaatcgagtcggcttcaaaccactcggctgagatcgcatcttctccaacgtcaccagatcaagatgatggggcttacccaccgatcctgatgaagctccccgacgatttggcggccgtctccatcacgacagcgtctccttcccgtaggcctaggcggaagtcggcttcaacaccgatttcgcctagcttcagggaagtcggcgtcatcctccaacctctcggcacggtttcgaccgatcagctggatggctacaacagctctcccaccgtcgactcgcgccccaccgacatcgtggagtatgacgaatttagctctcgctacaacgacctggatctcgacgacttcgacggaagcctagatgacaactacacccctctctacttcggcgtcttcatggccggtaacgagacggaagagcaacgccaagcccgggaaaccgaagcacgtcgcgagactgagcgtcgccgactggaggaggagcatcaagcacaagaacaagaacggctacggcgtgagcagcaggagcgtgaacggaccgcgaaggaggctgaggatcgacggcagcgagctctggaagcagggcgccgagcgcgtgatctcattggccaacaagatgttgaagggacacctgttttccgcacccctcaacagaatgcggttgccgcgatcaccctcctcgacaccctcctcagggagaacgagctcaatcaatctgaccacgtcgtcaacatcttgaaccagacgaagaccatgattgcggcttcggtcccagttaactccgaaagcgtccacacgccgactggcagccgagtcccccacttccgatctcatgactaccgtcatccaagcctcagcattaccggcgcaggatccaatcgcaggagcaggggccacgacgagcggtctgttcactcacctcccgatcatcatagggagcgccgagtggaacggcctcgctcaccacctcgtcgccgccccgtcgatcttcgcgacaccatcatacagcgccgagcagctcgaggttatcatcattcgccggactgccacgacgacgaccttgacggagtagcagccttcaccgacgacctgcgtcgagtggattggccagccggcttcaagccgactggaatagagaagtacgacggtaccactaacccagaatcgtggcttaccgtctacggtctcgcaatccgcgcagcaggaggagatagcaaggccatggcgaactatttaccagtggctttagcggattccgcccgatcttggctccatggattgccccgtggtacaattggatcttgggctgaattacgcgaccacttcatcgccaacttccaaggcaccttcgagcgtcccggcacacaatacgacctctacaacgttattcagaagtccggagaatcccttcgagattacatccggcgattttctgaacaacgtaacaagatctccgacatcactgacgacgttatcatcgccgcattcaccaaggggattagccccgaagaattggtcggcaagttcgggcgtaagcctcccaggacagtcaagctcatgtttgaaaaagccaacgagtacgccaaagctgaagacgccgtcaccgcatcaaagcagtcgggtcctaattggaagccaaaaaaggatacgccggcttcgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccacaccatcctaactccaaccatgtggccaaagattgtttcgtttacaagcaattcgcggatcaatacaccaagactacacggaagaactccgacgaagaacaaagcacgtcgaggaagaaggacgacggcgacgccccggcaggatttcaagtccaccgcaaggagctcaaccatattttcggcggccccctggcttatgagtctaaaaggaagcaaaagttgaccgaacgggagatcaatgctgttcagcccgacacgccccaatatcttcgatggtcagagatcgcaatcaagtttgaccgctcggatcatcctgaccgagtggtccacccggggcggtaccccctagtactagacccagtggtccgtaatgtcaagcttcgcagaaccctcatcgacggtggcagtgcactcaatatcctcttcgccaagaccttggatgatatgcagatccctcgctccgagctaaaaccaagcaatgcgccttttcacggagtaattccaggattgtccgcaactccactcggccagatcaccctcccggtcacttttggcactcgggaaaactttcgcacagagaatatcagctttgaagtcgctgatttcgagacagcataccatgccatactcgggcgcccggcgttagctaagttcatggccgtcccgcactacacttacatgatgatgaagatgcctggtccccgaggagtcctatccctacggagcgacatcaagcaagccgtcacatgtgacaaggagagttgcgacatggcccaaacccgcgagatggcgtctgcccgagaggatatccgactggctgcagccacggcgagcgaaggagaagtgcccgctaccaagacttcaaaaagcggagaaagcgaagccaagactaagaagattcccctagatccctctgatcctactaaaactgctgtaataggcgccgagttagattgtaaataggaaagcgcgctcatcacctttcttcagaacaataaagatatctttgcgtggaaaccatctgatatgcccggtattcctagagaggtgattgagcactccttacatgtcaaagaagatgccaaacctatcaaacaacgactccgccgatttgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgcgttgattatactgacctcaacaaatcctgccctaaagatccttttgggttgcctcgcattgaccaggtagtcgactcgaccgccggctgtgagcttctcagttttttggattgctactcggggtatcatcagatccgactgaaggaatccgactgcttgaagacttcattcatcacgccctttggagcttattgctatgtcaccatgccgttcggactaaaaaatgcaggagcaacttatcaacgtatgatccagaggtgcttctcaacacagatcggccgcaacgttgaagcttatgtggatgatgtagttgtcaagaccaagcaaaaggacgatttgatctcggatctagaagaaactttcgcgagcatccgcgctttcaggatgaaattaaaccctgataagtgcaccttcggagtaccgtcagggaagctgcttgaatttatggtgtctcataggggcatccaagccaacccggagaaagttactgctatcctcaacatgaaaccgccaagtacccagaaagatgttcagaagttgactgggtgcatggcggcgctcagccgatttgtttcaagacttggcgagcgggggatgcccttctttaagctactgaagaaaacagatgatttccagtggggacccgaagcacagaaggccttcgaagatttcaagaaactcctcaccgagccaccggtcttagcctcaccacacccgcaggagccgttgttgctatatgtagcagccacctcccaggttgtgagcacagtcttggtcgttgagcgcgaggaagaaggccatgtccagaaagtccagcgaccgatttattttgtcagcgaggtcctagccgactccaaaacgaggtaccctcaggttcagaagctgttatatggtattctaattactaccaggaagctatctcactactttcaaggtcactcggtaacggtggtcacatcatttccactcggtgatgtactgcacaaccgcgaagcaaacggacggattgctaagtgggctttggagttgatgtctttggacatatcattcaagccccgaatttcaatcaagtcccaagcgttagctgattttgtcgccgaatggaccgagtgccagcaggatacccccgcggagaagatggagcactggaccatgcattttgacgggtcaaaaagactttcgggcactggagcaggagtggttttaatttccccaactggagaaagattaagctatgtgctttggatacatttttcggcatcccacaacgttgccgagtatgaggccctccttcatggactgcggattgcaatttccctagggataaagcgtctaatagtccgaggcgattcacagctggttgtcaaccaggttatgaaagagtggtcctgcctcgacgacaatatgatggcatatcgacaagaggtacgcaaattggaagacaagttcgatggactcgagctcagtcacgttcttcgacacaataatgaagccgccgacagacttgccaactttggatccaagcgcgaagtggctccctctgatgttttcgtcgaacacctttatatgccgacagtacctcacaaagatactactcaatttgcgggcactcatgatgtagctatgattgaagccgactggcgagagcccctcatacgatttttgacttctcaagaactcccctaagacaaagatgaggccgagcggatttcaaggcgaagcaaactttatgttatgcatgaagctgagttatacaagagaagcccttcaggaattctgcagcgctgcgtatctttagaggaagggagacaattgctgaaagacatacattctgggatatgcggaaaccatgctgctgcacgcaccattgtcggcaaagcttaccggcagggttttttctggcctactgcagtgtccgacgccgacaaaatcgtgcgcacatgtgaaggttgccaatttttcgccagacaaattcatctaccagctcaagagttgcagaccatcccgctgtcttggccgtttgcggtttgggggctcgacatggttggcccgtttaaaaaggcagccggcggttacacgcatctctttgtggccattgataaattttccaagtggattgaagctaaacctgttgtcacaatcacagcaaataatgctcgagacttcttcatcaacattgtgcatagatttggagtgcccaatcggatcatcactgataatggcacacaattcactggcggagtttttaaagacttttgtgaggactttggaattaagatttgttatgcctcagtggcacaccccatgagcaatggacaggtggagcgcgccaatggcatgatacttcaagggattaaagcgcgtgtttttgaccggctaaaaccctatgccggcaaatgggtgcaacagctgccatcagtactttggtctttgcgtactacacccagtcgggccacaggccagtcaccttttttccttgtctatggggcagaagcaatgttgccgagtgaagttgaattcgagtctttgcgttttcgaaattttcgtgaagaacgctacgaagaggaccgaatggatgacttacaccgattggaagaagtccgcgaagcggctttgattcagtcagctagatacttacaagggttgcggcgttatcataatcgcaatgttcgatcccgtgcctttttagtcggcgacctggttttgcggaaaattcaaactacacgagatcggcacaagttatctcctctatgggaagggccatttatcatctctgaagtcacccggccaggttcctatcgactcaagcgcgaagacggtactctcgtcgacaactcttggaacattgaacatcttcgtcgtttctacgcttaagcttatcattgtattttcctatcttgactgtcaacatcaagttttcttcttgacgttgtcagtcgggggctattatcataataatggagtgtgattttttatcaattcaatttgcttacttggtctatcattgccttgtttggttttcctacttagtctgcgaggactgaaaggttttaatagcttctttgggttttaggctcaacaaagcttaacaaaaacttctaagaaatcaaagactaggctagaattatcacgcacagcataaatacaccagtattgtacaaattgagcctccatgtattacattcatactcagtcagaatcagttctttcatcatcagagttattactactcggctgaaagttagtattgtggaattgatctacaacgtcgcttgcaattttgtcagccgcattttgagcactgctgataagatcaagagcagcctcttcacttgtcccgtctgcaaagccatcaatggtgtcaacttcaattcttgggtacaaggatttggtcatcgctaatgccatgctagctcccatacttccagctttcttgatgttcttgaaatacacatccggagcagctctcagcttgtcaaagatttcggttgcgtcgagtgcactcggaccactgttattcaggaacatagcttggacaagtggggtagcgacattagcaacttcatctcttgctccttcaagcctcttgatcttaccaaccaggacgtcaaattgagcttgggatttgattttgcgatctacaaaacacatttatgatgagaatctgctgcgttataaagagagaagttcagattgtcagctggcagtaccttcaacttccttcaaggcagagtccctctgtgcagccagttctaccttgtctcttttcaaggcttcaatttgcttttccatttgagccatcttggcggcttgcactgtttgaaatccaaatggttgaggatacagttgcgacagcatagatcaatgcgacaggtctagaggttaccttttgacgaaccactcagctcgaagtttgaatcctggagctgagcaattcgctcccttaattccttctccgtctttttggcgagctccttggcctcgtgtaactggtccctaacagcttcaagagttcccaaatgaggaaccagtctttctaaagttgcggtcttggcctcattgcgaagatggattctctgcataatggtttgtgatttagttctgctaaaaagaaaacaaagtcaccaaaggcagtcgcccggaagacttacatttacaatacgagtggcttctccaagcgccttcttcagctggcatacttcctcatcttctttttgacgatttatgacgataccggcagcttgtgagttctcgtcccaccatttgattaagataggaggacgagagtcgtcggccgcctttatgcgaaggatttcttcttcgtcatcgcctggtggtcctgatgtgtttccaagacgttagacggataaactgaagttatttaaatcggcatcacttgagaagataatttacctgaagatgttcctagctgggcgtgaggtgatccttgttctttatttggagacccaattatcgagtcgttaccagcctctggcccttgagaagttgtcgtctgcgcttcaacttcggggatctcttgatcgggacccacatccgactggtttccagtcgggggctcttgggttgttgcagtttcagttgcttccgactggtttccagtcggtggctggtcactcggatcggccttgtcatccgaagcatgggcgccagtcggctggctttcggcagtcggctggctttcggcagtcggctggctttcggcagtcggttggttttcggcagtctgctcaacgtctttggataaatttggctctgtcacagccggatcaggatcttttccagttggatctatgtcggatggtttcctgcaaagtgtcctttcgatattcagcgtaatttctatgagagaagcatgtcaaagggagatggtaccgagaggtttgtacctggaagatgttctaatctttggcatttgacggccagccagttttttcttgggcatggtacgctttgggagtttattaggcgagcccttgtccccagatttatcgtcgtcgccttcatcgttgtcgagcaccagttttctcttccgagaacctgtctgtccagtcggattggaggtttgaggttgcggatctggtctgatttttgaacctccacctccctgaacggtgtgctgacgaggcgaccggcattgagtgattgcgggatcagatttcatcaacgcatattcctaaatgagatgcctccacggttaattaattcaacatgaaaacaagataatgttttggtcatagattgaagatttcagaggcatacctgcggaggcggattgaatgcattatatggcacaactggcagctgatgtgagtagctgacgacaatagcatttgagaaaattttatacattctctccttcatgattttaaagtccagagagtctggttcttcacgattgggatcatgcttgccgtcgaactcgaatgctgtacgggatctttctttaattggtgccaatcggcatttgatgaaatgccgagtaatctgctctccttgcaagccttgttctttgagttttagcatgcggtccatcaattccaaggcttgagcagcttcatctccgatcggaagagagttccaagtatcttggtacactggaggaagacaagagtactcgggaagagcaggctcaggattctgaacataaaaccagttcacatgccaccctttgtttgaggtcttgaagggcatagagaaatacttctggctcagagttcccctcaactgaaatcctgcccctccgactacacatgccttatttttgtttggttggggcttgagaaaaaagattcggcggaacagagcgaagtggggtttaattcccaagaaggcttcacaaacatggatgaaattggcgatatggattatggaatttgggtttaggtgatgcaagctgattccatagaagtttaatatcccgcggaaaaattttgaggtcggaagagcgaagccgccatagaagaaatgagagaagaccacaatctcgtgtgtatcgggggtcggaaaaatctcaccgcacgctggccgccacccgatgatctccttggcagggagaacgccgtgcgccaccatctccttcaggttctcttccgttacgtcggacggcgcccattggccttcaaagctttctttctcctccgccatcgattttacccgaatgcgctgatttgattcgagggatggctagggagaggtgagggattgaggcggtggatcacgggaaggattttgatgcacttttcgaaggtggatttgagcggaatggtgaaccctagtttgccggcgcagttctctactgtagcagggagtggggaaaatggcgagagttccggcggggaagacgaagtgtcgcttggatctcgggatttcttgttaagggtatcggaggtgcaaatgggcttaggcctgaacagtacctcagcccaatacttttaacagcgtggcccattgtgttccttagggacttaggcattttttgctttggcaatttatgcgcacaatagtgttgcccaatgctgataaaatcctttttacgcggtcatataattctttggaattattgcaatgcaaattaaaaggtgcccgacagaaaagcgttatgctgtttttgtaagcttttttaggctacaaaagctgtttgggttaacttggaatgacttgtttttattatagtcattcccttggtatgttatatgcctgttttcattatggtaaatagtcatagcctaggctattagacttattcattcccataatttttataatacttggtgggtaatccttagagtttttattcggatgcctgtcaagtgtgttcattcgtgaaccttttagagtgttaaccactcggattctttttattatggataaaaggcagtcggctagaatgcctctttaggcgccgcgtatgcttttgtcatatgatgcgcgattgtgctaatattctgttctcaactatatgtttagtttgttaattaatcacatagttgggggctacacctaattaggtgcatctattcgatgcaccgtattctttattgtttcgccctttacagtcttcgtcttcgctactcggcaggccttggcatgaataatttgaagcactcggattactatctttgagaaggctataatggttgactgcaaaggtctcgggggctactgtggagattatggatatcccatatctacacggcgatgatgtttgggctgaatataggataccgaatatagatagaatatcttatttgtatttcgagtttgtttctcaacttgtacatcaaggaaataccttgagacttagtcggttacgactgtattttatctgtatctgcctattctgttagggatatagattatcttttgtaacacggactccttcccatatataaggggggtccgggtgcctctaggggcggatgttgattttctcccaatcatccaatcaataatacactcggcggattcatccccggacagg

SEQ ID NO: 16852 - DNA, 16865 bp, Oryza sativa
ggagcaacctagccacgcccactgtccgctcgctcaaccaccagagaaagaggatgatgtgattcaatatgacatgtgggccctatattttttaatttttttggctgattggatttccacgttggcgccacgtgtatgccacgtaggattaaaaccgctttggaagtgctcaggggggtgatttatccggtatgaatacttgaaggtgtaaaatgtccggtttcgtggttcggggggtaattcggctaaccgcgatagttcgggggtaattcgtactttttccgatgaactttaattgcgttggaacaacactgatgttaagtgctgttgctatgaaattcaactagcattaccatgccaagttgccaaccttccctttgatcaaagtaaaaccatgaataacctctgccattagtaattatatgataatcatcatcccaatgctcttgggtccgactctgaccagtccatattacactccaggaaatcctgtagatgaaagaagatgaaaggtgtaggatcgaatacctagaaccaaacctacaatagggttgtgaaaagtaggaataccaaaaaagggaaaacttttagcaaaactaaaagttaattaattaccatctaacttgacaatgttcctgacgaagttgggtctggccacagagctcacgccagtctgacagcaccttaaccatcattctaaccgatgtagatcggctggtctgatcgtccttcaagccgccatctcctagagccgccgccggtctaaccgccctagagccgctggtctaaccaccaggttgccccgagcaaaaccgagcaaaatcataaagcgcagaactcttcaaattaaatcaactttattgcttctaaatgaggaagctccgaacgccgctttcgagggataagacccacaccctgtgcaaggcaagcctctttgatcacattgcccctatatttgcaagatattttttattgaaaaatgcattgcttagtatacacgataaacatgtttaggccctcagattgtttatgcaaccgacagaccgacctagtagtcgcacttatattacataggttgatgtttccttacctttgatagctccacaaatatttgcgtcattattgttatacgactatcgaggtagttcgcttagccatgcttatgttgtattgtcgggtgggaaacctgggttattccaattatatgcttaaaaatctggtgcgttgtaccgacgtgttgtgaaataaaatgtgttgtgaaatggtgatgatgcaaggtcatatctttgtggtttggccatgtattgtcgataagcatcgtttgctttgggaaatccatccaaacacattacagtgcgaccacacgggtgtttatgggatacctctggctaaataattagttatcatataggggttggtgtgccaatggttgtggggtgccgaggatgaggagacgaagtttatttagccctattgggtgtctctttttattgcctctattgtggcacgcgatatcagtaggagacatcgtcggtatttcttgagtggatgatggctgaccttgcctgatactcggctaagagacttagcccaactagggggcatgcgattttcatgggttagctttggaaaggccttaccatgaacttccgttaccgataggtatcggtaaccggtgatagtttcatggggtaaagcatgtaacctctgcagagattaatgaattgttcgaacacccgtggcacggtcaagtgtcacaccccaatctgataccgccgtacaacggcacctgacaggagcgtgtcgtagggaaacggcgctcaggtcgggtttttcacaattcattttattttcaaacacaccgacaccacaggtcgggttttggaggcttcacaaacccatttcccaagttttcgacaagcaatggtgtatgtgggatatttggtatacgcgctcagagagcacgaataccgaggtaccacaagggtggagcgacaaggaatcagggatgtacgacctacggaaattagtgcgactactgggtaggtccgtcggtttggcacgcaaaccgaggccaagcaagttaagtgtgtgattctaataatgcaagttacaaacaaaataataatgatttttcaattataggagcaattgatcaaagggtgacttgccttgctcaaggtcttcacgaagcttcacgaatcttcgagaaaacctgcgatcgacgaaaatccgataaccgcaactatacgcaaacaatcgaaaacctaaacaaaagaccaaaagaaagatcctatttagactaattagtagtgccattaaatagatctcaattttacggaattactggaagtggaacggagtcaatcggatgagcggttgagaagatatgaattttggaagtttaattggagtttctggaataggagaaatggtttatgaaattttatagaaataatattctcaagaatattattgacagtcactgacgcgcgggaccaaaggaaatgatttgtggaattttggaataaggaattgatttatgggacaaaggaaaaaggatttattaaatccctggaaaaagaaaaggatagagggatgtatattagacttgttcggtggcattggtgcggcccaaaggctaacgcggctcggccgaaccaaatgggccggcgcgggcgcgaggagaaggcccatgagggcgcgcggggagagagggaggcccgtcggggtgggcgcggtccaccgcgcgggacccacatggcggtggttgggttcacggtggggagagcgcacgcgggtgcggcgctagggttcggggggggaaaggcggtccacgcgcggcgcgcgggtggacgcggtgtgcggtgggcccacgcgcagcgtgtcggctctccgtggaccgcgcgcgagggtgggggacggagggaggcggctgaccgaggtcagcttttgacccggtcgcgtcgaggtggcgccgacgtggcaaccacgtcggatggggaggcaaaggaggccgggcaggctgatccgacggctcacggggtgcggggggatccggcgaacggcggcgagccggaaggggcggctagcactggcggcaggaggaggagaaggggaactcattccacggctcgcatcaggaagaggacgcgcgacgacggccggcggcggcggccaatctcgccggcatgccgacgtggccgcgcgcgaggagagcgaagggtgcgcgggctcgggcttagccgaaccggtacggtgttgcgacgcgcacgcagtgacgcgggacccgatggtcaccggcggcgcacgcacggcggtgttatgcggcggcggaagcggcaagacggcgcggagacaaaggagaaggccgacggccttggggcagccagggggaggtcaaggggatccccgggggcgtggcggcgagaggaatcgacgcgagagaagccgacgatggcggattgcggcggcggcaatcaccggagagcaaaaaggggaaaacacgacgagacgacgagggtttgattcaaagggatgggagcatctccggggttcaaggaatccgttcccggcgtcggattggacggagcggcaccgaggttggctggcgacgagagacggcctccgggacagagcatggtggccggcgagctagcgcgcggtgcaagggcgacgagcggcgattcggcggcgagacctggggcagtgtccatgcgtgatcggggggctagccgagctaccacgcgagctagggagggagaggacgagcaagaagggagaacggagggtggcattaccaagccgagacgggcgcagtgacgagcggccgacggctcggaagcgagctctccggcctcgggccgaggaaggggaggaaggagggtgcccggagtcccgcgtcacgcgtcctcgcacgcaccggtctcccggtgctcggcggcggacggcgacggcgagagcagaggaagggcgacaatggcgcggtggagtaggagtgtgaagtgggagggattgagatgggatggggagcttggcttcggggttttataggcgcggggtgaggcgatgtcggtttgggggggggggagaaccgaccttggcggtcaagcgctcggctggcggcagcggcggtttcgtgggcgatgcgaaagcggcgacgacgtggatgctttgggcggcgaaggcggtggatcggacggccgaatccgaaccacgggagcgcaggctggcgcggtcaaggtggaagcggcgagctggcatggtcgcggtggtggcgtgggcgcgacagggcgcaaaggtggcgtcagcggcgccctgtgtccgctcccgcaccaggacaagggagagagcgaggcggccttgcccgcaagggaaaagcgaaaggaggaggaggaagggagccttgctccttccgtttttgggcggcgaggctggagaggcgcgtgggattggcgtcgccgcgttggcggcttgtggcatgcggaggcggggccatggtgacgcagcggatgacagcgaaaagggaggagggctggtttggcggcgagcgcggaccaaggcggtcgacgcggcaggggcgacggtggcgcggccacagcggtcggccatgagcggcgccgcgcgcgggagcatcggcgtggcgcggtcaaggtggggcacaggcgcggcaggacgttgtcggcgtcctctgcctccgcgcgcaagaagacaagggcgagaggagagaggccgggtttagaagggaaaggtgagggaggacggtggaaagggaagcctctcccttccgttttgggcggcgggcaggcgaggcgcgcgcgggaagggcggccggcgaattcaaacggcggcggcgggaatcggcgccgaggtgaggagttcgacgagagagagagaggaaaaagacgagagagcgagagaaacagagagagagcgaccgcacacgcgcaacgcacgtgcgagggggtggaggaggagcggctgagaggagatgggccgaagagaaaacggcccacaaaagtccgagggaggcaaaatagactttttcggaggagattgatctggagagaaatggagagatttagggtttggattcgacttcaaatttgatattcaaactcgagggtttagggatgaatcaagggagactcaaggaaatgattcgagatggggatttgaataattctggattcgtagaagtacttggcgaggattcaaggaagcatttgaatttcagaatttgatttcagagactcgaatcggaagaggaaatttgaggcgaaggattttgatttcgatgagagggaacaacgggatttgaattgagatcttggcacaacttagactcgcacacaaagaatgaaaattttcgcaattaggatttttgccgaattagtttttaacgcctcacgaaaagcggagcgttacatcaagggcgagtgtaaggtgtttctcatagcgtagatttgtatgacaaaggtttgtggaagagtggttatttgggaagggaaacgtttccagagtccgcctatgtggcagacggccaacctttgtggttagcaacgggtctatgtgacctggggtgtcgtctgacaccgaagtgttgttagagctgagaaggtgttgatgtgctaggatagctgggtgaactatgtgaaccatgtgttgttgtgaaagtgaaaagaaactaatagaggaaacaaaatagttattgcttgttaatctcgtgacaagttgttgcaaagcaacttgtcaaatgggtcgaggcgtgagcctcctcccgacaactaaaacttgactcagtaggagttttcgtgaaataaatcactttgccaaaaaggcagctttcgcaaataaaaccctatcctccttgtttaaaccgagcatgtcactctttttcctagcttgctgagtatgttaagtactcaccttgcccttatattaatctatagagtatgaagatgaagacgtcgaccacaccgctgaggagtgtctccaggagcaagccgagtatgaagacttctagatgtttcgtgcctagccccaagcctcccttgtggaataagatagtctcgcctaggttcttttcctagtgcttagttgcttagccgcttagtctctccacgttattcgcttctgcgccatcgcctttatggttttttgtattgttgtgttgctcatctatgggcctgtccatgatgtcaactttcgaaagtactactacccagtgatgtaataaagcagtttactctgatttcacatttattctatgtgtactagctagtatatcccgagactggtactatctcacaggtaaagcataacaccccgatgtatgttagctgtgtttatggctaacgaatgtcggggcgttacagtgcaacaacaacactcctatctgaaaattcgactaaacttgaagtgtaggccaaaccctaatttttctctcaactcttctcttacaaaatcgataccgagaggtctcaacccctcctcttctgtttataccctgagatggcaacccaaaagacacgaattctacttgaataatttgccctaatccaataggaaacctactcataaaagtaacaatcttatcctactacaattcaaagttcaatcttcctaaatttgaactccttccaaatttgattccgcttttcaaacgcacacaatctctcttatatgccatcaaatcttcataaccacgttcattgttctttagtcaaagcatcacgcatgatctcccgatcgtctggacatcaatttctcccaagtcaactctcgatccatcacctgcaacgctatcccgagatatcaagacacaagtaaacatgaatcaaacaaggaaccatctcgagcaaaagttcttcccaacttgattcaaaattagcacacaacagtattacacacacgtagaaatcaactagaagtcataaattgaagcaatcacgagtatccaaagaaacattctgaaatcaactccaaatagagtctagccagtcagaccatcggactggccgcttggacagaacacaacacgccgatctggccggcctacctatagcccgatctgaccagtcctagtaaaaaccacttcgccaattatccacctattatcaaaaccaatataaatcatatgccattgttttttgatgtaatcatatgccaattgttcataaaaaaaatatgtaaatcaaaaacattgatttcacaaaaggatctatacatattaattaagacttcaacttatggtcggattcaatgcagttagctaaaccttctgaatcttttcaaggtaacacacggtagctagctgattaatagagttggcttcaccgtgtagtttgcaaacatcttcaaaaggagaagagatatgtcttttcatccaaactcgaggctttttttttttggtcctgctagccacatatgctcatgtaaggtagcattacttaggtgtgagaggcatcaggattatatatatgcataccacgcataggatgggcatctacacccaaagctattttactcttcagcaactgcttgattcctggatgaacaaattcaccaagatcaagaagtgtctgcttgcaactgaagtgactgcagtttgctggaccatctggaaagctagtaatcctgcctgcgttccaaataagtttccagcagatccagttgaggtaattcataatatttgtcattggatctcatctatggcatctatctatctatctattatctatctatcttctatctatctatctattatatactaaaagtccattaaacttcctataaacgctcctacgccgccatgtggtgctcctacaaacactcataggttgccatgtggcattttataatctcaccgtcgattttcatttaaaatggtggacccgttattttaggccattagattagatctatttgcatcctcctaatatcccgtgcatatgtgtgaaaccgtttgtaccagaaaaaacttacgtacgtatctatggtagggacaacccatttaactgtttatttgaaaaaaacgctcgtacgtaccttaaaaaatattaaaaagatgctgttcatatggaaacaagtacgtacatatatgcacgaaattttaaatttaaacaaatgcgtacttatatgaaactatatttcttacaattaaatttaaattttaagactaatattaactaggtttttcttttaaaaaactacaaggggagaaatgtttaggatatgtatatgtacaccttttttttattaatttctgtgtaacaaattgcgtcaatgcaaatcaattaagggcagagcttgatagtacaaataaaacactatgattaaattaaaatacatttatttattcataaaagttttttagtctttttatagaaaaggtaaaaacaccttattttaatttacacttaatttattagacatatgctccaaacaaactaagtatacctctttttttaccctaaaaaatgtatacatccttttttttatgatgaggaagattatagacaattgtttatatggatgaattgaatattatataatataaatcttaagtagagcttagaaaaattatctaaacaatattgatgaagaaaatttatggagaaaacatactgctaaagcttggtgaatgttgctcaattgatattccacccttataaatttttcaaacacatcctagatgcatacccgcgcgaatgcgctattaaatttcctaaaatgttctcatgccactaagtggtaccctataaacactctcgagtcgccaagcggcactataataaataataaatcagagaaatcctaccaacgattttgttggacccattattttagaacattagatatattttattaaagaaacagattcggcacaaacgtaaaaaaacaaaattaaaagttttggcatgttatacgaattaatgaacgtatgtacggtacgtacttccctcccgttccttagtatattattttctctcttcacgagaaactaaaataaaaacatttttacaggcaaaaaaatcccacaaatagacttctaccaactagctaggtctagaagctctccctctctccctcgatctacatatgaacgcaataattctaagtcgctacgtggtctataaaattagaaaacgtactaaaaaatatttataaaaaacaaagcaaccagctatcgatttctatttaaattgatggatacattgttttagattgttagattttttaataaaaaaatcgcaaacctctctccctcccttccaccccgtgcggcattaaaatccattaaacattttataaatgcttataaaatcttagagattctggaaaacaaactaatccattaaacatccttaaattgttcctaagccacaaagtgacaccctacaaacaaacgctcctaggtcaccaaggaacactctaataaataaaaaaaaaatctgaacaacgattttcatttaaattagtgaatccattgttttggatggttaaatcgtttttttaaaagaacacacacatccagaacctcgccatcacataggaacgaacatgcatacttccctcccgtttctttcagttttatctatcttcatgataaaatgataatcaaaattatttttacatgaaaaaaaagcccacaaatagacctccacctactacttggtctagcagttctccctctatcacttaaacatcctacaaactgaaatttcttaccttttcatccttttcaaaacttattttacaaatagactcctcgaaaaacttattacaggaatgggcctattttttttgcgccagagaggctggcaccatcctccaccctagcgccagccaccctggcgctgtcaccgtgtcaccgtggcactagggcacacgtgagtgggctgacatggcaaagggaggcgccacgctggcgcctccgtcccacacaccacggtgctagcaaggctgccgcactccccctgggtgggccgcgcccttaacccgtgcgggccccacctcctttctcctcccccactcattttcgccaacttaggagcccgagcacgcagagaagcccttctcccctctctcccccccatctctactcatcaaatccactcaatctttttcacaagttttttttggaaatcgaagataaaggtatactcctccattccatccttttttttccgttttaatcggttgcatttgtagatcggagggtacccctagaaacccttttaactttaaatataattaaatttgaatcaaataaaaattgatctcattggatttatttttgggttataagctatccttctgggaagtcaaaatatcataaattttctcataggaaccacctccattctttcaacacaatatttttttataaattcaaaactgcacgatgtcaagtaattttactttagaatttatatgttgcaagggtaattataagaaaataatcagcattcaaagcatactaaataagtttatttttcgtttagtatatatacactaaacatttcaataaaaattcacccccacaaatttcacttacattatataaggtgcccgcgcatgtgcgcgggctatctttctagttgctgaagaagtagcaggaaaataaatgcagaaacaccgcgatgagggtaaattagtagggtaccccgttttcatgcaccgtgataggcatgaaacaccaataatgcacacaaataatttaaatgtgtaaattattagatgtgccaattggtacaaataagaatgtttccttatttcttctgctctacttaaaattcatgatggaaacttctctagtcccgttaatccaaatttaaatgtatatattattagatgtgcaaatttgttcaaataagattgtttcattattttttctgctctacttaaaattcatgatggaaacttcactagtcccgttaatccaaagtccaggtgccgagggatgaatgactattgcctctcagatgcgatacgcattgtagatcaattgccaatctagaaacactctggcagaaaatgtttaatcgattctccatgtccctacctcggagcatacattttaatttgaagagagtatgtacgagattatggtggaaatgggattttatatttgcagaaagaaaaatatgttctcaagatgcaaatatgacaaatggtatgtctactgcatgattgacagtacatgctgaaaggatgtctgtttttatcttgatatatgggattaattttatattgattttttcaaagtttataaaacttggtttatgtcttatgatcattccattgatttctttgatttttcttgaaacatcgatactctacttcgatataaggggattccatgctgttgtcaaaactacagtcctgtagaagcatatttacttcatttttctgttttacataacctgttacttgtctcaccgtctgactaactgatcaaggtggagttaaaacaatctggcaaacaaacaaatcatcagcagggagtcatggcgattatgaatcaactcacatacatcacattgtggtactccactcttcaattgatcgatggccattatattatcgatcggatactggctatgaggtcatgtcataacgttcggtatgaaggagagaaagtacttcaagttttccctgtgcagatttcgttccatcagaccatatggaatattttgatcccccatcagttcaacaagcaactaacgtcgcgatgtgtggccatctatcattatttccagatgccttccatgactagacagtgctacctatatacaacacgagaaagatggagagaggcatttgttttcagatcataccatgatttctgaagaactcttccatacaacccatccatctaagcaaacatccaccctttgagtctaagtgtctaagacgatgaagaatgttccttttcctatagcactgctactgttatatcctcatcggtaaaacatcacttatacgatggttggtaatcgtaacatcaaacatttgtacttggacaaaaatttgtcaggtaagaattttacatcgaattcctgaccaagaattgaagagatgaacatttgtacttgagcataaattcgtatgttcaaaacatggtacttctgttctgtactgcaaaagtgctgttgcagcagtcctagttgtaccacgcccttaagaaacactaattcctagtcaatcacttagttcctctatcaaattataccaccagaagtttgagaaagcactgtgtgtcagatgaaatcatttggtagctagaacaaagattcacatgagatatgtagttcggatagagtcatttggattgaaatcataattttccaaacagcggagttgtgggaaacactaaaaagtattggttgaaggggacaatagtgtgtttttctctgtgttcttactcccaggttcccaacacccttctctcgttctccacgcgcacgcttttcaaaatgctaaacggtgcattttttgcaagaaatttctatacgaaagttgctttaaaaatcaaattaatccatttttgaaaaaaaaattactgatacttaattaatcacgcgctaatgaaccgctccgttttccgtgcgtgatatatgggttcccaactagaactaacgaacacagtgtttggttctaggtactgttatgaactttacttgagttgaaataacatcatggctaaatggtacggactgtagtgagttttcaggacattcccaaaatttcggggatttcaaaacgatagttcagagaagccagtgaatataatttcagtttttcatccattagctaggcccaaagcagcaccgcaagtttttcgcattaatgcttgatcccacagctacgtactaagccttctccattgtcaagcacgatttgaaatcaataaattaaaccaacacttcatgacatcaacaatgatgataccttccatgcctaatgcaggtatatataccttcatatgacatgtgcaatatggacattcacaatatggtagagtttcctgagaactcaaaaacgaaacataggcgtacgtcaatgccttcttattctgggaaggacactacttccctactagcagaccgcacacctgttgttgagcaactagcaagctactaggtttcccattatataggtttatcaaaattataattaaaggatttaaagcaggatataccctggtaggaagaacaataactaaattcatacaaagggaatcttatcaccagaaaaatataactttggatatccgcttgtggaggcatcactgtgcccgcacaatcctctgaggttttcaattttgggatgaaaacagagcgatactgatggataatgcccttaccatattcggtttcatatgtggctaaaaatatgacaacaaatagcagatgtaagtctcgatccatcacgagctatactcccataacctcaagtaacacttgcacatgaaaaacaaagcaactctatatccaggtaaaaattttggaccaacttgattcatttcagcacacaatagtatcgcacgcggatagaaaaccatttagaagtcatctacatgaagcaatctagaaaatccatgaaaacaacccaaaaccgactccctcccggattctgccggtctaaccgtcgggttacccgatcagaccgcctgaacacctctggtctgactggcgctcactgtttagtccgaccggcctagtactaaccatattgttcaccgacagaaaaatactattcactgtattttcaacaaacactcaccttcactactggagaaaccatctttgtccggttggccaaaaaccacaatagttctggttgtaataaaaaccgggacgaaagatggtctttagtcccggttcacatgctgttaggggcagtcaggcccctccggtatctttagtcctggttggagtttccatccagcattaaagtttggacctttagtcccggtttgtgttatcaaccaggacataagacccagttggtaacataaaccgagactaaaattcgatgtaccatatataatccctaggacttatcctcccaaactcctcatctcctattcttactctctctttatctttttctttgccttatcctctccttcttcagatggagcttatcctctcctcatctttctttgctgcagatcgagcgagccagcggagggccgcggcggccagcgcccggcggtggcacgcggcgacggccggcggggccatcgcacgaggagggaagcaccggggagacggcagtgggcgggcgccagccgccgaggtggcgggcagcggtgctccctaggcggtggtggaaccataggcgtctaggcgggaggctggcgagttgtggcggacggccagcgcccgatctgtaaaatttgtgatgtggattttttttctgatctgtgcaatgtgtgtggccgatctgttcgacgcgaattcttttctgatctgtgcgatgtgtgatatgtggatgtatttggggatataaagaaaatacagcttgatgtatttcgggattttgtgaatgatttgtggtgttcgaatgatttgtggataattttatgaatgatttgtgttgctcgaaatcatgcaagcaggaaaaaaaagaaaaaaaatcattacttccagttggtaacttcaaccggaacttaatctttagtcctggttatttcaaccgagattaaagatgggcatgtttagtcccagattcgtagtcccggttgcataaccgagactacagggggttgcgaactgggattaaaaagggttaatttctctaccagtgctttgacaattgttcatcaccaagattaggcatcacatgattctacaataaatcttcctatggtttagaaccgtgatggtgaatgaactagcataatccgtatgaatatttaaaatatgaaaactattctataaaagggttctctagaaataagcttacttcctctaaccctatcaataaaagaagccagtgacctttttacttaaaatcttcaggtaagcttcaaaaaattatactatatagtatctcgggcacatgatacatgcgttcggtatcgtggtgccaaattaaggaccaactaatgcgtcctatgtgtttcgacaggacatgttggagatgaatcgccaatattcaatgcactgtagcagcaatatcaattcatttcgtcgcaatctagcttgtatcatatatttgaatgtattatatatctacagaaatatactttctctgtttcacaatgtaagtcattctagcattttccacattcatattgatgttaatgaatctggacatatatatctatctagatttattaacatcaatataaatgtggaaaatgatagaatgacttatatcgtgaaacggatggaggacattgtatggtgctcaggggagctgttatatataccaccttgggagattccagactacatcttgacgccgtgttctgaaaattcgaaagttaattaaatagcagatgtacgttcaccagaaaaattgaattttacattcaagacagatatcaagatacaaaacatttcaagtaattgtacatctacttcaattcaaattctctttacatcagcatccacaatgaatttgaaattgattttttttaatgtttacataactttgcgtgtaaaacatcgattggtttatgtgaaatttttgaaaaatgtcgccatccccgtgctcgaaaaatacacccaagcagacatccattggttccatctgcctaattcatcaaacaagagttgaagcatggcaattgttcaacaaaaccctctttcattcaggagataatatggcggagatgtaccatcgtggttaggcacacaatacctgagccgctgagccctgtgggtgtcattaccagttgctgcagctgtacaccttgctctgccactacggtaaagttatactcttcgaggcacaagggagccaaagtgcttagctttctcgtgtatctttccttccttcaaaccagatgttgtatatcactgtctcccaaggttcgcacacaagagttctcaccctccaggatgggcatactaaaattccacatgcctttcaaacctataatatacctctgtttatcacttgcaagatagagagtggaatttgaattcatattgtggcatacatataatttctgaagaactccatatgcaaaccatccttgtggcaagcaagcaccctgcaactgagagtctgtcgaatggctccccggtagcaacattgcatttatcgtccccagtgaagcctcacttatataagatgggaattctttcctgaacttttgtagttggccattaattttgttgttaggttcgcatatgctactgcgtccattacttcgaaaggtctgagaggcgtcaggcttgcatgcacgctgtgatcggaatggtcatgttcacccaactgtcatctatctatctatctatctattatctatctattattatatactaaaaatctatgaaacttcctacaaacgctcctacgctgccatgtggcactcctagaaatactcctagaccgccatgtgtcattctacaatcctaccgtcgattttcacttaaattggtagacccattattttagaccgttagattatatgcattgttttgtacttcctacatatactaagagaatcagattaccagaaattaagtacgaacgtacaaagatatacctatcggtactgttcgtttgaaaaaaaaaacaactaacgtacgtatacgatgaaaaaaagctatcaagaaaaaaaaaacattgagatattaccattcacgtgaataaaaaaggaacatgcacatgtatgc

SEQ ID NO: 16853 - DNA, 2720 bp, Oryza sativa
catcggttttttacttaaacatcaacacattattttagatcatcaaatcaatcaatatttttctaaaaaaaagaaacatctcaacccttcctccatccccgttcacttgcagtgtgcagcattacttttcacagcttttatatctctatgataattaaaatttaaattatttttatgagcaaagaaaagaccacaaactaatctccacctattaggtctagccaactattatttttctaagtgaaaacaataacttaatgcccatattgactatattaactggtaacaaaaaattacattatgaacccacatccatattgaagcctcttctcaataaaggtaaaatttacaataggacatcccaaaaaaagtataattagctaagagacactgcaagaacgtatatctgctatgggacaccgcaaaaaactggtaattagctactagatacccgtggtattattttgttatatccaaaggaaaaggggagagaaacaatcacgaaagtatgattttgcccctttctgccatgtgcggctcgcatatcgctctaacgccgtggtagtcacgacatgggcggtggagggtatggcagcgtggcgtgccacgactccgagatcgacaacaatagcctgcgctctgtgacaccctactcgacatgaattaaaaggtggtccacgttgtgctcaccccaagcgtggtgtgtggcggagcataagcgccagcatagccctcacactgtagcggcaacaagtgtggaaatgacatggagccacaagcccaggtgcacgggccctccttgaccccctcccccctctctagagagccacctcaccaccggcgggtgctgttgctgcgtcgaagatgtttgcaaggcagacttagtaggtaagggaaaagttatacttttgttattgtctctctctgcatttcctttggatattataaaataatatcgtgagccaccagtagctaattaccaattttttcggtgtgccacaacagatacgcgttcttacggtgtctctcggccaattacatgttttttaatatcctatagcaaattttaccctaaagaaaagaaaatactaaaattgctcactaaaaatcaaaatatcacagctcaattttttataaaactagttgacccattatttatatcctgatagacatctaacgactttctatcaactttttctcagcttatatatagaagctatttacccatacattttgatattgatgcttttatcaataaatgatcacttcaggagataaataaataatcataaaatgatcatagcttctaaattatttatatgatctatgaagtcacgtggccagttgaacaacaaaccgattgtactgggcacgttggttgcaccaaggaatcttaagaatgaaacaaccatgatgtggcctcagctatatataagccaattacagatagaaattaaaagaccatatctatttttttggggtaaaacttcctacagtacatcgtgaatttgtgacatataggatagaacaatctagaaatatgcaattattacatgatattccagtttagtggtaattttctaagaaaatactacaacatctattttatttttttcttacttaattggagcgagataatttagaattgatgcctttaccccatggcaggttgtaggatcaacccacatatattttcattctgacttacagagatcaaagcatttcaaaagatgcttcataaagtggatttatccaaaaaaatggagattaaaagaaatgaaaataaaataaaatttatctaatttaaaatttgtttttgttgggtttataacccattctaaatagaaatattcaaacatttttgcaagactaataaaatgaatatatttaaaatttcaaacagaatctaacaaaaataattggacattcatagggaacacatctattgtttcgacacaaaattttctcatgtattagaaacaacacggtttaaagtaattttagttcaatttatatgtttcaagtaaccagcgttcaaagcacgtcgaattagtttaattttagtttatgataaagtgaaagaatatttttgatagaaaacaatccacacatggacattcgtaaaaaaattttacgcacatgcccgcgcatatgcgcgggataccttcctagttcagttttaaattattggagacggtttatcatttgcctgaaaaatattactcacaacatttctttatgtcgtttagctcatgacctttgaggatctgatttagttttacttcagggaattatcatcttgtttcgcccgttttcattaaaattgaaagggttatattttcactaggaattgggcgcgcatctcacttttgtcattcagtgcactaaaacaactgtattttttttcagtagtgatttaatcaaattccggggttttgcacatcagcagcactccccccaaaaataacatcaatagaaaacccaaaccaaaaccagtactcgctgtaaaattatgcacctcattgtaatttgaacaggggcagtgccatctcaaatacaaaactggagttttagttttgcgttttgtctcgaacatagaacatcactatcccaagaaatagtcgtgagttgctaatgcttgtcaagttccttcctggtagctagcttgaaaattatgcagactattacgcaataaaatttgtgcatataccatgcttgtc

SEQ ID NO: 16854 - DNA, 1308 bp, Oryza sativa
cacatatatctctgtatgacatatgcaatttcggatgggaaaattgaacttatattagaacgtggtatgattttgagaaagctcccaaagaaaacatatgtatggaaaacatatgtagcatgagcctgatcctcctccagcaaaacataaactttataagacggtagtactgacaagaccgttcctcacatggccatataagtgtatatttattttctgaaaatcctcacatgggattcctcactgaaattcatgtttgtgtcgcccgttttattaagggtgagactaatcacggtgaatctggtcgatcgcccataaccacgggcatggctattctaatagttttactctggccagaggtgcacaactgtacccacaagacacaacccaccgccatgtcacgcgcctagccggacacgtcaccatgctgagtgattgtgacaagacccttcatataaccccctctgaccaagcacaccacacctcaggtttcaccccccactcctcaacaggcagtgggcagtcccctctcgtgcctaggtgaatccggaagcgacaaaggccgtcgcagagcccatcccgctccatcacgcgcacccttgcctggatgcgtcagccagaggaaagctatacttcaagtcaggcagttacctattcccgcttgtggcaagcattgtatgtcttccagggtttcccacgaatcggtccaattgccctgggtgtgaccagcaaaaccatgcacccacagcctaccattcagtcacattttagttggataattatgaccaatgaaacatggccggatgtcccgagcacgcagctcgtctagatactaagaggtctaatactgtaattatcccatcaactaagttacccaaggttgacaaaggacagacatcaagtaaatatgacacaagcaagcagataggtaaactctaatcccatgtaattagcaaaacatgcatatttatttgcaaatgataaaacatttgtaaattaggatacaaatgctcaaggggaatgtgtgactttccttgcttcttcaaacaaatcttctggactcttttcctcgtgaccgcggacttccgaaatggcggaatctactcgctgacatgcaaaacgaggaaaaactcaaataaaaaccaagcaaacaatacataaaatgtaaacaaacatgtagagctcaattttagatgaattttgcaagttgagttgctcaatttggagttcgaatgaatttattatgaatgtaagaatttttgagcaacataaatgaatttctagaattattatcgaattattgtgcaa

SEQ ID NO: 16855 - DNA, 911 bp, Oryza sativa
gggtggcggcgcagcaacagcacgacctcctcaaccgcgaacaggtcatggacctcttccacaattgcatcaagctcgcctccgagaacgtacgcgccttctgtacctaaccccccctcgtcgttgttcttccccaccgccgcgccgaaaccctagggccactcgcgcgcgcctcgtattgagttcgccttctttgtgtttttgttttttccccctcttttccgatggggaatttgagcagaaaattaaccagaagaacacgtgggagctggggctcatcgaccacctcagcgagatcatccaggccggggaggaggacgacgacgagaccaatttccagaaggtgcggctgtgctgatttcttccattttcgaccttctttctactactaccgtgggaggagatttgtgacctcttctgacttcgattgagaaatttttttttaaccattttcttgtgaccaggctagctgcacgctcgaggcgggcgtgaagatttactctttgcgtgtagattcagtgcactctgaggcgtacaaggtgcttggaggcatcaaccgtgctggaagaggcgatgaggctggtaaatacccactagagtttcatagcgctttccaatttttactgtagccattcgattgtaattcgattttattcatgtgagtcagcttcgagttgcaaaagtattattagtattctgggcaccactaaactgtttcaggtaaattcaaactaagtcaacttacatgatagaaatttggctttgtaccaaaaaaaatgtccatctataaattgatcgaacaataaatagaaagatgttttaagattttttttaagaaaatcaagtccctgtgagaaatgggcttttctgacttttgggtcattggagcactcttcagatttcacgatcat

SEQ ID NO: 16856 - DNA, 729 bp, Oryza sativa
attcagaaccccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctgacacctggattatctccacctttcatttgatccctatttatagagtacgctgcgttgcttacg

SEQ ID NO: 16857 - DNA, 20673 bp, Oryza sativa
cgatttgaaatgaatgtctatccatgatttatcaatatgcaccaaaagtaaaacaagatggacttctttattttggccagtttctgtgaccacattgcacacaattagaactatactagataaccttgctgtcacctttagaccaattttactgtacataaagtgggtaaccctaattcaattatcaattcctcaaaccattgcaagtcacagctataggaaatcatcaacaaaattagttctgacctaaaagctttcaagaatcatatttagtgagccataaaagctcatgattcatgcactccaacaacaccagtagtatttatggttccaactcatcaactatttttctatgcaaaaacataaataataccacatctgtgaattataaaagaatgttaccaataactaacaacttagttcaatgagtaccaaagtgcagccacttttccatgatatctttcaactacacacttcgaatttgattaccagttaccaaatacagttcattgccatgctaccaatcatccatataatttttaaaaaggaactacattgtaaattgattttatcagtactatatatgcaacaaaagtataaataaatgaataaaatagaaggcatttatggatcatgtcggcagcccaaaagtcttccaggctgttaaatagttctacactgctatgttaactttgtcctgaaaattgctggactttggataagcataacaggacaattcaatgtaggtaatcagcaatcaataggcatgatgtacaacaaattacagagtgtcataccttgattgagtacaaaagatctgagaaattttcacccagacgctggcgcttctttgcttcctttacctccttttccctgagcctttcaacttgatcatcaaaaataagctgcagcagatccagcaaagataagtaacaatatcgacaaaaattcttatcagtcctacaactgaacatggaaattgttaccgcaagaacagcatcaataatacacatatattatcatcttcatcaaacataatcaaattttcagggtgacaaaacaataataccttcatgtttatgtttgttattcctttcaaagtatcatcctccgtaacagcagtttcgaaatcctctagtgtccatgaagtcgtcataggaatctaaacaaaattaccttgtcagccagatggcaaactaatttctacaggtaaaacttacctatggagcaagcttgtaaaataaaaggtacctttccagacttcactgcttctttaattcgggctttgtcatcttgatactgagataaaaggatggtaggtacataagttcatgcataacaaaaaataacagatattccagaatttaaatggtgattgtgatgagatgaaaatattgtagactcgtgcttttttgtgacatgatggaaataaaatttgttattgtgttttacaaacgcatgagaatggatagaattaacatctttcagcaggaccaagatgtaggtttttgccatagccgctggccacctctattcactacagattttacaagccatgataattgcaattccaaattcaggcatagaggcaactatagcacattgatgacttaatacattggataagcaagagtatactactaattttaaaggccaacctgtttctcaagctcctccattacatcttcaaacagatcttttggcattgaaccacttatgttcgaggccacagccaagtacacagaggaatctttaacctgtaaatcgataattttatgaatcaagaaaaaaaatgttgtcattttaatcgtatttataaaaggtcgatttcaatgacctgggcacagtaatcacgccaacgagtttttgcagtaagcattccttcagctacatgttcttccaacatcttgcgaaattcatcacgatttttgcgctcttgcctccttacttgttcctgacagaattgacttatattaaacatccatagtggttcaagacatcgaacaaaaaaaaaagaagtgaacgttatgtgaccaaaaaaaccttatgtatccgcttgtgctcttcctcttctttctccagatcccttatatactcctggattgcacagaaatgcatagttgaagcacaaaataaagaaagtcactgcagatctaaaaaaatactaacttggaaaatctccagtcgatcgatcttttcaagtcgggaacagcgttcatcatcctcaagacgttcttgaacttttctccactgggtacttgtctgcagcacagaaatatatatgtttctcattgatgaagctgtttgcatactaattgactaaacagttaataggagtagtaatgaaacaacctttatgaattcacatgactcgagaaaagctctatattctgctatgtgccttttgtgctcttcagcagccctggctctttcctataacaggatgatcgtagatacttagatcttgatccatacagtcaagtcatgccagaaaaatctctagttttgttcttagacatactaaaaaaactaagaaattgcagaataagattcccaaaagtgtattctacaaacagataagcccaacaccaattaaaatttaaaaggggaacagaatttctataagacagaaccttcttctgtagttccataagatagctctcaaataagtcttcacgctcccttggacgctcaacagcactaaaccgttcatcatcctcaaacatagttattgctttactgcataacattgaacacgaacaaacataaggcatcctccagcacccccacaaaaagttacaatgtaaacagcaactagaaactaacagtttggtaaacaaaattgcatcgaactatcacaggactgttattatgtatgaatagaagcttgaagtcagtggcgcatacctccatcttgttgatgaagtaagctccttagattcctaaaacacatagcagaaagtaaaatagtcagtatagtcaagacaaatgagtattagtaagggacataacatgagttagatatcttacttctagcatagctaaaaaatcatcacgtgccttccgctgtttgatacgtctttcttctgcttcaagctttttcctctggtttagatactgcaaaaacaaataggcctggcttcagtgaaccactaagtgaagaataaaacaatgcaatagaagacttcaacattccatgtaattgctaagacagattctagctcgtacaacaaagagctaacctcattaaaagcttgcttcctctccccaagagttttgagggcaccataccttttgtcatttatgatgaccctcatagcctagacatattatatcagtgtcaagcaattcattaactgatatcgattcaagtaaagttacatacctgatcccatgtccaatcagactcaacatttgatgattcaagcagagctttgaacgcatttttagcttcctataagtcaaaagaaaagtgtacctatatgagcttaaaacttgaaatgcacagtcaattcttaatatgtgcaagtttcccttaccaacttattagcataggtcacaggttcttcttcactagttttgtcttctactggagtaacattgatcttccctggaactgccatggtctttttggcctcctacagagaatataagcagcataaatgtacaggtatacacatataaacacatacatacagacagacacacaaacacacaaacacgagagtgagatatatcaaatgcaaatgtgtaggcacttagaagagcacaactgtgaccgtcggcatagcccaaccctaagtaggcctaaatttcttctaaggaattaaactcaaattgacatgcttctgtcaccactcactattccctacgtcccaaaatatagctacccttgtagttcactgagggagtaggcaggatgatttccttatcccaactcacgctaaccccagaaaaaatatccaagacttgaaatgaaagaataaagatgtagcaaatgatatttctctatttggagtaaatttcacaaaattacagatatattgaccaagctatcgtaaaactatagatttaatactaaatttatcacaaaactacagatttaaggtggagtattgcaaaactacagatttagtaacaaagttatcacaaaactacaagtttagcgcatatttaatcacaaaacttggacgtttataactcaaacataacattagtattaaggatttaaaccataaaatctttagttttgtgacaattttattattaaacctgtagttttgcgatacttagtcttaaacctgtagttttgtgataaatttattgttaaatctgtagttttgtgatatatatcaccttaaatcaatagttttgcgataatttggacaaagtatctgtagttttgtgaaattttgcatattttcttttcgtattaaacaaagcatacatatccatgtaaggaaaaaaatcagtgtttgcttccatccgaattgagtcacaccttgggatttgtattacagcaattcttgtacaattgtccaccctaacatacgttccaagtaagaagtagcatgtatcatggcaatattgcacaggatggtgataatagatattttcaactgaaaattcaccagtgtgggaataatgctcagactattaagctacttaacatgtagaatatatccaatcaatcctaggaatcacagataaacgatactgttacggcaatacggggatacgaaatttttgaaaaatgtggatacagcaagtatacacatatttcaaagcaggaaaaatatggagatgatatgatattgagattacattgttaaaattacaagcaatggcatgagaaaataagtggtacatttttcttacaatctcatactttattaggttcttaaatgactattgactcccatagaagtatcggtgttaccagagtacaggatttatcagacgtaagttcacagtaattttgaaggaccagaacatatgtttcacattaattttgaagcaccaaaccagcttgagctatcctaggggatctttagtttctttcacgagattacttgttcagataagattttgtttctttcaaatatttgagattaaataagactgttagtgcttctctcatctcttttcatgaggatttggcacagttttgaaatcaatgaaagacaagctaatctatcgcctaactcccattttctctagtgtctactctcccctgcccatcattcaacaacatagctccaggcagaagaggtcataactcaattatcatacacttgcaaatattaagaactcaaactataagtctagaaccctgtgagaggacaccacatgtacctccaattcttcagcagatgctccattttgagtgtcagcagtgctagctagagatgggtattcgttattggctctgaacaaatcatataacaactatattagcaacatttaagtggtgactggtgaggaagcattgagtaaaccatcgacagttacctgctaatccctgcatcacttgcaactgatggaatttctgtgcttataacaggagtaacaacggtacttggaccaccattttgcatggcagtattagatgaactggaggtgttctccatattgtgcgaagggccagcaccaggaggaacagagttcgctgctgcatcaagtgtacttggagcacccataatcgttgtggaggactggttagcaggtacagaagaaggttccacagagtttgaagtgggtccagaaggagcaccagcagttgtttccgtttcttgatcagggcgtggatttgacgccttctctgctaattcacgcgcaatctaaaagggaagaaaaaattgtttatagatatacaacaatattcaataaacaaatataaaatcaaacatcaaagaaggctgggaaacctttaactcatctggaatcgtccatttggattgctttgtcaccttattgtaatagtacctggaatgacagaataataagaaccggcaagaaagtgatttgtttaacttcatacagatgtgatagcatgtgttccatcaagaacttactttcgaccctcttgtgtagtaaattctttccattcagtagaggcatcagctctctgttacatcaaaaaataaataattaagaacacgtaacttttagcatagcaaagatgcagaatcaaagataaagttgaagttgtaatacgctaaacgttccatacatcatttcagtaagaaactaagaacatgcattgtcctctcgtggaaagagtaaagagttcattctggaaatagaagtagtcaatatagtgatgaattccaattcaccccctttagactttcaagatggtccaaattgaataagcccctcaactttaaaatccagtgcagtttacaacctgatggtggaattggtagtagcaataccaatccaaatggtggctatatcagacaagtcagcaaaagcccataagccatgaaaggaagtcattgcacatattcaggaaattcatgtaaaaataaacacaaatctctctttgactattcctcctatatctctcctctttctattagatggattaccaattaatttagcaacttaaacttaacaagaccaagatgccatgtatgtgaccaacatgacagttgcttaggaaaccacaaccgaagagtgtttagtacttcctttcaaagtggagatgagtcagtaagcagttttgtagtgcgtgttaggatatggactattgtaaagtagatggaagtagaacagaccattccataaattttaagagatagacagaacaccctaagggaaatgtaacaagtcatgacatgtttagcatataaaaaattaaggtaaccgaagaatatatctacaaaaaggtaagtgtagatgacacataagcacacagcacaactaacctccaacggtgtcatcaactcagcaggtttctcccaacttgattgccttgtcttcttattatagtagtaccttaaaaaggagagaaatagagaaagcaaccaaataagaataaaggtgaaaacttgcaacacaacaaaagatactgagcaccaccagaaagttaataacaaaaggtaagtaggtaaaatgattcaacttactttttcccatcagctgaagtgtgctcttgccagtctgaagagctagtttcgctggaattgatctgttcatttgcaaactcaattattgcaaggtaaggatgtcatatttgataaagcacagtagtaaacttaatacagaaaaataaactgattcagaagagatcagtgatatttactgaaggcattgtagcggaagatgacatcggctgatgcccaggctgcacaagaggtacattctgacctggagctgtaccccaagattgcactatgggaggaggaacagatgatggttgatactgcagtgtagcctatactagtatcagtaacttatcggcaaggggtggcattcaagatccggcaatagctttgtgaaattaaatacatatatcaaatgaacaaatagaatccacaaagtgcaaggaaaaataggacttgccgtataggatggaggcggtatagggcctcccatggtgggcatatggcctccagagaatgtcgctggcggctgcagaggcccagatgacataggtctagctggctgataagccataggaactgcttgtgatgcaggtggaacttgaccagagtgaggcaagtgctgtgtaggttgctgaaaatgtggcatctgacctggcatgccaatattagctcctggcatggcctgaccaacaggtcgaaactgctgccccggttgcatgaactgaggaggttgttgctgatgaatcaccggcctaaactgaaattagagaacgagatgacatattaggaatgtaaaatatgattaaaatggtccatgctgtggatacaaggggaaaattcaatcttccagtttacctgcataggcatcggaggtcccagattttgtggtgggacactagagcccatcatagggggcctagattgctgcttgagagagagagaaagagagaaagaatggtaaaaaattagcacatcacacgacaaaaatcaaaacttcacactgaaaactgccatccttaaaacaaccagacaacatttacctgcggtggcccagaaggttgcatattacttgccatcaaagcacatcaaaatgtgatgcgaaaaagaggaaacaagtttttcctaatacagtggctgccaagtgacaaggaaaggaagaaaatgacgggttaggacattaaatgcttacggatcgatcctcttccgaagataactgcaatatttaactaaactcaataacaaacttgctctgccagctgcactttggcacagtatttagacacaaataacgctgtgttagtatttagtaaacagggtaacggataccggcttttggatccttcctctccctccctctctcagcgacagaagcgaaagaagagaacttaccgttaccataaaaacaaacatgtcttatatacatagccaatgagctaaaactagatatcagtccagtgacctactagcgggtatagattagacatttgaacacaactggtctcctaaaccacatgccctcatatacatatccatgaaaacagatttcaaattttatctaagcacgacccccccccccaaaaaaaaaaaactaagggaggatcgaattatcagaacaaaaccacgtctcgtgttctgaaaaaaactagggcagggacagatgattccgctaaaccctaaaacaactaccgggagcaaatctatatgatggataagggcgattggtgcctatcaacgagaacagcgaaacgaacagaactagaaaagcagagctagggtttcgttactcttaccgcggggaaggaaatcaatccaggtccggatccgcgccacttccagtagaacggaggacgacgacgacgccgtctcaaccacgggagaagacccacccgagagaagtaaccccccttcgattcggggtggcaggagcgcctcggcggaaggagacctatagggcggagcgggttccggcggcgcggggcgagggcggcaaggagcccggcctcggcgccccccctgcgagattacggttgccgcgcggcggcgcggggcgagagaccagtagcgagaagagagagagagagggagagatgcggcggcgttgtctccacacgccggcggcaagggcggtgtggggtggggttggggttttagggcaaaaagggggtgcgggcgccgagtcgggcaaagggcgggcggggtggggttggggtcccaaaccaacgggttaccgatacacacacccctttcctgtctgggaccgtgggacggcgcggggtatgtatgtgtcaatgtcatgtattgtatcggcgagggagagacgctgcttggcgttggatggataatagcaggcacgcgacgggagttttttgctttgggctttcggagtcgcgttcctcgcctcctagaaggaataagttcactccaggtccctcaatttgtcgccgagtcttgaaattcgcccctgaaccgaaatatcaggtgtacctcatcccaactcacaataccatgtcaattttggtcactcggcagtaaagtagttgtttttagctgacgtgatgagtgggacccaagtgggcttgtcagcagccaactcgtctccctgtccctttcccttttccgtctcttcccatttctcagatactcaagcatcgagcagggtagtcggtgaggagggggtcacatacgatctgtagtggtgaaggggagggacttcctcatcatcatgcgcgccccgactgtgcacggggagtccaccctgatcatgctgagctgcacctatcagagcatggtcaccatggagaccgtccacatgggaggcgacacggggatcgtccctctcatggtggaccccgtgaactacgacgtgttaccgaaggtcgagtaggagctgcaccatgtctaggccacggaggacatggtggtcatgcgcaccgccaccgagcagagcaacttcaagctggttgttgccgtcctcgaaaagcgtcatggcgtgctcaagtcacgcgcggaggagctatacgacaaaccgcggtccgtgacgtaggcagccgagctaagggagatgcaggacagggtggtgatgcgtcaggagatagaggactttggtaggggcttaatgtgtgagaaaagggataggaaaaggtggaggaatgggttcaccttgacgaggtggagttggtggcgcgaggtttggccaacggggctccggtgagggagatcgaccggcggcagcgtggtggccagacatggtagagagagaagacaagagctctaagagtttggttgtgggggaaaatggagacatcgttgtctcttataggcagcgaaaggtggttgcaatggaattcgctgatgaggacacggtagtggcggcttgagatggaagaaagcgacgccggcttcgtcttcctattggttgcccatggtggttcggtttggtgacaaacaacggatgacgtcggcagggtgactcacaactgaggttgggcagcggttagggctgtcaacgagccgagctcgagcgagcttccatgtgtaggctcgaactcactatagactcgagtcgagctcgagccgagtctaggtttgccacgagcttgaagttgagctcgagctcggctcgttcgagcttcgagcttttctcaagcctgtttggtgcggtggaatactggaacaattcattccattcaaagaaaaagctgacactgtgatgcatgattagacggctaaggccctgtttctttcagcttgggattattataatctagattattgagtcagattactataagctagattgttataatctatagtagaataagcggttagttgtttctttcctagattattgggtttgcaagtctaaagagagagtggggtggcatggtgggtaatttttcacccaataatctggaaaaaaactcacctaaatgagcttatcagattataataagctgggctccagattataataagctacttcaataagttgtctgtttctttcagcttactcccaataatctggattataataatcccaagctgaaagaaacagggcctaaaagtaatactagtgctcctatgtatactaatgcaactgtgcaagccgcacactagtactcctactctcttgttgggaaatgggacaacaaatgcatagtgctccctctgccctggcactgccagtacttgtgcagttgtgctactccagtactactagagaatttgaccgagtaagaaagagagagaaggggaggaaatacctaggagaaagaacatgagccagatgttgaggctcgccgagttattcgagctcgtgttggtaggctcgtgagcttaaagtcaagctcgagctcggtttgattcttagacgagccgagctcgaatcgagctcataacaaatcaagctcgagtagctcacgagcctcgagcatttttgacagctctagcagcggttgcttggcggcgacggcaagatggtgatagcagtgcgtgtgccacaggcacccacagggagtttggcagcggtacaaggagcccggccgtgcctacatgcccgtcgccatgagctcccactcatggcagacacccttcatggctaacatgtggggcccacgtcggtgtcactcgccgcgtcagccaaaaccggccattatactgctgggggactaaagttgacacggtattgtgagttgaaggatatacctggtatttaggttttgggacaaatttctgacccgacaacaaattaagggatctaaattgaacttactccctcctagaaagagataatgagaatatatggtgtggactggaccgagattagggtttgagcaggcttaggccctctttgtttaggcttagaccctctttgtttaggcttataagttaacttataagccgaaaaatctaagcctaaacaaacgagcaaccttttcatttggctttttaaaagccataagccactctaacactattaagccaaaagctagattagagaagcttttttggcttatgtgaggtagatgtatggctccgccactaaacttaggacattaatccaccgacttataaatcatataagccaataagctgacttaaaagtctaagcctaaacaaagagggccttataagtcaacttataagcctaaaagtctaagcctaaacaaacaagcagctttttcatttggcttttttaaagccataagccactctaacactatgcaaaaagctaggttggagaagcttttttgacttatgtgaggtagatgtattactccactactaaacttgggacattaaatccatcggcttataaatcatataagccaataagctaacttaaaagtctaagccaataaacctaaacctaaacaaagaaggccttagtgcatgtgctggtgccaacttgccaaatcttaacaggccatctaggatgaatttagatgattaaatgggcttagtatatataaattttatcttactaatgggccatctaatggtgaacaggatggttaaatgggtttagtatatgtgctatgtcctttagcacacttgccatattgtaacgggctatctggtggtgaatgggaatggagcgcactccactgggctcaactgaggatgatcttagcatgctaagcattcccagggtgaaaaataactcgtcaggttctagccctactagactcggggggaggggggcattgtcatcgctaacctcgtagcccgtaagcctttgtgagttcactaggcatccatggaaaaatacttgttggagctgctatggttgtaagtgatgcaaaacatgtgaagtaagtgcaagtgcaagatgttgaatgcagatcagcagtaccacatagagccatgtagcaacaagcttacaatattgtgagtctgctatggtaactgacgcataatgttgtagaattttttttagcaaggctagttgatttataatggagtagcttttgcaccgtagcgaataatatgaacatcaaatgggtaggaggagctcctcctatggcatttgactttttgtcttttgcagtagtgtgttaaatacatcccatttggaacatgttcgtctagccatcatgtcacttcagtgctcccttctaacaaatgagctaggttgatgcaaacctagctagatcaaatgatatattaacacgttgtcaccctttgccaatagtcgcattatatgctaaagtcaataatcatatcagatgtttaaatagttaatattgtggttggaggatatcaaatttatgatcattgtagttgttggttcataatcattctcctaccactacctattgcatatcatgaatgaaggccaaccaccactaactgcaacaaggttagttggagggaaataagaggaagaggcataaatatatagactttgtggtgatgacaaatatcatgaaataactagtacaacgtatagaagtttggttcgaggagaaaaaagaatacaagaataggaatgtaagagcttataagatgagaattgattgagcttaccggaaatttccttattatattattttcaagataggagttatgctaaacataacaaataaagggtcaagttagagtctggtggtttctcggtcaataacttaaatatagtatcaaatacaccttaaataccctaataaagcatatcaaaacaataagcacacccattaaaggagctctctctctctctatctatctctctctcatgtggaccaatagttatttcttcacaaaatcttccttgcgtgatgttgcttaggggtgttagtcggttgccattgccataaacatattgtggaaattcatgaaagaagctaacaaatcattatctaccaatctactttgttggagcatcacatgaggatatggcggtaggctcgtgatagtatagcacttttagacatactacatatatagttaacatcctagccattgttcttcactttgctatagttgtttgtgtgcccttcgacactattcaccattatcagctccacatcatcctacaacattgtctaatatttcacgtaacaagaccactaaatacatgtcttcctatgcttgcaagtatacccatcgcaaacaccaaggattcctcaccattccttgtgtgtccatgtattaattaaccccatgcatgactcacatgtacatttgagcaacatccatttattcatgtcttggtatggcacttgatcaatttagacacagtcaacatatacttatcaagtacacatgtcctcgaagcttatcacaattttgaggacaaacatattttgattaaaaaacatatttcataaaaggccaagtctagggtcatgtgtaacaagaaaataaaagtttaacaagattttgacacataaccgcatggatgcgcaaataagaaagaaggccaaagactagttcgatttagatgaggaggcatcaagcacgacagcaacatagcatatgttcttcattttaggctagctacttatttcattcaattatgaacagccatatgctatgctatacgtaaataacttcaaatatgaataaatttgctcttctattttatattcttttgtctttctagtttccaagtaatttttttatatggttgatggaaaaggacaatgaaggggaattctgtgtatcgtgtagctgctagagttcattatgtgagatgttgattaagaacttaatacatgatggaaaataaccttttttttgcttgtgatggtcatctcctattatcatttattgttttaatcccttaaagaaagtgtttcgtgttgcaaacaacaattatcactaacatcttattttacgcatccatatgattattaataatatacaaacctaatcacacatagataaactataataatattgtcgatgttttagatcacgactacggaatttgcatggtatggagattgttggtaccagagtatatggagggggtcgcagtcgccggtggtgggtgtcagggctagggctctccatccttgaataatgtcttcttcagtcagctcctatatatggcaattaaactcgattaatcagtggttgggtcgatttcgccttctcgtatagggatcagcctctatcgtgtttgctcccaactccttgctttccaagtagtagtactctaactcttcttccataacctctcccaccttctcaggcttgggaaggtagaggaggaagcggaggaagagggatttgttaagaggagagaagactcggaggagggagagatggacaggggctatgcgctggaagagaggatttccggtgtgggatgacagttgcgtcaccctttcttctatgaagcttgttgaaactaaaaaacatgaactctataaattggtatacttgctcaaactggtattaccaactacaggtggctacagcaagtgttgaaagggtgttctctaccatgaatcttgtgaagaccaagttgaaaaatagtatgggcaatcaagtcttgaatgattgtttggtcacatttattgagagagatattttcttgaatattagtaatgatgctgtaatggagcgcttctatgctatgaaaaagcgtcgtagtgataaacggcattagattgcattgtttctgctatgtaagacttattttggactatttgcattgtgttttaataatttaagacttaatttaatttgaactaattgtactacattcggataatttaagatgtaattgtacttttgtgcttgaggtttttgttttggcttgtccgccacactgcctccactacaagcaccatcgactaggccgcttcatcatcctagaccacacaacccctccccctccccccaccctccgtcatcgcccttgttagatccactgcctaggccacgacctaagaagatcgatggcctagtttgctggaatttgaaaatatagggggaagcaatggcaccaatgattggaaaagcagatatggcaaaataagaagatattagatatagaggggaagaagtggcggtggttggatctagtagagggaagagtagtggttgtcgtccccatgggtgtaggtgttagtcaatttctttgtgatggtggttggcaacaaatgtggaataaaaggtaggtagggagatataaatgtaagtacatgtttggcaaatgggcaaaggatcttgatgatttttttatggttctaggggctattttgcacatgtatttctgtaaaatcacattttaccaaattttgtgagctgaaatgctaaattatttacgcctaatcaaaaccactgcgcattgtgaagtaggatctcaaagagtacactcacccgatgccattccacaagaccggccactttgtattttctctactactataatagtggagccgttctccttccattccctctgaccgtactgcacatgcgcaagatgagagaaaaaaaagaaaagaaacgcttgaattcggtgctttaagctcgatctatactcccaacccattcccaattatatgggtcagtgcaacccaattatatgagcatgttactagtaaatgcttgaagttatttgcctagggcagtaatagaggtggcattacttgctaggtgagtttggtggaaagagtacaacatagagagaagcggatatgtggggattattgtgctcaaagattggctagcactccgatcctttctgatgactgatttgaaacttggtagcaacacctcatggtcatggtcaaatatagagtaggaaccttccctctcctatacatgtatatttgtttttgcatgcatttaactcagatttgctcgagtcagaggaagtaacacttgatcagatgaataacgatatgcaattttattggcgatcgatgctcatgcatatatattgcgcgtagaaaaccattatgcatgcatatatatgtcatcaagatggaagaccagaacaactcctttccataacatttcttactttaggagaaatcaacctctcctataaccttgaaatatttaaccccaagactagccaactggccatccaaatcaaagtagttaatctatggatgaaggaaagaatgagaaacacaacaacataatatctgttgcttcctcccctgctccaatcctgcacctgtagacacatatcatatcccccctaccaacaaatgcaaacatctgcatgacatatatgttctccctatatatatactagatgtagaattaattaagttatgatcggtaaggcacatgcatcatgcatgcatgccttttgatcagttgtgtactatatacttggagtatgatcagacttggagttgtgaccaactgatgagagccctagcaaagctacaaggccgtggtcttgtagtggtggtggtggtggtggtacagatcctgcaacttcttccacgactcctccctctgcatcttgagctgcttgtagaagttgccgatgaacgcctccgccttggtgaacagctcttgcttgctcatcatctgctcgccgccgcccccgccgccgcccttcgtccagcacccttcctcctcctcgtggacgacgacgtcctcgccgtccccgcccccgatgaagaagaggctcgccctcgacgggcacctcctcatcttcttggacttcttggccgccgctgccgccggcatggcaccgccggcgatgacgacgacgtccctgctgccggctgcagcctctaacgccgccgccttcggtgtcaaggatggtgaagcggccacaattacagcgctgctactgctactaccgttgacatggtgatgacgaccgttggtcgccgccgcagcgacgtcgacttcacctggtctattgctgtggctcagcctcagagctgcggcggcggcggccggcttgggcagcagcttgtcgtcgcgcgggccgctggagatggcggcgaggaagccggcctcgacgccgagggcgacgacgagggcgttgaagaggaggtagaggtagggctgcctgagggaggaaggcaccaaggggaggaggaggaagaggaggaggagggacgccatcttggccacctgggccagcgttggaaacctcttcttctccatggccatcaccatttgtagctagctaaggctactagagtctaggagagatcagagagagagtaggaggggatcgatcagggtgtagcttggtcacctatatatacacgtgcagtagtgtctactgtgccccgtgtgctctactgtgcaggacacaagcttttaatatactattttccttttggaattaattgaaaaaggcggcaaatagataagcttgcgtagcgtaggtggtaggagggggatagagatcggtgatagagatgacgcacaagaaagaaagaaagaaagaagaggaatttgtttgagaaagtatctaatcttgtgtgtgtgtgtggagttgtggggcaaggtcggtgagaatattccggtcgttttcatgagcaggggcaggcgtttctcgccgtggttcggtgagggggagggtggtggccatgtgggagatctcccggtgggatcgtccatcccccttctgcttaattttattccctgccatgcatgcatatgcgcttgcgcgtgaccggcggcgggccgacggctcgcgcgcggctcccacttgctgttgcggagggatatctctggatatgctgcctggaggtgcatggacaattggtcaattggactggacacatgactggaagtctggaatatggttgtcagggacgaataactgaagcattttgtcaaaaactgtaactttttttttaaaaaaaaagaggttctccatctagtcatcagttgcgtgaaaaatttattttccacccgcattcgatattttggcggtcgctatgacgtagtataatagacacgcaacccctggtgcctaattggctaactcggtgtgttttttgtcgattgcatcttggctcctctgttgttgcgtaaaggaaaaataagtgggcagcactcacggcttattatataccacctccgttttaggttataagactttcacggtttattatatatgtgtcaagattcattaacatatatataaatatgggcaatgctaaagagttttataatctgaaacggaggaagtagaagagaaactcccatgaacattttgtattacgatagttcaaacaactaatagtactatttaagaaataccatcatgatatatagtggccaagaatttttggttgggtagttctatttcacaagtaccggtgaagaagtagaaatttcattcacatcaacgtaccaaaattttctaacattgcaaatcccataaacaaatagaaatttaattagtttaaaagcgatagaattatatcttataccatcactaatcgactaattcaactagcaaggtcaaaatttacaaagataatttagattgataggagcaagaggtgcctcttgttcttgagtttgagcttcatcaaaactatcagaaatgatggtggttcttcttgagttacaggaagagggtgttgcaatcttctttgccctttgcagttctaggaagagggtcctgcaatcttctttgccctttgcttcatggttccgctagagtgatgcaattaaggccctgtttctttcagtttgaaattattataatctagattattgagtcagattactataagttagattgttataatctgtagtagaataagtgattagttgtttctttcctagattattagagcctaaattattgggtttgcaagtctaaagagggagtggtggcatggtgggtaaattttcacccaataatctggaaaaagctcacctaaatgagcttatcagattataataagctgggcttcagattataataagctgggctccagattataataagctacttcaataagttgtctgtttctttcagcttactcctaataatctggattataataatcccaagctgaaagaaacagggcctaatatctgcatttctattcatgcctcaccaattctaccatcctacgaactaatgacaaaggcactggcgaggggatggtggtctggcggtggatccatcgccttccctttaaactccaaccatgcgttgtctcccaagttaccactgtataccctctagattcagcatccctgaggttgtggtgttcttttctcctgaagatgaagatgaagatgaagattaagttttttacacaaaacgagataatattaacgtatgattgattgagttttaattattacaaacttaaaaaatagattaatatgatatttttagagcaacttttatatacaaagttttcgcacgaaacacaccatctagcagtttgaaaagcgtgccacgaaaatcttaattttcatctaactcttgctggagaaaagaacggaaccagttcattggatctaactgccctaacctcatggggggaggatttggagggggctggcagtggtgcttgggatgcatgcagagggcggaggtggccggccacggtgctctttttttgtggggtggaggggggggggggttaatgggaat

SEQ ID NO: 16858 - DNA, 21896 bp, Oryza sativa
ccccccccccaacccccatcccaaattaagtcctaatcacccatccttttccttttgtcttctcccttctccgctttatggctccattgacaggccatgatatttgattggtacatattggagaacaaacaatgaaggaaccacagagatttcattcttccttgttccaatctcttgcaatcctacgagtgatttctattgggtgcttcacttcgtgagtaacacgagccacagccgctttagcgattttagtgaggaacacgagccacagccgctgaaagtacaccaggcaaagcaacttcagggagaaaaataattccagattggtttcattcagtaatctctagttttcaacttcgctttaaacaacatggtttggttgtgaaatcacataaaacaatgattgaactggtttttacatagttattctattttgatttaattgatcccgtgtttaacaccatgagagagaggaggcaataagagaaggacgaggaaaccaatcgagaagacgaatgtgacgtgtgggcccaccactgatgacatccaccggtgatcacttatgggacacggatcggaacagggaagctgcattctattatatgtaaatatgggtgatcacctcacagatgtgcctagtcatcattaaccaattaactatgaggggtgcctagctagcttatccataatacttccttcgtcccataatataagggattttgagtttttgcttgcactgttttgaccactcgtcttattaaaaaaaattagaattattatttattttttgtaacttactttattatacaaagtactttaagcacaacttttcattttttttatatttacacaatttttttaaataagatgagtggtcaaacagtgcaagtaaaaactcaaaatttcttatattatgggacggagggagtatttagctaggtttcatgcaattgtgagctagcaaaacctttgagaattgatattccttcacgagtaaatatttttgtaaaatatcttgaaagaaattaactgataactgccaactaattaatagtacaaccaatgaaactctataccaattaaaatacaatattgttcatgtattcagctctggtttcatgccgacatgatgtagtcttaaactaagacatatcatatatccagtatctaccgagtattttcgccaggtgatctcattgactcctcattcgtaaagaaaccaaagccaactatagcagctggagacagtatactgtgtcacatccaaataaattaagccacaggtatatttgagaatttgaattaggctccgataaagatacctatcctttatactttctgggcacaagtagctttttatcctcttatccatccagaagtgcgtatgaacatgggcggtttattctcttctttgcgtagagatcgctgtccttcagtttatatgagtgtagtaatctttattattgatgccagcatagcataaatacagaatagtaatctttatatatatgatcagtagattaattagcagaactattatagctagccctttcatcaaaaggtcgtgaagaattaatatacaaattttccgaaaaggaaaaggatgaataaaatatcgaagaagatctcagggcaaacgttcattccgtggccgggttcgtattccactactttaggagagactggataaaaagctgctcactagctgagctggaagaatgagaaaaagcacaagaaggttcctttaccgcctgatggatacaccacgttgtacaaacaccgtctttttaaaggtagcacataataatcgagcaccctatccattagaaaaccatctctaggtacagatattagtgaccgctacatctacgggcacatttaatttagttttgtacatttcacggtgagtgccgattaaagccttatttgtttgagctacgtcttatagaccagttccaattttgaactacggattataagttttggaattaatttatggtctttccttgttatttttgtcgtcatcacactcggacttaagttttaaactgctgaagatagaatcgtaaaagtcttagatattctaaactcattttcccgttgtatctgtcaaaaattgacttatataattaagcccatcccagaaaaatgtctgggaagaaaaatcgcgctttagcctttagcagcagagtggacggggaatatacgcagcagtgctgcgtcgtcgcccgatcttatcttttggctgagatcagtagaaaagggcggccggagaccggaaaaaggatatatgacgatgcgagggtgtttttgccgcaggtaggcgtcgaggcacagtgtgcacgcagcgatcgaccacagagacacacgtacttttttgtggcgtatgtacgtgaccgacgtacttagcatctgcaagagaccgaagtggtagatgacaccatgcatgcatgcatatatggagtcacggacgcgacccgtttcttcgcccggtatgaccggccggccagtcggtctcgtcaatagatgatctggtagctagagtgagcaactcataataaaaattattggaggttctatacatattaattatctaattattaactaatatactaattatataatatgaatcagctagcattgagtaatttaccaggtgcctgtgatcccggtaaatagtacataggttcaccattgggtagctataggtccgtgtatgtgtattagctagctgcctagcgcttactactctgtctaaaaaacgaattcctacctacgaacttggacacacatgtgtccagattcgtagtcgtaggtaggattggtctttttttttttacggaggggtacgtgttcaactgaataagaatgtgtacatcatgcatgcagtgcacaagctgttggttttttgctcacataaatatgctcaagctgttggttttctgctcacataaatacgcgcacacttgttcgtccgaacacacatactttcttttatattcacttgttgcctcaacaacctatttcttttttattgtctaggaggaaaatattagttcgaggtccacctatgctagaatacgacactagtacataactggtcatcgtgaactatggatgaaaacagatcggaaacgaacggaaattacctttatcatatttgttttcataatttttttcggaatcaaaatcagaattaaaaacctggatgtggaaatgaaatcgaatattatcgaatacagatacggaacaaataagacaacgaacatttgtcggtatataaaaatcccctcaaattgagtttccttaataaggaagagatatcgctcgtttttttagatcaatatctccaacatttatatcatcaatttgtaggagatcccacaattgtatgtgttcatggccattcccctaagaaacccacatgtaaatataattattcatttttaatcccaaatccttttactatatgtatagcttacttaccatatcacttatcaagttattgttgtataaattagagatgttatttattttattgttaccaggttagctagtgattctaagacacctctatacgttgaatgcaagtcaaaacacaccaaattatcaataaccctggacctaatgaagctaaagacaagcattagatggacagacaagagtttcacttaactgttgggtatattgaagcgtttgcttcataaggagaacgcattgctcaagatgacatatgaatcaaagcatattttgtgtctcttgggcttaggggttcatagaattcatgcttgtccaaacaactgcatattgtatcacaagcaatatgcggacttagaggcttgtcctgtgcaaggcttctcgatacaagcgaaagagaagttctgattaagggaaaaagtcaaagagggctggttcgacgaaggttgtgtggtatctatgttgacgatcgttaagtgcatattttaactaccaattcctgcgtaaaagatatcaattatattatcaaaacttagtataggactatactactaaccacttccactagttttggtaaatatagctatgcaggttatttaaggagaaaatacacccgacatgcaatgaaaatgaacccccgaccaatcacgtgcgagtacacggattgaggagcccacaagtcaacttaaaccgactcaaggtgaggccaaccacccgggaaccgactaaggggcccacctgtcatccaccgaccaaagtcggaggagaaagacggttgaggtggttcggccaaacccctgctggcgccgctaactgtcaccttccatgtgtcactccctgattggttcctgatggcggttatgggaggtcgatggccagaaaccgccatacttaaccatcattggacactataaaaggaggactccatcaaacttctcaacacacaactcttgagctcaagtagagtacaattcacttgtagttttatatttagtatgttagtttggtagagagtgacgggaagctccggaaggagtggctcgaaatatcggagttccttcgagaattttagggaggagtgccggagtgtcggcattcttccaacggagtttcggagaaagccgggattgttggccttcttctctcgcttgtacctcgaagaatgctttctttatcaagtaagtgttcgggtttatttatgtcccttaattagtttatttaactgagataagtattcttatcggtgtgggttcgtcgcttagtgtgcaactgagtgctctagcactaggactctggataaagaaggaagttcctacacaaggttagaatagtaattaataacttagacgtggtgtctaggttagaaattaacttcatttgttgcgtgctccatggaaagtaaggtaggtggcaggtggtgacagccatgtccgtccttcgtatctctccacgttcgggtacatcatatagctcaaggccggactcatcctagcagaccaggggagagccggtacccgaagcattcgatagagttttatctttaacttaattaactaattaaaagacataggaatcatttctagccaatttatcttaagttgttgtccttggattgaatcttgatcgtatattatacacacacgttccttgtgttcgatacccttggaatactctaagggggaagtgctacaacggtattccttgcgcttacggatttatctgtgatcataagaaatacgatcaatctacctatcgttgatcgtttcaagaaaatctttgctaatcttaagaaagtagagttatacccaattataagaacgtggatgaattcatcgcagggacccagatcgtgcacccaagaagtcagggtgacacaaacattttggtccatcaccgccgaggggagcgttttgaaagttcaagtgccattaatttggttttggtgattaatgataaatccaattacatgagactaatattgttataagcatttctttgtctactagtctcatgtggatatgaaagtggaatttgtgagaggtgattcctggacttcatatgagttgagatagaaacattcagtgatggtggacctaaatcacaaggatgaaatgcatggagatcaagctatatgtatcactctttttcttcgtgcacatattgatatattcatatataatatttttcatgtgattacgtaagcatgtgagactaatgttttgattgagccatatcttgtttaatctctttacattgaagacatggagatgatgaaggtatgtttttattttaatgtctatatttgatgaatgccttctattcttgtataggataagctctcaatgtttcatagctttttatgtatactcttgcttcacacaaatattccgtatgcatacatttagggggagcaaaccctatacgttagttatgcatgtatttgatccaagttattcactttcatttaattgggatctctacatttaagtatacaatcgagtatatgacacttgtggtgttgattaatactcaccacttattcatatccttttatatactcgatcggttagtcaacatgtgaaggttgacaactggatcattgggactaataattttattgagttgaatgagagaaataggtcccaaggattgcaaaggtgctgatgctcaagtgatatcattacacctaaatatactaaggatgaccaagtgaagatattgaagatgtggaatatgaagtggctactatggcaaaatggtgaaaggcaagcgatgcttggtcgggatggaccatgcatcgtgaagggtaagcaaggggcttggtgtcgaaaaaccaaatctagcggtgaagagcgagtgacgactttgtcacgatggaccgtgtgaggccatttgaagctacaagtaaccgcatcaatcatttgaagaatatatggtgaaacggttttggcgttgacgtcccttaagacaaagaaaggaagatggaaagaagtcattcctattgctataattttcttcctatttacatttgtgtcggtgacatgggaccgggagtatcatgacttagagacttgaggcagacacgatcacccacgtggcctaaccccctcgggggggggggggggggtcgggcccgagggtgatacggccgcccttctctttgtcttcccgaggggtcggaccgctcctgtctcggccccgagggccaaggcgccccgaccccttgtgggttttgcgccgcgtatatggggtaggtgagcatagcggggctcacctaaccacatttattgcggtttggacgagcgcatcacgccgcatgtaacgcagtgcagcgcactcgtttatccggtctgtgaccagtcaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggctttatcctaaccattacaggcaagatattgtatgaagaagggcgaaatgcagattgataaactgacgcgtggtcgacaagaatgaccgatttgtgaccggtctgacactggtcatgtcgtcagcagacagccatgttcccacgtcgcgcctgcttccggcggaagtggaggtaggtgtgggccgtcccatcagaaggtcattcggacggcaaccatacaagtcgccgtctgtttatgaaaagataggataagtccccacaaaaaagagagagatggggcatgtggtatccccttgagatataaaaggaggaccttgcccacttagaaaagaaaaaaaaaacgatcccagaacgatcgggggctggctagcactttgtagcttctccatacacagatccaccaaaacacaggagtagggtattacacttctcagcggcccgaacctgtatacatcgcccgtgtcttgtgctttttccattctcgcgaaccttccacacacagaccaggagcttagaacctcacccagggcccccggccgaaccggcaaagggggacctgcgcggtctcccggtgaggagccccaagctccgtcatctgacgcgccaggtagggggttctgcgtgtgttcttctaagctctcgcactttttcgtgtgcgccaagcttttcctgttcagcccaatggccgaacaagcaaaggcgcacaacctctctccgagtgttagcggtgacgacggggagccgaacccacgccgtcgagctcgtactccatcgccccctccacgccaaagtcctaggcgggaggaggcgctcgagagggtcgaaggatccgcgacttcgacatccacgggtgatggggaaggatggcgagatggggagcgtcgcctcctcgtctacggcgacggcagcacgccccagggcgcattccaagctgcgggcgcgctcctacgtcacccgcccgttgtccctgacccggagtctccagcccaacgttggctggacgacgtggctaacttggtcatgacggcacggcagcgcctaggtgctggtgggcggtcctccgccaccaagacctctggcgccgctaccactggctccgtgtcgtcgaggcggagggcgcggcgagcggcgacagttgctcgtcattctgccgccactccttcgtcagcgcctccgacccaggaagatcagcgtggggggccagatgcccgcatcgatatcgagcgccggcgtaatggtcggcgtgctccccacgcaacggagggcgcctcctcgtccggagtgtcacctcaacacggacgcggggatcagccctccgtgcccccggttggtggtgtcggctgtagagcctttgtggcgagccttcggaacgtccgttggcccccaaggttccggcccaccatcgccgaaaaatatgacgggagcgtcaaccccgccgagtttctccaggtctacacgaccgggatcgaagccgctgggggtgatgacagggtcatggcgaatttctttcccatggccctgaagggacaggcgcggggttggctaatgaacttgccacccgcgtccgtccactcttgggaggatttgtgtcaacagttctccatgaactttcaaggcacatatccgcgcccaggtgaagaagcggacttacatgcagtccagcgaagggatgatgagtcacttcgctcatacattcagcggttctgtcaagtccgcaacaccattccatgcatccctgcacacgcggtgatctacgcattcagggggggtgtgcggcacaaccgcatgctcaaaaagatcgcctccaaagagccccagactaccgcggagctttttcagctcgcggaccgagtggctcgtaaggaggaggcatggacctggaacccctccggttccggtgtggcagcttcggccgcccccggatccactgctcagacagggcggcgtgacaggaggaggaagaagaggtcagcccataccgacgacgagggtcatgtcctcgccgtcgagggcgcttcgcgggccacccgaaaggggaggcctgcgggcgacaaaaagaaggaggccggcgctcccagcaaggagcgcccaaccggcaagtggtgcatcgtccacaacacttcccttcacgacctcgcggactgccgcgcagtcaaaagtttggctgagcggacgaggaagtgggaggaggagaggaggcaggagcgccgagagggtaagtccccggcggttccttccggcaatcggcgaagtgaggccaagcagaaggcccccgccgaggacatcgatgacggcgatgatgacctaggtgtccaagagcctggggccaccattgccactgtcgatgggggagcgtgtgctcacgtttctcgccggagcctcaaggccatgaagcgagagcttctggccacggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtaaagctggggcgtgtcctcattgatggaggagcagccctcaacatcctttcccccgcagcctttgacgccatcaaggccccggggatggtgctccggccgtcccaaccgattatcggtgtgacgccggggcacacttggccgctaggtcatatcgacctcccggtcaccttcggtggatccgccaacttccgcacggagcgggtgaactttgatgtggcggacctcaatctgccctacaacgcggtcttagggaggcccgcgttggtgaagttcatggcgacggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcgacgagaggcttagcacatccgcccccgctgccccgaggcagcggatagtcacatgcgacgaggtcccggtcaaggaggttgccctgggcgacggcccgtccaagaccacacggatcggtggtcttctggacggcaaataggaagacgcgctcgtctctttcctgcgggcaaacgctgacgtcttcgcatggagaccggcggatatgcccggggtccccagggaggtggttgagcaccgtcttgccgtgcggtcgggcgcaaggccggtccggcagaaagtacggcggcaggccccggaacgtcaagccttcatccgcgaggaggtggcgcgacttctggaggccggattcatctgcgaggtcatccatccggagtggctggcgaacccggtggtcattcccaaggcgaacggcaagcttcggatgtgcatcgactacaccgaccttaacaaggcatgtcctaaggacccttaccccctgcctcgcatagatcagattgtcgactccacagcggggtgcgaccttttgtgttttctagatgcatactctggttaccatcagattcgcatggcaagggaggatgaggaaaaaactgcattcattacccctataggaacttattgttatacgacaatgcccttcgggttaaagaatgcaggtcctacttttcagcgtactactcgaatttctttgggtagccaaataggacgtaatgttgaggcttatgtcgatgacttggttgtaaagacgcgcaaccaagagaccttactctcggatctagcggaaacttttgagagtctccgctccgcccgcataaaactgaaccccgataagtgcgtgttcggtgtacctgcgggcaagcttctcgggtttttggtctctgcccgaggcatcgaggccaaccccgagaagatacgagctatagagcggatgcgcccccccagcaagcttagggatgtgcaatgcgtcaccggttgcatggtgtcacgcccggaatttctatccaaaattccaaacgcttacatgtgtgtgaaccctcgtccaggaatcagccgaggcacacaataacaaattgataatagagtacaaatattactctaattaataagcgaataaactgtcattacagaggtagatagttcctctcaatcaataaagatctaagcagcggaaaaataaataaacggcgcagacggctccactccacaggcagcttgaccaaggctacacctaatcctccacaccatcagcctcattgtagaactcttcctctgatgaatgattgcaaggtgagtatatgacatactcagccagccacgcagcaaatatgcaagtgcacaggataacaaaggatagcataatagggttgcatttgcaaaagcagcatttagcaaacatttgagaatttgataaagcagttaagtaattaaacaattttaatccaacgctatacaacataccctgttgtataggcccaaccattctgaacaaccaccccggctgcacagttctatctccaaaccaggaatataccattccaaaccaggagctaatcaaattattaccagtttaagcatcttttacaatgatgagaggtgtgagactaatcacgaaagacattgttagacccacccataaccgcgggcacggctattcgaatagttttactctgatcagaggtgtaccactgtacccacaagacacagccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacggttaatgtttcacaaccgaaactcgtgaaccggtccttaattgtcatgagcacgaccaacaaaaccatgtgctcacaacccaccattaccaggttttagttggcacattaattaattaactaatcacgattgaccatcgtgaactatcatgaaaccatcattaaataatagtgaatcattagttatcccataagtgagctaatgtttctaagcaaggctaagcaattatatctaatatctagttgaaccaatataaataaagctcaactagtcaaattataatatcccaaggtatcaaggaataaggtaatcaagaacaaaagggctatagcaaacaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttctgcgaaaacggactctccggaaacgacggaatataagcagaaaagagcaaaatcaccaaaacagcacataaacaagcatgaacagtacatgtggatatttttaaagtgtaaatctcaattttagaaaaatttagagacttgaaccaactaaatcggagctaagatgaattagttatgaatttttaaagattaaatcggattaaaacacttatatcggttaaaattgaattatgacgcaataatgaattatttttgaaaaggaaaagaaggattattgcgtcagcgggctagggtttcggtggaccgggcgcacgggcgacggttcacgcgaacggacggccgagatcgatccaatccaaaacggacggccgagatcgaacggtccacgaccggctcacggcggacgaccccgatgacgtcggcaatgacgtcaccgacagcggcggcggctcggcggagcggacggctcgggcggcgcacgcttgccggcgaacggcggcgctaggacgcaaacggagggcaccagcacgtagaggacgacgcggcgaacacaccggtgaccaaaacggcggcggaagaacaacgaacgacgacggcgacgaggaggaaacggcggaaaccttcgggttgtcgacggcgacgaagctccggcgatctccggcgacggcgaaggggcggacgaggacggcgacgacttggcgagcacaacggtggccttcccgagcgacggcgacggctgaaacgacggcggcgcacggctggagcggcggcgacgacggcaaagctagggcacacggcgctagagcgattccggcgacgagaggcgaaggcaagggtggcgacgggtagaggagacaccgggggtccttttaaaggggctcggaggcgacggcgaaagcccacggcggcggcaacggcgaaggaaagctcggacttggagagaagaaagccgatccgattcgaactcgaatcaaactcattccaaaccgatttagccgaagattccaaaggagaaaaggtagaggagatcccggagatcatttcccctctttcaattcggccggagaaggaaaggagcggccggatttggaaagcggcggcggcggcggcgcgctagggtttcggcccgaggaggacgacgatcccgacaggtgggccccacctgtcagcgggcggacgcgcgctcgcgcgcggcggactgggccggctgggtcgaggagagagaagagaggttttgggccgactttcggcccaaagccaaaagagactttttaaaacctttttcaatttaaattattccttaaatgcaattccatttattaaaaatacttccttagctcaaataaatcccagaaaaatctaggaattatagaattaagcaaagtatttaatgaaattttatctggccacattttatattggaatttattaattaaaattagattttctcttcaagacttttaaaattatttctaaaaattccatttaaacaacaatttataaattttaaattttcagggtgtgacacatggccgccctaagtcggttcatatcgaggctgggagagaaggcgctacccttatttaagctcctcaaacgctccgggccgtttacttggacggaggaagctgaacgtgctctcactcagttgaaggcgtatctcagctctcccccagttctggtcgccccggagccaaatgaaccctcgctactctacttagcggcgaccccgcaagtggttagtgcggcgttggttgtggagcgcgatgaggacaatcctcattccgcgcacccccaccctgtgccggcttggcccgggagaaagcagggaggagaggcccccgagccgaacgatggcccaaggcccccgacgaccggagcaggccctctccccgcttgtcagacgatgccaggtgcccccgacccccaaggtggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcctccgacccccaggacggccccgaggccactgtgggaaggccgcccctgtcgtcctccgaccccgaggtcatcggcacagaagaagagtgcaccccgcgaggccgcttggacaaagagcaccccagggatgtggcccctagcgaagaggatcggccccaccgaaaggtgcagcggcccgtctactttgttagtgaggccctccgggacgccaagacccgataccctcaggcccagaagatgctttacgctattctgatggcttcgaggaaactgcgccattatttccaggcgcatcgggtcacggtggttacgtcttaccccctcggccaaatcttgcataatcgagagggtactggacgggtggtgaaatgggcaatcgaactttctgagtttgatttgcactttgaaacacaccacgctatcaagagccaagccctcgccgattttgtggcagagtggaccccagctcccgagcccgtctcagtccccgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgactttcgggcgaccaataatatggcagagtacgagggactccttgcgggactcagggtggcagctggactggggatccgccgcctcctggtgttaggcgactcccagctggtcgttaaccaggtctgtaaggagtaccggtgctctgacccgcagatggacgcttacgtgcgccaagtacggcgtatggagcgccattttgacgggatagagcttcggcacgtgcccagacgagataacacggttgccgacgaactctcacggctcgcttcctcgcgagcccagaccccaccgggcgcctttgaagaaaggcttgcccagccgtcggcgcgacccgaccccttaggggagacggacgcgcctgacaggcccccgaggcccgtcggagtccaggcctcgggacccgaggggagcgctcccagctcccttagattgattgcttggatcgctgagatccaagcatacctcacagataagactctacccgaggaccgtgaagggagtgaacgcgtccagcgcatctccaaacgctacgtgctggtagaagggaccctctatcggcgcgcggctaacggaatcctcctgaagtgcattcctcgggaacaaggcgttgagcttcttgccgatatccatgaaggcgaatgcggagcccactccgcctcgcgcaccttggttggcaaagcctttcgacaaggtttctattggccgacagctctcaatgatgcggtcgacctggtcaggcgatgcagagcgtgtcaattccacgccaagcaaatccatcagccggcccaggccctacagatcataccactttcatggccatttgctgtctgggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattatggataacggcacctaattcactagtgaacttttcggcgattactgcgaagacatgggcatcaagctctgcttcgcctcgcctgcccaccccagaagcaacggccaagtggagcgcgccaatgcggaaatcctcaaaagccttaaaaccaagaccttcaacatcctcaagaagcacggcaattcgtggatcgaggagttgccagcggtgctctgggcgaaccgaaccacgccaagccgagcaaccggggaaacgcctttcttcctcgtctacggcgcggaagcggttctcccatccgagctcaccctgaagtcccctcgggccaccatgtactgcgaggctgatcaagatcagcttcgcagagatgacctcgattacttggaagagcgaaggcgacgcgcggccctccgagccgcacgctaccagcagagcctgcggcgctaccatcagcgccacgtccgggcccgatcactctgcgtcgacgacctcgtcctacgccgcgtccaaacgcgtgctggattgagcaagctctcaccaatatgggagggtccgtatcgagtgatcggcgtcccccggccgggctccgttcggctggccacgggcgacggcatagagctgcctaacccgtggaacatcgaacaccttcgtcgcttctacccctaaaggggaatcgggtgtcaggtttcgggctcgggccaaccccgcacccccatcgggcgtgcagggttggccgggggctaccacatatgcatattcttgtttctcttatatctgtatttcaataaaagcattttcgatttcctaagggctgtatctgtgctgttgtttccttttgaaggatcttgacttgaaataggtcactcgtgttcaatcttgccctcgggggctcgggtcggctaaaaccgccaaacggggcccagaaccgagccgtgccccggggcgtggtgaactccgggggggaatcggcaaaaacccacaatcgggtcacccataaccctcagtcaccgcgctcccggcctggccagtctcgacatgtggatctccccaggcactagccccgacccgagccatttgaggactaggacctgggcacgagcccttgttcaagccaagacacgaaaggatcgcggcacagatatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggcgctcactccgatgcacccgggtcgccagcctcgtcgccactatcgcccactccgccgtcatcgtcctcctcgtcggagttgggggcgaacgcgagccgaggggccgaaccctcgaagctgtggacgatatggtcggcggcgtcccggacctgcgcgcgcgcgccatcctcggtcccgggagggaactcgtccagcgccgtccatggggagaagtcgggatccctggcttggtaactcgccagtacgagctccaccgctcctcgggcgaggtccctcgaagatgacttaatcgtcctctcaagctcctcggggagccgttggagagtcccggctatctccgagaggcgctgggcgaggcccccctggttggcggcgtacttcgcagttcggcccgccccagaggcccacctgccggccggcgcggtctatacgggagacggcgtcccgaagcatgccgggccctacctcgcctgccaagcggaggggctcgacctccccggcggatgagtctagcgcgccctgcagatcggcgatggtgtgttcggcagctgcgaggcgggcggttaagtcgctgtcgcccatggccaccccgccgctgcgtgcccttgcatccagctcccttgcctgcgcctcgagttcagcggcccgctggttcggtgcggccctctcggcgcaggcactttccagattgcgacgcgcttgttcctcttgcgcagcctcgcggagggacaggctgtccgccagccgttgcgccgcggcctcggcctcctcgagagctcgctcccgctcggtgagcgcgtcctcgcggaggcggagcgcggactcttcttcggcgcaggcggcttcgtgcaccgccagtgtgacctcccgaatagcaacggcggcctcgcgatccgccaggtccctctccacggcgcaggcacgctcttctagcgccatggcacgggcctcaagggcttcctcgcgctgccgggatgccacctcggtctccgccacccgcagttctcgggcagcggcagcgtcaaggaccccccgggcggcgtcgagcttttttcctagctccgcctcccagctcccgtattgaaggcggagggtgtcctgcgcctcgttcatcacggtggtggcgatgagggcagccccccgctcctcctccacctccttggcgatctcccccagcaccttccgacgggcttcgagctctgagacgtgccggcggtgtgccttgcggcccacctccaccatggcctccaccgagcgtcgcccctcttcgacacgcgcccatgcggcgttgagctccgcccgctctgcttgcagggcctccacctgggcacttaacccgtccaacaccgtggtgtttgcgacggctaaggcctgcagaaggggttctgcgctcagtggagcaacggaaggcgtggggaagagccgcctcgaagaggatgccgcgcggctcggcccgccgatggacgtgccggactcagggatgtcccccagacctggcttgtcctgagcgttgcccgaggaagtgggcccaagcgatgcgcccgcggcctcgtcgcgagttgcctcggaagtcatcgccgcctcggcctggcgaagtctggcctcctcccgagcggcttcttcagcttggcgagctcggacggccacctgggcagcttcctcggcttctcgaaggcgatccgcggcctcttgccggtcagtttcacgggtcgcctcggaggatgtcgtcgcctcggcctggcggagtccggcctcctcccgaacggcttcctcggtctgacgagcccgggcggcctcccgagcggcctcctcggcttcccgaaggcgatccgcggcttctcgccggtcggattcccgcctccgggcctctgtggtcgccgggtcctcggcctcagactggccggacttggaatggcgggagggacgcgacgggatctcgctgaaacagaagaaataccagaagacaaacaagatggatgagtgaaaactcgtgttgagggaatgaatacggccgcaatgggcgtgggacgaacctgcgagggggtcggttaaacaaccaccttggaggggaaatgaggtttccccgggatggttctgtcccccccgtcttgcggagtcattttttcttccgctccccctcgggatgcgacgtcggcgtggccccctccgggcgcctgctgctggcacgggccgccccgccccctcggggaggagatgggggaggggttccttcctgcttcctcttcccccgggcgtcggcagggcggccgctccccgggcccccgacgcggggcccagaagcacgaccccctcccggggtagattgttcccccctgcggctcccacccgcgccatcgtggcctcgaggagcccgctcctccgacgccccgaccgcctgcatgatggtcaggatggaggcgcggtctggatcgctacagagggggaggactccttgaggaatgagggatgcctccacggagctgagattcagcacccgttggaccactatcttgaagtcctcaggagcccagtcccatctgaccccctggtgggtcctcatacagtcctcggacccggtgtactcccaggcgccccgggcgcgccgctggagtggcgcgatccggcgacgaagatagtcgccgaacaccatggcccctgtgagcccctaggatcgcaggcccgccaggcgatcgaggacggcgtcatagccatctcccagatctaccggcgcccgccagttggaggcctgcgctggaggctggctcggaagtcggaggcgcgcttcgtcggcgaggggggtgtagaaccagtcgctcttccagtcatcccacttcttgcaaaggacgcagggaatgtagcggtttagcaccggcccccgcggctggaagtagcaaccaccaaccaccgacggcggcgacaccggctgtacgatgaagaaccaccggaacagccgaagggatgggcgcaccccgatgaacatctcgcacaggtgcgcgaagatggccaaggtcattaccgcgttgggggtgaggtgcgccatctggagatcgtaaaactccagaacatccatgaagaaagaagaaaatagcggaaccagccctgccatagcaaaagggaggaagaagacagaccgccccgggtagcgtggcgccgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgacgccggaagaagagatgtttgagagcgagcgcgtgtggcgaaggtagggcacaggaaacaaggagtcagggcgtaagcggcgaagacaaggggaataatggcgaaaggaaggaagcaaatctcttcctcggcgactttatacccttgccaacgctatgcccggctcctcgtttctcgcgcccactatctgccccctcgtttctcgcgcccacgcttccactaatcccattcgcccgtttgcggtgcatgaggtggatatgcggctgtggcagtcgagatggaacatctcgtgcgcgcgttaatcacgctcgccgaccgaagcgccatcatcatatctccaggaaaaacgaaccggcttgtcccgattcccgtgttactcgagtaatgtggcagtcttgaagagaccgctcattattgacagccgagtaaccattgccgatgtgcgtgatttgcgaccgttgggtttctgcccaactgtggagaccggtcccacctgtcaccaggccttaggaagtggcgtcacacccgaccgcttccctcgaggagggcgatcgccctggcataacgccgggggctactgtcggtgacatgggaccgggagtatcatgacttagagacttgaggcagacacgatcacccacgtggcctaaccccctcggggggggggggggtcgggcccgagggtgatacggccgcccttctctttgtcttcccgaggggtcggaccgctcctgtctcggccccgagggccaaggcgccccgaccccttgtgggttttgcgccgcgtatatggggtaggtgagcatagcggggctcacctaaccacatttattgcggtttggacgagcgcatcacgccgcatgtaacgcagtgcagcgcactcgtttatccggtctgtgaccagaccggtcagatcgtgggttaggtggcgacaggcggtctgacgcacgcctcgccccatcccgtcaggacgagagcctccaagcactcgtccctagccggagccggcgtgttagctcctggagatggcacgttggttccggtcagatatatgccaggcttcatcctaaccattacaggcaagatattgtatgaagaagggcgaaatgcagattgataaactgacacgtggtcgacaagaatgacctga

SEQ ID NO: 16859 - DNA, 24503 bp, Oryza sativa
cccatcagaaggtcattcggacggcaaccatacaagtctccgtctgtttatgaaaagataggataagtccccacaaaaaagagagagatggggcatgtggtatccccttgagatataaaaggaggaccttgcccacttagaaaagaaaaaaaaaaacgatcccagaacgatcgggggctggctggcactttgtagcttctccatacacagatccaccaaaacacaggagtagggtattacgcttctcagcggcccgaacctgtatacatcgcccgtgtcttgtgctttttccattctcgcgaaccttccacacacagaccaggagcttagaacctcacccagggcccccggccgaaccggcaaagggggacctgcgcggtctcccggtgaggagccccaagctccatcaatttgagtataggaatgttgtactattaagagggatgtaacgtcgatgtgtttgtgtatgtctcattgctcaaagtgacccatcctttgagtggttttagacattccttttggttgatttgagtagttctctttgtgagctttccatagagtccaagatcatcaaacggacttacgagcaaaaagttatggccgttttgccatgtgtttttcggaaaatccgaaaaaattccggaaagtccgaaaatatttcggaaattccaaaaatggctgcgatattgagattgtcttctgttgatttttggatttgcccgaaatgcatttcggaaattccgaaaaatggaatcttggcctccaacggctagttttgagaggctcgggtattgataacaacggaattttgcatcagactcggagaggtagaagaaagttcgaagcggatttggtgcagaatcgagttgaattcagagtcagactgtgcatcggttggacatcatatcggctaaaaacagagcaaatgcttagcctagccgatatggcaagcaaccgatatggtatgacttggggcttggtttgggcctagactaagataaccgcaattggagcttgattaaggcaattgtatctattaattaggatatttatgtcggtttttgttagagatatggtaagagaccaccgtgtggtcttgtttgtattttatctttaggaaagtttgagtcgtgtctataatggactaagtttgtactcggggtataaatatgaacccgagatcattgtaaaaaagggacgacaaatgcaatacaactttggcgcatcgccaccctttttgttcttcttttcggcgagttctctcgataagaggtaacttgtctcgatgacttgtgctattggagctattatgtcgatttagatattttagtccttctatcatgaccatttgctatcatatgtcttaagtaatctagtcttagtatcccgatttagccctatcgactggttctcgctttagggttctcactgatatcgactaaatcatcttgctagattagattagcaaaggaatctaccaccctaaaaagtggttgccctatcggctggttctcgctttagggttctcactgatatcgactatagcaaaggcatctaccatcctaaaaagtggttaattacttgattgtttagactttaagtttctttacatactttgtaatagtactccctccagaaccacgtagccagcccaaccgacgggcgggcccacttacacataccaccccacttacactttcgtcctcgcttcgtgtaaaagggttaacccgggagtaacatggttggagggaagaggccttataagttggttccactcgtgctaaactagcaagatggtaataaacatgcgcacacagctcacatgggccacacaggcctcatcctaattgggccaggatgtcacatacactccccatcaaaggacccgacgtccccgtcggcccaacttacccagccacataggcaaatgtctaggaacacaccccctaagatcttagcgcacgtcacccccctccccctctaggcaacatcaatgccctttcagttttcaagcctaccccaaaaaccaaagtgcacggggtggatttggtggctgggcatgccaaagtccaagttgacatgatcaagtcaactgacctctagagatcccacaaaacgactaaattttgaaactgggagctacacgtgggacctttatccaatggcctaaggatcaaattgtcataaggatggttcctaagtcaaatgcaccacgagctccatcgcctatctccactccagctcgttcagcccctcctaccatcgaaggcgcaccacaagatgatattgattttgggtttgattttgtggaagctgacgatatggctaacattctcccctcctcagaaaaagagcaaggcacattcttctccaccagcggtatctagcaaaaaagccagtagagggaaaggaaaggaaaggtgacaacctcactcttggctgttaggaaatgatcggcagataaacgatgaagaacgacagatcaatcacagaagacacgagatttatcgtggacaaccctcctaaggcacgagagaaaaaaccacgggcgccagccagcaaatcttcactatataaactcaacatttgctcccaagaagctagatataggcaaggaggtatcagtttgtcctaagagcctagctcagagcagctacagttaggcatgccattggttggagaccacgagcttaccaagatgggtccaacgtaccgagagttacacgggtactacatagagaggtcgaactcaaggagaaagaatagagagatatagatattgggttttcatggcccagagccatttcttgggccatttggctatattttaataggcttcgacaatctctatgacctcttgaagctgcgagcggtggacacaaaacttcttaagtattacttgttgtagccttcggcgacgggcctccgcttgctccgaccgaagttggcctttatatgtgtgtaaatgaatttggatcacaactcaacattggctcccaagaagctagatataggcaaggaggtatcagattgtcctaagagcctagctcagagcagctccagttaggcatgccattggttggagaccacgagcttaccaagatggatcaaacttactgagagttgcacgggtactacatagagaagtcgaactcaaggagaaagaatagagagacatagatattgggtttttatggcccagagccatttcttgggccatctggctatattttaataggcttcgacaatctctatgacctcttgaagctgcgagcggtagacacaaatcttcttaagggttattgacatgattgtaagttaagttggaaggaggccaatgggcaaccaatttgggcatttgacaggttgacccaggaacgatgcaagttcactgcaaatgtgatacatatacaaattaaactccagtaaaagcatcaaaacctgggcacaaaaagatgcctgaatcgggctacattgcaagttggcaacgtattaaaagtagcaggagcagcagctagctagagaagtagcacagtttcaaagatcgagttgatacaggcctcgtatagattccaacccaacgtaaccactaccattctcgccaaacagactgcccgcgctattctgtaggctcagatggatagcgcactgttttctcttctcttattcacctctgtcatggtcatcgctgagccaattatcatcactgcatgagaagctagtaaagaacacacgggatgaaggtagggcttctggtagtcatagtggccaatctcccctggccttaaggagaagaagttttccgacatgcggaaatgtgccactggaaattttccattcttgacagtattgaagacggtttttatctcttggtccttcttgatgggaagttgaggttgggatttgattctgaaattacttgcaacctgcaaaagagtcaaaacttagagtcaaggtaaaataatgaacaatattgtcaggcctaagaattgatcatgaggaaaattaataaaggaatgttaattttgaaagacagggaacgaaaagtggactactggattttgatggaaataccctattgattccatatctatatggaattatggacaagaagtgtagcaagaaatgcagtttgtgcctttgtgggaagaaacaagtaaacaattgagaactggatcaaagaggtactacaacctcaattccttgaccaaagcgcaaacactagatatgaaaatgaaaataatgtttaaatagtttctaaggctactttgttatggcagattcactaatatatgactaggaggacagtttaaaaatagatgcacatcatattatgcttccaaacctttctggaacactagtccagtcttgaaggtttaaactttaattccactgaaatttccaggacaaccatgaggaatggccactgaagcgtccgatacttatgatattgataagaaagtcgacaaagaagggcatcttggtgtgacagaatgcaattgctcatacaaggtgttgcatcttcctgatatgatattaattaattgtttcaagaacaccggaaatgtgtatttttactaacaaaatatggaattgtggttacaataggattatgtgcaggatattcttgtgagttatttttgtccaggagataaacaaatggatgattgcataccaactaattaaaatcatgaattgcagcttggtaacctcactaaaccttacatatgatcctccttttaggccttattccttttgtttctgaaaatcatggtgtggcttgtaactcagaaagcagggcataggaatatgcaaaatacaatcactttgcaggaatatagccatcaactagtgcatattttctatttgcaaaatttatgaacataaacagatgaagtagtgctactgtgcttgatccaagagcgcctgtaatttttgaagtaacaactaaaataaaatgactataaaggcacactttagcctatcaaacaacacatgacatgatacatctaaaacagatattacctcaggttgttgctttcttctgcctaggacaccacattcttctagaatttgcagtacagtagcaagtcgatgattctaatttcttttccaacaacttccttgtattcttccatcaaattatcagtggataaaatccaactgaagtcctgtggtggttccaaacaagcatactggtgtttgtaaatggactccattgctcccaaacaggaatgcattgtgcatgtatctgttagagaagtaagatgatccaactgtaaaatctttgcatgtggatgtgaaatcaaataacaagtaaacaacagcaaggaagaatttcaagatacttcatgtgtaccagaatttccttggtcacgcagaagtgctagatatattttgtcgtcttaggtctcccagaccatgtgaattctttgcatacctaaaatatagggcaaaaataaatatgtgactgttacacttcttttgatggaaattgttacatattgtcattgtagaataaattgtgatgagagtaatgtgtgtaaaagcttattttaaataacactcgcaaataaattagcataatctggtttcacattacacatcagaaagatacaatttgcacatcattgcacacagggctgggatacaaacagagggtaaaattaagtttcccctggctctttgaaaagaaaaggttttctaacatcataataaggaaaaatcggtaacacaaaattttaacacttatttcatgctgcattgcaaatgccatgaaaacgaaccaaaatttcttctaacgggtatccttttttaggaaataaaaagaatatgtttccttttcttttacagtatataaactttacctggtgtatggtttcatttgaacttgcagagctagaaccatggaagtcatcagattcaagtgcatattttgattgacttgtagcgatagtgttccatttcaatatacactttcgctctatcatatcatcaactaattctctgaagactccccctctagcagatacactagcagcttcaccaaacatccacaaacagtgtctatatgaaaggaaaaatgcagccaatatatatagctgttattagaagctaaagtaacatatacagccgaatcaaattttgaattcaatatttttaacgaaccttgctttggtaattgcagcattgatcttttcaatctgaagaatcgtgttctcgtctttgaaaagcattgatagaataaccacttgataagtttctccttcaaaactatcagcagactcaatgtgcacattgattttattgtgagaagcatatttttgtctgagagaacttttgatttcactaatattgctgccacacagacacaggacaccaacatcaatcacttcagtatcttccagacctgaacaatttttttacaaagaacgtaaattaaggtctttatagtattgctgcaaaaacagcctcaaacaactacaagtgacagctatctagaagacataccttggaaatgatctcaagcatgtattggattgtggcaagctcaatggtgtttttctctttgcagctaggccccgtctgttccagtgacatcaataaagcaataattgggaaattaagacctttgaattttttgttgtattcaggagaaatacagtcgcaccatttgtgattctcccttcataaaatttctcattgcggaactgccagattgatggatgaattgcatattgctcagtgagcatatgcttccgaaaacccaaattgagcaatcttttgaaaggactcatagtaaacctggcattttcccgtacctaaccatttcatcaataagatatatcatttgcatcagccagcattaatattgtctagtttactgtctagtcatgtaaacgaatacactagaaaatcagaaagaaaagattaccttgcttggctgcaaattgaagtcgtcgcctagcatcaaaatgtgtgtcaccagcaggcgcaatggaataatgaggtcgcattcgttgattttggctgcatcatctactattaataaattgattggttccatagctgcttcatggagccgaaaagttgactaagttgtagaaatgatgactttagcatgtttgatgcagaagtcctcaagaaacttcctttccacaaactttggtaatttgagtgagcttctgaaacttcgaatgaaatccacgcattgcagccttaaataattcagtttagaaggaactgaacttaatccaaatgtccactggacacgtttgtcgcgtaacctcccatgacataaatcctcaaaatccttcgacaagctcaacaagtttttgttatgtcattggcaatatcaacagacaaataaatttctgaaaatttttcttttagatttgtcaaccattcttttctcatgagaagcttggtaaacttgtccttgaatgaactcaatgtgaacacgagaagactattggtgatacatatgattcttgtggtctcatgatcacatttttcagcgcagtatggatctagattaagtagcactaacaattcatgcaaccatattttaaagagagaatctattctataccactaagtttagcccgtgtttagttgcaaaatttttcttcaaacttccaacttttccatcacatcaaaactttcctacatacataaacttccaacttttccgtcacattgttccaatttcaaccaaactttcaattttggtgtgaactaaacacagccttattcaagttcaacgatttgttatcgatattgtctctttctataatataccggcgactttatcaattgttctacaatatgccattgggctagaccttcttttcaaaaataaccaaaatacccttagaaacatacaagattaacaattgatttatcttatcagaagtttcaaaaaaatataatttttttatgtggcctccttacacaacatggaagtttgaatacaagtttcaaattttttctggtatatttagtttttagaaataatatttttttatgtggtatgagagagaatctgcttatacaagacataatagcattaaaatatcttatgtagtgtatgaaagatgattcataataaaaacaacaagaaaaacgtatttatatagcatataataaataagttatatttttttaaaaaaatagaaatataaaaagcttgaaacttctttcatacgctacataagatattttaatgctattatgtcttgtataaccagattctctcccacataccacataaaaatatttttttctaaaaactaaatataccaaaaaaattgaaacttgtattcaaactttcatgttgtgtaagcagtcctcataaaagttttcattttttaaaactttaaattagataaatcaattgttaactttgtatgtccataagggtatttcgggtatttttgaaaaaaatacctaacctaatggcgtattgtaggaaaattaataaagtcgtcactatattatacaaaatgacaatgtcgatggcaaattgttgaactcaaacaaactcggtggtatagattagattctctctattttaaacaagggttaattggatccatataccactacaaatatatcaaattaggaaaacgccactactattcatgatatcggctaggtgccactggaatttcgaaaaattagatccatgccactccgtcacgtttttcattcactccccattaatttcctaactccgtgccgttttccaacttcggccgagcggtggcgaaggagctcggcgaggtacgtgtccaccagccactacgccagatcagcccatctttgacgacctatctgtgacggaccaaaatatctcgtcacagatactatcacctttgacgggttaaaataaatctcgtcatagatgaggctaaagaaaatgatccgtcacaggtaaatactcacctctgacgggtatatataaggacccaacacataatgattgtgacgtgtccacatataaacccgtcactgatgagtacttacctgtgacgggttttaagtttacacccgtcaaaggtgagtaacctcacctcatatattcaatcaattttcacttataaaaacggaaaccccaacccttccacaccggccaccaccccaacccacccccaccgcccacaacccatctgttttctctcttctttctctcttatctcttctctcttcctccaccatcgcctctcccctcaaccgtgcgccggctgcgtcaccacctccttcgcccctcggcgtcctctaggagctcggggtcgccacctccttcgcccaccgtcgacctccaggaggtcgggccccgcggccttcaacatcgatgccgccgccacctcctgaccgccggaccgccggtcaccgcggggccttcaacatcgatgccgccgccacctcctgaccgccggtcaccagatccagccgccgatgccttctcccgcctcccggctgctaacgcgcgccgcctgccttgccaggccaggccaggcgagcgagcgcgcgcgtgtgtttcccctcttctctccaccacacatgcttcaagtggctaggagggcatcctcccttttaaggaggtccccttctcctagaataagcaaggtggtactaaactccacatgcatgccatcccatgaggtgggcttttgtgattttccaaagaattaatacttgaatgggccttagcccatctattaattccaacaatcccccaccaaatctcaaaatcccactgagatttgccttttccaatgtactgtttatataccagcggttcgatggagaccgattaaggttgaacatccatctagaacttcaagctacacttactcacaacttgaacaatggactacgccttgaattgcaagtcttgtgcaagcaagtttcactcagagtcttatctggtactagaccgtctgtagactacccctcgggtggagtgtataagtcatactcctaggtctttagtaagcttcctagaagattcacccaaaatcttcatagactgcgaccaacaagctcacaaaggtgagttctttcaaaaatgctctgcaggacaacatctttgctaattaaagccaacagaactcattaaagcatagccaacctgccttgcagctcacgagagtatatgcatcttcacttagagagggtatatattggtactctcctctagtttactgatggtttgttcttcccaggttctaattcacaggatctccaatcacatagaatgggttaccaccatagtataactcacatgggtctcaaacccatctccttcgatgcattgtctatcacatttcgtgatagtccctttgtgaagggatctgccaggtttctagctgtttggatgtaatccaacgttataactccagagtttctcaatttcctgacagactttaatcgtcttttcacatgtctagacgatttcatattatccttagaactattcactttgacaattaccgtttgattgtcacagttcaaaagatagccggcaccattttttcaacaataggcaaatccattaatagatcacgcagccattctgcctcaacagtagcagtatgcagtgccgtcaactctgcttccatggttgacctcgtcaaaatggtctgtttgcaagacctccacgaaacagcaccaccacccagtgtgaagacatatccactagtggctttgatctcatccacatcagagatccagttagaatcactataaccctccagtatcgcaggatatccagtatagtgaagccccaatgccatagtacctttcagatagcgcattactcgctcaagcgcacgccagtgatcatctcctagattagaggtaaaccggctcaacttgctcacagcaaaggagatatcaggcctagttgcactagccaggtacatcagcgagccaatgatttgggaatattccagttgattcctagcaattctcttgttcttgcgaagcaacaagctaggatcataaggtgctggagaaggcttactatcaatgtagccaaagcgattcaagatcttctccacataatgggattgcaagagtgtaatcccattctcacctctaattagcttaatgtttaggataacatcagctactcccaaatccttcatatcaaaattttgagacaagaatgatttaacctcatttatcacctaaaggtttgtcccaaatatcagtatgtcattaacatacaagcacataataactccctcacccccaccatggcgatagtacacacatttatctgtctcattgactgcaaagcctacggatgtcaatgttttgtcaaatttctcatgccattgcttaggagcttgtttcagaccatacaaagacttcaataatttgcacactttgccttcttgaccttcaactacaaacccatcaggttgatccatatagatctcctcatccagctctccattaagaaaagttgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccatcaggcctaagcttcttcttgaacacccacttgcaccccagaggtttacacccatagggtcgctctgtcacctcccaagtcccgttagcgataatggaatccatttcactagggacagcctccttccagtagtctgcatcaggagatgcatatgcttctgaaattgacttaggagtgtcatccacgaagtacacagtgaaatcatcaccaaaggacttagccgtcctttgtctcttactccttcgaggagcttcactgccatcctcctcagtgacatgttcatgtgtatattcagtttgttctggtggtgtgattgaactgggaattatttcagaaggttggctagaactactatgtgtatccttcattgggaaaaagctctcaaagaaggtagcatcacgagtctccataattgtaccaacatgcatgtcaggtacctcagatttaactattaaaaatctataggcaatgctatgatgagcatatcccagaaagacacagtccacagtcttaggtccaagtttgcgcttcttcgttattggtacattgactttcgccaagcacccccatgtgcgcaaataacaaagtgatggttttctcccaatccatatctcatatggtgttttgtccttatttctgttaggaactctgtttaacacatgattcgaggtcaacaatgcctccccccaccatgccttaggtagtcccgcggtgtccaacatggcattcaccaagtcagtcagtgtgcggttcttcctttcagcaatcccattagactcgggagaatagggaggcgtcctctcatgtatgatgccatgttcctcacagaataagtcaaactcgtttgagaaaaactctccaccacgatcagacctgagtttttttatctttctgtcaatttgattttcaacttctgccttataaattttaaaatagtctagagcctcgtctttcatttttaacaagtacacatagcaaaatctagtagcatcatcaatcaacgtcatgaaatatcgttttccacccttcgtcaacaccccattcatttcacaaagatctgaatgtaggagttctagtggtgccaagtttctctcctcggcagccttgtgaggcttgcgaggttgcttcgattgcacacaactatggcacttaaaacctttgacaatggaaaacttagaaattaaacacatgctggaaagccgagacatcaagccaaaattaatatgacataaacgtgagtgccaaacattagcctcatcatccacactgccacaaatatggttcacagacttattgtagaaatcagaaagggaaaagcggaacaagcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagttgcacgatctttcccgaagtaaacttcagatctaccgtgccaacaccatgaacaggagcatgtgacccattccccattaggacggtggaaccccgtgcaacctgataagaagaaaacaatgggatgtcagcacaaacatgtacattggccccagtatcaacccaccaattagtagactgattaactgaaaaaacagtaggtaaattaccatacccgcttccatctccagtattgccaatggtcacattagcagacttagaagtctgccctgcaggtgccttcatccccttgcgctgtggacacttcctagctagatgactaggttggccacacacaaagcaagtcctctcatcctgattaggattgttgttgttcttcttctgcttcttgaagttggtggtctgttgagctttgtatttccccttgctcttgttctgggccttgtgcacaacattggcactggactgcccaccatcgcccttagacgcggcgtccttttcccgagctttctcctcaacatcaagagacgctatcaacccctcaatggagtattcctgtctcttgtgtttgagtgcagtaccgaaacttcttcaagatggaggtagtttcgcaataatgcaccctgccacaaatttgtcgggtaagacacacttaaggagttcgagttccttagccatggtttgtatctcatgagcctgttcgactacagaacggttgtcaaccatcctgtagtcatgaaactcctccatgatgtacagatcattgctagcatcagtagcaccaaatttagtattcagtgcatcccacaactccttagcgtcggtcatgtgcatatacacctcgttccagacgatcgccaagaacgctaagaatgcatcccacaaagagagtagtggcttcctcgaattgcttctgctgttgagcagtaagaattccttcaggtttgccagtactcacccagaagcatttcatagctgtcagccacatagtgaccctgatctgccatctcttaaagtgcacaccggtgctgttgagcagtaagaattccttcaggtttgccagtactcacccagaagcatttcatagctgtcagccacatagtgaccctgatctgccatctcttaaagtgcacaccggtgaatttatccggcctcagtgcatcggcaataccagccatagtaaaatcacagcgcctataataaggtttttggattgttgagattatatgcatataatgatttaatatattccataaataaatcatgacattgcagatgtaaactagcatgaacgcatcattagatctacacatgtaaactaagagggcatcctcccttttaaggaggtccccctctcctagaataagcaaggtggtactaaactccacatgcatgccatcccatgagatgggcttttgtgattttccaaagaattaattcttgaatgggccttagcccatctattaattccaacagcttcatcgacggaatgcgtcggagaaagcggcggctccggcaactccgtcgctccgcctcctcgacccatcggctccgccgtcccccgcccatgacgctggcctccatgcccttggcctcctggaaagagtgacgggaaggacgggaagaatgacgggaaacgcgatggagtggcatggattcaatttttcaaaattttagtggcacctagtcgatatcgcgaatagtattggcatttttctaattttccatatttgcagtggcatggatctattgatccaattaacccaacccttagttaaaaaagaggagaggcgcaaggaaagcccgatggtatgcatagggcatgtgacatgcgagggctaaggattcgcagatttattttttaatagatagatatacatctaatagtctacgataatgagtccaccgttttaagtgaaaattaaggatgtgatgttttgctttttttttctcagaatttataggattttcttaatttaatggtgtgccatgtagcgaatgaggagtgtttgtaggagtccatgtggtggcttagaagtgtttataggacgtttaatggaattttagtatataatagatcacgagtttacctccagtttcagtccagaaatgcttgtccactcgaacaatcgtcctttgtctggatgagttgggttgtaacagcatgcttgcatttatggtgtaccatggtcagcaaggaactgaatagagcagtggctgctagaggaacgatttctgtccagtggtttctgtacatgccctttgaagcatggcatcagaatgcatcctagccatgaatttggtaacagctaaacatgctccagtgctatcgatcagtagtagctgcaatctctttctggatcatcagtgcaagacatactcaaggcaataaccaaattcaaaataacttgcaccaaaagagagtaaggtggatagacttacctaaatgacattaagtggaagtactgtaataattctattaactttcttgttcagaatgcaaaatgcagagattcttcgacatccataaaagctttccatatcatctcagaagtactctaattattctccataaaaattcagagatgatatcaattgttaatactttcggatgtcggcaatatcataccaattgccaagaatttcagtcaattggttgaggagcatgcctgcctgctctttcactaacatgtcatcttgctcaaacagttgctgttttcaccctttacacttgcttatccagtcatagttgccttaccagtatggcaaatagaggaacaaaaattcagcacgcatgcaagcagtcgagcacttctttctatgctttttatataagcattcgtgtatctacctgcatgctctgcaacttaacatcatgttctgaaaggcacctcaaccatgttgcacatgtcttcctcctctccactaatattaaccaatagacagatatactatcacagtatatatactctcactgagattggttgtcccctttatatttcaacacagcagtttgcagttccatcttgaatcaagacaaacacaatcaggagctagaggctctgccctctatctccaatgcctattcggctgcatatctttgtcaattctgcaaggcatgccatcaactcatcggcattcatttgtcggttcatcgcataccatcttagcccgcttttgattcacttatcctattttcttatcattgatatacttggttttgtttccttggtggtgctcaggccaagcaaccacaagtacaatcctcgctatgttgatatgtttttcctatcgacatctgcagttacagtcataggattagccaccatacaaatggaggatctttccagctctcagatagctatcctgactctcttgatgttcttagacagtaagatgttcctttcctttcttggccttgtccttgagtcaagcaagcaaaacaagcatgatcctgaaaaccgtagagtcagttcagttactgtgtgcaagcaatcacagctagaagaggcgactccccaaactccatccatgaactccattgatatcaagaagagatgcctcaaatacttagtgtttgtggtgctggcatacatgatcattattcttgtcactggttctctattggtgttcatgtacatagctcatgtttcaagtgctagagatgtgctaacaaggaaaagcatcaacaaagctctcttctcgatatcggtcacagtctcctcattcacaaatggagggttattgccgacaaatgagagtatggttgtattctcctcaaacaatggcctcctgttgctactcattggccagattcttgcaggcagcacactgttccctgtgtttctgaggttggtgatatgggcattgagaggactaagattagcaaaagctgaagagcctgacttcatgatgaacaacagcagcgcagtaggtttcagtcacctgctgcctaacttgcagacaatatttcttgcagttgtggaggttgcttttgtagccatgacagtcatcctcttctgctgcttgaactgggattctgtagtgtttgcagggctcagctccctccagaagataaccaatgcattgttcatggcagtgaatgcaaggcaggcaggagaaaattccattgattgttcccttgttgcgccagcggctttagtactattcatggtcatgatgtgagttcctctctttcaagttcttcacagtctcaggcaacaatcagaagagataacataacatggttgcttacatttcttaggtacactccatccttgacaaagttgttctcagcatgtcaagatcacaaacgaatcggcccagaaagcgacgatagaacaagcaaggggaaaccattcctgaagatgatggcattttcaccactcggcttcaacaccacagtgataatgctggtctgcatcactgaaaggagatcactctccactgaccctctcaatttatccacatttaacatcatctttgaggtgataaggtaacaaataacacttgcacacacacaattcttctcataatgttcttgctcacctccatgactattttgagttattcatcacccattgcttctgcacacagtgcctacgggaacattgggttgtccactggctacagctgctcgaggcagctgcagcaccaggaggggattgcctgccatgagaaggcgtacaacttctcggggtggtggagtgaaccagggaaactgattcttgttcttgcaatgctctgcgggaggctcaactcaaaggattccacaagcgcacgaactaggtgatgatgatcagaagcgatcagtatgcgatcgatgttctgcaagaatcaagaatgcagtgtaccatcccatcaaaaaaaaagaaaagaaaaatggatgccctcaactatgatctgcccctatgttcaaatttcaatgatcggcgacggcgcacttaccactggcggcggcggcggcggagggtgatgcccttcgcgggagtgccgcaccggagctcgccgccggcgaacagacggcgccgttgcaattcctgcaatttttcacaaatgcagacagtgaaaaaagcccctccttttcttaaaaatttaatggattaaaaaagagcacatttctccccctttaacctttattatatcaattagtaaattacattaatttaactgatcaatcacagccaggatcatgttgcatgcaagtatctagacgatgaacaggggggaacatgttctcaaatgaattgatagatgagaacaagtgaatgaacaacatatctaccaatgcttctgaagttctgaaacttgctacgaatgcattcatggtaaatgctagtcatcttctgcaaaccaagttgagcttcttcttgccaacatcagtcgcttgttggcgttttttatatgtgggcaaggcagctctggctttaaagcatctatttttgtattaagaaaacaattggtgttcatcatgctggaattatgctgatgaacaccaagagataaaatgatctcaaatctcttgcaacatcctgatacaatgggcgtcatgctcttaaatatataaagaaaatttgacacacgtgacttgtagagtagtgaagcttagtgcatacgaaaatgaattgtcctataattgctgctgcacaattacatatgaactttgacagaaatcataatgtcatggtgatggtcacatggtatatattgcttcagccaagatgaatctgtttattcgtccagaaaccagtgtcgcatcaaaatgaaaaaaaaaacaagcaatctgtgattgtatatatctatctgcatatgtttgaaaagatcccagaaatctcataaaccattcccctcaaggaactagtactgaatataaggagtatactataataaagatgaatcataatcagctataatatcactatttacagcaagaaataaaataataaagaaatagaacctaacaaactctgataagatcattgtggtatcctaaaaataacaaccaatccctaaaaaacaacaaccaaagtatccacagactgcaagcaaaagggaagaagctaactttgtgaaagcaaacccccactgtaccaaaacgatatgaacaccacaactcatgcaaaactacaagcatggaaagcatcaaagggcatcggtacacatcctgaaactcattttaagccatcactgcagtatattataaataaccatcaagtccacataaaattataataaaaaaagatatcttcattaaaataagacatcggaatacacatcacctatactatcaatatcactctagcttgcattcacccataaagcagttctggttcatgcctctcaatgtcactctagcttgtattcacctttaaaatgtcactccagcttatattcgcccttgaagcagtccggttcatgcattgggcgaacttagcatctcgggtaggatcgaaatagatataatcgtccccacacatgcctactctattgcctgcgcacttcccacaactaatgattcttgcattggtcagcttatgagtgccatgcgccatttctatgaagtccatgtcgccaccacaataattttcaatcggatgcgcaggatgcataatcctggtcccttcatattcacaataacaacaacgagcttctccaaaaaagacaataccaaaaaaaggttagcatcaaaatacaagaaagaatcattctataaattatatttaagaaaaggacacaatcatatatcaaacataccgtgttttgattttcttgagacggtacagcaaaaggatacatcatcatcatcattactgaattcagcaaagaataacttaagtccacttccaacttttggtcttgccaaaaagtttacatgtgaatatggacatttgaagtccaagaagttcatctggctgcccacacgctcatttgcaacacagattacttgaagatcatatagatatccctacaaccatgaaagaagtgaacttgtagaaaaatggcaattataatgacattatgaaaaggacaattacacactaaacatatactcttgttatcctaatcaatagggaagaagtgaacttgcaaaaaaaataaactacaatggcattatgaaatgggtaattccacaccgaacaaatcctttcatcattatcctaatcaaatcattagggaataagtgaacttgcagaaaagtgcaaccataatgacatcatgaaatggataattccatgctaaatagatactaaaaccaggaaagaagtgaacttgcataaaactgcaattattaatttataatgacattatgaaatgataattcggcgataacagatcctttcattatctcaatcatcaggtaagaattgaatatgcagagaagagcagttataatgacaatatgaaatagataattctgcactaaatatatattttcattatccaaatcaatagtctaactagagagcaatactttgaaagtagcacataatatggaatggaaagtactaacccttttccttagtgcagcttcaatctttctatgaaaaaaaccctgttgagtgacaaatttttccttgaacgctataaacatatccaatgcatctgtagacagatcaacaattgtctccaaagatttagcagagatgcagtttgaagatggcaacaacgtagctagctgaagaacatcattcgaggaaagtggggtagaagcacgcaatagtgatttaacggcagcctgcaccttaggtagagattgagtggaaaactgtacataagcttcgggctcaggatgaaacgatgcatccgctgcagccttgtaggcactgacatcccagctggatttccacccttccgctcctgccatttcaattgctttgcgaactttcagattattctttagcagatatatcatggcatcatgctcagaaatctcaggaatgcatgtaagcaatagcttgataaggccacgaagggaccgggactccacacgaacaaaggtggaggtgcagatcatgtccacctcaagtttctccatagcagggaaagtagagtcataccagagagtgttgacgatgatgttggtcacacaactgaatgggccatagcagtaaccaccgttgacaagggcacggtggtaagtggtaacgagcccgaacatcttgcataggtaatcgagagattgccttgaggtacttggcatgaatcttgtcaagtagaacagcccgaagtgatattgtcaaaccacctggcaccttctcacaattagcatcaccactagcattagcatcggtatggcagttacgaagccgccgttcatcagcaaaaatcattggattgtcagacttgtcaagcatgcgcggcttcttcttcagcattccagacagcaacaagatcttctcaacagacaatacatagctgcgatctgctagcacggtctgggtgacgaattcaagatgagacgccagcgaaaacgaaccagcaatgaagccgtcgacgtcaggctgcctcgccgatgatgctgcgcatgtaagggcagccctggcagcgtaggaggagatgtggaaccgttcatccttggtgttgtagcagcgatcaagctcgatgaggcggacggcgacgaggaggtcggcgttggcgaggcacaggtagcggagcgcatcccaggtggggaggtagcggaagtaagatgtgaggaaggtgatgaggccctccagcgatcgctcggcgatggttcgtgtctccggcggaggggagggggcgtcgccggcggcatccgacctcgctgctgccgatggcgtcttgatgcttgccttgcgcttgtgcttcttggcccggtgatcgggatcaggcttgtcggggaggaaggaggagagggtgttggcgatgatgttggtggtagggtcgccgaagccgaagcagacgccggcgccaacgaggcgcggggcaagctccggcaagtcgtcgagcggcagcacggcgagcgcctccttgtagtagccgtggatggtgcccaaaatcacggatcggttgtgggcgattccatccgaattgccgtaggaaacatccggcctcccgctgcgccgccgtcggccatccatcgccaggcggcgattagggtttggcctcgacgggggatttgatttgatttgatcttttctttttttttccttttcttttttcttttttgtcctttctccctcgccccatccggcctaatctccactcgacacttggacagacaaggtaaagtatgacagagagtgagtgggcctaaactgggacagattcgaggaataggagttctggatgggaataagttcactttgaacctcttaactagtgactgaatctgatccgtattctttaattacaataccggatatcttgaccctctaactattaaaatcggtgtaatttaactccctcgatagctttggagaatgatttcgctgacgtggtgtctatgtgccagtattgacttggctttatgatattgacatgacgcttaggtggcactacaattaaaatgggacatatttgtcattaaaaaagaaaaaatgtggggcccactggcatgtggcccccttgtcatcctctcctcgatccttcttcctcctcgctctctcccttctctgtctgtatctttctctctctttcgatcggtcgcatcgctgcctgccaccgagctgcgccgtgctgccgcctgttgctgccctctccttcaccttccgccgcatggggcagcacgtggatctcagcggcggcctgctacgggagcttgagctcgtaacggctccaaggtgtggcggtgctacgcgctcgtaacggcatgccaggaggactgcgactacctccactacctgctcctcagcgcccggatggccgacgagctccgcgcagcacgagattgacatgtacacctgcctcatctatctcatctctctcgtcgacagcagcaacaataatcgtcgtgtcacagtataaagcccttgtttcaacctcctctagtaataagataatttgggtggttcatctcaaaactgaagattatggcgtatgaagatgggcgagcaattactaatctcttttatgatgattcatctgatcgaagcgatatgctcaagtgatcatgtcaatgtttctgttgtgcacttgtacttgaatttctcctttgacgggagtgggctccatcacacgacggtgtcgagcggctctcccaactccatcatgttagaaaatgatagacacataaaccataaaaaacaataaatcaatcataaagacataagatttaacatggaaaacccttctaaagtaggagagaaaaaaccacggtatcccaaacctccggcgacgggcctccgcttcgctccatttaaagctggcctttattcgtgtgcaaatgaatttggattacaattcaacacttccatcccattaactcaatatttgaaactttttactcggattggaaaactttcaaatcaagattttaaaacttttaactcggatttaaaaacttttgactcaagatttatttaatctttgagttaatgtttttaaaattcgagttgagagtttcgaaatttgagatgtaagttttgcagtttgagttcaaattttaagctgaaagtttcaaatagaagtttttaaatttgagataaaagatctaaattgtaaaatacattaaaaaacagaaaaaggaaaaacatgcgctggagattaaaaaaatcatgaaaaaaggaaaacgcaccggaaagttggggagcgtgcaaaaacagcaataaaaaaggaaaaatgcgcagggtaggagcacctgctggcacgtacacgctagatagcaatcctctctcctcatttagccaaatcgcaagcataaacataacttataaaaatcaacattggcttcatgtacatagaaccaccaccatcacgagataacgttgccaaaaatattgatacagattaatgcagcaaaaaatacttatatttcagatatgaagctagagttttggagttttaaaaaagtaactgcaccctttgtattttgtggagtagattcacccatgttacttttaaaaaaatgtggatatttggttcggttcctacttcatcggataaacatgccctcatgtggtagatgcggcaggagtaaaaaaagaagaagtaaaagaaaaaactagaaaatgcagaaaaacaagagcagattattatgaatcttgacgaaagcaagggaaaatctaaaaaaaaaaatcatgaaatgatgagcatacatatactgaattttgtcacgaccacatgtccttatctgaccagtgggcccacgtggcatagagagagagagagaaagatgcacttctttccgcccgttagaca

SEQ ID NO: 16860 - DNA, 3221 bp, Oryza sativa
aaatagaaagatgttttaagattttttttaagaaatcaagtccctgtgagaaatggccttttctgacttttggttcattggagcactcttcagttttcacgatcatgctactactgtatctcaaaaccttagatgataaatgatgcacgaggattagttgaattgcatttgatcatttgttttatttgttaggccgtgtttagtttcccccctattcccaactttccatcacatcatatcacatcaaaaactttcctacacacataaacttctaactttttttccaaactcccaactttcttcaaacttccaacttttttcaggaactaaagacacccttaaggtaaaagttaggcagtaattctgcaaattatcataaatacacctttgttgtgcctatagctttcccttggtaaatgcatgctgcttcattatgatgtcctgatttggtgttttattttacttaagattcagaagaaggtagcaatccaaagcattcacaagaaggtacaaacaaaaaggatgcagataggagggtatgcctatctgaattggttactgttcgtttttccacttaagttctgcttggttttttttctaatagcctagtgctgtttcatatgtgcagatatcacccacatcaactttggagtcctcatttgattcgcttaatgtaaagaagtttgatggtaagctccaagcagatcttttaaaaacttttttgctttgtgcttctgtcgggattactatcataggaccaaaagtttaaaattgtagagtataatattaatttattgcactttctgctagttgccttcacggttgatcctttgtaccatcaaactaccgcgcaatttgatgagggtggggcaaagggtctcttgtcatataacctcggagtatatgacagttgccgtgtgctctttgattcgtttgaagcacctgacaagtgcatcttaagtgatatgcaaactgagatggctgagttgattggtctttcatttgctaaaggtatgattgtcaatctgtttctattctgctgtctatgctctgcatttttttatttccatttaaggttttgtaatggtctactcttaaacagagcaaatcgagcagatgataattcatatgcccctctgcaatgatatttctcctaccttgagcaatatagtttatcagtttgatgatgaaaaccgaagaccacctcatgaagcaatttctaggcaaattccagtgatggaagatcaggtggttgacggtaatgatgtggcgaatgatgacatcacacaaaatgatatgcaaaatgattgtggaacttgggattttggaggttgtgatgatcaagagagcgtgtatgatgaacactgtgacccaatggatcatagctccatgaacggtcaagaggtacttcctgcaaacagtaaaacctagacacattttgtgtgtggttagagcatgcattttttgggggttgacagcttttgttcttttcttctttttatttcccaatgtttccaattactggagttttctgcgcagtttaaaaatctatgagaattgacattaaatgaatgtgagaaaacattgattaatcatggtatcaattaatatttttttaagataaaagtcaaattgagtaactttgtaggatgcaatttgatgcctattacttatccattcattcaccatccaatgacatttctttgattgaaatgtctgaagtactcagttcaaattatggtttatttgtttgttttctgaagtataaatatctgagggtatatttttttgcaggaaactgatgagtacacttttgagtctgctgaaggtcttgatgtaaatgaaagaattgacaaaattgcagatttcttgtcatttggcatgggattctctgcaaaaacaaatgcctgggcaggacctgagcattggaaatatcgaaaagctaaaggtactatgggtacatagtcctgttttagttttgtttcaggcaggcttgtttaatctaacctttgggcttacattcaactagatttggaccctgtcccaactaaacctgatgattcagacgccccaaaaaagacaaagaagaaaagaggcaaggatgaacctgacattgatttcagcaaagcattggaacatgatatgccaaatatctttgcaccccctaagaattcaaaatcattgctgctgcccgcaaatagggctaccagcaataacaaattaaaatcattgctgctgccggcaaatagggctaccagcaataacaaacttccagaggattgccattatagacctgaaagccttgttaaattattccttcttccggatgttttggtaatggcaatttcttataatttttttcttgatatggatctggggtggttatagtaactatggatctttttgtagtgtctggctcggagaaggaaaaaaccacttggtaagttttctatgttcttgcattgtgtatttcacatgaagttttcttgttgccttgttattatatcttgaagtcctgttgtaaattctgaaggttcttaaattatttatcacatcttccctgttcatattacctgtgttactttcctccagctccttttggtatttgatatatgggttaattggattcatgccattgcaaatttaccgtattagaaaaataccactactattcgtgatatcggctgagtgccattataattttgtaaaattagatctatgccatcaccgttatattttctgtcagactctccttcctttcttctcctctcctttttcttcctcttcttcctctacctgctccttcttctcccttccactgctatttctgccactgctcctgctcctgcccaggacgtggacagcgaccaccaccagcagcagctcatcttccccatctctctccactgctattgctactgctgctgctcctccccaagaggccaaggcatgagcggtgaccaccaccagccgatatgacgaataatagtggcatttttctaatacaacaaatttgtaatggcatggatccaattaacccttgatatattggtaagttcatattgctacttaaatacttaaacgaaacaatctgtgaatcgtatgatgttagagtattattatctgaaactgtggaatgcaaataagtataaagttcaggactgggtttatttatagagaatgctctgcacaactccaagaaaggtggtaatgtgatactt

SEQ ID NO: 16861 - DNA, 38068 bp, Oryza sativa
ctgatgacttcatcccatctgaaccttgggatggtgatgatttttgtaatgatcatgtcgatgaaggaaatggtgataccgatgtagaggatgcagtagatcttattaccaaaccaagacaggtgcgctccttttttcttttgccttcccttgttagacattttggttttgtgtgcttatattggagtctggttctgtattgatatttcgatgggcgctcgtacaaagttgcaattgacaccatttgaaatactaaagctggttagatctgaatgtagtaactaaaaagcactataacatcagaataactttacacaaaagaaattgtgtaaacagaatgcagagataatagctacctttctagttttctagttcttgaactagacaggtagctatattttgggatggagggagtaattaattcaagctttaacattatgtatattgatgtctgtcccataaactttaatttgtggcctcctagaaagcagaatcacatgcccatcaatatatgttaaatttatgccaagtcagtgcagatttaactcttatactttgggtactgaacagtccctagagttctgttatattttctgtacgacaaatggtgttttgactcccctccaaaaaaaaggagggcgttttgactttttgcaaatgtatagggtttacatgcctgatctggcttgacatgagttggctgttcgtagtggtggacatctatgctgctgatttttatggcacaataaatgtatccaaacaaacgataaaagtgtatcttgcaaatttattatgcatttacaccttacctatactcaggagcttctattcttgtgagcttagaattgctgacctttcgacagagtgctctgccagaggacttacatgaaaaaactagtgatctgaataaattattgtaatgtgtttgagtttttaagatgaccttgttttttttttaatgttactaacttacttggcctggtaaagtctgaattaatacctgtttccttcctaaatcaaaggtcaacaagattgatatacaatatgacaaggtatcaaaacaagtcgatgttcatgccttgaaagaagtgctctggaatcacatcaatacatctgctgacactgatgacctggtaatatcttctgttattgctaaaaattgctatctgaataacactaatacaatattgttttcattttcgtaaatagaatagcttaaaatgtaatcaataaaacacgtatgtttgttatttggttaatcttacccgtgacatatatgattgacaaaacttaaggttttattgtgctacattatatagtacagggtttacacgtggcatactggcatatgctttacaacatctagggacttaaaacggaatattaacaactatgctgttatcatccatactgccacaaccagctttctggaaactatttgtttatattcttttggtaaagtttatttttgatgtcgtgtttgatattttttgtaatatataaaatgggtagaaattaattaccagttgcaactgccaggacatggataatgaggaaatgattattatttatacttgaaacttgaaagtcaagccagttttttgctagtttctggctttcctcaagtataactaataacattgtgcccacccaccagacacaagtttggaacttggttaatattttgataattcaaaactaatacctgtatctgtttgctgaaaataagtttgttgcaaattgaaatgtttcaagagccctttattgctttgttatcctagtttaatttgccttggaaaattttcatgaagagtgtctaggaggatatttgtgaactgtgatactaacaaacatgaaaaatttgctttaaaaaaaggaatatctgtgtaattttctttgaatatatcgaaacatcaatatgatagacttgatactctgaaattcgaactgaacctttctccctaatttctgttgttctatattaatatgttaacaatattgtactcggttaaaatttgttcagcaggaagacaaggacacagaatcacccctgtgcctatcgaaagtattgcaagatcttccaagctgcaaccctgatgctgcagcaacagaaatttcaccgcacctatatttcatttgcctcttgcatttggcaaatgagcacagcttgaccttacgtgatcgtccaacattggatgaaattgacatatacattcctgcttcatctctcgtgaagtaatcctgtagttcaatatgttgtgcatgtttgttttattttttgttggttagggacttctcgttctcggtgtattattagattgccttgtatgttgaagattatgtattatgtaatgagcagcagattattggattgcgctaagctaatatataggtaacctatcatttactctagttgacctaatgaactatatataaaaatataaagtagagaaaatggttgttttgccaaggtgattcctttgtgacagtactccaatcatcactatttgatgtttgtgataaaatttggttaaatctgtacatcaattttattttttttctcgaaaacgtaagagaattgcatttcatttcattagggaagaaaaataaaggaaaatgtaaattaagtacatcaattttatatagaacaaatttacaagatctaattacttcatgatgtactaggacttttcgaggcaaatgtgcctgtaacatctcttttatttctaaactaactatttgagaaattattaatagtttaaattttaaaagttgaaccaaatcttattttatatatcaaatattcttaattggatggagtatatttttttttataaccaaccgctggcctaagtatattaagaggagcaggaatttacagttttgcttagagcactgaacaacagagcacctacaacttatatccagggtttaccaaaccttatagggtataaggtgaggttaccagcatcccacgatttagcggttatcgtgaaaaccatgtggttaccacaaggtaaatcgtgtttttaaaaacttagaaggttaccgcacgtgataattacgataactgtacggttttgtaaaccttgcttatatcaaagatagctttctaggtacacacaaatgaaagctgccccgatgcatttcaaagcgtggcgagcaggcccaccatcttccaagtttcccgttcatcctcgacctcgatagtcgcacacaatcttgctggtgaggttgcttgtccttcgaaaacacgaactatgacatttctaaacgtcaaacaaaatgaaagattgacatgctacatccagaacggctgaacagaagaacacacgttcgagaacagaaggaaactgatgtctagccagtcactaactaattaatatatcctgacatgccgacccttggaaatataccaacgtactgcatttatgttaattgcttactacatatatatgccttgttctaaagaggaacaaacatttatactacagttcagatgtaccggctactatttgtttgttcagaactatttaaaaaaggccctatcaacgaactagccgcccaaaatcgatggttttttcgtccaagcgagttcaccggaggagacgaggccaggaggggccattcatccattcattcattcctctccaatgtccttttgcccggcgaggatccttgagatctggaggccacggctgaaggcctggttgaagagcagtcgtgtctggaactcggacacgaaggggaaccatgacaagaggccgatggggaggaagaggacgagtcccatcaggttctcgtacgacctcccgagctccatgatggaatcccacagcattgccttcttcaccaacggcgaacatgcctgcccaatctgtggatgaatgacaagatcatacaaatcatttgggtccagattacgatgaacgctaaaatttatctttttattgagaaaatggacagggttttatatttgttcttggaattaagttttatgcttacaaaaaaaaacaaataagtggtgcagaagggtttcactcaccagaagaatgcaccaaccagtaggcatgaacccaagaatactagcaaaaacatccgaaattgtgaggttacaaacgacgaataatacagccatcacagagacaaaaccaaggaacaggaggcccttgagaatgcggaacataagctgcagatctgttccaaacttctgtcgcccaatcgaaaccatctgtatggaagaaacaacaaacaacaggtaagattattaatcatctgaggtagtataccacctgacatgctgtagctttacctttagaactactaggactgagagcataaccagccatgacaatccatatacctagatattgaaaagaggccagtaaattaaggtatatatcctgcaatagtaggaactatgaaagtagcaagcagaacagattgtgtttagatgaggtaccagaatgcttttgctgcggcgtgctatgttcagatggtacacaataccgtactgatagatcaagaagcggagcgaaagaatgatttccaagaggagagagcgaatgctagtcttcctaaggtgctcctgctcacttatccaccaagcctcccagctttgatccacagacatgccgatacccccacggttccccatccacttcctccaatctgtccagtcatcaactgtcttctgccattcgaagcatgacggattgaagataaagggtgcgaagagccaagatgcaaccaggaaccatatggagaaggtgacaaataggtacatgcttgagctgcggtaggaacttccatacactaaataaaccaccagaagtatcaacagttcaagtcctttaacaaagtggctgcgggagtacatgcggtaattgtcagcaaactttgcatggtagacaacaaatccacgacctgtaggtctgtatttagccccgccatgcagtattgttcttccgtagtagtgcgttttggtgccaagctggaatgtgaaaaacacagatgccagctgaagctgcatgataacaaactctcctaatgctgtgcggaatcccttttctaagccaacttccattaccatagggagaacaagcagcaaacctagctggaaaaaagactgcgaggccagtgcgttttcaagaggcttaatgttctgctcgatacgtggatccagcaaaatagacctttccagaccactcataactagatataacctcccatatagaaacacataaactgtaagtactgtaacctggataaaggaagaaggatgtcagtatcccaaatgccaaagtgaaacacattgtaaaaccatgcctatactctcaggctgaccaaaatatacttcatatttatatactaaggaactacagcaagaatggccaaacaaaatattttctttacatgaaagactttccaaatcttgatgattttcaatatactggtgactggtccatgaagaaacaaatggctccacgttagaccatctggtagaggaaagatgtcctttttgttcttttgtaagtaactttctacaattttagtgttatacaatttttagtagggttgattctcaaggaagattatgtttagtagtgttatacaagacagaaatacctttttaggagctatcaataatataaacttccaaatgaacatgttcaattaatattcttaccatgctactaaagtaaaacccaactgtagtaaagtagaaggatagcattctataaaaatcgaatctgcgccccagccgatagatatcacgactcaatgtttgttcaccattgccatttgccaccttagcttcaaagcttgaaatttgattcattcccacatcacgccccttaccaacttgcatatactcatgatgtgtgacattcccttctctcattgttgaattaaaacctataagaaaattgcgtttcagtaactgcatgctaggtaatggatttgtaaacatgtatgagatgcacggcttacctgaaaatatatcttcacttagatttatagtctttgaggctttacttatgccacctctagtaatatggaagagtctatcgaaaatatcaggatgaccataatggaaccgaaccctgtattcatcttgcaataatgagttgtagacataaaagcacaacatgataaaaaatatacagtcataaatcaatgttaaatgaaacaatatctaaccatgtggaaactactcaaatcttagtgaaccccgctccatgtcataactgtttagttacatttgtagaatgatttccagaaagctaggtctgactttatttttatagttgtgtaacaaattatcaaagcatatttggtagtttccttttccagttcatactaacacgggcatgagccacttatgatttccaaacatgcaataaggattgtgtgaaccaattgacaaagctatttgcgatcaaagtaagagtaactccagatacttatcagtgttttatggaaacaataaaagattttaaaacaattttcagataaattgcagttagcaattaggccaaaagtctactctgtctaggaagatgtggaacttgaatactggtcatggtctcatgggtataacagtcatgggctcacgactagctctttttatttggtcaacttattactaacaacacttcacaagttttgttttaattagaataatgagcttcccagttcaaaaatcctttggattttttcacagcacaggatatacattctttttgaataaggctgccatgtgcagaaattacaatgatggttagttgtttatttagctttaggaggtaagtggctagaaataagacgactggtcctttcttcttgaagttttgtgccatttgggttttgggagacgatggtgtaatttgctatgccttttgctgtcaacctcttccacaagagttttggtgaatggagagcccggccaggacattgctcactgtagaggcctccggcaaggtgaccccttgtctcctatcctttttatctaggttatggacgcgttgaacttagttgtggcgtgtgcggatcgtggaaatctcctggagcctctcactatcccgcgacagcacaccaggtttctctgtatgcggatgatgtggtcatgtttttgtgtcctacaagtggggacctatctcttatcaagcagattttggagttttttggttagatttctggactaaggaccaatatgatcaagagctcttgcactcctattcactgcttggaagatgatctggaagtgatttctaatgagttgtcttgtgaagtggcgagcttcccttgctcttatctcggacttcctcttacaatccgtaaatcaaccaagacagacttgttgccccttgtggacaaagtggcagataatttaccgagttggaaagcctctttaatgaacagggtgggtcagctaataacagttaggtggtcctcttggctattcctatttatgcaatgatggcgttggatcttcctaagtgggtggtcaaggctatagataaaaggtgtcgtggcttcttatggaagggaagagaaaatactaatggaggaaattgtttgatctcttgggatcgtgtgtgtcggcctttgtcctatggaggccctggtatccctaacctagaaaatatggggtgggcactacgcctgaggtggttattgtttcaaaaaactgattttgctagaccttggggcggtttatctattcatgtgtctcaatgtacgttctcttttcaatgtggctgtcaaaactatagttggaaatggagaaaatactgaatttggagtgataggtggctgcaagggaaaacagtagcagagctggcgcctaatctctttgccttgatctctaagagcacaagcaagcaacgtactgtggcgcaggctttggagaacagaagatgggcggctgacataaatgggggctatctgttcaggttcttaatgagtacttgcatagatggccaaatgggctgcccggcccagcatggcccaggcacgaccgtgcctgggctgaggtaagtcgggctggcacagccagacctacatgtcgagccgtgccgtgccaacccacgggctgcacacggcccaggcacggcccaataagactcgggccgtgccgagccgtccgaaagcacgacaacccatcattcttcttcacagaataagtctatttttgctcctcaactcattgggctgtgtctatatggctggaaaataagtctattttgtattcctattctctttgggccttaccttatatggttgattaagtctattttgggtctctcttactttttttcttcattcgcgccaggccgtgccggcccatcgtgccgaggaagcagcctaggcacggcacggctgtcgggccgggccggcacgggcatgaccctagtcgggccgtgccatgcttgggtcgggccaaattgtcgtgccttgggccgggccattgggcctcgggccatatggccatctataagtacttgaccatttgggttttggtagaagaggtggttctgctacaagatgtacaagatcagcatgtttggaagctaaccgccgatggatgtatacttgtaaatctatctatgaagcttatttcctgggatcgatcaagtttgctccatggaaaaacatttggaagagttgggctcctcttcgctgtaagttcttcatttggttggccgtcaataagaggtgttggacagccgaccggcttgctaagcgcggactgcagcaccccacggcctgtcccttttgtgatcaaagtgaagaatccgtccaacacattttgatttcgtgtcttttctcgccaagtgtggatggcactgttcttgaagctagggttctctgatgcagtgcctcaaccttcagccgatcatttttttaggtggtgagccaagctacaaaagaccggccaaaggacgtgcgaaaatggctcaactccttggtcatcttagtggcttgggagatttggaagcatcgcaatgactgtgttttcaatgggcgccaatcctagtattgcgacggtcttgcaggtggtagagaatgagggtaatctttggtgtttagcgggggcgcctgccctccaaaagtttcttaataggtcggcaaacctaagcagctagagcttgctggtgttggctggggcgtgtgggtgtgttttttcggtaggagggctttggatctcctactttgtatatttttttctttatttcttccccttaatgaaatgatacgcaattctcttgttttttcgagaaaaaaatagattttttagatataagagtttgagatgtttggtttaaggatagagttagagatatgatttattacttcctattggagaaagttgttaggggataaacccctataaaagttagagacgagccacatcaactattcacattaagcaaagaatgaactaatctagttacatgctcaaatcactcatcccaatttatagtattccctcttcacatgctagcaccacctggctatcctgttagtggtgtctatcaatgaatgaagggccataaaaactgacaaaatttaaaacaataatattagaactatcaaaactgttcataaaaagatagtggtttctggtgactgctgtgggcatagtgatgtggtcatgtgactgaggctgaaacaacttttcaaactagctaatgactttttttttatttgatctatggattatttgttacttagataaatttgctacaactgaaataaaatataattgaactgccaaaagagtatttctaaacaaaaagaagccactgtttatgagataattaaattttattgacctctacaacaaatgtacccaggttctatatattccattgtaaatttagatttttagaatattttgatatcatttactaatttttaaaactcaaaacataccccaaggctaacaagatatttgcatatgtaaaactattaaatgattcagatcaattctaggcgaattctcagttgcaccatagattatttagagccaaaacaaattcagccattgcaaaggaaaaaataaagtctatttagctgaggtaaaattatttttttaatcattaaacactatttattgccatagaattatactttaattcacttggatcaaatttatcaatgttataattaccccatagagcaaatgagaatttcttttgaagtcattcattagtcgttgaaattcagaaatcaaaagtagttttagctttacatcatgtcccgcctgaccgagaaaagtttaagaaatgcacggtgttgatagttcagggttgtttctcagactgccgtgacagttcaaggttgtaaattgtattttttttccttaccatttgacattttgtatcaacagagtattccatccatactaggttacaattacttttgacatattaagaattgggcatagtacttatccataattgatctgttttgtaaaatacttatgtaaggatataatggccttttatgcatgattgcctcaagataaagctgaaatgattttaaaatggttctcacagtactagttaggtaaaaggaaaaaatatcatcaaatactttttaacttttaaatggatgacgcacccaattcaaataggttaccattctgatgaaatgcatcagaaaaaaaaatccttaaaaaatccttctaacacaatgttaaaatgaagatttacatacttgagaggattagccaagactcgttgcccaatggtaacaaaactggtctcttggttggacataaaccaagcaagtgatgaaacactaaaatagaaaacaaaatacagaaaagggttactaatagatggcataaacaagatataattgaccagaattttggatagatacacatacctcccagtaaaaatgtgctcacggaggcctaatatagtgggttttctctttccatacttttcactctcaaactcctccagcacatttctcattttaaatgcctcttcgaggtaattatcctacgagtaaaggaacaatattatttttgtattgtacatgtaaaaatgtgtgctagaaatagtttaggtcagtcccagctggtccaacgcagttttgtacagtttgtacatgtatatattgatcatttgatccatgactaagactactagtgtttctcccccatatctaatatagtaagaaaatcaacatattgagttcaaaattaagctagcaaaatttcaagacaccacaatgtctactagcaaatgagcatgatttttttatagtgtttccctttttgggtatatgaacatgattctgtaattttcttgggcagtgacacaattttgcagtgtgtgtcagcaaaaaccaacaaaatgcagtgtgtaccatagccattgtttgcaaaatattatccaaagtgggtcataggggaagaccatgtatgatcccaatatacatactttgtccatatggctgagttgagcctgggcgtgaggggctgtatttatgactatttgtttacatttctcaacaacttcagtgaaatagtcaacataaagggtcttgaaaaataaaatgcggaaatgagtatacctgattcatatcaatggcctggagtgcctctcccctggtgaaaacaatggcatggttttgattttcaggttttccctctccaatatctgtaggtttgccaggaagcttgatgcgataaatttcctaaatcaggtttaaagcaccatgtatgaattatgccatagaactaaacacacagaacagatatagtgagctgttgaaaaatgacgagtaggtattaacaacttaagaagtgcgcatgaaactacaaacttcaatagaagtgaaaaactttatatatggtgctcatctagaaaagggacatcaatatgaagtcttctaccttctgaaaattttaattgaacataatctttgtaaacatagttccacaaacgcgtaaagctctctgttcaatgggggtacctcatcatacttttcacctcctttgacaagaacagaataataagtcttctctgttgtcccattaccagctggagcttctacttcatcaatataagcaacacgtaacgatgggtacctgtccaatttaaatgtcagatgggttgtagtaacattattatttatgatatagctttattaggtcacaagcacttggtttttatacattaacatgagattaaggatgtttaaatagcaagctttgtctttgggatccttggatgtcttttgcattccatagacttgacaagagacaacataggtaaatttgatatcagcaattgcccgtgccatatcgaaactggcccacccctgttgagaagactctactgttctacgatgttccagtttaactgcaaaatgttaaagttgagtcaacaaatatatagatttacaaagataggaataaaaacagagaattaaacgaaccaatatcagttttgtcttgaatacactgaatctcaagtgctctgcggtagtacatcattcctcttactagtaaagcaaaaagtaaataattagacagtatgttaatatgtagttaatgtgccacacaattgcatattggtgatattaccagttctggtgagtgtttgccccctataagatgcccagggccggatttcatccatctttgttttcagtgattcttcatccgttggttgaaattctatcctctcaagaaaattcttccattcatctgtagcatgcaacaggtcatgaatgatttactgagagactttgctccaattgtgagatcaaacacgtacagatacctggatatattttccgtagatagaacagtatggatattccatcctcattctttttataaaggtcttctgctgaaaagagcacctcctctttgaagtagggagttaaaacactgatgcaaaagcagaaaggctgtcaatcaaatatacttttcagtaaataattactccctctattttaagtcgttttagttttgtcctaactccaacttttgtaacttatatggagtttatagagaaacgaaactgatgttgtagatgttggtgcatttttctataaactcgatcaaagctacagaaattttacttagaacataactaaatgacttaccatatggaacagagggagtagtatcatagagcagaccaaagaaaaagggtacagtctattttgagcccttgaacttctctcaaaatccatttctcaccctgaactacaaaactggtgttttttttcaagtcaactttcaaaaccggacaaagaacacttcgggacatatattttagtggttttatttgtaatggaggtggtttttgtagttcatacccttattatgcataggcaaatgtcacttagttaggtccacaaccatgaaacttacctaattgaagttcatgctagcaacttgatcaaaacgactgtgaaatatgatttagggtgctatatgcttggttctgaaaattgggggtggaaagtaactggttttgtgttcagggtaaaaaatggactttgagaaaaatttcaagggccaaaaatggactttaccccctcacaaaaagaaaactacattgaccttggcaaataattatggagattggagagcacttatgtgccaaaaagtaaaaggcaaaagacattcggcaacactggttggtgaaagaagtggagggagagttcggtttcttacctaaaggacatcatactgcggacctgtggagcctttggcattttcatgaaaagtgagtttgcaaagaaagtgatcctgcgacgagcatccaagtttgtaggtacatatattgcagattctttcgttgtcaataatagttgaagcctaacacactgttaacacagaatcccaattcataatgagaggacatcagtacttgtaaacttatggtagaaaagaatattcatattgaaataagttgcttggatggacatataaccttctccttccaagttttatcttttactgaatccagatttatatttgcaaacaattgattgtttctgttttcatccttcaaaatactgcatgattggcaaaatattggtgaaaaaacaaaaaaaaaagaactcttgactatgcacacttaaatatagatcttacccttgtccattcttcataatatcctgtgtgatgatttccattatatcttgtaacaaattggcaatttgtgtctttatcggttcaatgtcttcatcagttctctgcaaacgcaagtgatcattttttggagaagaaagaaaatgtggtacagagaacatatagtcaataggatacaaaggtatgttatcagtaccaacaatagatttagcagcttatcaaacttagcacttagctgaggaagttcatccaatcggaactcttttacaagtgactgacgtcttatgctatcttcaatcctatcatgtattctatcaacaactctgcgccaatgaacaatgcaatattaattaaattagttagactgataaccatgctaaattaattttctcagaataaacatagactcaaacataataagctgaaaaaataaggaaaggaaagactactcacttcttatcactttgttccacaataaggctgtctagaatactaaacaatgtctggtagcattctactacagcataataggtatatggatcctgatttatcctctttctcaattcttcatccctttttttgacactattagccatgtcaagtgcaattggaatctggaatatcgtagtcatgagcaacacagtactgcctctccaagaaaatttagtagttaaataagggaatatttgagtagtgtaccttactagcgagaaggaaaggaggccactgaaaaacagtagtatcacccatagatgatggaacaatcagtaaatttctctccctagaaacaaatcaaacacagtactttaaacatttttgcagtattttttaaaatttttaaagtgtcaaagaaatggaaaaaacattaacaccaaatgcaaacctattgcttattaagtcttcttctctcaaagagtgaataaatgcattccatatgtcagagaacttgttaattttgtcttcctggtgaaaagggttatcataaaaacaacagcagtaagtaagctatcaagtaaactaaaaaaaagatttctagtataacgttttgcagaactgaacctcatgctcgtgtctctttggttgactatcatgtccaggcacaagatgtttgccaaatgctattggaattgcctcgaatcgtgatcttaacattccaagggtccggatctgcaggaaggtaaatactctgcaagcattagtactcttaacagcaccagtactcaaactgtacaaacctttatatgctacaaagtaccaacctcacccaagcggctgaaggcaccattcactccaccacatattgttgaaaaaatggcataccatatttgtgtgtccatgaagtatacctttataagaaatttaattaaacagcttggtaatgacatcgagaaagaaaacccccctaaaatgcatgaactgatacgtaccatgacaattggtgcccatacagtaattacaacacctaaattatgctgcactgggaatattcagcatccaatcagcacttaaaacatcgttcaaaagaattacatatcatctgtgtactattacataatcttacagtatggaaagaactcatgccatgcgtattgccctcgtcccaagaacataattgtcctcgttggtccaacgagaggataaatctgtgaacagtaatcacaacgcacagattatacaaaatctcacaagagaatatttgaagtttcacaagagaacaaactacaggcacataacaagggaattatagaaaaaaaaaagtgttagttaatccactagtcctgatcctgctcctgcctagtgcaacagataaatttagtctaaaataccatttagcttcattaactggagtaatcagttagcaatagatgaaggggattaaatgaggaggcttatttcaccttttattattttttcaagtcttggttaagacttacagaaggataagttgttttctctgcattaaaataactaggcctaattggtcaggcctcacttatgtgtgacacttgttgggaaatgttcttttggtgaggggttccttgaccccttctttggaaatatttctctgttcttagtgaaatgaagcgcagttctcctgtgtttttgaagtttttactctacactattacataaaagagaaactctacactacatgttaattccaaaccaaacacagcgtcatgttttcatcctcaggcctaaagtgctaagagaacagtgtgttctcaaaacacaacaaataaacagtctaaaatttcctaaaaataagtctaataacaacattatctagtcatgtccaaattgagatagtacgttacaagtcccaacctaatgtcgtcactcgtcacctcaaataaaggacacatgtgagtatatggaatcaaccatacatgcctatgcatccattattaactagtatatgtaataccagcccattagacactagtataggcctgtgtggcccatgtcatgtagcttttgtgggattagttccatatgagctaagataggtgggtgccatcatataaatccacacattccaaccatagcacctcaagtttaccctttctttacacaaaacgagaacaaaagtgtaagtgaggtgcatgtatacatatgagcccatcccataagggctggccggtgaattttgaaagctgggctgttacaatatatggacccaaattcatcatgttccatatatctgcatattaatctaccaggcatctgagcagcagagttggcactctaatatatctttaacacacaagatacatccaaatcaccaaaagaggtaactgttatctagtgaaaaacaaactataaataaactggggaattcagttgagcaagccatgctcttgaattcacgtgcattttctcaaagattggactgaaaaaatccactattggaatagaaattcattcggatgagtaacaggcactcgcctatagtttcagtcacctctttatttagaaaacctacccaaaatcaatccttttctcttttttattttattttttattctagtttatttttactataaagcacagcaagaaaagggagttctttgaagcagtagttttggcaaaaagaagttacatgttagtcaataataaatcatataatcacccatggaaacatggtagcaaatctgacctatacttaaattagcagagaactgtaatgttcagattataccaacctcaacatagaaactgaaggcgagcttgcatatgagcaatagtatccagaataatgtatacctgttttcatgaagagaaaaaacagctttagacagagataataagactcaaaatctaggtaacaagaaagtctaggacttactttagaagtgaacatgtatcctcatacatgcctcgggcaacatatagctttggctgattaataaaagatatgggtgagaactgacaacaacaaatagctctgctaagttagggctaatcaaatattacctgtgtccaccacaaaaaaaatctaataatgcgagaatttgaacgctccaatacccttcgaaatggtagaaatatgaaaaacaaagcactgaatatgtttggtaacatgtaaagagcaacggcaaaattatatatcgattcactctgcagatttccaatccagctgctgaagaacttgataaggcccgtggaattttgaatagaactcatatacgttgtaggaagaattatcaaccaagcaacagctacaacaaatttcaggatatatcgtatcatctgcgagcactccagactcctccaagctttccagttaagaattatctcaagcgtggctgaaaagttcaagagaataatttcataaattgtgcacaagagtacacgagaacaattgcccaaataattacagtacttgattgggtagaatcattgtaattttgcttctcttttatgtattctttgtaattcttttgtaaatattttatatttataaaagtaactgcatggaattttttaacccaaaaaagttaagcaagccttacttcaaaaaatttggagtaaatacctaaggaactatttgggattatgagggtggtaatgataattttgtttggttgaatcactttttgatacttgagtgtttggatatctgccctccttttcctgatcaagttgtacatggataattatcatgttctcaatcatatgagacgaaaagatttaagacaactattggggtaaaatggtttatacgattccaatctggtttaaaaacagaacattaatttttttttgttgatagaagctttaagaatgagcatgatagaacaaccacaagttgaaatagctaataagttcacaagatacttaaagttcataagttccaaacttaaaatgtaccttgcaggaagttcagaaatgcagccgttatgaatattgtcaaaacatttctgaaaacagtaggatcaaaaatagcagacggtaatccagaagggctccaagcaacaattaccatcgcctacaaaataaaacgaagcatggtatggtcaatagatagaagacatagaagctttgtatgcaagacaaagggcaatagatatacctggaaggctaatataaagaaagcccacattcgatcaaaacttctgaataggtgcaaaaatgtacgaacttcaacaaaatttgttttgggtattctccgtctggtaatcacacgatcatgatgctgcataattcaaaaattagttacattatcttccaatatactttcattttgatcagggatcatatcggtaacatacacagtaccaaacatacatctgttctttgggtgactttgcatgattgtacatctaattctttgttaaaattaactgtgatggagcatatgttcaaatgacaagtctgggaggatgtggatgcatggcaagatattcagcttgtgtactgctagcagcttgagcaacacgtctgaagaatctacaaagtgcaatgcatcctttgctattagcagtgtggaaggcaatgcagatggcactccgctacgaaagcagtgtggaaggcaatgcagatgcctcaagagagttaatggaaattctctttccatctaaaaaagatattccagcaatggtttcacgtaattagttcacaaaagaaccgagttttttatgttcaacgagagttttatccctgtctttttcgtcgatatgcattgctagtttgttcaactatgcttttcactttcttttccttcactgccaatatattggtattattatcctttacacttactcatatttttattagctgctaagtgtttccagttaccattagtgactgttctatatccaggaacatgtacaaaccaaagaccaaattatgctatattgagtttctataatcccttgcatggtactgaattttcattttgattcactatttgctcattctgttagttgaccgtcagaatttttaatattcaaccaaatttcaagatataataaaggagggtggtgaaaatattcaactaaaaagaagatattttcaccaagtatttgaagacaaaaactaatattttttattttggtaaatttcaaacagattgttccattcatttttttattcatactaatgttttcaattttgggtttcaaatttggttaaatattgagacttcaatgatttaggtaatatcacatcctctgaaaaaaattatatagctgaatttttttgagggtttatttttagtgcagaggcttattgattatggttgcgggcaagggcttcgtgatcattttggaaagtgtaacagccaactcatgctcaagttaactcaagggcatgaagtcgatgagcaaaattcaagggtatgaaagggaatgagtgaaatctcaaggccatacaggaaattctctcatattatgacgttgatgtatcctcaaagcacctcccacattttcttaacaagtcccatcgtactataaagaataaagtatgtaataactatactagacagaaatcgctacatcaaattgatgatatatgctctaacaatattatgtcacatgatgtaaaatcaagcaagaatttcttgttctcatgccagataaaatattgcattgttgtaaaaaaacaaaggatcaactgctaacctcttcagttttaattttcagaggaaccgcaaaaaagtcagctgctgaatccatcggccatttaagctgtttgaagcatctctttgacctgaaattgtatagggttatgacaaaaaggtgacagataaagcattacctttttcctgaaattatagtacattagaacccactgaaaactaaagcaccataagtcaataacgaactattaagaacaacttaccaaaagtattcattcaggtcatcatagtttctccactttgagtggcttgtcctaccacgtttattcattgcagcttcctttcacatcaaatgaaaaataaataaatacagccagagaacatggggctacataggatataacatatcagcacatacctgcttcataacactgtagatgggttgaataacaagctgtagaaaggcatcatcactcccctctcgccgaaagggtggatcaaaatcttgtcttctatcagatatgatgtcatacaaatcccttgccatctaactcgtgaattagggtgaaaatgattaataaaagagttagtgtatgtttagtgcatatgcacggtattagtctagcggtctgtgtaagaaaaaatttataaaagaatagaaaagaaaaacatacatcattttatttgtcaaacaactggtgggaatgtcttattttgataatgttaagcttgtttatggggataatcactagtggcttgaaacggattaggtcattagggtattagaagggagaggtagacattgattgctatgagagaactagttgacacatagcaaatagaggcatgaagtatatttcttgattagctaatggtgattacatgctatccatttttgtaagggtgactcaactttgatcccaaggaaacaaacttgaacttattattccatttaactactgccagccataacattagcttctatgcgcactggcccagcggggccatgtccacaacttttatacacttcagtctttaaataggttctcttggagtttatgcccattcctaagcagcttacacatgttccatgaataaacacatgggtataattgtgttcttgtactgatggctctgaaatatgcaataaatgtaaagagttgatatatctgcaattgcatgtagcatcactttgcacaagatggcaaaagtttatatttcacattactcagaagtaagaagttaatttgtttttctcattactctagagtgacatggcatcataaccttaaggtttggatgaaaacgatacttctcgacacgatataatcagtttatacatagacaaattagactggcatgatacaaagagcagtacagaaaaaaaaatttcatatgcacgcagtattgaagcagagaagccaacatagctctaatgctctataaaccaacaatatttggcattaactgccttgtcagtattactgccaaaagtgcagttacaaaaaaaggaattgatcataacagattttcgataaaacagagtagagccacaagtgaatgaaaggatgtatcataaattgaatttacctcaaatataatagaaaaaaaatcacttacatgatggaagatataacaaatacattcaggcataaagcgaacattagaagcttcaccccagatcagcaaatacaaccctatgtaaagaatctcaggttgttgtgtggaggcatcgtttggaattctgcaatgtcaatattctcagttgacaaggttgcagattttgagcaccagatgtgcaatgatcattagtggtacttactttatgtttgactccaaatgtaaatatcggcaccaagaaatgtagttttcaaagattttcctcatcaaggatctaactgtatcactatgcatctgcgagccatactagaagttcatgaatcagtttaatattcttacatttatgcggactgagaatgatgtgtgaaaaggcaacaagctcactcaagattagtgatattaaatgaagcttcaaagagaatgtttaccacatgattgtgtctgtcactttggtaggcattagccccttttctcatatcaatatttgcaagcagcaaaatcaaatgctccttctgattctcaacattgcctttctgtaacaacaaatcaaagcatgtatcaaatactaaacaaacagggtaggtgttcaaagataaacagtggtgtctagccatccaactcaaagccaccacaattattgtatctacagcatgttagagacaaaaaatatatttcccatgagtgcagcaatgataggtacaaactatttagttaacactgccatgtaattaacagatgtttggtgcattgcataaagaatttacatgaaggaatttactttaaatatgatattaacatcatcaatgaacatggttcaggaataaccaaaattgtaagtcttgcaagaattattatatgatgtgaccgcaccgtgtatgttttcatttccatatcattaaaacttctgagttacataaccaatgaagtactcaatatttatacttcacaaattgatatcaataactggtttagagaaaaaaaagttctataaaatggaaatagttcagaaaaaacgaatggagaatcagaaggttccagagcacgcagtcgtgcaaactaaacttagttccatacccaatgaagtactgaaacttttatactttgcaagttgatatgcataatttgtttaaatagaaaagttctaaaaaaggaaatagttcaatgcaataaacttttggatcatgcaatcatgcaaacttttggattaagttaagtaattgagtacgattgaagaaagtgaaaaaaaggcattagtttattttgcacctgaaatccaaatgtcagccagagccaatcaaacaaatcacggacagtaggtacatctgtctctttttcagcagaaactggatcaagccttggcatcgggaggccgtctatcttgcgaagaaggtccactgctgctttaatctgccaattttagagcagatcacttttactacttatgttatttatgaaataaatgtggtatttttaaaataaattttaaagtacatgacctcaggaatttccattactggttgtcgctgaccagaaatattaaggggtagaatgttgtagtgtgagaaggaagctttctccttttcaacctctttagcatatatatcaaactgcaaccagttgttcaatattatcatatttcatgatttacagaaactgggaaaatcaataatatcttgcaattatttgtaattactggatgcagaatgcagaacctcagcgtgaaatttttcaggtgtcacggtttttagcacatcatataggacggacgcaatctgatagtgtctagccatctcctccctaaggcattcaaagaatagtatgagaacattgataaagtctgagccatttgtagttttgcaccgagagatagttaatgcgatgcaacaatggccagtcttacggtttttttgtcttaagaccgtccacaagattttttttacaataatgctcataaaaccgctgaatctctttcgcatctgttcctgcaagtctgcgctgtgtctcgtgttcatcctgtgaaataacaaacgtcaaaccatgcaatgcatatatgttgaaagtgaataggagcaattaacatgctgaagcacttctaatctgagtaaggaagaatgttaaaagatttggggctttatattaatcttctacatgaaaactttattccagtttattccttgtggagttaattataacttctcacttcacaatggtgttctggaaaataatggagactcatttctttttgcacgaatcactattgcaagcttaatagaaatattgtctccactagtatcaagacaagctatcaccggtaactaactccaacaaaaacaggacaccaagtgatacctggtttgggagaaattctagacactgccatgcgaattctagtgggtaacggaactatgggattgtgaaacctctgaccgtatggtaaaactgtaaggccagttggcaaagtactctctgggggtcacataaaatcaggcttttggtgctttatgctgcaagcaaggactgtgagaaagtaacattttgtaatcttcaaaaaatcatacttgattagaggaattttttttttctgaaacagatggcagggccacagaagctctgcccattcctctgtactaatataaaaggaacaaatttaaactacatggatgctataaagcatcatggccattcatcctctagtttggaaagatgagatataaaggtgggtccttactctataattaatcatacacaattaatatgcaattaaaatagagactctccattactaagatttgcagtgcaagtgagaataacttcaatagggaaaatatctacttaaatccctcaagtgtaatggtttatttccttagcaccctgaacactaggtatcgtaccaccttaactaacaaaaaccagagcaaatgtaggcgtattgccagcatggcagatcaagctggcaacatgatagtgactcagcaaatcaaatatataaaatatctcttgcacagtgggcccctatgtcagtggtatactcttgttctttctcatctttcaccccccccccccctctgtttgttatggagaaaaaaaagagcacattccccgcatctctgccatgctgcttgtgaggtaagagcatagtgaaaaaaaccagaccggcccggtgtttggaccggaaaaaaccggaaccagaggtcagcgcggttcggttggatggaaagactggacatgtaattgacccgctttagaccgcttgaaccggccagttttaagtgaaccggtgataaaccagcctcgatcggaccggcctagacatctgaattgcttaaatgggccggaagaaggcccatttaattcgaaggcccgaaataactagatatttaggcaaaaatgaccaagaaaaagggaatggtggggagtcaaaccctggtggtgggtttgaagttgactccggtagccatccaagcattaggttgttagttctgatacgagaatataaagtaatttttatctagtagcgaaccacggttagaccggccggttcaccagtcagaccgtcggaccagtgaaccaagaggttgaccgggtcactcactggtccagtcttttcaactatgagtaagagcattagtgacatattcctctcaatcatctcagggcttgcaccgagcctgcttcccatgggcatcttggcattcctcaggttcatagttgctattgccgaaagcacaaccgctctgaccgtctattctaagaccagacttagctccgcaattctactgacacatacttcatcaagtagctttaagtcatcttaccattttaacaattaccgatttcctcgtgactagttgagaacatacttttggtacgtggtaggatcgaaattgcaggagatttattgctctcatagcttgggcgcgatattgttggtatgaaattgtatcaatctctcaccaccctgtgtcacctgttgactctgattagacccttcttttgcacatccagatctcatcatgctaatagcatatgaggggagaaagagagagcatatgaggaagcttaggtgcgttgcaccagcatggatcagagactgttgatggaggcatccatggcggtaaccaggaggtggcagaatgagacagagggtagaaaggggaagaagagagacttcatagagaaagggggcccacattcaagacaaattttacacattgttgagtcatatccatgctgctggccgtgttatcctccacagtggcaatactgccacggaactagcccagtgggttctttttcttccttttatattacgtggtactatactttagggtgtaaagtagacgaactgctacatttcaccttctaaggataacattgcaaactgcatatcgaggtgcagaaattttctttcggcgcaacagtctctctcaatagttaaattattcaggcacatcattattgtttatttgtgtcacgattccaggtgcttactgcaatttgtttgcatttccatttcacatcataaaagttcaaacagtttaacaccatcacaagaaatacacatgcacttaacaacaaaagctatgtgattcctgcacgtagctactttcaaacacttacatgccacttgggaaagacgtttgttacgtgtgctcattgatagataggtggaggaatagcaggaaaagcagataccttctccagcctatgcaagaggtatgttttgaattgccgaactcctcgtccacctgagtttggatccatggtgtgagccttctcgaacgcggtaaaccgaccttttagcaagcaccaagccaccaaccaaaaaccacagtcaagtcatcacaataggctaagttcaaagcagaggtatacaagggagataaacatgcacatttcttacataaacagaaaaaaaaataaaaataattctgcaatcgatactatagctgcgaaatgagattcttccaatttccaaggctcactggctcagaacattcatgatggcactagactacctaaatggtgtggtcggctgcgtccgtgcatgtaatacggagcaattcattagagtatgattaattaagcatcaactaaaataaatttgaaaaatgaattaatatgaattttaagcaaattttctatagatttttttaattaaaaaaacaccaatatgtgtcaacgagcgagcatagctgcgcatgcaggcaacagatagcgaaatcataggagagaagtaaaaaaaaaaaagggaaaggggaacgcagagcacgcacagaggtaggcgacgcgctggttctcctcctcgatctcgttggcggcgcggaggatggggacgatgggggcgagcgagttaggcaccagctcgctctcctcgctgtactccccgccgtcctccccggagtacccctccggcctcatggtgaacgccctcgacaagccccgccgcagcgacggctgcggccccgacaacccccctccccccgtcgccatgcctcccccgccccgcggcggggactacgacaacgacgacgacgaccaacgtaccccctcctccctattcgacaacgatcgagaccaacgccgcggcggcgttggcggcggtggcggcggtggtggtggtgaggatcggcgaggaaggggaggaggagatgggggcaaggcatcttcttaagcgggagggaggggggagtgtgagtgcggagtgcgcgctttttccgcttttgccgctttggccttctttctttctttcttcgaggggaggagaagggaggaggaggagattgtgcttcgctttgctttttttttttttctttctctttctttttgcggcgcagatgcggatcgagcgggggtggccggcgagggaagcaaggaattggaatttggaacggtgctgacgtgtggggccaggtaggcagggacaggggctttgttgaggttttttttcacttccctaattcatctctcgtttttttacgcgcacgctttttaaatttctaaacggtgtgtttctttaaaaattttctatacgaaagctactttaaaaattatattaacctatttaaaaataactaatacttaattaattatatatgctaatgaatactccctccgtactcgtaaaggaagtcgtttagcacaatgtttaagttaaaccttgggaatataaatcataaataactatcaagttgttgagtttaaaaatgtaaaaattatatgaatatatttgttttgaaaaatactttcataaaagtatacatatatcacttttcaataaatatttctatagaaacaagaagtcaaagttatgtttcggagaccgtatcgctgtccaaacgagaccgtgtcactgtccgaaacgaatttctttacgagtacggagggagtacacccattttatatggacagagtattagggcatgttctctttaatgcaaaaaaagacttactaaaatttggcattgccaaaattttgacatagttgccaaaattatatactcactaaaatttgacagcaaactaaatatagctacttttttgataactttatcaaaatttggtaagatcaaaaatgacatcaaagtgaacagagccttagtttccaacaggagccgaacacagggccgggctcttcgctttctttcgtgtgcgcttttctttatgaggtaaaaaacgaataatgtttatacctggtttcctggcttcaaaatgtctgtgtttcatgtcatgtgtaccaccgtatgtcggcgccgtactgcagagggaatgagaggatggataaaggtacagctacccgctttcgaattatttgtcgtcttatctaaattaaccattttaagttcgatcattaatctttagaaatctatttgtgtagtataacgttatactcccttcatttcataatgtaagactttctagcattactcatcatatttatatagatgttaataaatatagacacatatatatatttaaattcattagcatctctataaatatatggacaatactagaaagactcacgttatgaaacggaggaagatttatgcttttattcactacagaaacaactccatagtcgaactaatggtcaagattaaagcaatgagtataaatggaggggatcaatgagcatcggtaagctttgctttcctatatatgagtactaagttctaatgttttataacctcgtagagtggcagggagtcgttaataatttcttctttcgctttctccaaattgaaacttgaacaggacaggatttgaaaccggctctctccggatctgttcattgggcgatcgttcaattatgcacgcaaaagagagtgctttaatcaaataaaagatacagtttgggcacgtctcaactctaaagctagctatcactagcttcactggcgtgtttagttagcatcaagtggcagctatatatatatactcagaacaatctagcatatatattcaactggattgagatcctctgacataacttctcactaacttggtggctgacatgtgggcccgaaagtggtgaggcccacatgtcagtcacggcgaacattagaggatcatctttcatattctactagtgtggattgcatggatacgggactaccacgggtggaactacgtacacctgggatgggaatagctaattatattgcctcgctagggctcagtttctactgttttttttaggaaaaaattgctataggatactcaaaaatcgtgtaattgtctaagagacactgtaaaaatgtgacactgccgatggacagtacaaaagttgtgtagtttaggacaccaaaggcattattttataatttctgggctgaaagaggggagagaaattttgaaatgatgggaatgcccctgtactccttattcctttctctcaatgcagccgacatgtggacccacgctcagtgtcgtcatcctcctctcgccagcgcccaatgccgaccgacgccactgcatcccttccaaaatccgatcgattcggtgagagagtcagcgatgcccaatccggtggctacaacgaggcagtgcctctcgtcggccgccgtccctgcccacgacgccatcgtcacctccaccggccaccgcgcccacgcccagaccacctccctccacctcatctcctccctcctcaccgcgacgccctcgcccgcacccacagcgccgcctactccccacgcatccaactcaaggccctcgacctctgcttcgttgtctccctcgataggctcccctccgtctccgcctcctcctcctttgcctctacgccgatgaaccccccgtctccaactccctcatggccgccatcaagcactcccaggccaaccagcgccgcaacccggacaccttccacttctaccaccaggccaccaccgcccaaactcccgccgctgtcaaggtcgagctctcctagcttgtcctcgccatcctcaatgaccccatcatcagtcgtgtcttccctgaggccggattccgcagcagggacatcaagctcaccatcctccgtccggctccacccatgccactcctcggccgcctccccacgtgcacccacccgccgcctctcttcctctgcagcttcgccaccgtggatgacgttgatgtcccttcgccggccgggaaccttgccggcgttggggaggagaactgctgccacatcaccgagatcctctcccacggccgcaactctcactgccgtcaaggtcgagctgtcccagcttgtcctcgccatcctcgatgaccccatctttgctcgaattttggaagggaccagcgcggccaaggcagcatagacgcacgccttcaagacgatgacagaagcggtgagcacgcagaacaggaagatggacaagcatacaacggtgaagtcatcgacacttggggggcaatccggacaattcaataaaaatctcaccactttcatctcgaaaatgataaaataatgtgttcggtgttatacggccaattacataacttttgcagtgtccatgggcagtgtcacgtttttgtggtgtccctcagccaattacacgtttttttgcgtgtcttgtagtaaatgttttctctttttgagaaaatccatgaaatgccattgacaagcaccctaatccaagaaatgccattacagccaaactgttgttaacttctctccgttaagttgtatgaaaagacaatattacccctgggcaaacatttgctcactcatcattctgtattgtttgcccacacaacattatttttgcattgatgcatatttgaattcagacataattattttgctatcaatcaaattatttcaaaattaaattcacaaattttgccatcaaaattatttcagaaatttcgctatcaattatcagggttgtgatatgagcagaaatcaggctatcaatgattttagaaattttgttatcaatctgagctaaataacaaaacatggtttcagagttgagtacaataggtagactgcctgacaataaaatagagctaccatcaatcatttttcaggcattgaacgtgcagactaataatcatgtcaaaattcgatactactttcatgtaacccacatcagggcaatcaacacacaaagtagcaattatgatgcttaagcgaggatttgggcctgaaaaaaaccctaaagcggatggagagagacggggagttgagcatttgagcatttgctagttgagcatttgctgtctgggtacttaacataaaagaacaaatgtaatacagagcaaagggacatgaaaaacataggccaagtttagttttaaaatttttcttcaaacttccaactttccatcacatcaaaactttcctacacacataaacttccaacttttccgtcacatcgttccaatttcaaccaaacttccaattttgacgtgaactaaacacacccataggctttccctcaattcagcctgcatgcgtgctccatcgctgatggatcccaattcccaaaacccctgccaccgccggcgtctagtgcccggcgccggggctcgggccggagtccatgatcccgccaagcatgtcgaggctgacagacttcagccactgcaggccaccgtcaccggcattctccatgctcccgaccattgcctccaaatcgaccgccagcgactccaccgcgtccccgtctttctccatctgcttaagcatctaatactcctgggagcgccgcatcgccgctgagggccgccgcgccaccgcctggggccaccgcatcgcccctgtcacccatcgtgttaggtttagggctgtcttcttatttttccaatttcttttcttttaacggattgagatagtataatttggagtgagggcgatttagtcatttttgtaaactttttttgttctaacagtgtggactaaacagtgcgttgactgtgatggcatttctgggacaaataggcttgtataatggcactttcaggaagttgtgcttgttgacggcatttctgggattagggtacttgtcaatggcatttcatggattctctttttttttattacacggtacacacaccactacatgcgcaatattacactcacatcccctacgaatgtgcctctaacgcatgcttaaagagacgaaaaccaaatgcacatccttgatcttactaaaatcatgttaaaaactcgcctataaatacgtaatattcgtgggtacaggatttaaaccctgatgaataaaatcatgcaccatgactccgccatcccaacactaattcttccccacctcattagacttgttaaccagctcttgcacattatgtaacaaaacaatatatgctaactagtaaattatactaattacataaaaaatagttggaagtaatttgtaggacaaaatactacttaggtgttaggagcagtaaataaaaaaaagactggactttttctttgctattttaacctttttagaaaaatattttacaaatcgacccttacaatttagaaaccttattgcacatcctcggtcctcggtatcagggacgttggcaccaaggtgtgatgtctcgacgccagatgagctgacaccaagggatgggttttgatgtcaattaggctgtgttcggcagcctatgtttccaactcccctcttcgttttccgtgcacgcttttcaaattactgaacggtgtattttttgcaaaaaaaaagttctataggaaagttgcttaaaaaatcttattaatccatttttcaagttagttttagctaatacttaattaattatgcgataataagctattccgttttccgtgccagagggataggctccaactggcacaaatgaacgcagcctttagtttggcactgacctctcccatctagatttttttagggaaactctcccatctagatttcctctaaatctatacattttaaaactaaactattcaaacaggacgaaacacccttcccctattttagctagttttgacatgagctagcggtgaatataagatgaatctcataagttggagttccacaaaccaaactagcagtgaaactgcaatgacagaataatctaagcaaaacccaaccctaattcaacaacggctactgaataaatagattctagggttgaccaaggacccatggacacgtccctaatggatgccaacatatttcgatgattctcgttgacttagaaggagtgttaacatgagaccagatccattggagagttgatctcgttagctttccatacatatgtagaaagtaaaaaagtaattcgaatgagatcttggcgatgattttggtgcgagcttctcctggattccaagatggattcaaacttaatatgaattgggcctccatctccaagcctctctccaagtgcttcctagccctcgctcatacacatccaaagcagtgatgccatcatcagttgctgccctagatccatgttgcgatggtcaccacactcactgccgtcctagaaccatgctcaggttcagctcatcgggaaagtgtgcaatgaggaggaggtcggcatgtgctcctagcgtgtcaaggagtaggcagcagggaggcgtgatcagggtcatcgtgtgcatggtatgaattgtctaccagagagacgggagagatgacagggagtacatggcatcatggagacttaagcaattaggcacacacttttatcatagcatgcaatttttatctgaaaacaatgcgatatgaaaattttggcataacatgatcaagggaagggggtaatgtaatccgcactagtggtcatctgggttgcacatgggttcctcgttgtataagtagccagctacatggatgggaacttaatttcaattagaacataattaaataaatccataaaaattctaaaaattccaaaattacgaaatcaatcttcttggatagacctttattttagatgaatttaagtttaagttccactcaatttggagttaaactggctgtgatattgcctctaaaagattcaaatttaaattaattgaaattattgcgatatgttacagtgctacccttttcatttctccatgagaacttggaggagtctgaggcttccgctcaaacttcaatcaacatggattcgtggtgaagaaaatgtggggttaagtgttcattgcatagtctagggctctaggcaaactcccgaagtggccttcgcatccttctattgtggtggttagatgacgatgcagctgacgaatggtggagagtatcagggtcagaaaggagggcatgtggaggccattgtgagaaggtgtaaatggtggctaattgcatgggccaaggttgttggagctatgcattaccaagaacatggtggaatgacataaccgggtttggcatcggcatcatgtgtagggttgggtgttcagtttttccggttaaatcggtacggtttctttggttatacctaattccattttcttataaatggcagaattctagtttcttataaatggcaactgaagtaaacgataaaataaatgtaaccacacaaaataaaccgaatcacgtcggttcgattcctcggtttaccaagacaaccgacctgctcaccaagcacgcgttccagatagcattgggatagctagatgcgatctcccttgcggccttcacggagcgaacatctcccacaagctagttagcaacaaagttaaggtaatgggctttggcctattgagttaagtgagcctttgagactttcatgttggaaacaccagggaagtactttggactagtaatgcatgtacctagatcagttgttcggctttgttggttaagccggagattgaacacaagcaaaaataaaacgaagaaaaaaccaaagataaaaaaaactgctacttcggctcggttcggtatggttcgctccggtcttcggttgtcggtattattgtgcctacccctactcatgtgtccatggggctcaccacacacctgcatccaatgacatttaatcattctaagcaccatgcttacatttctaaataatgtcagtaattctcccacccttcggatggataagttaaaactagtgcaatccgttaagatcattggacggatgtcgtagcatagatcgactaatctaaactgtatagtttatgaaataagtataaactactcataaaccatataactgacaaagcagtatatgaattaaaaacataattaggtagataagatatttctattattgagctcatagtattacaagaagagtacattactaaaaacatacccgaatctccgagaagattgggaaattgaagaaatattctaatcctaaactccactaaactaaagagtatacaaaatgtagaatagagagattgcttcttgagtgtgtggagtgaagtgagaagcacccataaccaccatcaggggccaacggagagctgccatagggaaggcggaggtgagaggggccatgcctggtttggctgacccctggtttagccaaaccagggcaaccgtctctctccaccgaccttctcccagaggctgccaggtgggcccctaggtcagtgcacgatggattagccctgaattaagtcggtttggtatgacttgtgagccctccaatccttgtgctttcacgtgattcgctagaggtgtgtttctttgcaagccgacacatttctccttcactttattgtataatccttacatccatagtatttctccaagacaagtggaactacattatttataactaatatgcgtataagaaatgctagttctccttttattattgagctaattgacacttgaaatcggtatttaatgaccgtcaacacccgtgaggagctagctagcctatagttgtgggtgacgcgggcctagctggcgcaaggaaaggtgaggcttggttgccctagtgggctgactagctagctcagttgaggttgtccagtggggatgggtcgaattgggggcattgtctcgagcctactaagaaagtatttcctatttccaacaaatttattaattagttgaaaatttttttcgaccaaattatttcatatttcatattcttaactcagatgtttttcttagttaaaggaattttatttaagttggtgagatggctaacaagaaaccgccagaaccatcatggatgcaggatttcagaaaagatttttgacaattcaaaattttgggttccatatttttatttcataaaattcaggatgttacatccgggctgctggatctcataatagggaggtgtagagggctaaatctgaccacacacaccaccatggttgtctcgctggtgatgcatgaagtctcgtctatgccgctgggagctcctcttcccttccattttctcccccgaggctacccccacttcctccctagttccatcaatgtcgccacaccatctcccttctaacttagaggtgatggatctattctccactagcatggggccattgaatctgaccactccaaacactagggccaccagatcccaccctccaagcttgggtcacttgaacccaacggtagggtggtgcggtggcacaactaatggcattataatgggtaaggcgatggcacacaatggtgataagtgctatgatgggaaaggtgatggaaacaagcatggggatgtccataatgataatgcagcaatgactacaatggtagcatatcaatgactaagcgaggagagcaagaagcatgagatgatcatgaaggcagtgcggtgacgaccaagagagcggactgagcggtggttgtaagtccctcctacgatgatggtagtattattttattttttttattttttgctgaaaacatgcaaactgacgattgggctcttgaacaaccaatgatactcattattgaaaccaattgtgatactccaaatatctcaattggttcaaaagccaacaatgaagtttgttatgaacaaatgttgatggctgattatgtactactgtatttgcaattgcataagggtatttgtgtcatgaggaccaatctttgcatttggtggaggttctgcaattacagtaggcatttaatactttggtagacattttatagttgcgggtgcttgatagtgttatatagttgtgggaaggcatttactactttgggtaaagtgcaatttaccccataaactattgcggtactctggattacccgtgaactacaatacgagacattcttctctcctcaatcgttaaaattttatcccttgagtaagaataaaagtggttttattattgcgtgccattgctttgcccttgtggcattggaggccacctatcaaccattgcttcatgtttccttttgtttttatccttattttttctcttctattgcttctaccaccggtaacctcctcctacttccttggtgacaatgctagcgaccaagtagcctccttcactccttcagcataggcgctggctagtcctcatttcatccccccttttctatttacccaccattgcaccatggaggcgttggcatccattcccctccccatccttgattttgttgttgtcaccgttgaggagcaaggaggtgaacaccaaacgaatgagtgttggagaccaacgatggttggtagtggtcagggtctaggcagtaagcaaggggatgcggcagaatgaggagccagcaagggtgaggtcaaggtcgaggcctaggcaatgatcaatggggctcttcagctcaatttgt

SEQ ID NO: 16862 - DNA, 21034 bp, Oryza sativa
tatagaacttaacggcgcggaatggacggaaccctaacaacaatggtatttttgggacaaaatcgtttgtactatggcatttcttggaactcacacttgtcgatggcatttctgggacttagacgcttgtcaatggcatttcatggattatctcataattttaacacaatcttgtaaaagttcgatagaatacaatattttggacaaaattttgacagaatttcagcaataagtttggcacaatttcaacagatatgttcaacatctcgccttatataacatgtccaagcatcacaaagtagcacatactcaagaacacacattaaacctctctagggttttgggattgggtgaaatgcaaccttctaacccgattcacaccctggttgactgatttacttataaggggtataatggccattcacaaattacaatatcattttttccctttgtttaatttgaaagttccgagtctacctaactactgtcacaactgggggtaaacggttgcttcattttaaaaagtaggggcaaaaacacaaacctaaaaagcagggataaaatcacaattgaaagtaggaggctaaggttttaatatataggaatgagattctaagataaacttgtgtctttttggagagatcacaatgttatgccagcaaaagtgaaaatgctaattacctaacttgtcaatatcactcttttccataactactttagctgaggtttttctattaatgtagggaacatctgcttgtaccaccttacttcaccatcaagtaagtataaaattcgtttgtaaagccaagaagacttgacttacatatagaccaagtaacaatgctttgaacaatacagcaacaaataattcgccactactttgcacaataccaaggtaatgtacggcttgaagtagaaaaccaaaaccaagtccaccttaaattttgcatggcaaaaggacatcaaagttgagattactagttagtagtaattagattactttacaacataggctcatctaaaaatatggttttgttgacttggtggagaagagtcatacataggagaggagtatgtatcaattcaaaagtggtggaaaggaggttctggttcctctcattatattgttaatttgttatcggataaggaaactagaaactattttgatagtgaagtaggggaatgaactatgcaatgaattcccaagaagggcatatagtttctagagcaacaaaaatgaaaaacaacaaaaaatcaagggcattaacacacatgtttaaccactcgatcgtaaaagtacttcatagatgaaatatttggtcccagtatatatcacactctgcgtctctgcaatcaacagttgatcagagaaccctaattaataaactcactttttacccccgaattaacacatgcaccaggggcgactaccagcttaactcaataaacaaaccatcctaattaagcgactaattaaagacctaattaatcaaagacatggccactccatatatatgcatgtagatcaatcagcaagtggcctggacggtgagcacgccggacaggcacccggcgccggcgaacgcgccggtgatctccaccgtgcacgactccttcccgacgcacgccgccgtgaacgcctcgtacgccgccttggactcgcacccgccctcgtagccgccgcaccgcccgcgccccacgccgaagctggccacgtcgacgctcgacacggcgtggccgccgccgcacgacagcgtgacggcgtcaccggcctcgccggaggtgcacacggcaccgggcaccacggtgcggagggcgacgcccgaggggtcgccgccggcctcctcgaagaggagcagcgtgttgggctcgccggcggcgaggaaggagcgcggcacgtggtagtagcgctgcgacggctcgccgcagcccgtgaggcacctggtgccgtcgccctccgcctggaacgcgccgcggtagtcgcagcggtggcagccggccatctccgccgccgtgtacgacggccagtagcggccgaggttgttgccgttcacccacgccacgcccttgttcaagcccagcaggtccaccaccaccgcgtcctcgccggacggagcttcaaatgtagccttcataacaaaaaaaaaagtaaccaaagtattaagattgttttggcggtgaaagaattaatgacatgatgaaatttcatagggaaggtaaattaagtaaattgtagtcttcataagaaaacaaaaaaagtattaaaaatccttttatttttgcaggtgaaagaatgaaacgatgaaatgaaatcatacaggtaattaaattactccagtttcataattgataagttttaggttaaacttttataaattaactaataatgactttaaaaatatctagtttaaaggcaccaaaacaacatatataaatttgacttacaaagtactataacaaaagtaatatatatatatatttatattaatatattgtaatagagaaatatagtcagaaatatattttgaaaattatgtcattgttcagaatgttaagaattataaaaccggagagagtgagtaaataatggacatatactgtaccttgtaccaagtaaaaggcctgttgatggggatggtgccattgttgccattccatttgtagcctggcttgtcaagatggatctgcctgtactcactagccaagccagcctacaacacaaaaaaacatcaaagcaagaaacactatatgatcaataccagcaaagttaacaaacaactaagcattgatgaaaaataatgtgtaaccttataagaccaggagctgttggagagatcaattgcggtgccattgctgtctatcagcttaacagggcctccaacaatgcccgtgggcatcttttcgaacgaagggccatagttctgtttaccaagaatgatcaaacaatttatcactggtatacatgattaattgcaaataaagaagatgagttcgttgctgatacgatggaagtgagcattcaagaaagaaaattaggaaccttgaggccaacggttgcactcagaagagagatgtagttcttgccatcatggagcttcaccggcgactctagttggaagacaaaatctccatcggcagaatggtttttccctgacaaattatgaacacacatgtttgtcaatgaacattctttaattttgacccgcaggttcacaaacattctttaatttcgacccacacagaattaaaagaatggtgcaacgaaaatatggaaaaaaaataactttgatactcaccaataagcttcccgttcacaaaggcataaagttcatggccagtcgtgttcacgtacaatttgtagctcccttctcctttgtgattaagactgcaattttttttttgttggtgacgttctaaatttgtaacatatatatatttttttgtcggaatcatttcaaatttacatcatcatgatctcttttctttagtataaagagattttttttttaaaaaaataccttgttctgtaccacaggtaatcactttgatcggttgacgtgacgatctgctccaagagctcattcttcctaaagttgcccttctcatcggtcatgaaaggactcaagttttcaggcatccaagaccattttaggctctcctgctcctgctccgccgtgttgggtttcttcaccatgacagacgtctgggtcttaatctaggtcataccaagaggaaaacaaaattaagagatgaattatagaccttacacttggtctcattttaatttcattattgattattgagaaaggaaaaataccttggcgctattgaaggcaacagtcttgcagtcaggcaagatgctgactgaccatgcaggcaggaggtgagtggctccatcgagggtcacattgacatctttatcatcaaatctgttgttgatgaagcaagcagatgaggagtccagagtgtacttggtaacctacattgatcagagatagtaccaatatgcatgcattagatatgtttgcattagacgtgataattttgattaaaagaagggcgtgatctgaatattactgtgatgttatcgccatagttggtgtcaaaatactctccatggacaagagttttctccatggacttgagcacggagtggagttccttcaaggaccatatttgggttgcctgagattacctgtaataaatcaaaagtagaccaacaagattataattaaaataagacaaaaaattgctttcttattcaaattcaccatataattaacagtacggtaaaatatattaatcaaagcttaccatactcatccaaaggcgcgtcataatcatagcttgttgtgatgtaaggacctccgaaggtacgaccaaagttggttccaccatggttctaacaaaaaatggaaaaaaaaaactcagcataaatcaacgaaaattcagtcattgtgaaagagatacaagctagccagcataccatatagtaattttgcagagatccacgcttttggaagaacatcgcaaccgcaaaagcaatgtcttcagctgacctatggaaatccggcttgtcccaagctttgaacctaacgttaagtacatcaacaaattaagataaatctcctccatgttcatcaaaaaataattttgcaaacaaagagatatatgtactaaaagttaattttgtaaacaatgagagaaatactaatggaagaaaaaaaaataccagccagtccagttctctgtccaaatcttagggatgcctgtcctatttggaaaccagtcatggcaatagaatccattacaggtattgacctagagcggtccaaaacaatgacaaactcatgttattagatgagtgataaacaaataaattcatataatattctatattcttgtgggattaaaacccatgctcaccacattgtgcggcacatcgtcgtcttgttgacacatgatccatgggacaccgacgttctgcttgttcgccatgtcagcacaccagtggatgtattcagatgcagactggttgttgtttaatttccccatgatgtttccatactcattctcaatctgtgcattgatccattaatgcattgatattaattgacaatatatattgtggaatgacaatagtacaaattattaacatgctaatttcccattgttcaatcatattgaagaatgatcattacaatacctgagcaaggatgatcggtcctccttgttcagcaaacatttttgaatccttcatcttgttaactataagagtggtgaatgtctccatctcattctatatcatggaaaaaaacacttgcattaattatatgctagtatatgtaaaagtacacaaaaatagatgagaattttattattattattattatttaacctcaaaaggctcattatgcagcctaaactgcattccagggatgtcgcgtagccaagctggaagtcctctgcacatttggcatttgttttagaaaacaacaaaacacagtgagcacttcaacatgcatgcatggacacataataatgttatagaaagaaactagagtagtttagtgtgctcgcttgtttcctcttattctatatgaacactatagatataatatttgattaatttgcagatcgatataatagtctattctatttcgtttttttctctaattctatatgaacattatagatataatattcgattaatttgcagatcaatataatattctattctatttatcactttgacacacaaatgctttagcatttatatacatgatacatacccatagttccattcgccacagatgtacgggccaatgcgaagaatggcgtacatgccggcattctggatctccttgaagaacctgacgacatcgtagttaccctcaaaattgtactgccgatcaaagcaaaaacattgttatagtattactagtatttatccatggttgttattgtatgtaatagctgcagtacgtagtagtgtttatgtgctaaagcaaaagtagtaatattgaacctggcggcggtgcggctcatggccgttccaaaagatgtaagtctcgatggcatcgagaccaccttccttcgccttcttgatcagatccggccacatctgcatagcaacaataagattagattagatagaaaaaaaatcaaattaatcttttgcgcacgtacatatattgcttatgttcattaatttcttaacacaaattaagaaaataaagatcgaacgaatataagtcacaacataatatgcatgcataagtatataaaagtatagaacataaaactcctcgcactgcttagctcatcacgatctatggcacaaaaagaaaagaaacactcaagcaagcaactctgtatcctactagtacaaaacactcaaagttgtatatgcatttaatttgcagattaatattatcaactatctctattttttaatacatgatgttgttgattttttcacacatttaaccattcttcttattaaaaaaacataattataatttattttttgtgagttgttttatcactcaaagtattttaagcatgatttatatcttatgtatctccataaattattacaaatgttcaaacatattaaaaaattaacgacatcatgtattgaaaaacaaaaatagtatacactaggaatatctatacctatacagcgttaacctggtgaatctgccgttgatcaaatagacccacacattattaatttatagttaatatcatggtcccatgggcctcacaaatcccatccaataatctctacatacaattttgttgggaattcagttggatatattgccgatgatctggatttcaagcggaggcatcaacacaaatggaaatagagatgaactttaggacgcgctcagatatctccaagtcgatcgggtattattgtttctcaatctagattggtttctcatctcaaacaattttaacctgggtaaactatatatatgacacggttgaaaaatgagcacctggaagagtacatagtaacgtgctaattactttgctgacagagtttagtctatgattatgttgactacacggacagaattttggacaatgattatgttgctaccaacatatgattaattccgtggctactttttttatttctttttacatgtacagattggatctaatgccaaaatttatttaattaattagttttccacttaacacattactacgcatagttacaatttcaatataattctcaacggtgataacaatatcaatattgtacaccattcataatacatggatcttacaattttaaaaatatacaacgaattctatgattaaaatataattcactcagaaaataaattaaaaatcaccatattgcagttggcattaatttgccatcaatttaaaccattcctatacgattttgtatgactgaaatactatcagagtaaaattttatagggctaaaaaataatatttaaaattatctcgtgcgttgcacgggttgacggctagtataacaagtcggttacctcgggagtgctccggggataatggatggaaccagagaggatgatccggcgctggccgtcgatgacgaggctgcggtcgtcgtagctgacgctggtgcagcccacggcatcggccgccacggcgaggaccagcagcgccacccaccaccggcaccagctgctgccgcgccgtcccatcatactgctgctaatttgaagttaattagctaggctacaggggaggaggggaggagaggaggagacgagatgagttgcaactttgcagatgcaagcgatcgaattgcagagatcgggcgtgggggtgatacggaatttataggccgcagcgatacgatgcgccgtacgttggagatagatacaatagaggataattacgtagtacacgtgggcatgggtttgttaatcttggagatactattgcacagagaaacaaacaaagtagttaagccggatcgccatgcatacgataaagacgtatgatacgataattagtggttagccgtaaaatcgagattgcgtgccgtttcttttttttttgcggatagtgctaaaactagaaaagacaatctccatcccctcctcctaactgagagatttgataatttaacactattttcaatgggtttcgattatttgacattctggttcactttcatacactcatatggtctcacatatcatcctcacaaaaatatcaattaaagtaattggacaatgaaaaaagcgttaaattatcaaatttttcctcctaacttggcatcagaattcttttccatcagatgataatgcccctcgtctcttcacgagattttatcacctctcggaactggctgacaccctgtgcattatcatagactctgctgcctgaatagcttctgatgttccagttatccctatcagatatcttgatcctggcaccactagcctgaatgatctctgtaatgttccttccggcacgtcgtacgacagcaccaaaatgttcatcagcaataccaatagtgagaatcttgggcgtcattgttagcaggtgagatctcataggtgtactgggtttgttgttttggtcccttcctccatacccattaggtccataattcacagcattattatacggcacctgtgggatcataatacccaacaggaacaccagggtaactagggaaactaaggcctgcatatggaaatggggaactcagattaggtgggtagtgaacgtcctccgataacttatgcttcatatcaaatatattgcacgcatctgatggtccaagggtcctgtgacagtaacgagtctatcatgcaaaccaagaaaattgttatcctgtggtgaaatcttgattccagcatgtgtgtcttcaatgaatgacttgattcctttaccaatgattcctccacaataatttagatgaaggaattaaagctttgttgatcatctcagataattacatccaaaggtgataaaattagataaggtgatacaattagataaaaaagagtattatttgcagcaagcaactgcgctctgaaaatgaaattcattgttatagaaaatcctggtccgcattctcattgtttttttgttccccaaacactgcaaccaagcaataaaacaataggggctactacacacatgccctcatatgaacacgatggaaccagaaacaaataaatcccagaaccgccatatcggtgccaggaaaagttacatcggattgtactagtcaaacctgcagagaagcacaacccatatattcatcatgatcagtccctctttgagccgctaccattctggccggtgaggatcctggagatctgcagcccccggctgaaggcctggttgaagagcagccgagtctgaaactcggagacgaaggggaaccacgacaggacggcgatggggaagaagatgaggatccccatggtgtactcgtacatcctcgccatctcctggatggagtcccatggcccgatcttgcggagcacatcccggctcctcagcctaaacctggcgcagcaacgccccttgcatgcggtgcccccggtgcaacatgaacagaacagggcgcagagcggctccgtcaccaatctccggaacaatggtccacagagctgtgcaatctacgagagtaaagtgaatgtgatgattgaatacaatggacaaatgagtggacaattctagtgggaagggggaaaaaatcaggttgaagttgtgagcacagatgcatcacttacctgaagaataaaccagccagtagggatgaatgccaaaatactggcaccaacatcagagacagtcagattgaaaacaacaaataatatgaccaccaagctgatgaggacaataaagacaatgcccttgaggatacggaatacaagttgaaaattggtaataaacttctctctccccattgagacgacctggaagaagaaatatgctcaactgtaggattactattgcaaagaacataatacaataccaaataaactgttaccttaagtgatacaagaactatagctataaccagccatgatagtgcatacacctgtggaaacaaaaaaaagaaagaaaaaccattagtccggtcagaattcatacattgatgcagagcactctagtcaggataagtaccatgaagcttctgttcccatgcactatgtgtaaatgataaacaataccatattggtatatcaagaagcgaagggagaggacgaactccaacagcaggctacgtattgtaccattcctcaggtggtcatgttcacttatccaccaagcctcccaactttgctctggtgccaggccaatacctcctctattgctcatccaatgccaccagtcagtccagtcatcaacagtcttgtgccactcaaagcatgatggattgaagacaaaaggtgcaaacagccaacagaaaacaaggaaccatattgaaattgtgacatatagatacaaacttgagctcctgtacgaaatgccataagctagatagacaaccaaaagaatgagtagctccagtgctttcacaaagtggctccgggaatacatccggtaattctcagcaaactttgcatggcgcacaacaaacccccggcctgtacctctatattttgcaccaccatgaagtattgttcttccatagtagtgagtcttcgttccaagatggaaagtgaagaaaacagaagctaattgaagttgcattattacaaactctcccaaggctctgccaaatcctttctccaagccaacctctatcatcatagggaggacgagcaacattccaagttggaaaatagattgagttgcaagtgcattttcaaagggcttgatgttcttaatttgtggatcctggagaattgacttctctaggccactcaaaacaagatataacctcccgtataaaaatacatacactgtaagaacagccacctgaaagtaatcaaagccataaaatgcgttagcacactttgtacaaaagtacaaaccttatgtcacattttttagttctttataatctgctggtcactgctttaaaaatcatgaagaacaatatagaccattttatttccctactaggttgttttctttgtagagaatttatctcctcaaacggaatgcaaagataagggagcataattattgggccaacatgctaaatgtgcctcaaacttaacttcacatccaaatatcttcctgggactttttgttttttttgcaataatactggttggttattggttttagtggcaagatttttctagttcatatcttgtttgttgtcgtgctttacaaaccacaaagtgaaccaatcagctattgcagctccagaaactttatatgttactaagttgatgtgtcaaagaataagattcataccatactattgaagtagaaaccaactgtagtgaagtatagagacaacatcctgtagaaatcaaatctgtgccctagtcgataaatatctcgacagagtgtttgttcaccatttccgtttgccaccttggcctcaaagttggatatttgattcattccaacatcacgtcctttacccagctgtatatattcatgatgagtaacatttccttgccgcagggttgaattgaatcctttaatcagaacaaccataagcttactgcacagaacaaaactaatttgcatgatgcacataatctctggaaattttacctgcaaagatatcctcgctaaggttgataacctttgatgccttgcttatgccaccccttgtgaggtgaaagattctatcgaaaacatcagggtgaccataatggaatcgtaccctgcataagaaatttggaaaaataaccaaagaaaataactccgctgctcatggtacaattgtacaaagatctacacagcaaggtgaaaatcattctagcctaacctgtatcacttgagttttataattcctatatttacttaacaatttatctcctatcctctcaaaaaattatctcctacacgataaattgtacctaaaatcaggttttacacggtgagaattgtgatagtacctagcccccactggttccctaaaactggtgggttattgggtggtttctagactcactctaggcactgccaatcagtttgggattgatgaaaattgttcaagttagtcaaaccagtctaacttgggagtaaattggtataaatatcattactaactcactgaaaatgagatgagtaaataacaagaataattgatttgtcacatctgaccagtttgaccataaacaggtaagaactggctggtccacaggcctttacaaccctgtcagctgtacgttccttgaatttatgtgctgtaaattatcatttctaaattctaagtatattgccttcaacccctgtgttcatagcatgcatggccttgtgtttgctttgctatgctatgattttggctagtcaatgccatttaacaattttagcaatttattgttcaaaattatagttcctttacaccttaacaagtaaatctcccagcatatattgatcctttattccttgtgtaactcataaaaatattctagtttggtggttggttatggctccatggaacatttagtagttatcaaaatccaataatatgaaagctacacatttgtgggtaggagctctgccatgaattagataggatcaaagcttagacaaaaccatactgaatgcttgaggagaagccaacaacatgaaaggaatatgaatcaagcagacattaaggttgtgcaatatggtgactatattgcagaagttgtataaaatgaattggccaatataattttgaaggtgaaaggagacatacttgagagtgttcgcaagaacacgttgtccaatggtaacgaaactagtctcttggtttgacataaaccacgcaagggatgaaacactatatgtcaagtaagaacaacataatgttagtacaaaaggagttaaaaaaataaatacactatcagcaaaattgatggcgcgctaaagtctagaggtgattaatagaaaaaaagaaaagccaaacctcccagtaaagatatgttcgcgaacacccaatattgttggttcagactttccgtgtttaataaggaactcttccagtagatttctcattttaaatgcttcctcaaggtaattatcctgcacaacagagaatataagataaactactaagtgggacttattttacacagagattgcatacctggttcatgtcaattgcttgaagcgcttctcctctagtgaagattatagcgtgattttgattattaggctttccctcgccaatatctgttggtttacctgggagccttatccggtaaatttcctaaaaaaaggttaaatgtcaaattgcaaggcatcactagtcagtttaacttaatcatgtactgactcggttaacaacaatattgagctctatttacaagagatatttgttctaagttcattagtgtgcaacatatttccagagcaattaagaggttattcaattcgctgccatttcttggaatgttgacaactgcaccctgacatcagtgttgatgtctttatgcatttgaatactgttccaatttattttataaatattactatccacaacttgatctacaagcactttatcacttaaaggtaaaaccgatctataatcactatcatggataataaaatatctacagaaaaaggtagatatttgagttcaagcaatgaaaattcagtacctcatcattgcctttcacaagaactgagtaatattgtttctccattttaccatttggtaatggcacttctttctcatcaatgtaagcaatacgcaatgctggatacctgtattgcacataacgctgaaggatgcacaaaagatatgtactttataaaatgtaatgggtgttcagcaacttacgttaacatgagatttaagatgttttcataaagacctttttcacgggaatcctttgatgccttatgcatgccatagagttggcaggaaacaacataagtgaattttatatcagcaatggccttggaccttgcagattcctctccgtctaaatcagctaaggtataacaatgtagccaaagttaattgtttccacataaaatgaaaaatggaggaccagtgttttgtaacaagagcactatctgcctaaccttgagcatttgtcatatcctcatagcattgtagttcaagagctcgtctgtagtacatcattcctctcactagacataagaagataaaaacaataagatctggagaatagatataagtttggcagcttactagaggatagaaacattcatagtaccagttctggcaagtgtttgaccacggtaagatgcccagatacggacatcatccatgtacccttttactgcctcttcattttctgggtcaactccaatgcgttctagaaagttcttccattcatctggtgaagtgacaaagcattactcattaaatttttactatgaacacagaaataagatgaactacatttaggatacactaaaatctgatgagtaagatggttgatagtatggaaaaccagattggtggaacacatactctttcactcttcacatttatcatgtcactatttttaatttgtaacattgatctgcggatccttcacgaattgtgttcagcagtttttattgataaaaaagaatctgcaactcacctggataaatcttttgtagatagaacaaaattgaaatgccatcttcattcttcttattcagttcatgagaagaatagagcacttcctcattataatatggagtcaaaacactaaatagtggagtttgttagaatgtgaagttcctcaaaatgagtgcagaggatagtaaattaataacagaagtaacactgcgcattatgtacaggtgtacagggctgagtgaagatataataaaaaattaaaaacatcatatcgttaacatgatttatttcgaaagacatgaatctgaatatggttaattaaaaagaacatacatttgtccatgtctcaatgttcacatgacgagcacttgtgcatatagctctataaccatttatctaacaaacaatctgatgtcccctcccaaaaaaaaacttcagtcagtagggaaaaaaaaaaccttatcaggcatcggaccatccccaattttcagtttggttctgagcaaaactatcgggttcaaccggttactactgtttcatttgcatctctagtcttttatgcaaaccagaccaggtacgggctctagtttccccagtttaaccgtcggtccattatagttaactattcaaaatgcagcatgtatgcacggaatgtcatattataaaaaatcgccgtacagagttttatttaattaatttattagtccacataccaatatattaggatatgttatgtacaaacaaatatggtgtaatctaatggtcttatagatttaggcaggtatcagaatctcatcaatttctgctgtaaccaacatatgcagacagaataaacttagaaatcaaatctacccatacttctgaaataaaagttcattgatgataaaatgcacacctaaatgaaatcatatcatgaacttgaggtgcttttggcattttcatgaacagtgagtttgcaaagaaggtgatcctacgccgagcatccaaatttgttggtacatccattgcggaatccttcatagtcaacaataagtgcaaccggacaaactgggagcaaaacatctatttcagtattaaacaattaagaaacaactttcagagaagtcacaatgatagttgcacaccttctccttccaaaacgattcctttatcatatccatgtctaaatgtgtgaacctctgctttctctcattctcatctttcaaaatactgccacagttttcaaacaattaaaccaacacatttcatatctaaggaacttattaattacaatagttcttacccctgtccatctttcatgaaatcccgtgtagtaatttccataaaatcttgcagagcattaatgatttttctctcagcagtaccatcagtagattcattgctctgcaaaatgagtgataaatacagattaaatgtaatatatatatacgcagaaaaggaactaataaaataaatccattcattcttctgcaaaacgagtgattaaatgaatctgcgttaaatgtaaatatatgcagaaaacaaactaataaaatgaatcaggcataacagttgttaccagtagatgcaataattttgccagcgtgttgctgactttgccaatctctgccatatgaaaatcttccaaaagtgtattattttccacactatcaagcactgttttatcaatggcatcgacgattctgcagcagtatgtcaaatgagccaaatcagtaatttctaatatattgtacagaggaatagattcaccatgtaaatgaaagagtatggcctttacttctgatcattattgtctagcagaagattcttaagaataagaaccaaggactcgtagcattctatgacagcattgaatctagcttggtctagtctgattttttcaatcaactcatggtaatccccttctttagaagtcatggccatgtgaagagctgtgggtacctggtatattcctgagaccatgagcatctctgcaaaataatcaaataatattggataatttattatctatttctgagcaaacaggctttgcgcaccttactggcaacaaggaaaggaggccatggagtaacagaaaaactacttgaaaatgacggagccatcagtatgtccctttctctatcaaaataaaagttgagggttaaccctacagtgaatggcatagtggaatactattcaaaaaaagtttacagttccaacctatcacttatgaagtcttcctctcgtaaggaattgatgaatgaattccaaacacaaaaaaatctcccctcaccacatgcttgctgcaatgaaggtaataaaatcactcaaaattcaagtgcctttagcaaatactaaagaaattatgcatttctatgtcttcagcccacctaaaagggaaacagatcctaacttactgccctctgactttgagtggctgacatgtgggcccctagctcgcgggcccatatgtcagcgacccacatcagagggcagtacgtcagaggagattttccccctaaaagatggcccctgtatgcattgtagccacctacactttcattctcactgcatgtaaaagggtaaactcggatatccagatctcttgtttatataatagcttcagcctacctagtctcactaagtcggaagtttcacaatcttagaggtgttggtaggatcacttctgaactacacacgctagtctagctgaaaacctgattatgtgctgctgaaaagcttagtaacttaggaagggtacatgtccttctataggacttttaagtcggtgctacagtagaagggcgtgtacccttcctaaattagtaagcttttcagctcagtttcagctagactaaagtacagttcagaagtgatcctattcctaccaacaagaggaaatttccatgcttgaaagtttcaaaatgacatttgaaacttccatagtaaatgttttctgaaaatacaacgatgaatttgcttcacttgaaatatttcaagttttgagtcaaaagttgtgaagccaatgtgaaaaaatctctgcttttgcggtagggatgaagagggagatgacaattattacgtgtgtagaggggggtttctgcagaggagatagctatcagatgatgaggggagtggagtctcatttacttaggctgtccgtgttaagcatagttgtaaaaaggggaccagactggtggttcaatcagaaaaaccagaaccagatctcagcacagtttggttgcatcaaaagaccagatgtgcatttggacccctttgaacagctcgaaccaacagtcttgaggtcatgaggtgaactggctattataaacctggaaaggctgggccggcaggggaggaagagtgtttgtaatgggccaaacggaagactaatcctttccctcaagacccaccacagcttaatttctttggcaaaaaacacagtttggttgtgccgaaagaaccaatgtgcattaaactgggacaggttggcctggctggggaaggaagagtgtctgtggtggcccaaacaaaatcctaatcctttccctcgaggcccaccacagcattcttttgtcaaaaaaccagtaaagggtgtgtcaatgggatccgatccctggttgagagattcaaagcagtgtgccttctccatcctaccatgaaggctgctgcattttaaatggaacatatactgcatttaagtatattaatattaaccaaccacggtttgactgcctagaccgactgtcagcgatgggttcacccatcaatctgactttttaaccatgattagcagtcccatgaggaaaatacaaacctctctatgcgctgttgcatggcttttattgaaagcttctggcattgatttgaatctggctcttaacatgccaagggtacgtatctacattaaaagaaaaagaagatatcttacaactaaacatttttaacactgcaaatatattgtcatacataaaagagtcactaacctcaccaacatgactaagggcacctgaaacacccccaaatgcagttgaaaaaatagcataccatatttgtatatccatgaagtacacctataaatagagcagtaggttatatcaatcatggaacaatattagaaccttccaagttcgagaaaaaaaaattgaaccttcatgattataattacataccatgacgattggggcccatatagtaatgacgacaccaaggttgtgtggcactgttaaaaattaacaagaatattgtaagtaaaatataatcaccataagaaccatgcagataacatgtatatccaaaataacaagagaatattagaaaagaaataaggagaagccccatatacttaattatatagttgcccccctcccccaactgccacacacacacacacacacataaaaaataaagaaaactaagtgtagttaatgtatttctctcttctctcatgaaaccacatgacctcaattgtttgtagctttggatgatcaaactacagttcaaattgtctcacttctcttataaatagcctcaattgtttctaacctttggatgattaacctatgcagcaaattatctctcttcacttttaaagtcacatcatctcaattatttctagcctttgcatgtttgatcaaaggtgtaaattgcaaaaagcatataaaatcaattatcttgcaccatattttatcattgtggtacagtattcacgcagcaatgcacagggttttcatctaatgttataggaaatgaaatcgccaaatgaacaacattattgcaagagaacaaaatcaagtttggccctcaacctctgttggaaagctattcactctgaactcaaaaaaggctgtcttccccagtactctaaaatctggacagataacaccctcaaccctattctatggtggttttgattagagtaaaatgcaccacgggtactaaaacttgaaaggtgggtgcacttcagttgtaaattgctcaagcaagtcacacaacttgtttcgggggttcaaatatcacagagtacatgtcacatgaactatttgttgctaaattaaaaacttttggcgtaagttgatgcacttgtgaaccgcagagcaaggttacaagtttcaagttaagcaaattaacctccatatttttacgtgcactcctacatgcatatgctttcagtcaacacaatcgcatagtgcttagcaataaaacaacaaaattcatcttaaattggattttactgtcaatacttttacaccattggtttatttgtagccatgtttatgaaagaaattaatatggcatccaacttcgaagatgaacatcccacatggcatatgttttatgtgatttgcacctcggaaacaagatgggtgattcttttgagctatttgcaaaatgagtgacttaattgcacccaccttacaacttgtggtactgctggtgtactttactcattagagtaattcagaggggacaggattgcattgaacatttggtccaatctagctatatcacaagatacttacggaaagggaagatttcatgccactcatagttcccaactccttggttaagaaggaactttgtcggaccaataattggggatatctgcacaaaacgaaaacacattccatagagtaaggaaaaaaagaaattgcatacattaaaactgttatcgtaattcctgttgcagaatagaagatagatatttttttgaaacaaaaaataatagacagtacttctttgtcaaggtcttctaaaattgagttttttacttggcagctgtgtaaacattaatatagctcattattagattttcaatagttgtttccttttatatggtaaagaagacatatcattttcaaacttgtatatatttttctagatttttcattttttcagggcaaacaaggttaagtctctggcccataagactactcggtactcacgcccagcatggtacagcatgtgttgtactttcaagttgtagtacctgcggtgcattcattaggtcgagccaacccgactctgtgtacaggagctcatgtcagaccccatttagccacacctacccaaaccgctgagtatgcaggagccaacatgcataatcaagccactaagacaaatgtgagcattagatgcacgttcactggtgtagcaggcactggcttgtactatcatcactgtacatgagagcacaggggagagacaagagaggaacaacattggatagaagaacaaggaaacatcactctcactaacatgttggaagtggcactagccaagccaaaacaacatgaagtaataatgaacacatggttttctatttttctgcaacagaaatttctcaaccttgag

SEQ ID NO: 16863 - DNA, 592 bp, Oryza sativa
gtcttcttattatagtagtaccttaaaaaggagagaaatagagaaagcaaccaaataagaataaaggtgaaaacttgcaacacaacaaaagatactgagcaccaccagaaagttaataacaaaaggtaagtaggtaaaatgattcaacttactttttcccatcagctgaagtgtgctcttgccagtctgaagagctagtttcgctggaattgatctgttcatttgcaaactcaattattgcaaggtaaggatgtcatatttgataaagcacagtagtaaacttaatacagaaaaataaactgattcagaagagatcagtgatatttactgaaggcattgtagcggaagatgacatcggctgatgcccaggctgcacaagaggtacattctgacctggagctgtaccccaagattgcactatgggaggaggaacagatgatggttgatactgcagtgtagcctatactagtatcagtaacttatcggcaaggggtggcattcaagatccggcaatagctttgtgaaattaaatacatatatcaaatgaacaaattgaattcacaaagtgcaaggaaaaataggacttgccgta

SEQ ID NO: 16864 - DNA, 907 bp, Oryza sativa
acttcagtcactctcacgcgtggagttcttcatcagtccatggctggcagtgtccagcaatagctgcgtctcgccgcgcagcaaacggcggagcaggcggagctgcacgcgctccggcaatgtcaggtcgtcgtccagcaccgccgccgcgagccttgcgtccacctccctccacgcggcgaccaacacgaggcgccgtcgtcccccacgctcgaggtcgagggtcgtcagaatcccggagccgagcgccgccgcgaccaccagctcgtcgaggagggctggcagctcaagctcggcgacggcgacagcgacagtagcgcggccgtgctgcttgccgtctcgccgccacgcctttgactccgcggcgtcgccgttgatggcgcagagcgccgcggcgagctcgtacggctgggagtccgacgggtctttctgcacggccgccttgtaccgccgcagcgcgtcgtcgaagtccccgtccctggcggcgaggaaggcgaggaggaggttgacgtcgaccgccgcgaggtcgtcgccctccgcctcggcgtcggcgagggcgcgctcggcggtggcgcgcgcctctcggagtcgctcgccgcagagcggccgcgctcggagcagcgacgcgagcatcgcttgggagcattccacgaggaacaccggctgcaggttgacgggcttgatttcgcggccaccggaggaaggcggcggcggcgtcgacttcggcctcgtgaagtacggaaaacggctgtacttggacacgaagaggcgtagtgcggtgagcagcaacgaaatggccagcttgtccgcgacggaccactcaccttgctcgaaattcttgacgagcacggcctcggcgagcttggccgctagcaacatgactaccctgtcggcggcaccttgggtg

SEQ ID NO: 16865 - DNA, 1944 bp, Oryza sativa
gagcgtgtacgagtgccaggcccatctcgacccggtagacgaccgtggactccgcggccgctagtttcttggcatactcacggaggtacctgccggtgaaggtcggagcgcggagtgcaccggcggcgagcgcgtgggccgcgtcgaggaacaaggcgtccctgccgctgctgctgccggcgagggccgcgttgaggtcccgcagcccagggtgcgcgcggacgaggcccaggtgtccgcgggtggtggtggcggcgccgtcttgcggcggatgggagacgcggacggaaatccccgacagcttcgccgccacggccgccgtcccggccagtgccgcggcgagggcggcgcggcggagtctggacatgtagccgtttgctctccggcggcgaggagaaagtctcgtggtttgctgaggattcgtcgtgcttgtactggacgttactggacgctaggatgcagagctctaaaagatgaaggaatcctttccctatataggtgtactacgtctggaactctggatgttctgcgcttctcaagcgaacggcccaatacaaattttgaaatattttcgtccaacaggtccatgcaggagcatagttattagtaagggtgaaaacggtaacggaaccggcgttcgtttctgactttctaccggtcgagctatatagaaatggtaattgacccaaaaaattggaaatggtaaaaaatatggagatggaaacggaaatggttttgctgttataccgatcgtttccgtatttaccgtatttttatggaaattactgtttcttataataattactgtatttctagatatgttgatatttatagggtatgtctctactttacccacagtttagagattgattgactcttcaatcaaatcctaacttgagtgcgtggctaaaatggatttaatttataatttatatagtatagcttaaatttatttatacatataacatacttatgagttaaatatatgttttctatagtttaatgtttccgtatttgttaccgggttccgatctgtaccaacatatttctatccgtattattccgtttccggttttccgatatttccgatatcgttttcgtttctgactttaccctttttgatttcatttccgagaaaatatgattatggaaatagttaaggctgttttccgatcgtttccgaccgttttcgtgaggcgaggcaggttcaatgtggcttcgtgaaaataaaattttctatgccacatcggacgtttcaccggttgttggaaggtgttttcggacacgaatgaaaaaactaattttataactcgtctgaaaaccacgagatgaatttattaagcctaattaatctatcattagcacatgtgggttactgtagcacttatagctaatcatggactaattaggctcaaaagatacgtctcgcgatttccatgcaaactgtgcaattagtttttctttttatctatatttaataatgctccatacatatgtacagagattcgatgtgacgtttttgggaaaaaatttctgggaattaaacaatgcctgtatagcacatagtatgtattactccatccaaaatatagtaatttttagtcttcaggacttatactaaaatatactactaacaacaattacaatcatccgccatttaatttctccacctacctccacttctcatctaattacaacatttcatcatttaattctacctactttctaaataaatgtgtccaaccctaaaattctgtaggtagtacttcactactgaattgctaaccttcattcgacaaaaattttaggtgagaattctgttgaacccttcacggttggattcatgtcacattttttcttctcgagctccgacgaatgaaggcggcccgacaagttcaagtctcgatttggggttggggtggaaagggggtgggagggggggga

SEQ ID NO: 16866 - DNA, 7523 bp, Oryza sativa
gatctgcttaactccagtgcaggtccaaaatcttgcctttaggttcatgagcgtgccagttgatttgatcctacaatcaataagaaagaaagacaaagaaaccgcggttaaatccataaacgatagccgatcggctagttgccgatgacatatcatttatttttgagccgatgtcatattgggatcgatcggccattgtgaataaataagataaagctaagtctactcgatcggctgtagatgttaacagtacataattgtcacgtcgatgtatatttaaaccaagtgattgggatagatcggtcgttatgccgagacagtataaatcacttaagtcaaaatatgcattaacacgataattatatgaatgttcacagcatagccgatcaatctagtacgtatcggctgatactccgataccactctatattaagatattaaaataaacataatacattaaacaggaagcctaacatattctaatacaataagatcttaacacaaagggtggatttagcataacaattaagcatataagatataaaatagctaaatcaggtaagatcggctgaaactccgatgctatctctttcagtaaccataaaacaagcaagatattacgattaaaaatattacttaatagatcaaactcaaccgatgcagcattaagcataaagataaacataagatctaagcaagatgatgaaagcatctaagagatggtagatatgctatataatctagattaacagcaagatttaaccctatcggctattttcctaacaataagaactagccgattgcgggttaaatagagtaattactaaagattatagaacatatatgataactcgacgaattacatcaacaagattagagtgtcataaagatggaagcactaatcccgagaacgcaagccgccatgacaagtttacctctagttgaagatcgaaatcgatgcagcccaacccgaaagcaagaactcgacgaaatagaacgaaagtaaaaaggtggcgatgcgccgaaattgtgttgaactgattgttaattgattacatggggtttgggctacttttatacccaaagtacacaatatgtccttgtcaaacacgactcctaacactattacaactcaagatacaaacaagtccttaaggcggacccttaccgactcaaagtataaggaaattacacaaaatatcctaattaatagatacaattgtcttctcaggactcaatccacgtgtggcaatccgtatgaagcacattaacttaacccgatgacgtgtactgagtcacattgtcagaatcggctcaatcggctaccttatccgactcgaactctgccaactctggtcgcagccgattcggacttcggccgattcttactctatttccggaacgatctacagaaattttggtgattatataagatattgtcagagattatataagatatatgataactcgacaacttacatgaacaagattagagtatcgtaaagatggaagcactaatcccgagaacgcaagccgccataacaagttttacccctagttgaagatcgaaaccgatgcaactcaacccgaaagcaagatctcgtcgaaacaaaatgaaagtaaaagggtggcgatgcgtcgaaattgttgttgaacatgtgttattttattacatggggcttggggtctatttatacccgagattacaaaatatgtccttatcggacacgactcttatctctaacaaactctaagataccataagtctttgcggcagacttttgcccaaacttatctataaggaatttacataaaatatcctaattaatagatacaattgcctccttaggactcaatccgtgtatggcaatccatatgaagtacttcaactcaacccgatgacgtataccgagtcgtattgtcaaaatcggctcaatcgactaaccttgtccgactcgaactctgccgattaaggtcgcagccgattcggacttagccgattcgtgctctgtttccgtaacaattcctatcttagattccgcttctgtttgatcttcatctctgatactcatattaccaaatttggtcgttaacacatgccccccaagttcggaatatttggtaatgtttcagatttgccatatctgtttttccaagaatatcgctcgttgccgtttttcgaccgttaccgcggtgttttaaatattaactgtcatctccgagaaatttcacaccgtcacctccgttttcaccgcttaagcaaaccttgtcttctctctctctccggcgatcccctcggtgcgcaaggcaattccaaggcgatctcctctccggccaagattccgcccgcggcgatgtcgacctccgccagcccgtctgtcgcgccatcggctgagtacgcagaggtacgtgctcatcagctagatccctttttccgtgcagtatatcagcttttcttcatctctattcttttgcatttgtagcatctctccaacttggtcgcggttcccagtctgtcaaacgagcaccagtattttctcggtccgatcggcaatcctgatccccatgagtttattagtgccgagactaataggattcctttcagactagccaacccgaacataggtcattggaaaaacaccttcaaatcttggccttccattgagaaaagtgcccctgagaaaagttggcctgtatggtacaagcgggtatcggctagcaagcaggctcactgggacgaaattggaatcggccaagcacttgccctgaccatagcaaattcggctaaggacaaacccctgatggccgctgcagcctatttctggtcgaacacacttaatgctttactctttaaccaagggccaatgaccccaaccctgttagacatcacaatgatcactggcttagatgtcacctcattggctaatcccatgagcttgaacactaaaaacacttttgagttcaagaccaagagcattggaggctggtcagggtatattgcagcgtacaagggcaaagggccagtcacccctcgagagcatgtagtctttctgctgatatggcttgaaaagttcctgttctgcggatcaagttgtggtcccacaaccaactggcagtttccagctgaagccctagaaacaaagagacaattccccttaggcaaaatcctcctcggctatctgtaccaaatgttgaataatgcatcggccaagatagctgtcggctcagttgttggtgtaggtggaccatggtggttgctgcaaacttggttaaacttggtagccatgaaagttgttaatcggccaactgctcctgctatcctagtaaattttgtcttcaaaaatctcaaatcggctgtacaatttgtcttgatgcttaactatcttcaactttctctcttgcaggtattagccgatctgttctcgtttgatatcaaagattaccttgatgaagagacagaagaagataccaccagcaaggctctagctcccttgtccgatgacgtgaagaaaacacttaaagatatatctcatcggctagggtcatcgttagatagcttagtagccgattgtggttcaatccgggctagattcaaggaaattcaactttagatcccagatgatcttgccaatattattactccagcagtatacctcgagcagcatcaattcaagctggaaagagctaaacaaagattagctgatcggcgggagcacaaggatatcgaagctacaatccaagccaatcggcaattggtgcatgaagaaaaatccaagctcgatcagctgtctaaggttccgatcaggtccaacattgatcggctcgaagcccaaaagattgatctcttggcacaacttcaagaatgcaatgccgagctggatctggaacacaagaaactagctgatctcccaaaagctgttgaggagcagaaggctaagctgagatcggccattagaaatgtcgccgatatgactaagtccttaacagtcatccctggaaccgatgctcaagacgcccaagcgatcgaagaagtagagtaaattagataaagggttgtatcggctatccaacattacttatcccaatgaatatccatgtaataggacttagaaaatttttgtaatcggctagaaaactctgatacttcatctacttgttctgatattctcttgtgccgattaatataacttctaaagttgttcaaaaattctcaattttttcttgcatatatgtgccctcctaattttgcaatgacgaagacattgataaaattataaattagtctaagggcgatataaccatatcggccatcctataacggcaaaacacagccgattatgtgaatgaaaacaacccgcttagggcgatataaccatatcggccatcatacatcggcaaaacacatccgattatgataataaaacaactaagggcgatataattatattggccatctcaaggcgatgtaaacacatcggctttacacgtatcagcaaactcagccgatcatgaattaacccatacacttgagtaatatttcttcaagtattttccattaagtgctcgtccataaacttcaccatcaagtccttgcaacatataagctcctttagacacaaccttgtggatttgaaacggtccttcccaatttggtgaccacttgccgaatttattatcacgagttcctatcggcaagattagcttccaaacaagctctccctcagaaaaagacttgggtaccacattcttgttgtaatgtcgagcaacgctctctttatccttggtaacttttgcaagagctcgcaacctaaactgaaccaaatcctccctttcatcggccatgagattatagtactcatcggctgtcaacatatcttgtaaatctgttcttctcgagctgattctaattttccatggtaaaactacctcatgtccataaacaagcttgtaaggaggaacttgaatcgatccatgacaagccatccgataagacaacaatcctttggccagtctagtatgccattaccgaggataatcagaaatctttctcttaaccaacttgatcaaactcttgttagacgcctcggcttgtccattgccatgtgcacagtaaggtgaagaattcaacaatttgatacccatgctgccggcaaactgaacaaactcatcggacacaaatatcaaaccctgatcagttgtaatggtctggggaataccaaatcggtagattatgtgctccttaacaaattgtatagcatctcctgaatcaaccttcttcaaaggaatagcttctacccacttggtgaaataatcagtcgcaaccaatataaatttatgccccttacttgaaggtggattaatctggccgatcatgtccataccccatcctctgaacggctatggcttgataataggattcatagctgatgctggtgctctttgaatttgtcacgaccgaaaataacccaacgggcgttccttacgtgcgtgtattattccttgtcccaggaggcaaggtacaccaaaagttgatacaattcagagtttaacaagcggaagcgtaagtaattaatttattacatgggcggcgaaggcccagcacacaagaagacaaacgaaaaacagcggaagactagggcgacgaccacaggcgcttgacggcaggcacgagctagacaccaaagccttcatcatccaggaactcctcttctgggtttgggaaaaattgagcaagactgagtacaaccaccgtactcaacaagacacacccacaagtgcaaaatagatgcaagggagtacaagggggttataatataaggggttagggtttgcagtaaacagcattaaaagacacttagttgctcaaagctattttgtcaatacgatcctagaggtatccaatgttattaatcaaggccgtgaacccacacgaacctgccttaacccaaggcctacgatgattcaaaccgaactggcaacccgaccctgggtcccagctcgtcccaagccaacccaggccaaccattccatattttagttgttaagcaggttttaagaattaaaacactaacttgggtacattgctaggcttgcccataaccgagggcgcggctattcgaataggttatactttgatcagaggtgtacatctttacccacaagacacatctttctcacgtgtaatcacgtgccacataccatcacggtatacggacggaagacgtgacatagtttccaacccatcctagccatagacaagagtaccgacccaaccccacctatggccggaacctccgggacaggtaggtaggactgagcccctagcagcaggacaccagccctgtgccatgacatttcgactaccgggccgcagctcgtgtagccttcatttgccctagagatgtccatcgacccccgacttcgtccatctccatccgtgtacttttgttcataaccagactgagccacaaactaagccttacccactagacatgtggaagtacgatagtgctttgcaacagaggcccgaagaccggtccttatatggccgaggtgttactatcaaaaccatgcaccccgagcccagcctaaaaccattttgagggttttgaatagagggggaggtgtgaatccaattccacaataatccaaccattccatagtgtccaggtgatatgaatattcccaaagtctagagttgtaaaaccacctaatgttgcctaattaaccagcgaagcatctacctaaattcatactagtggtaccataaatagagtacccactagttggggttttgtttattctagggtgaacaaggtaataataacaataacaacaataataaggtcataacaaaggtaaataggcatggctaaacaaaatagtgataacgcgggaatttaagtaaagcggtaatgcaataattttaaatcaaaataattttataaactgggattcaatatgttcaaggatgatgtgacttgccttgctcgctttcccaaacgtcggcttcaacctccacgaagagcggatcttccgaagctgcagcgtctacacgaccaacagaaaagaaaaggcttttactctaataaactccatataacaagcaggaacaaggcagaaaaatgggtttttgacctcttaaggaaaaattagagacttgaacggtccaattccgagttcaaatggccaagttatggccatttgaagtttatatgctctttaaatgaatatttgcgaatttcttcatttaaattttaatttaaaaagggtttattgcgtcagccgagggggaggggcgcgcggaccgggtccacgggagtggggcccacgcggcagcctcacggtccacggtggaccgggcgcacccgggctcacaccggccggcgccgtgggccccacgcgtcagccgcacccgagggcgcgggcagctgacggccgggccccatgcggcagacactcggcgcgcccgaaggcggccatgccggcgcggctggcgggaggcggcacccgcgcccctatgg

SEQ ID NO: 16867 - DNA, 3208 bp, Oryza sativa
cggcgcgagctcgattccggtgaggagaaggcgcggcaaagggtgaaaacgggcaaaggaagtgcggggagggtttaaatagggttggaagggggagagagcggccggggaggaaggaaaccggcgcgggaggtccagccgccatcaatggcgccggcgagatttgcgggggcaaatccgcccgtttgaacgcgagagagagagagagggaaaaaatggggggaaagggagaggggatcacggggagtatttccccccactttattgcacgcggggacggtaggatgcggcggatttggcggcggcggcggcgcttggcgcgggcggggcggcgggagcggcgggaggacggggatgacgggtgggccccacccgtcagcgagggtggcgggcgggcccgcccgtcagcggcgcgcgcgcgcagggagaggccggattggccgcggggagagaagggagagggggagggaaatgggccgagccggcccaagagagggagggagggtttttttttagggtttttatttttataaaacctttttaactttgtttatttcttaacaattattatttgtgctctgaaaattccactaaaatttatttacacattttaggattttaggaaatatacaaaaatcctccaagccttaatttgacttttaactttgcacattttaatttttgaaggctttcacaaggattttaattattctaggcataatttaaaggatatattttagagtcattttgggacgtgacagaattgctccaaatttttgacaatcttgacatcctttataatatctgaaacaatcttccaacattattggccaaaaataccctgcacgccgaagtaaccacttcatcttgtgagccgattgatgagtaccacaaattccttcatgtacctcacctatcgcaagctttgcttgatcggcgctcaaacacttgagcaacaccccatcgattgttcgataatataactcatcatccaacaaggtgtattttaaagccttataacgctatttcctcgaagctgattgagatgggttttgcaaatactgatacacatcatatctccgatcatcggctgtcatcgtggcaacttctacctccacatcttttaacatcggcttataccctgatgctccctgagccaaatcattagcttctatattctgctctcgagaaacatgcttcaaagttaccagccaaaatccatccatcaaccttcggcatttctcattgtagaccattaatgtatcattcttgcattcatactctcctgccagttgaccaataaccagtaaagaatcacccataatttcgatagcatcggcttcaacttccttaagcatttgcagccctttgagaaccgcttcatattcagcttgattaatagttgcataaggcttaatagtataggcaaactcaaaacttgccccctgaggagaaattataaccaagccgataccacaaccatgagtgcatactgatccgtcgaagaacaatgtccaaggcacaatgtcaaccaagccgattaagtcatcacggtgatccacaataaaatcggctatagcttgtcccttaatcgcctttggtgattcataccgaagatcaaattttgttagagcaaatatccacttcccaatcctttctttcaaaattggagccgatagcatgtatttgaccacatcggctttacataccacagtgcattcattggacaataaataatgcctcaacttggtgcaagagaaatacaaacacatgcataatttttccacaggagaataccttgtttctgcatctaagggcctgcgacttaagtaaaatacagccatttctttcccttcaagctcttgaatcaataccgaaccaatcgacttgtcaccagccgataaatataatctgaaatgtatccctttctgtggaggaatcagaacaggtggggaactaagatattccttgatattatccaaagttttctgttgttctgccccccaagtgaacttttgatcggccttcaatcttaacaaaggtgtaaagggttctaaccttcctgataaattagagacaaagcttctaacaaaatttaccttgatgatcaattcctgcaacttcttcttgtcctctggaggttgaatcttctgaattgcatcaacactcctttgagttacctcaatccccctctcatgaacaagaaatcccaaaaactggccagccgatacgccaaaagcacactttgtcggattcatcttcaagccatattttctagttctctcaaacaccttcctcaaatcggctatatggtctcctatttcctttgacttgactaccacgtcatcaatataaacttcaaccaaccaaccgattagatcatgaaatatgtaattcatggccctctgatatgtagctccagtacttttcaaaccgaaagtcatcacaacccattcaaacaagccgattgcaccaggatatctaaaagctatcttatgaatatcttcttctgccatgaagatttgattatatcctgcattgccatccataaaacttaatatcttgtatcctgaagcagcatcgaccaactgattggccaccggcattgggtactcatcctttgggatagctttgttcagatctcgaaagtcaatgcacactctaactttgccattcttcttgataactagaactatattagaaacccattcagcatatcggcatggccgaataaaaccagtatcatacaaacgtgcaacctcagccttaacagcctctagcatatcggctttacatctccttggtggttgttgatatggtctaaccccgggtttgataggaagccgatgctcgacaatcaatcggctgagtcctggcatctcatgatattcccaagcaaagcagtctctgtattcttttaaaagctctatcaacttggttctgaattctgaagataaattcttactaatgaatgttggccttggtctgtctcctgaacctatatcaatttcctccaaatcatcagccgacataaaaccctatcattgcttgtcatcgagatcatctaccatgtccttggtgtagacatttgaaccctcctcgaccccctcaaaataataatttgggctctccatcttcaatcggctgtatatcacaattggacactcttagaaaatctccatcccaaacttttccagatagacaatca

SEQ ID NO: 16868 - DNA, 907 bp, Oryza sativa
  unsure (1)..(907): unsure at all n locations
ttggtctgtctcctggacctatatcaatttcctccaaatcatcagccgacataaaaccctatcattgcttgtcatcgagatcatctaccatgtctttggtgtagacatttgaaccctccacgaccccctcaaaataataatttgggctctccatcttcaatcggctgtatatcacaattggacactcttagaaaatctccatcccaaacttttccagatagacaatcaataccatccatctctcaaagagctaaatcggcattagcaacattaactgacctgtcggctggtacaatttcaatcttgtcaccttgccattgaatcaagcactggtgcatggttgaaggaatacaacaactagcatgaatccaatcccttccgagcagcaggctataggaacccttcccattgatgaccaaaaatgttataggaacagttttactgccgactgtcagctccacattcaaaactcccttagtttccgatggattgcaaccaaaatccttgagaaccatgttagttttgataagatcatctggatttctacccaatttttttaatgtagcatatggcattaaattgatagcagttcctccatcaaccatcattttggacattggcttcccattgacaaatccattgatatacaacggtttgagatgacgattctctgtcccttctggtttctcaaaaactgtctgttctggtgacaaaaccaatttagccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16869 - DNA, 5979 bp, Oryza sativa
ggcaagggcgttccaaaagatggactccattcctcgtgatccaggaacttttgtggctccatcttgtgggcaaggagtgagggaaatgagagtggaaactcaccctgcgtggtggtgcttccatcctgccatggatctgcacaaaccacattatagcttattgcacaagagggaaggaggggctactctgtatgggagagggaggagtacgtattgcacctctactatgctagggcagctgaggaaaaagaattggtgggctttaaataggctcttccgctgacttaagtgtacgaagctaatgtggtgacttgctgaacgcattgttgacccatatattttctcattttcttgctctcttctttcttttgttgtgtacgttcgcaccctgtgtacacccttctgcctagatcataaagagtgctgggtcgccttgtcgtgatgaatggccatagtaacgatgggtcgaagaaaagtttgcgttgaagtcttgagatgttgtaatcagagtactgtggcacatccattttatatataatttaattcatattgcagaattttaggacctagattctcttgtgctaactgtatgttacattgttactcaatacaatttatagctcacacataaaaaaaatttgtgtccaatgcagtaagtatggcaaatcagttctctataaataatggtttttgtatctgttcacaaacatggcaagcaaggcagtgaattactgaattgcctgaatcagattttaactgagcttcctttgcaaaatacatgttccttgaatgactgaatttgcttgactgttttctgtcatacttttatgttatttatgtcttacctgggttttgaatgattttatactattttttgcattagggcattggacagcgaaacatactctagagagcttttcgaagagtgcgttgtccacttgaaagaaaggttaaaagagaaagagcgcttgagggaggaagaaaaggtaatgtactgatggctgttttatcatatgatatattgtttacctgcatttcttgaaggtgtcagaatgtgtataacatggttgaaacatcgttacttgtatgttgtatcagcagcatctgtttctttgtcaggtgtagcattgacttatgtttttttcgcctgaatttgtatcttctattcaggcaagaaaagagaaggaacgtgaagagaaagaacggaggaaagagaaagaaaagaaggagaaagaacgcaaagaaaaagaaagagacaaggagaaagaaagagaaaaggacaaaggaaaggatcggtcgaggaaagatgagatggatattgatgctgttgatgcagatagccatggctcaaaagacaagaaaagagaaaaggacaaggaaaagaagcataagagacaccaccatgacactgcagatgatgtgagctctgaaagggatgagaaggatgactctaaaaagtctcgtagacatagcagtgatcgcaagaaatcaaggaaggtataacatttgtgctttcgtgcaaatcaagcttctaagtattggcgatttggtgctgatatggcactgtatcatgcatacaggccccggtactaggataataaaaactaccagtttagtgctaaatatatcagcagacattgccaccatcccttgaggagtaccttccaccctcaccaaatattagtgctgatatacgtttaccaacttttattgaactgaaagactgtgctttgcctttgtcttgtgatgttatttggactcattggtggatgattttgtttgtgctaaaatttaagtcgtcttttgtttgtaaaagccatagtggctgtaggacactgcaaacatgtctgtcacagcttttggtgaaccgttacaagctgacattgccatcacttcatgctttctaccaaaaagtaatttggtattttaatactgtaatttttattggtgaaatgggagaattgggtttaggatgttcaagcaaaaagtaacactgccatatataccaccttcgaactaataatattagatgggctgcttactttattaccaatgtcataggatgtccttaaatattgttaaaagatccctactgtgtgaaagcactttgaaatatgaatgtattggtataacctttggacaagtatttttcagtaggtaaagaaatgcactttgtattttgcccacccccaccccccaaacaaagctgtaaagtttgataagtataaataaaaaataccttatgaatttactaataatttgaccaacttttttttgtcgcaatctacaaaatttgactttgtaaatcagctatgccttgtaaatctcttgcataaagtatatgatatttgtattcaaccagaaatcttgtctctagcccttgtaccagcaataatcttgttaaagtgctccctattgtttgaaagcactatgtaatatgaatctattggcatcttgatgaatcttttggtataaccttcttactgcaaatttacttgtaatttgactaactacttttttgggggtcaaaatctacaaagttttgactttctaatcaactataccttatatctctcttgcatgtttgatatttgtattcagcaggaaatcagttttgtaaatcacatggttgtttatctgattgagtaaacttagttagaacatgtaatgattttatgaatgctattaatgcagcatacccatgcttcggactctgatagtgaaaatcggcacaaaagacacaaaaaggatcgagatagctcccgcagaaatggcacacgtgatgaccttgaagatggtgaacttggagaagatggggagattcattagtcattcgtttctccgctgagattgtcagtactactgctccttgccatgttattagttaaataccgttttcttgttttgctcaagtagcgcatctgcttaagaatttggtagtgtcaatcactgttattagtgtacatgctctgagatttacttagtattttatactattttgcagtatcacaatacagtcccccctcctgttttggacatatgaaatggtgcattttgttggcaactataaatgctttcctccagagaaggacaatttctttatggggattatcttcttgtcttgatctggcttgttggaaatggacaataatagccttcattgtttggatgctcacaatgtagtcatgaaggttcttgtactgcaaaacttttgttgcctttagttatcttcttatccccttccctttgtcagtctgggtataggttgtatttgttataggagggggagggctgtaaagtgtttagtggctgaaaaagatcctttagaaggttaggtgcgaaatgcatgcaatgctgaggtttataactgaatttcgttgaatcatctgtgcccagtggccactgtatcctgattagagctcttgatctacaagacttgtgtttctccatggatctcccgtctcctgcattatgttgccattaagcggcacctggctgttgctgtaacaccgaggcctgtctgtgggtgcatggaatgcaaagcacacttggttggaagcatggcaagaggcaaagcctgcccaactcactcattggtcgtgctgctgcagcagtttcatactcgttttgacgtggttttcactttggagttgtttaacatcttgttatttactatgccatctaacatagttttcgtatggtagcagttttgtaatagtttgctgctatttatggtgctttatagatagatgtacttgcagctgacgctgttgatattctcatgaatacattgattctgtaggctatgtttgttggatggctgatactgaaacgataacatgatccatcctggtattatggctgtagattattaactttttttgttggaagggaacaatttactaactaatcttcacagacggaccctttgcatttgggtgtttaagtcattcattgctgctgtttgttcatgatgaccattatggtctgtactggagctgtctattcaactagtttctcaatccctgtaaccgtcgggttgcatgcgttttgtgatgtgtggcatgtgtgctgcgtttcaattggcttttattagttgcaatgaattatccaccagtagttgaaagtcggcaaaagctgcatgcttggaaactatccaacggcaaacaagtcatgcatgtccagacaactcgcctacaacggttgaacccaaatctgtacagcataagatttaggggtccttaggaatggaggaaaaatcaatttataggtaaaactttttatatgtgttcttagcgacttaaaagccaatgctgaaaaagaaactacgttgaaatatcttaaaatcaattttaaaattaagtttgaaaattgaaattttggctttgtcatttacttattaggagaaccgatgtagccgctcctctttaggttgtctagaccaatctcaaacatctgttttctcaaagatatagtttctatcaaagctccatatagggctggacaaatagctcgggctcgtgaactcggctcaagctcggctcgggctcgcctggctcggctcggctcgaatcctgaacgagccgagcccgagcctgggttttagctcgtttgtgaaccgagccgagcccgagccagctcgcgagcagctcacgagcttagtaggctcggtttgaatagaaagacttctggctgaaaaccaaaaaagcccatcaatttgttatatgttggctgcatataatatacttaattatctttgtagggacttgagagttattatctgaataaccaagtcattgcaaagcaacacaactgctgctggcaatacaactgctgctattgcaaagctcacgagccagctcgagccggctcgagccagaccacgagccgagccgagcctaatgtacagctcggttggagagccgagccgagccaagccgagcctggcatttcgcgagcttccacgagccgagccgagcctggctcggctcgcctcgtttccacccctagctccatacaacctctgtttcaattttcttatcgctctagcatttaaaattttggtgaaagtacttttcgttctcatactccaaaacattttccgagatgtatactttccttcttacccataatcaatgcatccatactactatttgtactcatcactggaaattttaatacttgccttaaaaagattattgttatgttattaatacggtagcgatgtaaattgccacaacgatttaatttgtaacatatggagaacgacaagcaaattgaagaagtaccaacttagggcagtctcaacccatagtgtccataaacagtgtctatggtgacatatcaataagacattacaatggaaactacacttcacaacccatgatttcttaaagtgggtcattaataaatacatcatctctcttctttaccaatcatatttattcttcatctactatgaagacactattttctcccaatgcaaaacttgatagtgtctagtgcatatgttctcgtgttgaaactgtatcttgcatgagacccagtttctttctctcttcactctctctctctcttaattaatatagtgacacataagttaaaagtcctacatgtgaatgtagttaataccatagacaccatcctaaatggagggttatgattgcccttgtatcacttcccagttcccaccgctaatttaaaagaaattgagactaaaaatcaaattctcatactgatccacctttatttctcactgtcttaacttcccatcctcttccccaacaatgtagacacgaatcaagatgtccagcgcgttcccaattctgcagccataaaagaaaaaaaaacaattttgagctagaaagatggcagttaagtatggcaccaagtcaccaacggccaatcaaaccaaactgacgtatttgcaaatgaaacataatttataaataaaatttttatatacatatttttggcagt

SEQ ID NO: 16870 - DNA, 1151 bp, Oryza sativa
  unsure (1)..(1151): unsure at all n locations
aaagcacctcatgccacctctttgggtattcctcaatcttcttcttcactaacttcaacaatgttttattactcgactcggcttgtccattagcctgagcgttgtaaggagaagagctcaacaatttaatatcataagattcggaaaaattcttcacttccttagacataaaagaagcaccttgatctgtagttaatgtttgtggaataccgaatctatggataatatgcttcaaaataaagtcaactacctccgtatgagtcatattcttcaaaggcacggcttcggcccacttggtgaagtaatccgtagcaactagcacgaaccttttctcctttaatgacgaaggataaatttgaccaataaaatccaaagcccattctcggaacgaccatggtttgattatagggttcaacatggcgacgggcgccaattgaacattgccgaaccgttgacaagcttcacatcctctataatatttgaagcaatcatcaatcatcttcggctaatagaatcccgctcttctaagcaaccaattcatcttgtgggccgattgataagttccacaaattccttcatgcacctctcccatagccactttagattgatcttcatctaagcacttcaacaagacaccatctatatttcggcgatataaatcttcatcaagcaatgtgtatttgaatgcttgccgccgaattttccgatcaaccttaagtgtgggatctttcaaatatcgaatcaaaggaattctccaatcttcttctgcttcctgggcacaaatgtccgaattcacaattaattcggcctctaaattgattgaaacgtgccccccagcgctctgcccagaaccggtcagaccgaccacacagggccggtcagaccgctcggggtcgccggtcagaccggcggcatgtagccggtcagaccgcccctggtcaccggtcagaccggccacgcaatgccggtcagaccgcccctggtccccagctttgccaatttcgcacaaagatttaaaagcaagcaccggctcctctaatatcagaaataatcccttcttcacattatagccagatgcttgttgtgccaagtcannnnnnnnnnnnnnnnnnnnnnnnnnnnnnnnnnnnnnnnnnnnnnnnnnnnnnnnn

SEQ ID NO: 16871 - DNA, 1154 bp, Oryza sativa
tgtttcttcgatttgcttgcaggaataaggttcatctgcaccggcaagatcaacaacccacagagaggtgtatcgatcactaaggcgcaacacaacaacgtttaatacgggtgtagtggggtcgttaatgtttcttccaaatcgtagttattattaacttaaccaaagaaccggctaaccaccaccttgaattgcttcaagtgaacctcagggtttatcaggtggtatcagagcttttgttgcttggtgagtttttatctacctataacaagaaaattaccattcaaaaaaattgcatcctgtgcctagccatatttgtgccattgcattgttcattcagtttttgcttttttgagttttgcgttgcatcgtcgcgtcgagttgctggtcttagtgtctagtccgtttagagttttgagtttctagtcacgttttgtaccactgccgtcgccgtcgtcatgtgcttgttgtcgtcgagacctacgaaaacggaatcgtctttctgccagggttctatttttctagttttcagaagtttttgctggtcggttttggagatgataagttgcatctagtgtttgttacgtattatatatatatatatatatatatatatatatatatatatatatatatatatatatatatatatatatatatatatagatatattgtttggtgctccatgggcccgggcaccattgttgaaattgagtatatacccaattcaaatgagtatgaaactttttcaattacttaggtattaacattaactcttttactaactagtttaaagcaagtttgaactgaatttgaacttgtttttgttagattttgattctaggtataaaaattaaaaagggggcccccaaatttcccccaaatacataataattagttaggtatgtaatcatggattgtgaaataaagttaaatttgagttgttttgttgataagtataggtatgaatcaaattattataactaggtatatactcacaatttgaaaattttgaaaaatttgagtgattttgtgcattagataccatggtgcccgggcaccatggtgccccatacgagtgtcctatatatatatatatatatatatatatatatatatatatatatatatatatatatatatatatatatata

SEQ ID NO: 16872 - DNA, 2973 bp, Oryza sativa
agtagagctcattccgttacaacatataaagatttggccttttatattcacttaccatgtgataatattcaaaagtgacatgtattatgcaagtatatctattataattattattattattattattattattattattattattattattattattattattattattattattattattattattaaaggaatagaaaaaagagcctccacgtttgctcttacggcatagaaattctcatattaatcaaaaaaaaagaaaaatagagtctatatagaaatatataatttagaataactgaaattcggaatgaataaataaaaaatattagaagtagagcatagagtccatataggaatttaaaactaactaaaattcggaataaacataataaaattaaaagtagagtatagagcctgtataaaaatacaatttacaactaattaaaattagaaattaaaaaaacatgggaagaagagtctaaagtcaatttagaagtaactgaaattcgaaattaaaaattaaagaatattgaaagatatgttcagagtccacatggaaatacaattagaaataataaaaattcagaattaaaaataaataatattggaagaagagcatagagtttatatataaatacaatttatagataacgaaagttcggaattaaaaaataaaaaatattgaaagacgagtctagagtccatataggaatataatttgtaaataactaaaatttgatattaaaaataattaataactaacacgtatataaaatacaatatgaatatacagattagtagtttcgtaaagttagtaaaatttaaaattatattgtcatttgaatatattttaataataaattgataaaacatatatgttattatatgagagaaaatataatgatgctagcccgcgcaatctgcgcgggccaccatgctagttattattattaaaaacaaccggtacccccgttgatattttgttcattcaccgtgtgatgtccaaaagtgaaatatacaaaatgacaacctaaagtgtgcacaaattatgtgtgctcattcgccggtccaaaaaatcattcataaatggtgtatctctgttatatctccatgctgacatttagctgaacataaatctgtcatctgtgcaagcatataaaatcaagggagcatataaaaatattcaggggaatatcatcaaccaagagattttctttttcatgcaaccaagaactttcatccgttcatagagggaaaatgcaaaatataatatactccgtatcaacatagacgcaagcttgtcagcaggtttctcgtcccagttcaaatgacatcgagaaaataatactctatatcccataacccgcacaacatgtagagctttgatgccaaataaattgaccatataaacaaggagaaaaaaaaatactgaacttgttaatcgagagaacacaagatccatccaaggagaaaagatcacgaagtatgtactattcagtcaaaagctaaaccacatggcggattcaaagaaagatcatttgtgtgcactactgaacaagaaaaattcagaaaacagtgagcctatcaacttctgaacggggaaatttagtctcacaagatactgacatatttacttaaatctcagaagctactagtaacgagaacatcgaaatttatctccccgagcaccaaaagccaaaaagtaaagagaactactacatgtgacttatcactaaatctgaaaatgcatgtaaaattcagagcgagaacctatacatatgaatcttgccggtaaaaaatgggaggaaaatagttcaagatccacagaaaagcagcggcaccagaaacttccggtgctgcccaacagcaaactgaaccagaaggggtataacccgcacgatactttaattttgtgctcttatttaaattttgtacacattccaaatgacatttcacaaatgttatctacttaaaatacataatattctatgcatgatattacctcatttcttttaatttgccaacaatataactctagacgacgataagagcatgacatatctataaatgacactctgggtttgatattacctgtaaaaatagggccacaaacgatatatcgtataatgaactagaaacccaaaacaaaaatttgcagagtatatgaaaaaaaaagatagatatatgccccaatcagaaatcaggtgacagagatcttaaaaaaatagatatatggaaaaaaagcacatatactgagatttttactcgtggagctgacaggtgagagagaccagaaattagttagtatgactaaccaccaatcataaatcaacaatcccagctcacttgatctgttcctctcaattgaatcaagaatccttactaatcccgaaattaccaatcataaatcataattcatgctcctttgcaagtagctcaatattttgaaaataagttcacgacagcatgcacttgcaagatggaagaaatataatatgcaatattgctttccaaaaataataaacaaaaaggttgagcagatgtctacctgctttccttagagacgaacatgcaacccaaatcagaaaacttaaaaaacccccccaaaaaaatcaaatcagacagtagcaacaacctccactgccgtcatctatactctagcacaaatcaccaaccaaaaatccaagaatccaatatcacaaatcacaaatcaccatccaaatccttgttaattatcttgcaggcatgcagcccctgctcacctccccacctcgccgcatcaaagtcgcacagacgtggccggccatcggtaggatttactgctacctacttttaagaagtataaggtgtattttgatctattaggatgtctcgatacagtagcattttctacattcgaaaaaaaaatctcatcttaagacacgatgtgatctattttgatacaacagaaagcctttctccagtccagac

SEQ ID NO: 16873 - DNA, 1105 bp, Oryza sativa
  unsure (1)..(1105): unsure at all n locations
ttgcaagcaagaaataaaaaacctgctagataaaggattaataaggaaaagttcctctccttggagttgtgcagctttctttgtagaaaatgctgctgaaaaagaacgaggagttcctcggctagttatcaattagaaacctctcaataaagttctacaatggataaggtatccaataccttataagcatgacttaatacgaaggattcagggttcaaagatatattctaaatttgatatgaagtctgggttttggcaaatccaaataaaagaagaggatagatataaaactgcctttactactccttttggtcattatgagtggaaagtaatgccgtttggtttaaaaaaaatgctccttctgaattctcggttataaaattcaatatgatcaagttcaaccagtagcaagagtaatagaatttgcagaaaaatttccagatgagataaaagataaaacagagttgcaaagatttctagggtgtttaaactatgtctccaatttttataaagatcttgcaaaaagacagaaagattttaaccgagaggttaaagaaaaagcctccagcttggacagctaaacatactcaagctgttaagaagatcaaaagtaaggtcaaaaccttgccctatctttatatcctagatcaagttgccttcaaaattatcgaatcagatgcctcatattatggttatggaggaattcttaaacaaaaaaaggattccagagagcagttggtcaggttcacctctgggacctagaatgaggctcaaaaaaattattcaaccatcaaaaaagaaatattggccatagtaaaggtcatatcaaaattccaaggagaattattgaatcaaagattcttgctgcgtatagattgcaaggcagcaaaagatgtcctccaaaaggatgtggagaacttagtctccaaacaaatttttgccagatggcaagcaatattatcatgctttgactttgaaatagaacatatcaagggagaattaaactccctaccagatttcttatactcgtgaatttttacagggctatggnnnnnnnnnnnnnnnnnnnnnnnnnnnnnnnnnnnnnnnnnnnnnnnnnnnnnnn

SEQ ID NO: 16874 - DNA, 4150 bp, Oryza sativa
gtgggataagtttgcaatcacaccagtaattgaagaagaaagtttcgagccaaaaacaagaaatctcatgtggctcaattaaaagaagatatacaagagaattattaaaggcaagacccgagttgacaaagggagaattgcaacttcaagtatatgaaaccatgtttaaaagattggaagaatcaccaaaatctagttccacatgcagaagtctagacgaagatatggtacaatacagccaaattaagccatcttcgccaatacctccttattactcaattaagcaagataatgattcagatgaaggaacatcagatttcaatccaacgcacatttagtcaaggtatgacgacagatcttgtcaccaagataatgaataaagatcctgtcatccccgacaaagatcactattcaagataaggaatctacactattctagataagataagcctatagtcaaaaggcgatattatgacatctttattgaaggtcaaaagcgtcatcaccaaagattctctccatgaagtctaaagggatatcataaactctttgaagtcaagaagagatatcatgaagattctctaccgagtgctatataaggggctcaccatcgcattccacaagcatcgcattattcacaagaacaacaaccacaacacatctcactcaaccattcctctcgcctctccaccagccatcacactccactccactccatctaagtgtttgtactatagtataacctaaataaaagactcatgagagtctaagtgtgagagtctatgtaagagtccttgtgagagtcctgtacctgtataattacgaacgtgttgtaccaagtccttggtgtaatcttcagaaggatctaccttcaacttatcaaggtatatgaatgaacacctggaccgttctatataaacctactatgttctaagtatctaatttacattatatcttgtacataattcatatttacagcttgtctttatttcctgtactgcatttatgtttgcataataataataataataataataataataataataataataataataataataataataataataataataataataataataataataataaattcaacaacctggattaccatccaattgccacataccaatctcacatccaagattgcatatagatactgcattccttatatatatatatatatatatatatatatatatatatatatatatatatatatatatatatatatatatatatatatatatatatggaatttatttttgaagtggttttggagatgattggaatttacaggtgaatctacaggatactgctgttatttcatgtgaccggtcagaccgggctgtgtatgccggtcagaccggcgcaacccgcggactgaccggctgaccctgtgtcagtttcggtttcggattgtttgtttggatatccgtgattgtttcatgattatggcttctagatggatactatatgtatgtaatactattgtttgctactaatgagtcaagttggagatagcttggtctcggaatatggtttctttgtttatttcatgtgtaggtgtctcgatgcctcgggagagtatttgcagtgatggaccgggagtcggcttggggataagacgacgtccgtggtggtcagagatcatgcgggatacctaggctagagttgatgcacgtggttgatggagattccatatggcatacgatggagttattgtgtgcgtatgggatgcggagtcgaatttggaaggagtccaaatttggtatgattggttatgtaaagtttgtgtcttgtactagagggtttcctaaggtgtttaggactcttagtatgagtttggtttgtggctttatactgccgacctcatgtataaatagagggggagcgtgaggcttccctgtatcgcttttgagagcaattgagttgagttttgagttagggtttcgagtttagtcgagatttttgtaaggagtgctgttggtgcactttgtaaacacagagagaatcaataaagtcgtcatctactttaagaattcttcgatttgtgtttcaccgggtttcggcggtctaaccggtaactcatcggcggtcagaccggcgacaagtcggcggtcagaccggcgggagcacggcggtcagactggcggcatccactcggtcagaccggcagttcaatctcggtcagactgacttccgtcgatttcgagggtaacttttatttctgctaaaagttttttggtttttgggtataccaaccattcaccccccctctgcttggcttagttcttgtgtttcgatcttacaagtggtattagagccttgtttttttctttggatttttatcgatctagagtttttgccatggctactcctattaggttttcaactaagcctcatgttttcgatggaacggatttttctcattggtgtagtaggatgcaatcttacattatggctgaagattatgatatttggagaaaagtttctcatccttatgtgattcctgaagctattaatactactgctgaaaaaactgcttttgaacaaaattgcaaagctcgcaacattcttttgagtggtatttctcgttcggattatgatcgtgttgcgcattttcgaactgctcatgaaatttggaatgctttgagtaactttcatcaaggaacaaataacattaaagaacttcatcgtgatattttcaaaaaggagtatattaaatttgagatgaaacctggagaagctttggatgactatctttctaggtttaataaaattttgagtgatcttagatctgttgattcttcttatgatgctaattatccacaatctgagatttctcgtcactttttgaatggtcttgatatgtctatttaggagatgaaagttacatctattcaggagtctgttaacatgtctactttgactttggattcactttacacaaaattgaaaacacatgagatgaacgttctttctcgtaaaggtgattctaagtcgagtgctttggtttcttcttcttcctctttggatgttgatgcttcttcatctaagtcttcttttcttgctgtttttaatgccacatccgatgatcaactcggacagattgaggaggaggatttggctttggttgctaacagaattgctcgagctatgaataatgctaggaacaggaaaagaggtgatctaaatcgttgctttgaatgtggttcaattgatcatcttcgtttgcattgtcctaagtttgggagaggcaaaagagaagacaaagatggtgagaagaccaacaacaacaagccgaagggtacatcccaagggaggaagttcaaggagaatcttaggagggtttttgatcaagtctacgccgcatttgagccatcaagcgatgtagatggtgagagtggagatgatgataagggaaagaacatctccggtgtttacgtcatggtgcgtggtgaatcggacatagagtatgaagatcatgaggtaagtacttttgaagaagctattaatattttgagtgcaaaaaatatgaagtgtgagaagatgtatagaaaacaggaatttatcattgaatctcttaattctgaaattgctaggttaaaatctcttattcctaatgatgatgattgcaaaaattgtgtggttttagtgaatgagatttcgaaaattagagatgttaatgttgcacatgatttgaaaaacaaatcttctcttgcttgtagttttgctttgcacacacgcactttggatgagttgtttttaactaaaaagttgttgcaaaaatatcaaattgcttttcatgctagtttgatgtttaacatgatttctctaaaaagttaaaacaacctcatgatgttttggattgctcaacatgtaatttgaataagatgaaactaaaagatgctttaggtcgtgttgagtacatggaagatgttgtgaaaaacaatgaagtgctttcttgcctcaaatgtcgtaaaagcaaaggtgtcatggtagattgtgaaaattgtgctaatttggaaaaagaggtttcttatttgaaaaattctttgctaatattttctgatggtaaaaagaacctcaacatgattttggatcaatcaaaggttagcacacataatcgtgg

SEQ ID NO: 16875 - DNA, 1481 bp, Oryza sativa
cttgacgtagtttaacttccagatctcctcaatgctggacggagtatgtgtttgacccaacttgatcctggaatgcatctatacggacgccactgttttgcactgtgcatttgtcatcttgtttgacgggtgaaaatgtgtatccatttatatcgtatccttgccatgtgtctatggtccaagacggtcccatccccaccaactgtactgtctcatttgggacaaccgtggacattgtcacacgattcttgaaccattcgttgaaccgagaattatgttctctgttaatccatgcatcagatggccccaagttctcatctcggattttcgctaagtgctcctcaaagtatgggccaacttctgtcatatgttggagcacagcgtaatgagcctgcgcgtacgacgcttgatcgggcttaattcttttccttccgattgtgccaacacctgacaaccttccctcgtgacgagacgctggaactccgataggatcggcatcggacatgtaattgacacagaactcaatagccacctcggtcgtgtaaccttcaatgatgctcccctcgggtttagctctgttacgaacgtacgacttcagaactcccatgtacctttcaaacggtcacatttcccttagaaaagctggaccacatagttttgtttgcttcaccagatgaacagggagatgaaccattataacaaagaaagacagtgggaaaaacatctccaggtgacagagggtattcacaatattggtctgcagcccatctagatcttctggatctataaccttctgtccaattgcattgaagaaggcgcacagacgttggatcgtgtgacgcactttcggtggtagaatgcctctgatagtaactggcaagatttgtgtgattagcacgtggcaatcgcgagacttcattccaacaagttttagatcgtccaatttaacatacttacttatcctcgctgaatagcccgatggaactttaatatccttcaagcatgataacattgcgatcttctcatccttcgacagtgtgtggcaggctggagggaggtacactttacctgtctctgcatcttgtatgggctggaattcgctgcgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggattttttcttccacatacccttctcctttgtcttgctacgttttcttttcttcccaaactcattgcttatgtccttgaccatattgtggacctcatctgcggacaaatctttgggagcaggctgaagttctctcttaccattaaaaattttcttctttcttctaaatgtgtgacgtagcgggagccacctccggtgacccatgtat

SEQ ID NO: 16876 - DNA, 5762 bp, Oryza sativa
  unsure (1)..(5762): unsure at all n locations
nnnnnnnnnnnnnnnnnnnnnnnnnnnnnnnnnnnnnnnnnnnnnnnnnnnnnnnnnnnnnnnnnttttccttctcctttgtcttgctacgttttcttttcttcccaaactcattgcttatgtccttgaccatattgtggacctcatctgcggacaaatctttgggagcaggctgaagttctctcttaccattaaaaattttcttctttcttctaaatgtgtgacgtagcgggagccacctccggtgacccatgtataccatctttcgtgatttcttcagccaccggcttcgtgtatgttccttgcaatcggagcatgccttctttccttttatagtttgtccggaaagattaccgagtgcaaggtagttattaatggtgcaaaacaatagaactcttagcttgaagttctcctgaccatatgcatcccaagtttccacaccttctttccaaagaatctccagatcgtcgatatcattgccgggttgccttggaccttggattaacaagcacaacataatatatttccgtttaaagcataaccatggtgggaggttatagttcgcaataagaactggccaagtgctgtgagtactactcatgtcaccgaaaggattcatgccatccgtacaaagacatatcctcatgtttctagggtcagcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaacgatcaatgataggtagataccacacaacctttgccggaccacccctctttgacttatttccttcgtcagcacttttctttcgcttgtatcgagaagccttgcagataggacaagcatccaagtccgcatattgcttgtggtacaatatgcagtcgttgggacaagcgtgaattctacggacctgctttgcttcgtatgtcgtctcgggcaatgtgttctcaacaggaagcatagccttcaaaattcctaaaagatctgtgaaactcttgtctgtccatccactacttaccttcagcttcattaggtccaaggtaactgacaacttagtgtgttttgctttgcatccagcgtacaaaggcgtctcggaatcacttaccaacctgctgaatttcattccatctctctcattctgggctgggtcctcaacgtcacgtaacatgtcttgcagcagatcgtgatccacatcaaccatttcaccgcccaatggagaaggtataaacatttcatgctcattttcatcttcctgattatgcgcaccacttctgtctgctgctgctccacttcctgattcttgctctccatacttcacccaacatgtatagccctccatgaattctcgttgtatcagatgaccgtgtacgtcctctccgctatcaaacatattctcgttcttgcaatctgcacatggacaacacatataatcactgtttcttcttatccgatcctcctccgcggcgttcataaattttattacgccatttcggtactccgtagaatgacgtttcaaatttttggcatacatccaacttcgatcaattgctacaaaataaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatgcccccaacagcctcccaccaaaatagtgaacagtgggatacagttacactaggtggtggggggtatttatactgtgcaacaaatatctgtaacggccctaaaacaatcaaccgtgacgggcatacaagtaatctctatcgggccttaataaaaggccatcaaaaaatagtgtcatctgtgacaggcaataaacttatctcaattgggcctctagttggagcccatcacagatgaccctcatctgtgacgggcttcttttagggcccgattgagatatggaaccctcatctcaatcgggcatcaactataacccgtcacagataagtgtcatccgtgacgggctttagttttatgccgatatactatggctgtgcgaccatatctcaatcgagcgaaacttcggcccgattgagattacttccttgtgacggcccgcaaattccagtcttgttatgggccgtcacagatggaaggatctgtactagtgtcccatgcatgacggtgatggtggtgtagatgtgtgtgggcatcgacaacggtccacggcctcgttggtccgtgcgccggtgttggtgacgtcatcttcatatagactcttcccgccctgccatttagcctcgtcggtggaggtaaagatggtgctcgtagtggggactagcatggcattggctggggtgagaataagatgacggtgtcggtagtggtgctgagctcgagtatgttcatggtggccatgaagaggtcatcagcgaaagcacaaatgacatcggtggtcacaaagaagtcatcttgatattgctaggagtaacagagacaccagtggagattccaagcttgtggtcacttgcggttggggtagaatcacccatctagcctagatggcactggtcgaccattatcatggtacatgagtcagcctactgatcgctgcagcacgcacttagtattgagtggttttatgggatgttaggggcatagcctagcctgggaacgatgagatgcgttccaggagctgggtggccctcttgtatatgcgccgacaatcggggctgaactcaaatgatgttgagccgtctccgatcgtagtgacttgactcgggagtgcgccgatggcggccatgaagaagccgtcatgtgtatgggcgctgcggagtgatagaggcaccggtggggatgccgagttcgtgatcactagacggtgaggtgaggattcatgtgaggatgacactggtggcagcagcgagtcggaggacttcgccggcagcagacgaacggtggcggggcatacatatatataactgtttcgttcatcgaacggatgaggttggcgagcgtgacgccatcgtcgttggcgtgaggatgactccggtagtgacgatggacgtgaggtcatcattagccggcggatactccaagcacgttggtgataacagtcggcggatccaaacttgcacgttggcgacgaatgcgcgattggcaccggcaacggtaacaaggccgagcttgtcatcggcagagaaacgaccggcgccaggacgatgaccagggacaggttcgccattggtggcagccaggagtatagacgccgatggttgatgaccacaccgacggcagctccaagcttgagagacggtcggcaggggagaaacggtcggcgccggcaacgatgaccaggatcaggttcgccatcggtggcagccgcgaggataaacgatgatgattgatgatgacaccagcgccgactccaagcttgcgcccgttgtcggtgaaggcacggttggcgccggcgacgatgacggggtcaagctcatcatcagtgtcagccatgaagcgaacacaggaggtcgacgatgcgcgagcacatcaccggtggtgacggcaggagtgaagacgccttgaccgtgcgggccggtgtgatgaccgacggcagcgatgccatgatatctcccaacagaccaccgaacctcgtcatcaccgatgatccgccacccttgcgtgtatgctagctgaaatggagaagacaagagacaaagaaacaaatagcattacacatggcaggtagcagcatcaccgccatgtgctgccgatcacgacgttccacctcttcttctctgtatgtgtgtctgctctcggcggcgatatggcggcacaacttgtgctgcgtgtgtgtcagtctctcttctcgtatgcctctgcgtttctgtcttctcccctcctccttagcacgcctcctcgccggacgccgagatactgcggccaacgtcaccggccgccgagcacacgcgttcccgccggacgccgagatactccggccgaaatggcgtgtgcctctctctctctctctctctctctgtgccttttcgtgtgtgtgttctgtctctgtgtgttgtgtccctgtgtttctcctgtccccctgtaaaatgaaatggacaatcttttataggggtgataagtcggttcacaggctagctcatacatggattagtatctgctcaaccagccagccgcttccatctataagccaaatttccatttagcaaatatcatgattatgataattccattgtattgtgatatgattattgaagcttccattctatggtgatacggagagtagtatttccatgtgaaatctcaggtgcttgctgctattatctgtttcgtttccaatctgacgtgatatggatcaattttccttgtatacttatacgctcacgcactgctcatagaaagaaactttcatatagagctatcttgcccttttgatttccttggtttccatgcaagcatgtacgtggtttccatgcatatgatgtgagagattaacggccggcaaatcatgtgattaacttcctctaatgacagtgatacagtggcatatgcttccattcccatgaaaacattcacacctttttccttccatcagccaaccatgaaattggatcgatcaccctatatcaaaatgtcgcgagtacgtatatactagagcagccgacggcaagtgtctcacaatattcatacgtatacgccatgtacgccaggttgtgttattagtgataattaatcaccaatttcgttattatatcgccgttcccgaaattaatactttgacacacttcatttctttcatttataaaaaaaatgtacaaaatatcgtcgaacataaagacagaaaaatagcagttaaatctataaatgatagccgatcggccagttgccgatgacatatcatctatctttgagccaatgttgtatttgagtcgatcgcaaatataaataaacaagaacgaactaaatctattcgatcagctgtggttattaatgaaatataatcctaatatcgatatatacttaaatcaaatgattgggatagatcggtcgccatgccgagacaatataaatcacttagatcgaaatatatattaacaagaagattataagcattcatagcgtagtcgattagatagatctagcatgtatcggctaatacttcgatacaactctatattgagatactaagacaagcagaatataccaaacaagaagcttaatatacctaaatgcagtaatatcttaacataaagggcagatatagcatatcaattaagcacataaaatatgaagctaaatcaggtaagatcggttgaaaccccgacactaccctaatcggcaaccaaaagcaggctagagattatgattctaatcacgacttataagatcaaactcaactgatacagctataagtatgaaaagaacaataaaaatctagacaatcaagccgttggttgtttcataggatggtagataccctatataatctaagttaacattgatatttaacctaatcggctgccttccaacgatagatgttagccgatttgaaggttagataacgatattgtcagannnnnnnnnnnnnnnnnnnnnnnnnnnnnnnnnnnnnnnnnnnnnnnnnnnnnnnnnnnnnnn

SEQ ID NO: 16877 - DNA, 824 bp, Oryza sativa
gggcccaacgggaaaaagggggcaaggagagaatgggccggcggcccatcccgaaaggaaaaaggaagggaaaaagaaagaaaaaggaggaaaagaatttccagggaattaaatattgcttgtaatcatttttaattggttaaaattatttctagagctctgaaaattccattaaaaatcttgttagcgtattttgacatgtagaactcaagaaaaattccacatgccaattccgattattatttacattaattcctttagggtttcactcttgcttttacaccggtattttcttgggaccatttataaattcaatttaggcttgggagaagaacttcagagtgtgacaaacctacccccctttaaacagaatctcgaccccgagattcggaagagctggcgaagaggtgcggatgggcggcctttaactcatcttccctttcccaagttgcctcttcttctgagtggtggctccactgaaccctgtacaacctggtaaccttatttctggttcttctttctctggtctcaagaatacaaaccggcttttccacataagtcagatcttcttgaatgtcgatgtgctccgaatcggcttgttcttcgggtaccctcaagcacttctttaactgggacacatggaacacgtcatggatgccgatcatgttggatggaagttctagctgataagcaacttctcctcttccgtccaagattttgtatggtcccacgaagcgtggtgctaacttgcctttcgtctggaaacgggtgcactccccgagcggaggtacacgaagtacacgtaatcccctgtttaaaagtga

SEQ ID NO: 16878 - DNA, 156 bp, Oryza sativa
gagtatgcgttccagataacagagaacttaaacagctgatacttcaggaagctcacgaaagtccttattccatccaccctggcagcatgaagatgtactcagacttgaaggagaaatactggtgggttagtatgaagcgggaaattgcagagttcg

SEQ ID NO: 16879 - DNA, 568 bp, Oryza sativa
  unsure (1)..(568): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatttcaacaccaattggttctacagctgtgttggatcctgatgaagatggtgaagctattgatcaaaaggaatatggaagtatgattggatctttgttgtatctaactgcttctaggccagacatacaatttgctgtgtgtttgtgtgcacgctttcaagcttcttctcgtgcttcacatcgtcaagtggtcaagcgaataatgagatatttgaatcatacacttgagtttggaatttggtattctacttcatcttctatatgcttaagtggatattccgatgttgattttggtggttgnnnnnnnnnnnnnnnnnnnnnnnnnnnnnnnnnnnnnnnnnnnnnnnnnnnnnnnnnnnnnnnnnnn

SEQ ID NO: 16880 - DNA, 646 bp, Oryza sativa
ggtcgactctagaggatccccctccgtctggtattgggaaagttgcgggaacatcaattgtatgccaaacttagcaagtgtgagttctggttgtccgaagtcaaattcttagggcacgtgatatctgctaaaggagttgctgtggaccccgaaacagtgaccgccgtcaccgattggaagcaacccaagacagtcactcaagttcgcagtttcttaggtttggcaggatactaccggagattcatcgagaacttctccaaaatcgctcgacccatgacacagttgttgaagaaagaagaaaaatttgtgtggagcccgcaatgcgagaaggcgttccaaactctcaaagaaaagctagtttcctcgccggtgttaatcttgccggatactcacaaggacttcatggtgtattgtgacgcttcgcgccaaggattggggtgcgtgctcatgcaggatggttatgtggtggcctatgcctcacgccagcttcggcctcatgaaggcaactaccctactcatgatttggagttagccgcggtggttcatgccctaaaaatctggcggcactatctcattgggaatcgctgtgaaatatatactgatcataagagtttgaaatacatcgggtaccgagctcgaattcgcc

SEQ ID NO: 16881 - DNA, 3874 bp, Oryza sativa
  unsure (1)..(3874): unsure at all n locations
nnnnnnnnnnnnnnnnnnnnnnnnnnnnnnnnnnnnnnnnnnnnnnnnnnnnnnnnncatataaacttcagatggccatatcttggccatgtgcactccgcattggaccgctcatgtctctgatttttgcttatgatgtcaagaacccattgctgtgcttcgcttctgcttgctatatggagattagtctatcaatagccttttcttttccggtggtcgagtagacgctgcagcttcagaagatgcgctcttcgcgcaagttgaactctgcctttgccaaagctagcatggcaagtcacatcaatcttgaacatattgaatcccagctctctaaactatgtcgatctaaattatcgcatgatcgctatatgcaaattcccgcgtgatcactgtgacatgtagccatgcctattcaccttgtgtatgaccttattagtgtcatctgtattgtacctttgttcaccctagattaaacaaaacccgaactagtggacactctactcatggtaccactagtatgattataggtagatgcttcgcttttaattaggtaacattaggcgggtttacaactctagactttgggaatgttcatatcacctggacactgtggaattgttggagtattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtacacctctgatcagagtaaaatctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtgggttcacggccttgataaataatattgtttagttctagaatcgtgtttacaaaatagccctgagcaactaaatatctttaaatgctgtttactgcaaccctaaaccctttatggtataactcctttgtactcccttgcatttattctgcacttgtgggtgtgtcttgttgagtacggtggttgtactcagtcttgctcaatttttcccaaccccagaagaggagttccaggaggatgaaggcttcggtgtctagctcgtgcctgccgtcaagcgcctgtggtcgtcgccctagtcttccgctgtttctcgtttgtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtctactaatgattacatcgagcatattgtaaatggcatgattctcattctcattctactaatgattgcaatgtgtttcgacgataggttcaatcggccatagatgaaggacgattgaagttcactgatggctccaagatgaatcttgatcatgatccttttccggtgaatacgattaatttcaatgataagaaggtgttgattcggccggagcaagccgaatctactaaaggaaaaggagtaatcattggtgaagcaaggcctaaaatgatagtgccaaagaaaccggaggttggcgtttggaaggaaaataggagtggagcttcaacttctaaagcccctagaaagaccaaagtgacttttgatatgcttttggaaaagtatgagaagcaaggtggtgagagggttcgcaacaaaggaaaaagaccaagatcacttcctagggagcgatttggtcattcaccaagacagtcgcattcacctccatatcatcatccacaagatatgtcatggggttcttatccaatggccaccgccgggttatccttatccttattacatgccctccaatgcaattcaaccaagggtggggaggaccgaggaggccaattcatgagcgtttattttcaccgaacaacggccggttatatggtaagaatcgggctaatgaagaaaagagggaaagaaagcgcatcaaggtggaggtaaggacttcggaagtaattaccatcaaagtggggtctcatgatgtgtcaataccttctggagatgaagttggagagtcttcaaggaaaaaatccgaggccggtaccagctcatcgcagtcggatggtctgaccaggccttttggccggtctgaccgcagccatacagccggtctgatcgggccatcaggccggtctgaccgccgacccgacagcggtccgaccgacacctcaaggttgtctgccgggcgcccaaatgtcgttttgccgggggcatctgcccgttctgaccggtggtctacgtccggtctgacccggctccagcgccggtttgatagaaggtttgcaaagggcgatgtgagggcttcatcgtcttcaaacaaggttaatagagggcattatttacctcctggaacagagccggatcctaggtggatgcctaaggatttgacggctactcaaaagagaaggttgcaacgtcttcgggctcaagagataagagagaaaaaagccgaagagcaaagagataaaaggttcaatgagttgcgaccaccaccggtatggaggcataagtccatagagaaggaaaaaccggttgttgtagaggagaaggaggaacaatcggttgataaaggtgaatcatctccaaaagaagacatgaatatgaacatggtatgtatgttgcctatgcagttttgtgctatggatgaagccgaggttgctcaattctcattaggtcctaaagacacggtttttgagaagcccgatgagtcaaaccgtcacatgaaccctctctatctcaaaggccatgttgatgggaagccgatctctaggatactagtggatggaggtgccgcggtgaacttgatgccgtactcattattcaagaagttggggcgtgaggatgatgagttgaagaagaccaacatgattctcaatggtttcaatggtgaaccaacggaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattattcaagcggatacatcggccgaggttgcaatggccgatgctacttttgagtggcgccatgggaatatccaatgcttatcggggannnnnnnnnnnnnnnnnnnnnnnnnnnnnnnnnnnnnctccgatggcaaatttgtatctatctctnnnnnnnnnnnnnnnnnnnnnnnnnnnnnnnnnnnnnnnnnnnnnnnnnnnnnnn

SEQ ID NO: 16882 - DNA, 1479 bp, Oryza sativa
tatgttgattgctttgcatgggaatatcatgaaatgctgggtcttagccgtgagcttgttaagcatcggctttcaattaaaccgggttttaggccttataagcaaccgccttgtcgttttaatcctttgctatatgaccgagtaaaagaggagattgatcggttgttgaaggcggggtttattaggccatgtcgttatgcggagtgggtttctagcataatcccggtggagaagaaggggagtcgtaagattagagtttgcatagattttagagatttaaataaagccactcccaaagatgagtatcctatgcctatagccgacatgatgattaatgatgcatcgggtcataaggtaattagctttctagatggtaatgctggctacaatcaaatctttatggcggaagaggatatgtataagacggcttttaggtgcccgggatttgttggtttgtttgagtgggttgtcatgacttttgggttgaagaatgccggtgcaacctatcaaagggcaatgaatttgatctttcatgattcgctaggtattatcttagagatctacatttatgatattgttgtcaaatcggatggtatggaaggacacatagcagatttgaggttagcttttgagaggatgcgccggtatggtttgaagatgaacccacttaagtatgcttttggtgtgtcggcggggaagttcttaggatacatggtgcatgagagaggggttgagattgattctaagaagatagaaaagattcgtgatttcaaagcaccgacatgtaagaaggaggtccaaaagttgctaggtaaggtgaattatttgagaagatttatttctagcctagcgggtaaaatcgatgcttttattcctatacttcgcttgaaaaaagaagccgattttacttgggggcaaaacaacaagaggcgtttgaagagttgaagagatatttgtctactccacccgttgtgcgagcgcctaaagccggaaaaccttttcggttatatattgtctccgaagacaaagtcattggtgccgttttgacgcaagaggaagatggcaaggatatatcattacatatttgagccgccgtcttttggatgccgaaacgaggtatgtctttatagaaagactttgtttatgcttatactatgcttgtaacaaattgaggcattatttgttatctagtacatgcatagttgcttgccaagccgatgttattaaacacatgttgcaaaggccaattctaagtaggagaattggcaagtgggcatatgctttgatagaatatgatttggcttatgaaccattgaaatctatgaaaggccagattgtatgtgattttatagtggaccatcatgtagatattgcttatgagaaagagatttgcctagttgaagttatgccttggaagatttattttgatggttcttcttgcaaagaaggtcaaggcataggggtaattttgttttcacc

SEQ ID NO: 16883 - DNA, 1033 bp, Oryza sativa
cccgtcgccatgttgaaccctataatcaaaccatggtcgttccgagaatgggctttggattttattggtcaaatttatccttcgtcattaaaggagaaaaggttcgtgctagttgctacggattacttcaccaagtgggccgaagccgtgcctttgaagaatatgactcatacggaggtagttgactttattttgaagcatattatccatagattcggtattccacaaacattaactacagatcaaggtgcttcttttatgtctaaggaagtgaagaatttttccgaatcttatgatattaaattgttgagctcttctccttacaacgctcaggctaatggacaagccgagtcgagtaataaaacattgttgaagttagtgaagaagaagattgaggaatacccaaagaggtggcatgaggtgctttctgaagcattgtgggtgcataggatatctaaacatggtgccactaaagtcactccttttgagttggtttatggtcaagaagccgttttaccggtggaggtaaatcttggttctcttatatcaagcaagatgatttgtcaagtgaagattacaagatgttgatgggagacaaccttgatgaagtcatcgacaagcgcttgaaggcattggaagagatagagaaagagaagaagagggtggccaaggcgtacaacaagagggtgaaagaaaagttgtttcaagttggagacttggtttggaagacaattttgcctttgggtactcgattcaaggagttcggtaagtggtctcctagttgggagggtccttatcgagtgtgcggcattgttcgagggaacgcgtactttttggagacacttcaaggggagcgttttcagcgagcgattaacgggaaatacttgaagaaatacttcccgagcgtttggcaagacgcttaggaggtactatggccggtaattgggttatcgtcctaagaccaaaaacgtgttctatgcttttagattcacgttgttcatcaaaaagataggggggcatgtgtttacaccca

SEQ ID NO: 16884 - DNA, 601 bp, Oryza sativa
ataatctttcaaagtagataaaagccaaagaatctgtgaacaacaattagcagcagcaacatattcagattcagcagttgattgagcaacactagattgtttcctagaagaccatgcaatcaatgatgtaccaagaaaatgacatgttccactagtacttttcctatcaattctacaaccaccaaaatcaacatcggaatatccacttaagcatatagaagatgaagtagaataccaaattccaaactcaagtgtatgattcaaatatctcattattcgcttgaccacttgatgatgtgaagcacgagaagaagcttgaaagcgtgcacacaaacacacagcaaattgtatgtctggcttagaagcagttagatacaacaaagatccaatcatacttccatattccttttgatcaatagcttcaccatcttcatcaggatccaacacagctgtagaaccaattggtgttgaaattggcttgcaattctccatcttgaaccatctcaaaagatccttcgtatacttcgtttgatgcacaaaagtaccttgaggtgtttgcttaatttgcaatcccaaaaagtatgataactcacccatcatg

SEQ ID NO: 16885 - DNA, 1254 bp, Oryza sativa
  unsure (1)..(1254): unsure at all n locations
nnnnnnnnnnnnnnnnnnnnnnnnnnnnnnnnnnnnnnnnnnnnnnnnnnnnnnnnnnnnnnnnncgaagggcctgctggtagctggctgctctgacaacaactctttctcgatgttcctcgagtagattcacatcgtcacttcgctgcttctcctgttcctcgtcagagtacttctgtactcgtgtgctctgatgccgtagctccgtggggagcatagcctatgagccatacacgaggaagaagggtgtctccttattgaacgttgtcggtgtggtgcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggcattgatgaactgggagccattgtctattatgatgcggtgaggcaatctgtatctgcagaatatcctttgataaacttgatggcgtcgtcagccttgatttcccccgtgggcatcgcttcaatccacttggtgaacttgtcgatcgccacgaaaaggaacttgtagccgccctgtcctcgtgggaatggtccgagtatgtcgagcccccaacacaagaacggccatgtaagagggatagtctggagcgcttgtgccggtagtcttgtgtgtttgctatgaaattgaaaggcttcacaccgctgaaccatgtcgcaagcgtctttacgcgcggttggccagaaaaaaccttgtcggaaagcttttcctaccaacgtccgaccggcggcgtgtgacccgcacatccctttatgtatgttgaggaggagatgtttgccgtcatcgaacgagatgcatttgagaagtaccccttttggcacctttttgtacagatcgttgccgatcatacaatagatcttggcttgtcgggttattttctcggcctctgcatcgtcctcgggcaactcgtcggtactcaggaacttgatgagcggggtccgccagtcctctgtggtctcgatgtcggcaatgacgtgttctgcccctatagcccccgagctaatgtcggggacaactgtgctatcttcgtcatttgctttttcactgatggctttgtcaagannnnnnnnnnnnnnnnnnnnnnnnnnnnnnnnnnnnnnnnnnnnnnnnnnnnnnnnnnnnnn

SEQ ID NO: 16886 - DNA, 7055 bp, Oryza sativa
  unsure (1)..(7055): unsure at all n locations
catagcatagccgatcagatagatctagcatgtatcggctaatactccgatactactctatattaggatattaaagcgagtagaatatatcaaccaaaaagcttaatatacttaaatgcaacgagatcttaacataaagggcaaatttaccatgtcaaagaagcatgtaggataaatgtagttaaatcagataagatcggctgaaaccccaatactaccctaatcagcaaccaaagacaggctagagattaagattctaatcccgactcataagatcaaactcaactgatgaagctataagtatgaaaagaaggacaatatacaatcaagtcataagatatgtcatagagtggtagatatcctatataatctaagtcaacatcggtatttaacctaatcggctgccttctagtaacaaatgttagccgattgtaggttagatagcgatattgccggagattatataagatatatgataactcgtcgaattacataaacaagattagagtatcatgaagatggaagcactaatctcgagaacgcaagccaccataacaagttttacctcttgttgaagatcgaaaccgatgcagctcaacctaaaagtaagaactcgtcgaaacaaaacgaaaataaaagggtggcgatgcgccgagattgtattgaacgtgtgttagtttgattacatggggctttggtctatttatacccgagaattacaaaatatgttcatatcggacacgactcttatctctaacaaactctaagataccataagtctttgcagtagacttttgcccaaacatatctctaaggaaattacataaaatatcctaagtaatagatacaattgacttctcaggactctatccatgcgtggaaatcatcatgaagcacgtcaacctaaaccgacaacatatgctgtgtcatattgtcggattcggctcaatcggctaaccccgtccgactcgaactctgccgatcttagtcgtagccgattcggacttcagccgatcttcactctgtttccgggacaatctctatctcgattcctccttcacatccgatcctccttcacttttggatatcactaaattacttcttagacatacaaaagtaaattcaataaagtctaaatgtaatttacatatattatagaagtaactttagacaaaacgaaagtaactttgtcataacattaggggtaattccattgtagggataaaaacataactctatctataaactaaattaattagcacaaactatggaattgactaaaacaataataggtagtcacctctagcattatgaatgtataggaagtaatttaattaaatctaaaattatgaatgtataggaagtaatttaattaaatctaaaagtactctaaaagtaatttaatcaacactaaaagaaacctttaagtgtggcgggctgggcggccggggagcacgccacgtcggattttgcaaagaaactctcatatttgttcgtaattccgtataggtctctcagtaacgtatttggagaggagaaatcgcggataggaacctatatgtaaaaagtgaaaataataggggctttttcgcaaaataatgcccactacctaactccccaaacctcgggttgcggccggcacctttcctttttcctttcgggagcgccagcgccggccaccctggngcggccacatcaccttcccccttgcgcggtccccattcctggagcggcggcttcggcttccccctttccctctccttctccntatgccgcctggcgccgcggccgccgtctcgcgcagccaccgcctccccctcttcctctccctcttccgcctcgcgccgccgccgccgtctcgcgccgccacctttgcctccctctcgggggggggtttcgcccggggttttacccaatctctctcctcccttcccgactcaccttctccctctccttcttccggcgccgccacctccgcctcgtgccgaccccatctcggagcacggccgccacaaccgccgcgtgcccgtcgccgcctccgcctccgcctcgtgacttgaacaatgttgcatgcaagttgaagctaaaaagattacaagcaagctgagaagctttgcactaaggtacacccagatcttcctgcaaaagtcccatctgataccgcatcttttggtagaccaaggtgacatttctgtgttcgttgctactttctgtaaatttgataaccaaaatgccacggctttatataggagggcctgagcttatatttaacttgctaacctggaatatatcatgcgggtcatggatgggtgtttttaactatgctttagtttattttaaagtgcggtaacatgctaatttgtttagagtaaccatgtctatgtattaatcctactcctaaaactgcaaggaggttgaaagcaactgaaatttataatgatacattgtaattcatatattgagattctaagttccattgtactcgtcgaatattgcttcgtagtggatgtaatacataggacatattggcttttacaatggtttcagtgtttgattatattccgatggagtattttatttaaggcaaaatttgttataggacatccaaaatttgtgtaattggctgtaggacattgtaaaatcgtgtcattgctgagggacaccataaaaatggtgtaattggctgctgggcactagatctattattttattatatttgatgctaatggagagagaaaaaccgtggaaagtacgaatgtgcccctggcactgttcttcttcttgcttcagctcaatattgagcaacaaacgggatgggtttttggggtcggtgtaggccgacctgatggtggagcgtcggcggacagggttagggagaggaagcggtggaggtgggggccgcgtcagggagaggaagggcagcgacggcggggtggccggacgcgaggaggcaatggtccaatgcaagcggcagcggcggcgatgcggaaaatttggtatcgagctttacattttgtttcccctttgcaacccgagctcctgctccatcatcagcagctctactcacaatcgcacgcggcgttcttctgcgcccacccatcattcgacttggcttcgtgctcaccttgaagccaaatacggaggcggcgaacgacatggtggtcgcaacgctggaaaagctttcatggcggcggtgctggccgagacacccccacgtttgggatactactgctctgcgctgccttgtacttcaagttgaaagaggttaattttgggcctagcgctcttccccaccggcaatgatgcccctgactgtcggcaatgacgcacctcacctcacacctgctcaagcggcagctcatccacaataagtgtgtacttggctgtgaaccagcgcttggattgtgcaattaagaggcaggggcaaacttgtatttttaaaatttctctctccactttttgctcgaaaatgataaaataatgcttccagtgtccaacagccaattacatcatttttgtagtgtcccttagcagtgacacgattttgcagtgtccttcagccaattacacaaattttagatgttctttagcaaattttgcctttatttaaagttccactaatttttggttttgaacaaaaactaactccatctcttccaacatgaacagattttgagatattaacattcctatgcaacccattcttgtgacaagagctgggccattctagccaataatggtcttcctttgcataagatttaaagctggatatccagtttttcagaaggtaacaattatctataggatctgcttgcttgctgaaagctttcaattctttttaatcaatcaatgtgcagtttgagtcacttattattgtagagattagaacaacgcgcctcctgtacatattctgtttagtaacttgtacggagtttgggtataacttgtaagcaatataaactcaatatggcagctttatatgttggatggataaaacagaatatacatattcaattgttgagaaaacatcattggtccttaatgcctcattgcaaggtgaagtccttgtactccatgagtccatgttcctccatgccaactcaaatggtccttgtactaataaatcttattattccatatagacaaacggtacctccctagatgccaactcaaatggtccctcaaattttacacttgatgaggtagtctgctttccaaaattccaagtttcttgttgaagggtgctacaacatatttacatcgttaattttcttgttggtttgtaggaaatggaattctaagaatttgtacagaggtcaaatgcgtatgccaagatttgctcaatgattggcccttgaatttatggtcattctgatgtcaagaaagctatcacatgcttgctgtttggtggctcaaagaaggtgtatatatgatcttatctgtgtgtattgctgtcccggtctccctcgatcgcggggaaggaggagcagatccattcgagaaggtgatggtattggtgaagaagatgatggctgccgttggcagccctcactctagggcggcggaggacatgctgatgcaggccagcagccagtgtggtgaggaggagctggaaaggagcaacatgacgctgctgaggtgttggtctcgacctaaaaaattggcatgctgacttcgtcaaggttgaatagccaccctcttcgactcatcttggtaaatcttcctccttcggccctatccgttcgttctttcttcttgaatggattcatatcttggagatcaacgtcttcaatgcagttcccaaaatccatgcaagtttatcatctgtttccactttccagactatccttgcgcatttacgtttcaaataaatttagaatcacgcagatcaagatctactcttataaagttattattgcctttagtacctcatatagcagttatattactcataatcctcctccgttacattacagaagcatcctctgaaggcgacacagataaattatgtaaccgtgatgatcaatgcagttacaaaaattcatgtgagcttagcatattttttcaaactatccacgcacatatgtatttcaaatcgattttcatatcttatctattttcagtgtatccattaaaagaacaaataaactgaacgcccatttgaggaacctacgaagtgacacaagaagcttcatagaggaaatatcaaaaagtccttgaccattctaaaaaattttagacggtaaccattaacaagacaaccattgagcagcgaagtttgaaaacatgccaaactgactgttgcttttctcaccaatatttcacaagacagtattcaacatgacatatggccactaagccagttcaaattaaaccattcaagtacaagctggaggagacccaaccaccatactcacgtcaatagatggtcattgcaacctcagaatgagatggatagatttcgtggcaaccaatagcattcagattggagcagtttgcatctcccatttctacgttaagaagcgcttggaagcaatcatatatattctctgaagtctggactatctattgactaatactcttatctcgtcaatccattggacttgtgtaattgttacttgtcatgtagatttagcagggctctgttacttgcatgttttgttgtcaacacagaatgtaatcacaggcacgaccaattttatgcagcgactcatgcatagtctgactatttatcattcaaataatgcacctttaaggtttctgtcatttttctttcttatgtacgaagtaatacatagtaggtaccactgctcgaaacagcaattcgagcaaactatatataggaggcgtgccaaggcgcccccagcatttatatacatgatatgcttgtcattacctgtaaccatatttaaattatcatgttgtttgatttatatcatgtggttgaaaattcattttagcatgaattacttataatgatttagaatttttcaaatttattttagtacaccatggtagaataatgtgctatttcaaaatttccatttagttgcatttcttgagaatgagtttcagtgatttggttggattatctaggtgcaaatgctgttgttacttgttgaaaccatggaaatatttaatatgggatgccatatgttttatcctctaattgtgttgcttcaaatgaaatggtgttttagataaacctcagcatatttatttttagtcaacatgtattcatgctaatttaatgtactgatggattgaatagtagaacattagtttacatgtgcttttgttatgaagacgaagagttattttgtagatggtgccaagattgcatttttctactatttaaatcacaacggcgttgccaatgataaaatttttcccaatggtgtaacattatctattggttcatttttctgatatcctaatatttctatagggcattgctttggattttttttatctagcagctttgccagtcccaattttcacttttaatcttgtagtgctggtaattttttaggtcagaaattgatagttcatacatattagcgtattgttacttgggtaaattttcttgcaagttgaaaaattacacccatgggattgtcttgtttcgctcgagatttttttgtactttcatttttcttacggttttagtaagatgctactatgcttgatttaagtaagatattactaaggtataagtcataattagtcttttcacatggaaaattcatgagcagcggcattagatgcaagtagccaatggcgtggtggaaagaagaggatctgaggatggtggcgaatctggagccaaggtcgatggggcgggcggccgatctaggaggcacaccacccgggtttgttcttggcccttcctgaatcatagttcttcctattacaatgcacttgtctatgtgcctcttggtttctccaggctgatgaaccaaagggccagtttttcctaggtttgcttctctccctggggggattttgttggttttgttcttttttgcacgtcatcaggcatttcatcgcctgtg

SEQ ID NO: 16887 - DNA, 4763 bp, Oryza sativa
  unsure (1)..(4763): unsure at all n locations
cgacgtggacggcgtggcccgggagacgcggacgtgggcgcggcggcggtttcggcggtggttgcgggcgcggcggcgcggcgcgaggtgggagacgggtccgataggtgggccccacctgtcggcgacccgggtgagaggaggcgggcggccagcccgcgcggcctagctgggccttggccttcggccggcccagcaggaggggaggaaggaaggagaatgggccggccgcccattcaaagaaaaagagaaaggaaaagaaatgaaaaagaaaaagacttttcccagggatttaaatattgcttatgctcaattttaattggttaaaactatttctagggctctgaaaattccactaaaaatcctgttagcgaatttcgacatgtagaactcaagaaaaattccacatgccaattccgattattatttgcattaatttattaaggtttactcttgctttacacatgtattttcttgagaccatttataacttcaatttaggcttgggaaagaacttcgaggtgtgacactaccatccaggccaatcagcaactcgtgcatgaagagaagtccaaacttgatcaactatctgaaggcccgatcatgtctaatattgatcggcttgaagctcggaagattgagctcttggcacaactccaagaatgcaatgccgaactggatctggaacacaagaagctagccgatctcccatagtttgtcgaagaacagaaggcaaggctgaaatcggctatcaagaatgtcgcagatatgaccaagtctctaaaagtcatctctggaaccgatgctcaagatgctcaatccattgaagaagtagaacaaattaggcaaagagctatatcggctatccagtgttacttgtctctgtgatatcttgtgtaatagatcttaggaaattttgtaatcggctaagaaactctggctctttatctaactcatcttgataatctttatgccgattcaatataactccacattttgctcaaaaatttgcaacttttcatatatgtgcccccctaattttacaaagatgaaggcattgctaaaattataagttgaactaagggcgatataacaatatcggccattgcacatcggcagaccacaaccgattacaatatgaaaacaactaagggcgatataacaatatcggccatttcaaggtgatgtaaatacatcggctatcatgtatcggcaacaccggccgatcatgcattaacccaaacacttgggtaatatttcttcaactattttccatttagcgctcgtccataaacttctccatcgagtccttgcaacatgtaagctcccttagatacaaccttatagatttggaacggtccttcccaatttggtgaccacttgccgaattcgttatcccgagtcccaatcggcaaaatcaacttccacataagttcaccttccgaaaaagtcttgggcaccactttcttgttgtaatgccaagcaactcgttccttatccttggtaacctttgcaagggctctcaatctagactgaaccaagtcttccctatcatcggccatgagattataatattcatcggctgtcaaatcactttgcaactctgttcttcttgagccgattctaacttcccatggtaaaacagcctcatgtccataaacaagcttataaggagggacttggatcgatccatgacaagccatccgataagaccaaaatgctttggccaatcgagtatgccactgccgaggaaaatcagaaatctttctcttaatcaatttgatcaaactcttgttagatgcctcggcttgcccattagcttgtgcataatatggtgaagaattcaacagtttgatacccatgctatcggcaaattgaacaaactcatcgaatacgaagattgaatcttgatcggttgtaatggtttgaggaataccaaatcgatagattatatgctcttgaacaaattgtatagcatccccagaatcaaccttcttcaaaggaatcgcttctacccacttggtaaaataatcagttgccaccaatataaacttatgccctttgcttgatgatggattaatcatgccgatcatatcaattccccaacctctaaatggccacggtttaatgataggattaatagccgatgctggtgccctctgaatcgctccaaaattttgacaatcttgacatccttgtaatatttgaaacaatcctccagcattgtctgccaaaaataccctgcacatcgaagcaaccacttcatcttatgagccgattgatgagtgccacaaattccttcatgaatctcaccgattgcaaccttggcctgatcggcacttaaacacttaagcaacaccccatcaatcgtctgataatagagctcatcatccaataaagtatacttcaacgctttatatcgcaatttccgggaagccgattgagatggattctgtaaatattgatgcacatcatatctccaatcatcagctgttaacgctgcaacctcaattttgatgtctttgattatcggtttatatcccgacgccccttgggtcaaatcattagcttcaatattctgctctcgagatacatgcttcaaagtcaccagccaaaactctttcatcagctctcggcacttctcattataaaccattaatgtatcatttttgcactcatactctcctgccaattgactgatcactagcaaagaatcccccataatctcaatagcatcggcttcaacttccttgagtaattgcaaccctttgagaactgcctcatgctcagcttggttgttagttgcataaggtttaatagtataggcaaactcaaaacatgccccccgaggagaaattataactaagccgataccacaaccatgagtgcatactgatccatcaaagaacaaagtccacggcacaacctcaaccgagccgattgaatcatcacaatgatcaacaataaaatcggctatagcctgccccttggttgccttcggtgactcataccgaagatcaaattttgttaaggaaaatatccactttccaacccttccattcaaaattagagctgataacatgtacttaacgacattagctttgcatatgacagtgcattcgttggacaatagataatgccttaaccttgtacaaggaaaatataagcacaagcacaacttctccacactgcatccaagagccgacgacttagatagaatacaactctttctttccctgcaagctcctgaatcaagactgagccaatcgacttctcaccggccgatagatataatctaaaaggtatcctcttttgtggaggaatcaaaactggaggagagctaagatattccttaatactatccaaagccttctgttgctctaccctcaagtatacttttgatcggctttcaatcttaacaatggcgtaaaaggctctaatcttccagacaaattaaaaataaatcttctaacgaaatttatcttgccgatcatttcctgtaactctgtcttattctctggaggctgaattttcttgattgcattaacactcctttgagttatctcaatccccctctcgtgaacaataaatcccaaaaactagccaaccgatacaccgaaagcacactttgtcgggttcatcttcaggccatatttcctagtccttacaaaaaccttcctcaaatcggctatgtggtcctctatctctttagacttaacaaccacatcatcaatgtatatacttcaaccaaacagccgatcaaatcatggtatatataattcatggcccgttgatatttagctccagcacttttcaagccaaaagtcattacaacccactcaaacaagccgattgcaccaagacatctaaaagctgtcttgatatcttctttggccataaaaatctgattgtatcctgcatttccatccataaaactcaaaatcttgtgccctgaagcagcatcaaccagctgatcggctactcaatttcttccaaatcatcaaccgacatgaaaccctgtccttgcttgtcatcgagatcatctactatgtccttggtgtaaacgtttgaaccctccacgacgcccttaaaataataacttgggctctccatctttaattggctgtatatcataatcggacacttttagaagatctccatcccaaacttttccagataagcaatcgagaccatccatctcccaaagagctaaatcggcactggcaacattaactgacctgtcggctggcacgatttcaatcttgtcgccttgccattgaatcaagcattgatgcatgattgaaggaatacaacaattggcatgaatccaatctcttccaagcaacaagctgtaggaacccttcccatcgatgacaaaaaacgttgtagggagtcttactgccgactgtcagttccacattgaaaattccttttggtttctgatggattgccaccaaaatctttgagcaccatgtttgtcttgattagatcctcagcatttctgcccagcttcctaaatgtagcataaggcatcaaattcactgcagccccaccatcgaccatcatcttagacatcggcttcccattgacatagccgtttacatacaatggcttaagatgccgattatctgtcccttccggcttctcaaagactgcttgttccggtgataaaatcaacttagccgattcttcctccacttcatcaannnnnnnnnnnnnnnnnnnnnnnnnnnnnnnnnnnnnnnnnnnnnnnnnnnnnnnnn

SEQ ID NO: 16888 - DNA, 590 bp, Oryza sativa
  unsure (1)..(590): unsure at all n locations
ctatagggcgaattcgagctcggtacccatactagtggatggaggtgccgcggtgaacttgatgccgtactcattattcaagaagttggggcgtgaggatgatgagttgaagaagaccaacatgattctcaatggtttcaatggtgaaccaacggaggcaaagggtatcttttcggcagagctcaccgtgggaaacaagacgctaccaaccgctttcttcatcgtcgatgtgcaaggtaactacaatgttattttgggtcgttgttggattcatgccaattgttgtgtgccttctaccttgcatcaatgtttaattcaatgggacggcgatgatgttgaaattattcaagcggatacatcggccgaggttgcaatggccgatgctacttttgagtggcgccatgggaatatccaatgcttatcggggagggatctttctagctacgattttattagtatctccgatggcaaatttgtatctatctctgtaaagccggctagtatagcacgactaagccatataaatttgtataatnnnnnnnnnnnnnnnnnnnnnnnnnnnnnnnnnnnnnnnnnnnnnnnnnnnnnnn

SEQ ID NO: 16889 - DNA, 3185 bp, Oryza sativa
  unsure (1)..(3185): unsure at all n locations
tcaccctaggaaaataaaaccccaactagtgggtactctatttatggttccactagtatgaacttaggtagatgcttcgctggttaattaggcaacattaggtggttttataactttagactttgggaattctcatatcacttagacactatggaatggttggattatggtggaattggacacatacctccccctctattcaaaacccccaaaatggttttaggctgggctcgaggtgcgtggttgggttttgtttgtcgtaccttgggtactataaggattaagctcgtgcctctgttgcaaagcactaccgtacttccacatgtctagtgggtaaggcttagtttgtggctcagtctggttataaacaaaagtatacggatggagatggacgaagtcgggggtcgatggacatctctagggcaaatgaaggctacacgagctgcggcccggtagtcgagatgtcatggcacagggctggtgtcctactgctatgggctcagtcctgcctacctgtcctggaggttccggccgtaggtggggttgggtcggtactcttgtctatggctaggatgggttggaaactatgtcacgtcttccgtccgtataccgtggtggtatgtggcacatggttacacgtgaagaagatgtgtcttgtgggtaaagatgtacacctctgatcagagtataacctattcgaatagccgcgccctcggttatgggcatgcctagcaatgtacccaagttagtgttttaattcttaaaacccgcttaacaactaaaatgtgaaatggttggcctgggttggcttgggacgagctaggacccagggtcaggttgccagttcggtccaaatcatcgtaggccttgggttaaggcaggttcgtgtgggttcatggccttgattaataatattgtatagctctaggatcgtaattacgaaatagctttgagcaactaagtgtcttttaatgctgttcactgcaaaccctaaccacccctatattataactcccttgtactcctttgcatttattttgcactcgtgggtgtgtcttgttgagtacggtggttgtactcagtcttgctcaatttttcccaatcccagaagaggagttcctggatgatgaaggctttggtgtctagctcgtgcctgccgtcaagcgcctgtggtcgtcgccctagtcttccattgtttttcgtttatcttcatgtgtgctgggccctcgccgcccatgtaataaattaactatttacgcttccgcttgttaaactctgtattgtatcaacttttggtgtaccttgcctcctgggacaaggaataatacacgcatgtaaggaacgcccgttgggttatttccggtcgtgacaagctataacatcggtttctaacatccctaaatctcttaatataatcaatgacaggttcattatatttttacttaaccgatgttaaatcacataacctaagctcagtttctctagtatagaaataatcatgaaatttttcttctaattgagcccaagtatgaatagaatttgccggtaaagaagtaaacaatgtaaaagcattaccggacaaagataaagaaaacaaacgcaatataaaagttgcatctaacttatctttaaaagcaatcatagatgaatctattgtagatgctacttgttgttggatagattgtgttacctcatcattgcttaccaaatcgggggcgagcttaggacgtggcccgggcttgatgatcacaccttgacgagtcctggtgcttgccctcatcaacgtctcccgtgtgagttcattgatgtactcctccatagctttgcggtcttctcctacgaaatcatccaatgtgaccggtatcatattggatggctccacctccgtcttggatggcggcttcatcatggcgaaatcgaagttgagttgacgatgaacggatctcttccccagcggagtcgccaaaaatcatgttggcaacttttttgacaagttaacaagcacgatcgcagcaccttaagtcttgcggtgatcctagagtcgccaaccacctcgatctagcaaagagctaaatctagatgggttttaataactaaaccggctagcggagccgatttctagataactacccgtctcgtgggcaaaacggaaggttttcaggacaaacctacaaagagatgtcgcactctggcagcggcggcggacggtttacgacgcaaaccgacaaagatggataaactaagagaaaactaaaagcaatatgaaaaacgattcgattgatttattgtagattggttttttacaatgaatcggccatgtcccttatataggggttggtcttgtcctctacaggccctcctccacgtccaactcggggtagaaactaaaggaaacccaaaacatgccttcctgagcaaggaaacctcgaaacctgacgaaacacagtcggactcggacctgccggtcagactggccacactccgccggtctgactggccctcaaccggcggtctgaccgcccaacacacggcagtcagaccggcccactcggaggaaaccggtagacttctaaattttggcaatctttcctattttaatcataggtgtcaaatttgggtataaacatgtgcatggttggatctgccggcgctccgctcgcgtataaaccccgaacgcttcaggcccctggatagctacatgctcaaggtgcagcctcctcttgctggtggtgtcagccgcttgagaagagggttcgacggctcgccgccgctgacggggcagacgcacccaacctgtaaataccgaatggctgggtaaattggtcaccaccagatttatgcgagatgttggttgtagcttccgatcgatttgcatggatttaagaattttgggaattatttttccagaaaagaaaatcaaaacgggagtacctacccccagaacgatgctattgatgtacggtggacgatgctgttgtcgatgctgtaagcagtgctgtgatgtctccagcgccgctttttgcctttaccatatgatttcagcgagccaatggattggtcgtcaccttcggctttgccgatcggctgagcgcctgcgccgtggacaccgatcgagtcgctgcaacgtgnnnnnnnnnnnnnnnnnnnnnnnnnnnnnnnnnnnnnnnnnnnnnnnnnnnnnnnnn

SEQ ID NO: 16890 - DNA, 1262 bp, Oryza sativa
  unsure (1)..(1262): unsure at all n locations
ccagagaggctggagccgtcccgttggatgacggcgccagccactctggtgcccaaaaaggaccatttctgggataagttttttcaagggtctatttgcgaaataagtttttcaaaagaatcaaaatgtgaaaaatccagacaaatatacctaattccgatgcaattgaagcatatggaacttggaaacttccgctaaaatttgaaagcatgattggatattttgcgaattgagtgtggtgaaacctgtctgactgagtctattcgacttaatattagtgcttcacatttaaaattatttttcagtaatcagtgataagtgattaacacaaatgtttaaaactagctggtttcttattctagaaaaatctgtgatcatatagatgcgatcaaggtatccgacacaagctttttatatactctagaattattgtattcaaattagttttaaagttaatacactgtctaagaacatcagttcaaaaaactaatcctgtctcgatcgatcgaacacataatgtgaataacagcctactagctcctagcgcgtgcatccaactggtgcttcttctacccacgaccagaccattttctcccgatcatcctgtggcaacatatatacatacgtgtacagttattggatcactaggaggatgaaccaacaacttattagtaggatccattcccgtcttaaggtcttgacaaacaaagaaaaattgttatagtactcaacctgcgaaacagttgaaccgaaaccccgccaaaatataagaatagattaaaataaattacacacgaaaccacgccaccggcggtgacggcagcgacgaacctcctcaccggaaaccggcagtggcgacgacgactattagatatgtggtatccataaccctgacaatatgttatatatatatgtatatatgtatatatgtatatatgtatatatgtatatatatatatatatatatatatgtatatatgtacatgtatgtatatatatatatatatatgtatatgtacatgtatgtatatgtatgtatatatatatgtgtacacacatatatacatatatgtgtgtgtgtgtgtatatatatatatatatatatatatatatatatatatatatatatatatatatatatggcttgaatccatgtctagccagccgatggcgtgactccttccacataaccggagtatgcaccgttgcgatattcccaggtgagttnnnnnnnnnnnnnnnnnnnnnnnnnnnnnnnnnnn

SEQ ID NO: 16891 - DNA, 5354 bp, Oryza sativa
ctcccatatatatatatatatatgtcgacgggggataccctagaccagatatagagggtattggggtccgttggaacgaggatctacgtagtacgacatcaagcaaacagaaagcaaggattatactggttcaggccccttgataggtaatagccctaatccagttggtatgggattatataatggaaatcacaaattataaagggaataacaaaacttgatggtaccgacgagaccgtagtcaaattggttcgactagatctcccggcgacttggctcctgtgcgctccgacttcgtaggctgtggtgaatgtgttcgcggtgagattcgatgccctaggtcctgcccagggggtccattttatactaggggtcagttgatctccaagtaggactcggagatatcggacctctcacgatatggtaaagacccggtcttgcccgagtaggactccttacatccgtggattctatttctattacatgatagatttcctaaacgtataccagaactatccgtatacgcatgggtataccatatcagtactcatcgtacgtccaaggatagagggtataccttatccgtaaccttgacagtagcccctgacttctgcttaaatgaactcatgtaatcgatcggaacttctgatgtcggaatcgttgtcattctcatctggtcgatcccggcatgagaaccgtagaggcaaagagtcatcgacaacgtcgcatgaagttcaacagttatgagtgaatttaaattgaagtatgaaaactaccgcgcgcaatggacccagaattttccggcggcaatctctctcctttcctcggaatacgcaccgtcggtagtgcacttatttaaagggattttggaaacccatttgaagtccgttcaccaaaaaactcttcagccttctagcgcccttcgtcttctccgctctccgcaaagaaaaccctagcttgcttcttccctcttgttctccggcgatcctccggcggcgatggatcttgacaagtccacctcaaccaccgcgtccatgaagaagttgcaggacgacggtgccctccctggtcgcgggaccatgtagagggagacaggaggtattaaacccgaacccgtcttgggccgcatggttgtggtcgaagattacatttcttgcggttttcttcctctgccttccgagtttcttcttattgtcttgaacttctatggtctttctttgcttcacttgaacccgaattccatcgcatttcttagcatctttgctcatctttgtgaggcctacattggggtagagcccttccttgatctcttccgcttttactacaagttgcgttggatggaacccaacagggtatccggatgcgttggattccgacttcgggatcgcctgaagtcacgttacatacccttccaatgcccctcttctcgtagcaagtggcaggcgagatggttttatcttcagatagaaaattcagaccccgtccttgttgttcctgaagaacagccagacaaaatcccagagtggaccgccaaacccgccctaactccctccctccagtctttcatcgacatcatcgatgacctctgaaaacgggggttgtcggggtacgaagtcgctgccgactttgtaggtaggcggatccaaccgctgcaggctcgcgcccatccggcctttgattactctgggccagaagacatgacccgggtttctcctcggggtattttttcttgtatttcaaactttactccgagtgcgtctgtttctcctgacttatcgagttcttgttctcgatttataggtctggacagtgacaccgtgggacgccgcgtcggccaggtgatgattagtgccccctcagaggcgagcgacatcccgatccccctttgcgagaggggcccggccgaacgcactgctgcgatcaatgtgagtgtactcaatgactcctttacatctttctcctcgagatcgcgtcgtgatttcacgttatgtaggctctccctctgacggacgtcatcggaccgctcgtggatcatcaggcggcggcgtcattgaaggagggcgtcgccaaggaggcgtccgatgttgctgctgctgccgctgctaccacgagtggcagcaacattccgaagaaggggagtaaattctcctctgtactcgggacccatcggaaagcgccaaacccggcggtaagcctctctcttgttttttaacgcgtagtcggaataacttgacctgacaccatctcatcttacttaggactcagacgcgtctcctctggctcatcgaaggcaaaggcttgtgacgatcggcgagaagtaagtagacgtttttgaagtcttttcattcacggagtcttgatcgcttagctttatgaaagagaggaaaatcttcgtaggacggcgcgggcgaaggcgacgcaaggtgggaccgatgctgcctccagcgcgtcccctgcggcgacctcgacagatgtcgtggtcgctactaaggaccgggaggcggcaccgagtaaccccatcatcagcctcatgcctactcggggcccatccaccgatgacctcacctggggggagctccaagtggagatggagcatatcctccaggccggcgctcgcggcgtaggtcgtgagattgaggaggccagggtggtggcgtcgtcggcaaaccagcgtgccgaccaactggctcgcgacctggcggaggcccgcgagaacctcctaaagatgagggagctggtggtcggcaacgagaggcagcggcaaggacttgagcaccggatgtcggagctcgagaacaacctgtcaaggatccgaggctcgctgcggatatcgcacaccggcctgcaccaactcgccggcgagtgtggtgtcacgactaccatcccggcgaaccctgacgagttctcgctgacgtcctcactcgcggaactggctacggcgatggaggagatcacctccaagcatgcggccaggattggggaggagacgtccaataggatctacaccggggcgtgccatgtcctcgcatgcgtgaggctggcacaccctgatctagaccttaagaaggctttggatcagggggccgccgatgacgcgcgcaagggtgtggtggaggaagtcgatgacttgggggagtccgtcctccccctttttgaagagtaagatatttgttttcccctatacccttaatcctcatgctgtaaaacctttgttggatgcaaactgctcttatctgaacagtcgtttccctcgttttcttagcatgtgattccgagtactttgttgtcgttgtagagatatcgatattgaggatgtccagcagcgcgggcagcctaatatgccggtggtcgctccggcgcttgcactcgagccgtttgtgccgcgggaagaggtcagtcaaagcccgtccgcggaggcgaatatggcgatgacgtccctaggtttgcgtcttagtctctttcactccttgtattcggattgacttaattagctgtgtcctcgaaagagaagagtagcttgacttagtctttttcgtcccaggcagattttgagaacacgatggctgaccgagtttgtcgaatccaatattggaggacgaagctcgagatggccaaactcgaaaacaccatgatcgaggtgaagaaggatcaggctgtggaaactcttcgaggtcgcgaggtatggttcaactcgtacctcaagagctgctgtacggcgatggcgagggtctgcaaggagctccgagttcctcgcagagatctcgaggagtcggcagccggatatatctcatggttgaatggggcttgtgcacagctcgaagggatcggcaaacgtatcgacgaggccctaaagcaggagtgtcgtcgatcgagccagtacaccagaggacatgtgctggcctgcatccgagatcaccgcccgcagcagcacctcgagttccttcacgaagggttctcacgttctcggaggactcccacggagattgatggtcttgagcagtcgatggcgccgcttaccgagaaggtatttcggtccgtggattggcgttggccgtcctggtagtttttgtatcctgtaaaaaatatctcaaagaaacatgtaatatattttggagtatctatgacttgcaagaaacacttgtgaaatagaaaaggaatctatctaactaagttttcttactctgggtatgttgtgtatgagcgttttctcactttgcgacttcgatcagtcacttgagccatacactcttcctagcccctagccttgtcgtcggagaattattctcagaggataaggctcttggactcttgacttgccttggttgaaaaagcgctgaccctagcccccagccgtgaagttggaaaactcaatttccgattacacggcttggttaatacgcacggcgagaactcttacatgaccagaacttacatggtcgtttgtctctacatgatccgacaaggccttatccgctctaggcgtccccagccgaagttcccttaggttcctcagaggccttgtcaggatggcgtaaagggacatgaggataggtttcaactctaggtgtcgtcgtggtaagggatcgccgggaaggaacacttagactgtagtctttacctgaaatcaatctttattgaaatcgtaagatgtcttacaagtatggatactattgatttatacataaaattttcgtaattgatcaatgttccatgaatttgctaactcgcgaccatcgttgtctgcaatcttgaatgcacctggccgcaagaattgcgtgatcgtgtatggtccttcccacttgggtgagagcttgttacgccctgcttggctttgaacccgtcggaggacgtaatcgtcgatcaaaagtgtgcgtgctctgatgcgcttctcatggtatcggcgaagggcctgctggtagctggctgctctgacaacaactctttctcgatgttcctcgagtagattcacatcgtcacttcgctgcttctcctgttcctcgtcagagtacttctgtactcgtgtgctctgatgccgtagctccgtggggagcatagcctatgagccatacacgaggaagaagggtgtctccttattgaacgttgtcggtgtggtgcgcacggcccatagatcagaggggagttcttcgacccacttcttgtcgtgtgacatgaatctgtcgtagactcgggtcttgatcccttgtagtactatgctgtttgcccttttgacctgtccattgctctgagggtgagaaaccgaggcaaaacaaatcttgactcccaatccaatgcagtaatcctggaagtcggaattgatgaactgggagccattgtctattatgatgcggtgaggc

SEQ ID NO: 16892 - DNA, 3260 bp, Oryza sativa
agatcgttgccgatcatacaatagatcttggcttgtcgggttattttctcggcctctgcatcgtcctcgggcaactcgtcggtactcaggaacttgatgagcggggtccgccagtcctctgtggtctcgatgtcggcaatgacgtgttctgcccctatagcccccgagctaatgtcggggacaactgtgctatcttcgtcatttgctttttcactgatggctttgtcaagacgtccagaaaagtaccaggttcgagtggctctcgtctagacgcacgccgtgctaggtcgtttggttcaatgttgtccttgcgatatacgtgccggacctcgatcccatcaaaccttttctctagcttcctgacttctgcgaggtacttggataactcggggctagagcacttgtagtctttgtgcacctggttcgcgactagttctgaatcccctttcacgattaatcgcttgactcctagtgcggctgctgctcttatcccgatgagtagtccttcgtactcggctgtgttgttggtcgccctgaagttgaggtgaattgcatgcttgaactgatctcccgaaggtgatgtcaagatgaaccctgtccctgctccttggctattgaatgcgccatcgaacgccattgtccatgtctcgctgtcggtctgactgtctgacctgttgtcgagcatagtccagtcagctacgaaatcggcgaggacctgggacttaatagttgttcgtggcacaaagtgaacgtcaaattggcttagctcgactacccattttgcaatgcagccgacgacgtctctgtttctcacgacttctccgagggggaaggaggaaacaactgtgactctgtgggcttggaagtagtggcgtagctttcttgatgtcatgattactgcataaagcagcttttgaatctgtgagtatcttgtctttgcgtcgtggagagcttcgctgacatagtaaactggtctttgcaccttctctctcttgacaacaatgacggtactcacagaatatggtgtggcgacaatatagaggaataattcttcattaggttggggagcaacaagtacagggggatttgacaggtagcatttgagcgcgatgaacacgtcttcggcttcctgtgtccacacaaatttgtcttgtttcttcagcagagcgaagaaaggttgtcctcgctctcccatcctagcgacgaatctgctcagtgccgccatgcatccagttagcttctggacttccttgagtcttgtgggcgactttatgttctcgattgccttgatcttctcgggatttgcttcgatccctcttccggagacgaggaatccgaggagcttgcccgatggtcctccgaacatgcacttctccgggttgagcatgaggcgatattgtcagaggttgtcgaacgtttcctggaggtcatcaatcaatgagtcgcttgtctttgtcttcacaacaatgtcgtcaacgtaggcctcgacattgtgtccaagttggtcattaagtgccccttggaccgtgcgctggaaggtatttcccgcggttatcagcccaaacggcattttgatgtagcagaatacaccgaatggcatgatgaatgttgtcttctcctcgtcctcttttaccatgctgatctggtggtagccggagtaagcgtcaagaaagcttaacaactcacatccggctattgagtccaccaattggtgtattcgaggaagaggaaaatgatccttaggacactccttgttaagatcggtgaaatcgacacacatcctccacttctcgttggccttacgcaccatgattggattggctagccactctgggtggaggacttctcggatgaaaccagctttgagaagcttgtcgagctcttctcatatggctcatttccgatctgatgcgaatctccgcagtttttcctttactagcttggcatcggggtcgcaccatgagtttgtgctcaatcacctccctggggacccccggcatgtcggacagctgccaagcaaacacgtctgcattgtcgcggaggaaggtgatgagcgcgagttcctatttctcatccagtgacgccccgatcttaacagtcctatcggggttggcactggagagcagaacgatcttgattgcgctgtctggcttcgacgtcttgttggttttgttcactttcttgggtggctcagctatggcgggcgggttgggagcatgctcgaccatgtcgaggctccatttgtcgcactgcaccgccagcttcgcgttttcctgaatagtgattgttctcttcggcccaggcatcttgagcacttgatacgcatagtgagatgcggccatgaacttcgcgagtgcagtcctcccgatgatggcattatatgttgtgtcaaactcagcgacatcaaaggtgatctgctccgttcggaagttgtttgcttggccaaaagtcacaggtagcgtaatcttgcccagtggcttggacgatgagtgaggagtaattccgtggaagggttgatcagtgggcgtcaactcacttcgtggggtccccatcgcgtccaaggtgctggtgaagagtaggttaatggagttgcctccgtcgatgagaacccgtgcggaataaatgtgcttagggacgtcctagggttgccctagggcgcacaccccttgggctaagcccacgacacaattacaaggcccaaaactcaaaatcagattcggactagatgagatatgtgtcttgttttgctgattgtcggcagctcggtaggaattttgacatgggaccaaaaccatatgaaagtagacttcataatctttccaacaagtgctcatgggcctctaaattccttctagatcagcggctagatccgtttgaagttgatgctatcaggaggcccgaatccgaatccaaaacgtgtacaacttgatctcttgtcttctatgggctaaaagtgacatggtgagatgaaagaagacttggagaaggtcttggtttggtccccaatcaatttcttcaatcatccatgcattccttacgctcagtctcttttctttcacccaagcaagtacctctgcaaacgaaaacacacaaaactcattgtgttgcaacatttgttcaaacatataacaagtaaatctaatatcacaaatcacaaatcaccacccaaatccttgttaattatcttgcaggcatgcagcccctgctcacctccccacctcgccgcatcaaagggtaccgagctcgaattcgccctatag

SEQ ID NO: 16893 - DNA, 2737 bp, Oryza sativa
cgagctcggtaccctttggttgattaatacataaagtagccatggttatatccaagctagttgtgtcctcatcatcctctccttcttgattggaaaccatcctcggtttcaccttgtcatggagcgtattacacttatctttgtctatcacaacatcctgcgcggaacatttcttgatggccatatgattggatcctagaatctttgtagtcgaaaaaccacaacactccccttcttgcaaaccaacctgtaactcatttaaacaactagaggaactagatagagaattacttatatgcatgcggtcctctagataatacatttcatcatgaaaaggaggtatagtcaaattcgaacaaatatatactcgatgcacattatattctcctttactatcataattgccaataatatgaaaaatcacatcagaaggacatggcaattcaaatctagcaaataatttcttctttagacagttgagtggacaaatatcatcaaattgaatataaccccaagtatttaaagaagatagcaatttaagctcttcattctcactagcaatgtgaataacatgtttaaactgaacacatggtggctctactatagaactaacatgttcattcactagttgtggcatggatataagtgaagcatcgcacaacacttctttatcacaagaaacatcaaggaaattgttttgtgacaaaggtatttcaacaattgtttccaccgtgggttgctctaatgtagcataagtagtggacatagttggcacctcataaatatgcataccttaagtagctgtagcaccattatcattaccttttttctcatcttcagaaattataggtgcttggttaattaaacattcttcaagcatgcatggagctaaagataggtctttttcctcttcgtctttcttctctttcccattaccttgtttattctcagatgcctgcaaaatattagtatccaaaacaataggcacaacattacgttcattttgtaataacttagacttagttgaaggcatcataatagtatctttcctggtatctctgaaaatctcatcgattctatttttcgtcctttcaatactatctttgaaaatttcctcgattccattcttcatcctttcaagattatcttcgaaaatttcagtaaaactcataggtaccaatttcattttccgaccattatgtttaaatgtgtatgtattagcaacaaaattatgcgatccattattatcatatacccatggttgacctaacaacaaagaacatgcttgcatagggacaagatcaaaattggcagtatcatggtaatttccaatcgaaaagtttattctcacaattctatttaccttgaacttaccacaagagttgaaccatttgatgtaatatggatgaggatgcggttgtgtaggcaactcaagtttctcaaccaaatctgaactcaccaagttattgcaactctcactatcgattatagtacgacatgctctatccttaaccacaaactttgtttcaaataattcatggtactgccattgctccgctttctccatttgagaacttagcaaggtaaatctaatatagaacatatgcacttttggttgattaatacataaagtagccatggttatatccgagttagttgtgtcctcatcacttctccaacgccagttgcttcgtgagtgcctttttgaagacgaaacaagtctcgagagagtgcttgtccgactcgtgtatcgggcaccatatttgcttcgtgtcgtcaccttgtgggtctaggtgcttgggtgggtcagcatattctgctgtgaggacctctgtttgagctttccttttcctactcctgcgactcttcctcttgcttgcctcaggtgcatccttggctggtttcttctctccccctgtcttcggcttgtcgttcttgcgtctcagggcgtcgtccgcgtgagtgcattgatcgacaatctcgaataacttacgagcagtcgtgatccatcttgtcgccaactcctgggtagtgtagcgatctcgaacatcagacttgaaagcgcggattacggaagcatcggtgatctcggggatcgtatttctgcactcattaaagcgccgaatatagtccctcaatgattcgcccggattctgcttcaacgcgtgtaggtcgtcttcgatcgcgtggcgcttgtatgttccttggaagttagcaacgaactgctgccacagatctgtccatgaagaaatcaagtagggtgggaggtgaaccagccatgaacgtgtagatcccttcaacgccgccggcaaataatttgccaatgcgttgtcgtctactccggcagcatagagtactgtggaatagacctgaagaaactcctcagggtcggtgcttctgtcgtatttctctattgttcctagtcgaaatttctcaggccatctaacctctcgcagaaaacgagtgaaagctctgcacccgccgctaggggcggtgggttgtcggtgatcatgtgctcgtcgtggatgcctgttcgatgatgaagatgatgaagatgacgaggatgatgacgagtcactcggcttcggagtgcgattacgaggatgacgctcaggttcttgagaaccttgtcatcgcccaccgttgttgtcccggcgctgatctccatcgtcgtcgtcattacggcgtcgtcctcgactggtatcgcccggcatttgttgcttgcgattagtgcgtt

SEQ ID NO: 16894 - DNA, 2483 bp, Oryza sativa
ccgcgaggcagaggggtggcttgacgaggtggcgtccgctgttcaggctgttccccattagcgccgcctgtcggcggttgttctggtggtgccctggcagcggcttcctcgaacgcgttactgaggttggccactgattcccgtagtcgtttcatccactgatcaagatcagcgttcaagacgggatcataaggggtttccctcagtattgcattgatggttctgatatgttgggcctgcgtagccaattgatcctccgcttccgtgttgccgcctgtagatgtgctggtcccatcaatagcgtacacgttgcgtgctgtacttgttgatgatgaggcctggtcttcgagcagatgtaggaagacggctcgtgggggtcgatatcgattaccccgacgaatcgatctgaaatagtcgccactcctcgctccttgtccgcatctctaggggagatttgtgactgctagaccttaggaggcgacgtcctcatggcactgagaaggaccttgtagctcgagaggtcgtgagtcttgccttgtgaatgggacaatagacatcacgagtgggggaagtacgttgaattccacgttatttgcaggcacggatttcagcttgtacgtcgggaaaaaccgagcaagcttgcaaggtgtgccttttggtcttgtggataggacaccaggtccttgtcgcctcggaagttatccttgtcggctcgtgcttctcgtcggggagacaagatttggccgtgttaggatccttctcgggctcaaatgtgggcgatgttccgttctccgcttctgcaggaggatctttcgacgtggagtcgaccggggtcgtaaccacgccattctcgctcctggtaattgctgggccattcgagatcggcatcgtggtgtagaccgggaagacgatttcgccgacttgagtccacaccagcatcgttgaagttgaggctccttggttgatgccggggtcgacgctgtcgtcgaagaggcttgaagtcatagtagtagaaccttgagcaccaagtcgccctacctggcgcgccactgtcaacggaggatacccgtagacctggggtccgttggaacgaggatctacgtagtacggcatcaagcaaacagaaagcaatgattatactggttcaggccccttgataggtaatagccctaatccagttggtatgggattatatgatggaaatcacataatacaaagggaataacagaactcgatggtaccgacgagagagtagtcgagttggttcgactagatctcccggcgacttggctcctatgcgctccggcttcgtagctgtggtggatgtgtttgcggtgagattcgatgccctaggtcctgcccagggggtcccttttataccgcgggttagttgatctccaagtagaactcggagatatcggacctctcacgatatggtaaagacccggtcttgcccgagtaggactccttacatccgtggattctgtttctatcacgtgatagatttccttaacatatactggaactatccgtatacgcgtgggtataccgtatcaatactcatcgtacgtctaaggatagagggtataccttatccgtaaccctgacaatatatatatatatatatatgtatatatatatgtatatatatatgtatatatatatatatatacatatatatatatatatatgtatatatatatatatatatatatagacacacacacccctaataaaaaatacgtaaggtttccggattttttttccgtccgtcatcctgttcaaacgttgctaaaatcatttttaatcggctcaatagtcgagtcggaccattttcaatctacttcaaaatcacgattgatatagaatatgtattaattgattgaattattgaacacaactagcagcttgccaacttggttagcggagtgaaactttgctttggccagctgggttcgattcccaccaccctaactttttacatttataggtggtttcacttacgtggcatcctagtcaggaaaaaatatatatatacgtgaggtatatatgggtggtttcactgacgtggcatatagtcaggaaaaaaaatatatacgtgaagccgatatgtcagctgcacatttcttccccttctcctcttttctcttctctcttctcttcttctttcttcttcttcagtgagggatctaagccggccgaatttataggtggtttcacttacgtggcatcctagtcaggaaaaaatatatatatacgtgaggtatatatgggtggttcactgacgtggcatatagtcaggaaaaaaaatatatacgtgaagccgatatgtcagctgcacatttcttccccttctcctcttttctcttctctcttctcttcttctttcttcttcttcagggagggatctaagcccgcggcccgtgggcggagcagcttgtggcccacagcagacgatcgcaccgggcggcgaagagaacggc

SEQ ID NO: 16895 - DNA, 9143 bp, Oryza sativa
  unsure (1)..(9143): unsure at all n locations
gatctaagccggcggccggtgggcggagcggctgcgggcccacggcagacgagcgcaccggggcggcgaggagaacggcggagaaggcgggtgaggcgggcggcgaccttgctcccgttcgcgtacgtggagttcttccgaccttgctcccgtccagcggtgcgtccagggcgcgcccggcgccgtggagttcctcctgtccgtcgtcaaggagcagcacgccaccaccgtggacaagacgacgtccacaccgctggttcgttctttccagaaagagacgacgtgtggcgtgcaggatttggcaaaggtgagctcgccggaggaggcggctctgagcatcctgcatgcttaagctctcctccttcgcctgcttccgcatcctccttcgcctgcttctgcgccgaccccgctgccgatgacctcatcacgccattcccatacgcgtcccacccgccgccctcgtctcctccgccattgccactgctggagcttgagctggtcgtagtagagcgcgctcagcgcctcagcaccacctaaccacaaaactgttagtggtgtgcatgcatagcttagttagctgattagttagagctagtcaatacatgaatgtgttgcatgagttgtgtggcagttagcttcgtgcatgcggccagctagtggctgccaaattaagttgatcgcgtgctgcgtgcccgtacgatgtgaccgaagtttgttttcttagctataaaagtcatgtaatctcggcttccggcttccgactccggccgttcatgccgcccgaagatgatgtggcgcacgttgtcgacgttctggacgcgctcaccggcgccgtcgagcgcgatggtcagcaggtcacccgcggtggcctgctcgagcaccgccgccacgcgcgcggggctccaggtcgcggcacgtattgggagccagcaagagatgacgccggcgaaaccacccgccactccacctgccaccgccaaccgctgccgctcgctgcccgccgccggcctccctcacccaagaagtcaagagagaagagagaagagagaaaagagaacagaagaggaagaacagagaagaaaaaaaataggcaaaatttgctaacagtacattcaaaaaacgtgtaattagctagaagacatcgcaataacgcgtttttgctgtagggactgcaaaaaattggtaattagctgctggacacccgcggaattattttattatatctaaaaaaattagagagagaaacagctgtgtaagtacggttctactccctttgtcctataatataagggattttgagtttttgcttgcattgtttgaccactcgtcttattaaaaaaaattaaaattattatttttttgacttactttattatccaaaatactttaagtacaacttttcgttttttatatttgcacaaattttttaaataagacaagtggtcagacaatataaatacaaactcaaaatctcttatattatgagacgagggagtaccttttgattttttttctttttcttttttgtttcttccttatccttttctccctctctcattctttctctctctctctctctgttctcaaccgctgccttcaaccttgctcgccgccgcttcgcctatcgtcgtggcgctcgctcacctgccgtcaccggtgctactactccatggcttcatgtcctgcaagcgaaggaggaggagcaaccactggtgttattgtttcacgacgaccaccggcgtgaaagcggcgccgaacgagcagtctgtggcagcctacgagtgcagcgtgctcatgaccgtcgcgccctcgaggaggtcttggaccgccttggtgtagtacgcgcgcagccgccgcagcgagcggcggtacagcgccactagccaccgcacccgcagccgccggaacgcactgaacagccgcctccgcccgccggcgccgacgccacgcctcgcacggtcacatggcggcgcagcggcaacttgcggagggagggagcggtggtggcggcggcacagctgctgcacgcggagaaaggaaacgacagcggcggcggttgcttcttccggaaaatgggagctgcgacgatggttcctatgcgcggagaaagggagcggcgacgacggcgcagagggtgcacgtggtccggtgcgcggtaacgacagcgcaaagggagcggcgatggctgcgctcgagaaagcggcgatggcagcggcgactgctgctgccctcggaggaaacgacacgactctgctgctgcgctcgagagagcctcctctctcttgctctttgcttggcgatgagaatatgtgattagtgaagactaactaatttgaggcaagggtaaactggtatttaatgcttgtttctctctcatattcctccaaatataataaaataatcttgttggtgcccatcagctaattaccagttttttacaatgccctacaacaaataaacattcttgcggtatcttctaactaattacacgttttttagatgtcctgtagcaaattttgccaaaaaaaatatgcagggctgacatgtgggccccacgtatttttttaattatttttgctgactaggatgccacgtcagcgaaaccacccatatatactgcctagggagcttgagtgaacggttttgtatagtttaggggtggagatttctggttttgtggttaagggacctcagaaaatctcgctgttaagttgagggacctccggtaaacttattcctatgcctaacctttttcactgagtatgggctggcctctcatatgctgcactaccgttgcactgagtatgggccggcctctcatatgcctaaccttttgcactgagtacgggccggcctctcatatgctgcactaccgtttaaaaaaattgaacactaattattactcagaataagtctattttgcctctcacatctcaaattctatttaatcccaatttttttctctctgccactagcacggaccatgcactgaaaaatcaaacgtttaacaccgctttcttcaacagatattttatgattcagaaatcttataatgaatcaattttaatttgaaaattaaacatctttttttttcgtcatcaacaaaacacgacatattagagtccgcagtacctaattaaaaaaataagtaaagcttccggttaatcattcgtccgtcgttaagcatgggcccacacaatattttgtcgctaatccacaatccgtaagcgtgatggagatctcttacacccacaaataaaagagaaaagaaaaaacagaaagctagcaagcagcccaaccaaagcagtataaggccggcccagcagtctcaacccaacagccagcccacataacagaggagcaccagccagcacagtactgcacggtactgtagcaaccgagactgtagcatcggggtactgtaacacgaataacttccccacagcttgagaagcactcaagcacctgcttaaatatgaggcttgcacgtcgttataaacactgaattataaagtttggactcacgtgtaccagagatcagataaaaatagatgctattttactatttaaaaataaaataaaaaacaacgtaatcaccaacaaaatgatttactttttaaaatataaaaaacaatcgcatgctttttttttcaagaaaaacacgtaatcaccaacaaaattaattgtgtttgcatcaagattgttttccgcgtcaatttctcattcgccgtaggacacctaaccacgtcactttttttttctatttatcgtacgatttccttctgtttttttttagtgaaaacgattctgctactggagtgcagtgagcttgatctgatagctagctaaaaatatttcttctactatgggtactctttatgatataaaaaagtgtttatcaatatcaatgacaaaaaaataaccgtacattgcaactgactcatgataaaaataaatactttttatggtttcaaattttagtattcactataaaaatccccgtgcattgcaatggatgagagttattttaatcttattattgttatactgtttaattaatgtgaaattcactatttaaatttgcttagatatatatatttttagaaagtcataagctgcaattaggagtccgatcatctcaagctagcatgcgagtttttttaaagagatttcttatacgactccttctatgtttccaaaaacgaacaaacttaaaaactaactcaaatacgaaaatgtatttccaaaagtaaacgaagttaaaaaccgactcatacacggatgacgtactaaagtaccggcaaaaaaatttatttttttatattatagagattttatagtggtattaattgatttcttataataatccatgtaagtggatttagagcattcttgcaccgggaatattcgatttgactatgaggagctcaattaaccttggtggctttacactcctcccacacacccattactactttttcttttttttgcttcacccaatgcaacgcatgggcattttgcttgtgtgtgtgtgtataatgcagattcgcactcgggttcatatgtacctacaatctacactgttgatgtgttccaagattcctgctgcaaaatgtagctaaccttaacgaaatgaatgcttactatagggagaaaagataattaggattaggttggttcactatatgtataacatgtatgttgcattttttaccaaataaatttttcaataataatcatatataacatttatatatctagtgcattgtatttttctaacccttattttgtttataacatgatatttagtcaaaatgagaaaacaatatatctactatatcaccaaattgtcatcttgcaaaaatgatatttccaaaatgatatatatcctaccatcaaaaactacataaacaagataatttatataaacaaggtaaactacataaacaagttttgcataagaaatacaaaaattatataaacaaggtattttacacttgtaaaaaatatagtataacatgtatgttacattttgttagcacctaatatactagccttgtgggtacatgtgaacttgcgtgcaaaaaatccaactcttatatatatatatatgataaaagtaacttagtatataattaaagtgatttacaagcataaatatttttttcatcataatataatcatgtaagatcttgatgtacagatataattgcaacgaaacgatgtaatcgggtcgtagatcagataagtaatttaagagaaaaaattatttgaaatttagatgggtaatgaggatgcaagtggcaggtgctactacttttagtaagaagggtaacaagttgattacacactgcactatttttggtaaaaagcatggtcgctggttagcacaaccgagtgcatgcgctccctgtagtcgcatccataagaaaaataatcaaaaaaaaaaaggaaaagtactagaacgtgaggattttatcagccaggcctccgacattgttgctacccaccaaaaatggccaccatcgccccgcttctagtgtggcccttccctctcccgcgttcatctcactaccgctagttccatccccttctccacttctccgaggcgattccccttctccaatccattcattccaccctcttccgatccccaaccgccgctggtccgtatccattccactctcctccgacccctaccgctgccggagtgctaggtgcgtcaggatctaatccctctttgtgtgcttcgtttcctacggcaattttgaattgtttatacaaaattttggggcgcatgatttgacagtgagaccgtgatggatcgatcttgaggcgctgaacgtactgcttgccaaaatttctcggttttgcgtcgtggtgcgggtgtgtgaggagcgttttgcattttaattttagggtatgaatattgacttgtcagtgcataattatatgaaatcatggaatagcattttgtagaaaaaaagaaaatgtgagtcctaggcactgttggcatgattgatagaaaactgtgtacattttttatgatgcaaggtcaggatcatgtgatgagtattaaaatcaggttatggattttcttttcacattatattatctgtgcattcttatgtaatagctttcttgtttatttgacatttatagttatccggtttgatttccctatctatctattgtgataaaaaggatacatggcagggtaccttccctggcccttttcgtcatacttgtttggcttcttgtctcatatgctctttttgtcttgctatatgcgatatgatatgatcatcggaccatggctatctaacagttctagatgctgaaggatgttggttccatggcccacaaatcccaattagttttttaaggatgttagtttaatgtgcatgtgtttgtattctatgattacaataggcttatccttactaggaaaatcctgacacttgtactgttattggttattttaagagcacgataacattattcaggtattcatctgttactattgttccagtatattatgggcatcacatgtcttgactggttatatctgtggcccatatttatcattctgatgatttaacatttactcatgtattcctctatcagggcatcacacgatgagtgttgcaactgaagcatgcccttcaccaaagctacacacaagactaaggctgtgggagtttgcagaccgttacgtatttgaaccagttgacggtcttgctgatttgttcctgtcagttgatcggacaaatggatcaatgagtctagtggaagagttgccacctcgtggtccctctacaaatcctaaagttagaatagtttttggtgtgattggagtgctcaaacttgcagttcggtcgtactttcttgtgatcactggccgtgattgtgttggatcctacttggggcatgcaattttcaaattgacgggactaaaagttctgccatgcaataactcgttaaatacttcttctgctgagcaggtttggaagtgattatttgggccttatttacaatttctttccatccatattccattagtcattccataaagctcttgcagaagaaaatggaatcagaattttcggaacttctggatgcagcagagaggactataggcctgtacttctcctatgatgtcaacttaacactaacgtgggtacctcaatgaatattatgcctttttttttcttgcaaacatttgcctgaagtgtatagagggggttccatctttcttttttttttgttatcttcctcttctttcgttttaagttggttaagcatttatctctgccccttatatgttgtagttcacagaggctgcatgatctaggagatcagtttaagtcacttccactttggagacaggtttgttgcctagctccttacataattccgtggtttgcttgtgcatgaaattcctgatcttttttatcctttcttatataatctgcaagcttctatagcttgtcctcaacatcttcacatgatttataccgctttccttattatggaacctaattgtatatttggttattacttattagatcagtggattacacttgtgatgtagaaagatggaattgaagttaaaattttctaaatgcaatgtgtttcatttggccgatatttgttttttagataatggaagctttattaagactcagttaaatacaccaagatgatacattccaactgagtccacccccggcctctgcatagaatgcacacaaccaaaaaactggacctaagaacacttccccatcacaaaacatagaaactagtggctatcaatccgtagactagatcgccacccatgctcctgggtaaaaaactcctgtgccacctaatccaaacgttgcgataccaccgcaatagtatcccgaagtccctgtttgtggaggatggcccaggagcgtagccaccgggtgactaaagtagtaacctgcaaaggagaagacaccaccttgttatcaaaaattacctcgtttctgcttagccatatggaccaacaaagagatgctgcacccatcaaaagcagatttctcatgtctttaggaacacaagtaagccaacgcccaaacaagtgagtaatattttgaggaggttgtatgttcgaagccatatgaacaacagaccataccaagcgagaaacacgacattgaaaaaacaaatgttgaatggtctcttccttgtgacaaaagccatgttgaatggccgatatttgtagttgcagctaaaaatttttgatgctcaatttgtggttaatattttttcatgagaagtcacgtgtgacaaaattgtaacgatgtgattttccatttaagaaactcaatttataataccacacactcctagttagcatattccttcctgagaaaatagctatcatacaaatccaagcgaaatgaaccaaatgcatgaaagctatatcggaacatgtcacacaatagattcttacttaatttgtaaattatagtttctagttttaaatagactgtcaaatggaagattctcagttcaatgaacaggtccaagaagcaagcagaagtccatagcgtacctagaataaaatattcatgtgcttcagtttaaaaatattttctagatgtacaatatagtatgtttgcttttatttccttgtcctgatttcttaagaaggatgtggtgggagaaattagcaaaagctgatgttacattttgatttttccgtgatgacatttgcaccgtattttagaatattgctaacactgtgcccattggtaatgattctactagcatcctgcaaaatcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16896 - DNA, 1114 bp, Oryza sativa
ttaaaatttaaatgaagaaattcgcaaatatacatttaaagagcatataaacttcaaatggccatatcttggccatttgaactcggaattggaccgttcaagtctctaatttttccttaagaagtcaagaacccatttttgtgctttgtttctgcttgttatatggagtttagtagattaaaagccttttcttttccgttggtcgtgtagacgctgcagcttcggaagatccgctcttcgtggaagttgaagccggcgtttgggaaagcgagcaaggcaagtcacatcatctttgaacatattgaatcccagtttgtaaaattatgttgatttaaattattgcattatcgctttatttaaattcccgcgttatcactgttttatttagccatacctatttacctttgttatgaccttattattgttattggtattatttctttgttcaccctagattaaacaaaacccgaactagtggacactctactcatggtaccactagtatgattataggtagatgcttcgcttttaattaggtaacattaggcggttttacaactctagactttgggaatgttcatatcacctggacactgtggaattgttggagtattgtagaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggccggtgtcctgctgctaggggctcagtcctgcctgcctgtcccgggggttccggccgtaggtgggattgggtcggtactcttgtctatggctaggatgggttggaaactatgtcacgtcttccgtctgtataccgtggtggtatgtggcacgtggttacacgtgaggaagatgtgtcttgtgggtaaagatgtac

SEQ ID NO: 16897 - DNA, 1938 bp, Oryza sativa
ccaacgccattctcacccaaatcctcgcccagcaggccaacatgatgactgctttcctccaccacctccaaaatccgccacaacttaatgctccaccaccaccctcacaacactttaaacttgccgagtttctccgcatccgcccacctaccttctctagctccaacaaccccgtggatgcgttggattggttgcatgccgtggggaaaaagctagacactgtgcagtgcagcgatgaggagaaagtcatcttcgccgcccaccagctgtagggacccgcatctctatggtgggaccatttccaggctacgcagccagagggacagcctattacatgggctcgcttcaccgccgctttccgaagaacccatgtgcccgccggagtcgtggcccttaagaaaagggaattccgagagttgaagcaaggcaaccgctccgtgatggagtatttgcacgagttcaacaacctggcccgttacgctccggaggatgtgcgggaagatgaggagaagcaagagaagttcctggcaggaatggaccttgagctgtccgtccgtctagtctccggggattatccggatttccaatgtctggtggacaagagcatccgcttggaagccaggcacaaggaactggagtcgcacaagcaccgcttggcgaatttccgcaaccaacagggtgctaaccaaagggtccgctacaccaatccctatccagggggatcctccttgcagcagcaacaacagcagcagcaacctcgctccgcgcctcgacctcaattcgtggtgcgcgtcccacagccgcagcagcagcagtatcaacaagggactcgtgcgccccgtcctcctccaccgactgtgcagcttggtcaaggccgcagggacgctcaaggtccgcagcgtctgtgcttcaactgcttcgagcccgggcactttgcggataaatgcccgaagccaaggcgttagcaaggccaagcgcctccccgccccaacaacggtggtaaggacgtcattcggggtcgtgtgaaccatgtgacggccgaggacgtgctgacaactccagacgtcatcgttggtacgttcctcattcattccatccctgctaccattttgttcgactctggagcttcccactcgtttatatctgtgccattcgtggggagaaatcagttgggggtagaaaggcatagaaaccctctgctcatcaccacccctggaggggttatgacagcaaagtattatagccctgccgtccctatagaaattcgggggattccttttccctcggatctgattctgctagacaccaagaacttggatgtgatccttgggatgaattggttggctcaattccaaggagtagtggattgcgcgagacgcactgtcactctgtaccgagggccggaacaaccggttgttttttttgcacccccaacctcagtcagaagttcagaacttcatcagatagaactgtcagaaattcccatcgtcagagagttcggagacgtgtttccggaagaactacctggtatgccgcctaagcgagagattgagttccggatagatcttgctccaggaaccgctcctctgtacaagcgaccctaccgtatggcagcaaatgaactggccgaagttaagaaacagttggaagagctgaaagaaaaggggtatatacgtccgagtacttccccctggggtgctcctgtgatttttgtggagaagaaagacaagacaaagaggatgtgcgttgactacagagctctcaatgaagtcaccatcaaaaacaagtaccctcttccccggatcgatgatctgttcgatcagcttaaaggtgccactgtattctccaagattgatcttcgttccggatatcaccaattacgtattcgcgaagaaagatattccgaagaccgcattcaccacgcgatacggactgtat

SEQ ID NO: 16898 - DNA, 1453 bp, Oryza sativa
  unsure (1)..(1453): unsure at all n locations
nnnnnnnnnnnnnnnnnnnnnnnnnnnnnnnnnnnnnnnnnnnnnnnnnnnnnnnnnnnnnnnatatatatatatatgggggacactcatatggggcaccatggtgcccgggcaccatggtatctaatgcacaaaatcactcaaatttttcaaaattttcaaattgtgagtatatacctagttataataattcgattcatacctatacttatcaacaaaacaactcaaatttaactttatttcacaatccatgattacatatctaactaattatatatatggatgctatatacctataatcaaaatctaacaaaaacaagttcaaattcagttcaaacttgctttgaactagttagtaaagtagttaatgttaatacctaagtaattgaaaaagtttcatactcatttgaattgggtatatactcaatttcaacaatggtgcccgggcaccatggagcaccaaacaaatttactatatatatgtacatatatatatatatatgtatatatgtatatgtacatatacatatatacatatatatgaaaatgtcgtcaacctaaaccgacaacatatgctgtgtcatattgtcggattcggctcaatcggctaaccccgtccgactcgaactctgtcgatcttagtcgtagccgattcggacttcagccaatcttcactctgtttccgggacaatctctatctcgatttccatctcaattcctccttcacatccgatccttggattaccagatttggtcattaacacatggcccccaagtctggaatattggataatgtttcggatttgccatacgccgactccgagagaaatccgcacttgccgtttttcgaccgttacacagtgctttaaatactaactgtcatccccgaaaaacttcatccgttacttccgtcttcactgccttagccaactttgtcctctctctctctccggcgatttccccgacgcgcaaggcgatttccagacgttctcatctccggccagatttccgcttgcaacgatgttgtcttccgccagcccgtctgccgtatcatcaaccgagtacgcgggggtaagttctcatcggctagatccttctttttcgcaatagattggttttcctcttccttatcttattttcccctttctctgttcttttggatttgtagcatctctccaacctggttgcaattccaagcctatcccatgaaaaccattactttctcggcccaatcggcaaccttgatcctactgagttcatcattggccagccaatagaattcctttcagattagccaacccaaatctaggtcactggaaaaatacttttaaatcttggccatctcttgagaaaacttcacctgagaagagctggattacatggtacaagcgcatgtcgactaccaagaaagttcactgggacgaagggtaccgagctcgaattcgccctatag

SEQ ID NO: 16899 - DNA, 782 bp, Oryza sativa
  unsure (1)..(782): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgtatgcggagttctcttacaacaccagctatcaggccagactacaaatggcgccgttcgaagcgttgtatggccggaagtgccgcacacctctcttctgggatcaaacaggcgaacgtcaactgtttggaacagaagtgttaacggaagcagaagagaaagtcagaaccgtcagagagaggctgagaattgcccagtttcgacataagagctacgcggacaaccgccgaagggagctcacttttgaagcaggggattacgtgtaccttcgtgttactccgctccggggagtgcaccgtttccagacgaaaggcaagttagcaccacgcttcgtgggaccatacaaaatcttggaacgaagaggagaagttgcttatcagctagaacttccatccaacatgatcggcatccatgacgtgttccatgtgtcccagttaaagaagtgcttgagggtacccgaagaacaagccgattcggagcacatcgacattcaagaagatctgacttatgtggaannnnnnnnnnnnnnnnnnnnnnnnnnnnnnnnnnnnnnnnnnnnnnnnnnnnnnnnnnnnn

SEQ ID NO: 16900 - DNA, 652 bp, Oryza sativa
ccatgttaattgagacttcaatatttaatttgtggtgcagatttgtttgaggtggatgtacgagcagggtgatgttttgttagtgaagacatacaatgaaaataggatgaaggagaatcttgatattttcgactgggagctcactgaggaagagagagacaaaatcagcaaactcccccagcagaggggtctgactggaatgcagttcgtctgtgacaatgggccttacaagtgcgtcgaagatttgtgggatggtgcttaacatgtcgcaggctggccctatgcaccaataatctggatggatcatgcttgctggggatctagcaaaataatttgtaattcaattttaatcttctgtcttctcgcaaaataattgtgtgaaatggagcgccagatgtgctcaattgttatctttcttctattcgtaatcgataaatatggtattttccaaaataatattgaaatttcgagatattgataccgaacatgaatacttttttatctagcatttcttaaaaagtcatcaatagatatcatcttggtcacagcctaggatggtcgtttcaggttgatgtatgagtattgctgcaacgattttacctgccgcattcaattattctgttcagtattagcttgttatgaaaatggaaca

SEQ ID NO: 16901 - DNA, 22173 bp, Oryza sativa
  unsure (1)..(22173): unsure at all n locations
nnnnnnnnnnnnnnnnnnnnnnnnnnnnnnnnnnnnnnnnnnnnnnnnnnnnnnntattggatatctgtgtttgtttctgtcatttttgcagcggacatggctagcaaaggcctgaggctagccaaaaaacaaaatttattttttttgtggattatagtcatctgtgatgggccacaactaaatgcccgattgagatgaggtcatctgtgacgggctctagcttaggcccgattgaggtcactagtcatctgtgacgggatctagtttaggcccgattgaggtcagcagtcatctgtgacgggctctagtttaggcccgattgaggtcatcagtcatctatgacgggttatagtttaggcccgattaagatgagtatcatctgtgacgggctctagtttaggcccgataaaggttagtagtcatctgtgacgggcgctagttgtggcccgatagagataggtcatctgtgacgggctatagtttgactggtcgtctgggtcaaagctatcagtgatgggctttacttaggaaccgattgagatatattcattcgtgacggccgtttgcccgattgagataactcttcacatcagtgacttctagcctgtgacggacgctgtgcccgattgagatggggcttaccgcccgattgagatgagggtatccgttctagtgggagaatgtgaagcaaagaccaacgacgaccagcacagcttaatcagaggtttctcacgagtttaactcgcgagagtaattaaccaggtgtcttccgagaccctgggaaacaggagaacacaatcgccaattcagatccaccttgcctacaggccatagagagcatttgaccaaggattttgtattttttaattctttgagaattataataaatgcattttccttcgtctattttatttgtgtacttagtacactgcacgcccgcgcatcttattttattttatttccctgtgcggagggacgaaaatttattttttctctccaaacactttatttcttgttaattgcagaatcaaatcaactggcacgctcacgaacctaatggcaagatttttggacctgcactggagttaagcagatctctcaggcctcgtgtttttcgcatcaacacctatatgccattttatgtaaaaaaaaatgatcataaaaatccaggtttggttagatgaaagtaaatgaatagttttggtactggatttttggatggtgctctaagagcatcgccaacagatgctcagcatggcttctaatctcaaaattttggttgttttaagtacaccccaacagttcccctcactaacttgcaaatgaaatccccttccctatccttctcattcttcactaatggggagcacgccggtttctagtagcacgcacgagatgatgagagtgacacacgggaagaggcgggagcgatcacaggggaccgatagtgactttctttatccattggtagttttcgggcgaaatattttttatattagtagatgaaacctcgtgcagaagtttagtatgattacagtaacattaatgtgtaatataacacatctagatactggagaaaccatttttgatcggttgccaaaaagccacaatagtcccggttcaactaaaaaccggaactaaaaaccatttttagtctcagtttaaaagtgcacggggacttcatgatctttagggcctatttggcacagctctatctccagctccaggagctcagccaaacagtttcagatccaccaaaactaggagtggagttggataaaactctcacaaaatgtactagagttgtggagctgggtttaggcagctccacaactccactccagactcaactcctagagttatatttaggagttggagctgtaccaaacaggcccttaatcccggactaaaaatcatctttagtcccggttctatttgtgttagacaacgttagagcaccgagaaaatagatctttaatcccggttgatatcaccaactatctccctcccacgtcttaaatatatcgaaccaccatagacttagactttctcatctttatctctccactatctctttttcctctatccttatctctttccttcctctaactccttatctctttcccctatcttttctcagcgtaggactaaaaacttgtttcacaaaactacagatttaatgccttcatttatcataaaactatatgtactttgcacaatatatcacaaaactacagatttaagaacttgtttcacagaactacaaatttaatatcttcatttatcacaaaactacaggtttagtactaaacttatagttttgtgaaacctgtagttttgtgataaatgaagacactaaatgtatagttctatgataaacaaatgcactaaatttatagttttgcgaaacatattcttaaatatatagttttgtgatagtttgtataaatctgtagttttgtgataaattgagacactaaatctgtagttttatgaaacaagctcttaaatcttaaatatgtagtttttttgataaattatgcaaaatacctgtagttttgtgaaatttactcttaaaacttttacatgtgttcttaatgacttgaacgccaatgttgaaaatgaaactacgataaaaaaaaccctcaaaattaactcgaaaattaaattttaagattcacattttagcatcaacatatatcatcaacatatatgttgtagggtaaaagatgtggcccttgattggtaccctcggtcacaggatcttgccgccgcaaaggccgttgcgcgaagctgccaacgctgttgcagccagcgccgccgctgcactgtagccatcatgtgaaccgccagtcatctctgcagcttccacttcgctgaatagattcaagagcttatttggatagattttagtatgcaaattatttgtttacggaaagttggcagtggatggattttgtttgaaggggcgatgcatgattgcaatggtagcaagattatcttccgatcaacatttgattagcagtaatcatctaaagcctaacccaatttttcctcagacagctgtgcgaaaccaaacaatcaaaagagacatgctgcctgactaggcaaaattcatcatctcgggtggctctctggcatgcaaaatcctcaggcatatggcaccaagacaccagccaaacaggcctttaaacggttacaaagttctcaagcttgacaaatggatggatatgatgaaatttagactcacataaatgtctctgcttgtacctacagtacttctgctatggtaagtaataagaggtagggaaatatgatactgaagattgtcatgttatcactccctgttcctctcattacgtatgggacctaccctccaaagaatagcttggttaagcacatactgtcatttcttgccttttcgagccaggtagcgctcgcgagctgcctgtattttactgtccacgtcagattgtttaacatccattgctttctttggggagcttacttgtttatcctctagaggttctggatctttcgatccgctggaaccaccactgtaatataattgagattattactgtagtagcataaattgccatgttagaaatagtaattattttaacccatatatttcataccttaatttgttcatgtccaatctttcaagcttcttcaatataggtttaacccaagactgatccacggcactaacatttctcatgaaaggacgagtagtatttattaactcatggtagacaacatataccggcagtttcccgtattcatcaccttccagtacggaaaatggatgcacctgcaaaaagaatatataacaaactgtaaagggtcaacagtaattaagtttgtaaactaaagaatgtagtcaaaaccaaaatgacaaaattctacaaaaacagcttaaaccagtcactgtgagattcatgcgttcctgttgcatgagacaactattatttgcagctaatatccagcatatctaaaatactttgtcgacaattacccgagaacaaactgcatactctcagcaaagcatattcagcatatctaaacagttcaagtagcaactgaaagtttcattggcttctacatctagtaaaaagtttggcacaaaaaactgctacccttttggtttggttaagctggctaatgtttcattcgccagaatcatctcaatttacccttgccatttatgcttgacactatagcaaaactaatctgatagattgcagaagtcaatacctgcactagttgtgccctgtatccaaccgtatgataaccattgtgatgcagcatcctctcagcgagctggttaccatatccaacacatagagctctccttaattttctataatcagggtcactcttccgctctttctttgcttgcacatctgttgaacctaaatttacaaaaaaagaggtaggtttagtagtttttgatatacgggccaaacttaaacatagtagttgagtgaacattggaatacgtaatgcgctgggctctggatctattacatattttggttgcaatacgagcaagatgagttcaggttatattgcatctgtagtcgagcactgcatggatattactgaggttctagaggtaggacgtacatcttcatggagggcatatgtaacaatatctttgtggtagttcctagaagttaaaattcaaaaagtagaacaacgaattgacaaaagaggaaaaaacagctcaacaacagaggtgtcccaggaaaggaagaagcaaacaggtagtaggtttttgaaagggtgggtacacaataaaacagaaactagaattactgatcaccgaccttttgcaattttttgaataatctgacttaattggtttctcacatctttgctgaatttcatgcctctcacctgcaaaagatagttctgtgatctacattgtaatctaatgtctagaaaactatctagggggtataaagtctgtaagtatcatgacaaacagtatatgcaggcatatagatatgatgatcacacaatgttatccttgttatatgtttcaaagtttgcattgctagcatgaaaactataaatgctaaaaggcaatttaagatgggaacgtatcatatgcacacaagcttccggtgcacacttcatgcacaccaactaacaaatatctccaaaaattctagaaaaaagtagacttgtactctcaattgtattacacctatgtgtgaaatctcatgtttgaattaattatttttagacgtaacataaaagacaaaattctgatagtatactcttatacctgacagttttttctttttttgctacggctaaaatataatgaattttcagatgagactttacacatatgtgtaatactccctccattcgaatttgatcaacctatttcacctgggctccagactaaggaacacttgcatgcaaaatgagaagacgagcagccaatttttattcaatgaagcatcctatttttgctcaattgattggcttgaatgagaaccgaagagccaggcaatccttgcatgccaaagcaataaatctgcatgcaaaactgattggctagcatgtaaatcaaagagccacccaatccttgcatgggaaaacaataaatttacatgcaaaactgaacagctaccacatccttagagcaagttcaatagtatagctcactactagctccaattcatctatagccaatctaatagccaattcatacaatagttgcttactatactattaatatatggtcccacctgtcatacacacattgtgtcttggagtccgtgctgcagctggctacaaatctgtagcccgctgctcttctctctcatcatttatctcattaaaatatgtttatagccggctaatagcctgctattgtacctgctcttatgcactgatcaattctgaatgttttgcttttgcacttatcaattccaaatggagggagtactattaggattgcatgtccaattttttctagaattttcgaagacatttgttaattgctgtgcacagagtgtgtatcagaaacttgtgtacataggatatgttcccatttaacatgacatgcttcgatgacctatttaaaataaaattcaggtattatatcatgctttgtgattcggcttgttctatgcaggaaggtccaacacagttgcatttatttttgcaacactagtacttaataattttattcctttcactgtatcatattagaatcaaaatgttattttcattcacctgcaactcatgatctgagcaccatcttggatcatagcctgttcgatcccaactttcaaatatctgaagcaactgtatatggtcgccccaaccagaaccatcaggaagctcttgccttttcctctttccctccatgtctttgctgtaagggtgcaataagttcaccataaaattcaatgtgttacagtagcttagatgaattacaaaacaaaatgcccaccttctagttgaccggaatgtgatttcagctgacagaactgcagcaacagtcaatgcctgagatagacatcccaattcgtttgcttcaatcaaagtccttgaaagagaaggctcaagagggagctctgcacacatatcacgggacaacatatcttgcataagtccataagttacttgacactagaattttgacgtactggttcttttctaaacaacattccagcaccatcaaccctggtgcagctgtgcgacgctggatcccgacgtggccatgggtcaacatcaggtaactggagccaagggttattggcaccaagtctttttaggcagaagggggtgcgttggctgccacaaaaatttggcatcacccttgcacattgtgtccatcacaaataatttatctatcagtggcatacacacaaatcatatccaacaaacagaattcatcacatgtgaataacagtccatcatgaagccatcataatttatcacacactcacaatttcagcatcatcgctacccagtacccactaggttctgttatgtactccagtacagataagcaattgcaacatttctagtaaaggggtaggaataatatagctacttttagatgggtacaaattactctgtgggtacccgttgacccactctagttcaacaaaagtaaaattggttttgttgaaccagagtcagtcaacaaggtacaaacagagtgacccacacccacgtcatactcctatatctactacaagcaccatatttagtctagcaaatcatgtcgcgtacaatcataaaatacaatagcatgtaatgggcattactaagataagggccttaggcatagttgacccaagtggcacattggcaccatggaggctgtgtaccacaagggcaggcaagaagatggcgagactaaagacacttgtttatctcttgcttaatgaacagaaatacagccccatccttatattgcctcttaagaaacttatatctaagatcatggtaataaataactcattaatctaaattaaagcaatcacgtgagcttcatacgtttgaacagtaaccacgcgggtactgttcatgtgcgcaatgctgctggacctggagatattgaccactgcttttatatgggaactaatgggctcagatgacataggtaaacaattggttatcaagcctagcaacatattgcaggatttaagaagttatgaattacaagtaaaaatctcacaacagttttctcatataccagtcatgtaagaatgtgacctgatggaacactggcatgtgaaaagaatggttttcgaatatatagttgacaacttgatacttcttccttccattataagtcattatgggtttgtcctaagtcaatcttctattcttctataagtttaaccaagttttacagaaaaatgaatagcaatattttcaacacaaaacaaatatagtatacaaatagtaatgaaactaatttggtgttgtagatgttattactttttttctataaacttggtcaaacttgagaagtttgacttatgacaaacccaaaatatcttacaatatgaaacagagggagtattagacaagttactagttgcaaatacaaaattttcccaataaatatcatatatctagaaaattagaagcagatagtacaaaactgtggaaatttccagatcattacaaaagcaacagcttgttcccaagacaggttctataacattgtggagatattcaaattccaaacattatatagacatgtaaacggctcatactcaagacaaaacaagaggaaaactatggccattgcacagggaacaaatcttactacacaaaaactcaccagacattaaaaaactagacgtgcccacgcggcgacacgccgcgctcaggcaattactcgtttcacttcagttttatttggcctaaaagaatactaaaaatattttatacacatgatgacaatccacacatggctaatgtaagataaaatatcaacttatagaaacttgatgatcgcacatccacacatgatgatcacagcacaggttaatatcaactatcatataatattgcttatagaaacttgtaaacatgcatatgtgccgtgattaactaaaaaattcactctttgttgtaaaaacccctaaaatccaaatatgctttccgttcgctctcatgtggttccatattagcctgttgttccacttcaaagcattaaagcaagcatagatatagtacgttttctagcttagtaaactagtctatgcccaacaagcatcttgcgagaacaaatccatctggttcattgctttatcagttgatcagataacagattaggaatggagttttccttgacctggaattgcacttagataagtgtaagaaaccatggcactaccttgaaaccgaaaaaagtgcactatacactcctgaaggctgcttctggttggaaaccagtggaaaagacaaaactcgagatactatattttgtagtgtaaaattttgatacctcgagatactaattttacataaaaatttttggtacttcaacatatttctcaaggatggtacaaaaaaacccaaactcataatcttttaaattccttcagctcatggatgagatgagaattattgagatttctagccctgtagacatttcaggctacctggcatggggtatatgtggacggattcctgctgctaccttcatgctcaatgaagaggcaacaatagaatcatcagaatcatccagcacaaactatatgtagcgccaagcaaccagtggcatacccgcataagtgcaaagcaaaattaagagaacgatagcaattctatcggagaacacactgtgaagtgtgaacacaaaaaggatttgagtcaacgggaggaaaaacacacggttgtagtataaggaaaaaaaactgtacaaattataaaagtaaaacaagaaacaataaacagaccattgccagcttgaagatcaaaacaagaacggcaccgaacagcagcacaacgcgacctagcaaccgaagatgacaacacaacgttgattaaggaaacgtaacatacagcaagcatgaaaaactttgggacgatcaaggctaaatatatgaaagggaaaaagaaaataagaaataggagtagaaacaaaagggttgggagcagccacgtaagacagcatgggcacacccacgaggctacacacacaagcgcatggcaccacgtgcaggacgcatgcaaacacaagccgtgcacaagcagcagccgaacacaccaaggaaaaaacacgcagagcagaaataaccaggtaagcaagtcaactacaaaaattgtaaaaacccaaagaccggcacgtatacgaaacccctgtagaaacgtcaacaaacaaaactggacaccagctacgtcattaagagaaaaaagagccagtcacagctaggaaagaaaacagtttaacacgcggcaaacactggaggggtaaaaaaaaaagaaaaatccccaaaacgcagtaatctgaccggaggctactaggtaagtattcctgttagaaataccaataaaacaacaatgtcaacataaactgcctgaagctttgcacaaaaacattagacctcttaacagttgtatatatcagacatttctgaattgaaatatcaaaacattgccaggtatggcctccttatatagaacattagaggttagaccgttacatatttaagagtataaacttcttaaaataaagccaaaaggttaacaaaaagaagatgacaaacacagaaaatgatcatccctgttcatgctgccgctccacacatcaacagttacttcatgtgctggatgtgctaacagagtcatcaaaaacgcacatgcacatattgaactaaagatacaacaatattatattggtatgcaacaaataaaattagaccatgtgaagttcaaataaaagaaaaagaaaccagatatgctcgtgatttgatcaaactttaattgcatacattgttcaagagtgaagacaaactcaaataaccacctgatttcatttcaattgaaatgggacaagcaagctgagaatacctgccataattcgtcctacatctgttatttgcccattttcatcaattgcatcgatgaggtataattgcctcaaagcatcttctaatgattcacctgcaggtcattgtgcatcaaaggtaagagatagacaatactagtttttatttcacaagacaatttgtacaggcaaagaagtggatgcagtttcactgaggatctcctgataccaaacaggaatagtaagctactagttgatatccccgcgctttgctgcgggatatgtggatgaatgcatattgtacattgtataaatggtatatgtatatgtttaaataatgtaaaaatgatgtggaaataatgatttgacattgcttgcatattgagttctaaaaatacaacaaaattgtaaatgatatgtcatgtttgcatgacatttaaaatactctagataataactgctatggatgatgatgtggtacacttgcatgtgatttaaaatattctagataataaatgctagagggtgatcatgtggcacacttgcatgttgggctttaggagttagcgggcatcaactcctaaaacaggtgcatcaaaagatattatcataatccaccacagtgccaaatggagcgtaaggttagtactctctctgtcccattttaagtgtagccatgattttctatgtccaactttgatcgtctgtcttattgaaagttttttggaaaaaaaattataaacataagtcacacataaagtactattcatgttttatcatcttataacaatgaaaatattaattataaaaaaatttcaaataaacggacaatcaaagttgggcacgaaacctcatgattgcacttaaaatgggacggaaggagtaggtcatatgccttttgaaataggctcgtccagccaccatgaaagtatttgggtggaggctggacctagaacaataaatgtaataacttaagttaaaccatgcagaaccaagattttaccaacagctacttatgttgtgaatagcactacatttgtattcaaatatatggcaattgactttattcaatctttggtgtgcaactttgaccactacttgtctattagaatataacgataatatctaacaaattataatattgtaaaagtacttgtaaagaaaaacctaccgatatgattttttatgttttcaaaataaatattttgagagctattgatggtaaaactttccaaaattgaacgaataaagtcaatgggatcatatatttatatacgaagggagtatatatctagtttctgtagattagggtgttcttctcgttttcctttgccaatggccgttgtctatgtttgccttttggagctaatccaatagataaagtgatttctaacaacaaaaaagcattaaagatggatgaagattgaagagctataattaagaatagagaattctggagttttatcttacgagatggtgggtcaaggaaatcaaacttcagtatgttgatatcaggtagatctaacgattttagatacaaaacacttccggcaagagaagaacgctggatttctgggattgtagcctcgagaaactccttttgataaatggaaattgggtataacctatagcacttcccaggccgagttcttccagctcgcccagctcgctggtcagcctgcactcttgttattcaagaagtagtatggtaaatattatggatcataactagatatctctgaacaggatcatgatctagttgaacagatgaagacagtagacagataaccacagtgtgtgcaacatagtatttacctgctaatctgaactacgtcaagtgaatacattccagacgatgggttatactggcgttgctttacataaccacaatcaatcacaaacctagtgcataaaaaaatattttagtgatttgcatacaaacccaaaagaaaaaggaaaaaacacgtctccaagaacaaaattgcagccattccaagttcagcagggtaatagaaagattgcaaattttgataacgcaatatcagttcagcagtttcttatttattaacaaaacagctaatgaaatcacaaatgttcatcagcacattattttaatcgtaacactaatttctcaggatgaaagatcatactcaaatcacaacttcgtacgtacattaaagagcgagtggcaaagctatattcaagctttttcctcctagacatgtacaaggtatctccaagttatgcatatttcttttatataaaatcaaatagataattagtttgtgaattcaacatataaaccatatatttttttccttttaagtttaagaatataagcattcatgtgaatttaatgatattatagccatttgctcctaccatttttttttacaaaaatacacttcaaaaactgatactagcagatcagttgatgtaactctcataaatttaatagcatgttactagtagttcataacaaaaattctagccatttccttgcataactctaaaaaaagtatttatttgcatatacttttccacaaaatcagctaaatacatcataaacacaataatctatcactaaataaataaaaaaggctgaagatggaaactgaaagtatatgtgcactttaactgactatgtttgcagtttgctgcttacacaacaccatccacagtaagagatgtttcagctacatttgttgcaacaatgaagcgtcgacaatttggaggtgctggagcaaatacccggacctattgtgacaagggaatacatcagcaatgatactatagagcatcaaacatttaccaacaaatggaatgaaggacaattaatgaatataaatactaataagtgtgcttaaacccaaaaagattagaccaaaacagcagctttggcaacaaatcgggatcgaccttgcttttcaactctcagttgagcctattataattcgcatccatcagtgcatccatttgttagaacgtgatccccaggtagttaaattttgctatcatagccatatattgttagggggttggttaaatatcatccaaggttatcctgttgcagcaatgcagcaagcacagaataaaaaagatactctagtcccccaagaaagtcgatcaacagcaagcaatacacacaacaaaaaaggaaaaataaacattgaaatattcctagttggcaatttttttcagtgacatcacaaaatcttacaaattttgctttaatataatctactactagataagtaattgtaaggcttgttcagaagacttttgcctgctaagaaatttcacttagctgcaatagtgtaggaactgtacattgcaatgccaagcttcattgatcaattagagaaatggagaagaaacatggccaggtgtgtttattaggttcagtagctatggatcactagataagctcatatacgaaaaattaaattgattaagtaactgaaagattaaaatatattctctgttcaaatttgtattataatctaaaacatacactcaaatttccttaaattcaaacatcagtatataaaaaacatatttcaggtgaagttgacattatcaaatttgttaataatagtatttcacactccgtctattctcaaacagatgatgttttagaacgtgtgcagtcaaaccttggaatcttgactcataaacaaatgcaaacacctcctaatcgctataagatttataggtgaatgacattaataggcctgtcatgaagaatacctaaaagatttataggtgaaaatgaaattaataggcccgtcatgaagaatactttcatatcgctatcaataatgaattttatgactatgtcatgtcccaaaagtcaccaaaaaagaacggaggtagtaatataaaagctccacgaaattttcatgagcataatcaaacaaagtattcaaaggcgcatattggagaccacatacatgtccaaaatgtcatatacaagcattcatgggatgtcatatatgcaagaaacaaatataacaatacactagaatggaagattaatgaattacctgttgttcaggtggcaaagaaccgtgaagtggaaggacaagagcatccatacaagaaccttcctctagattttgaattctttcctccaattttgataccatcttatcaatgtcatcctgacaaaataccattcaattaattcaaaaggtctgtgtaagtacggagtacaacaaaagaaagggagaaaagtttagcaaagaaatggagatcatccattgatccataaatgtttagttaatcagtgttccaaaaacagaccagtaaacgttgtgtttttttgccatactagtaacatgcccatgcattgcaacatgcccatatgattagaatgggttgcatgggcccatatgactagggatgggttgggagtgtgaatcgagacccaaccacttatgggcggtggggtgagagaagggatggagggagaatcgagatacaactgattacacgatggaagaagagtaaggaggaggactccgcttttaagtagtagagatatacaataaagtaaacacggggctgttttggggcattaaattataactagatgaaagcccaaaaatccaggagtattactgattttatagcatatctctgacgatatccttagtgtcaaatagaacaaaaaaaatatccttcaaagtttcagaaacatcaagctcaagcatgcaaaaaaaatatatattctgctaacctttcctgtcatgaatattaagacatcaccaggggattccttaacatgaatatctgttgaagaaaaagaatgtttggaactgttagaaacactagctaaatacctgtgatttgctatggataaaaatgaattatacatgtgctaacattgtttggaacaagttaattgtaagatttttggaacaatatcatccctgattccctgtggatgtctttgcatggtaaacataaattctagggatgaaataagatattaacaatatgtagaagtactgttttataaaattaaagtacacataggagtagttggtaaaaaaatacaacagagttggtgggtggcagattcactgccaccaccattgtcttcttttaaaggagtatagatatcaaatagttaagcaaatatgaaacaccatggcccaaaagtttaacaaaatatattgttattattttcaaataataaaaaatttgatttttccagcatgaatataaatcatatgtcagcagacatactcctctgacactaatatgtgtatttcgttaaaaaaatcatggtattgttaaggcggtaaggcgtaaggcgaggacccagcacaccttacaccttaggcagtaaggcataaggcgaggcaacgccttatacagatagaaaaataggaaatgaaagactttttcgtaatatctagagtccaaggattaaaatggaagatgaaaataggaaatgaaggacttctttgtaatatctagagtccaaggactaaaatggaagatggtgacagatatttatctatccatccccatccccgtccccatccccatcctcaatcccatcggcgccacctactccctccgctccactgccaccgacggcaagacctctccgcagccgtcgcgtccatcccctctggtcctccctcttcccctgccgccaccgctcctcatcatcaggtggtgctgggcatcgaggaaggtggatctggctttgccagtggtcggcgacgacagcgacaaccacataggtcagctattttcattcctcccccttcccctgctgccgctccttctccaggattggcttatccccttgattttgccctttctctagtttttcccgtaaagcggaggcagcgccttaccgccttaggggcgccttaacaaccatgatggtatcccaagatatggctttaaaaaaagtagttttttaaaatgatgttttataatgttagtaaaaccagtgcggagtgtacttaacataaataagagccatcagatacagacacatcccaaattcgccagagctttaaagaggttattcataggtgtagcaggtccagcacttatttcatcttttttttttacattatttgtccatccaacttgaccatagcaggacgaatactgtaagagagattcaagggaaactggcctagttaccctcttgccactataatgctagcccattcatgggcacatatcaaaaccatccatgacatttgttacatagcttatctgttatgacaatgattgatgtattccagtagtgaaataacacatagtgacttaatagagatgcaccaacaatattcacatgtcattgtcaaggtttaaaatatagccacataaagaaaatgataattacctatagcggttctcagagaagattctatataattcgttggatgttctgtgctgtaaaacttctccacagggaataaggttccagggatattcaacacaggacatccagagaagaactttgacactttcaaaccatcaagagtagcagaagtgatcagaactttcaaatctgaagctcgatccttaattaatcgtttcattaaacctagaagaatatcactgtaaacaaacaaatatcagaacgcgactaaagctttcaacaaatagcaacaaaatccagcggtcgtgtggccgatgccaaacaagaaaaagttagtactgactatcgatcactttaaaaatacaattgctagcttacaattgaagcatctgagaaccaattataataaatatgggcaaaatatggagaacgaaaaccacagtaaagttgcatcctacagttagtaaatagttactaggcatttgcgatccaaggccctcccattcaaagttgtccaggtaaacatctaatatagagaactatcgattatatcaaagtcaattttgagaacacatactagatgtctacattacttgtgagtgaaaatatcgtataggtactaattcctagcagtagagaaagaacgcatcagaagaaaaggcaaaaaaataagttgatttatataaaataggtacaggaagaccaaatataaccaatacatttatgttgactcccagtttcatggcacacagaatggcttcccagcactgttttgttcactgttccaaaaaccggacacataagcaacaaaagttcaacaggcatgcaatcaatcttgggtaaatctatgtagtgtataagcaacaaaagtttagcatattactataactaaatgtagtgtatgacccattcccggtaattatcttattttgttttcaaatcacaagttttcaattcaaacaacaagaaatgggtgtggaataactgaagagtaagcagcaaacttgataaagtgctaaactttaattcaaactcttatagatcagttgaacatataaaacgcatacgtgtttaaactgcgctcgtgagcttcatccagaataattactgaatactgcttcaactcagggtctgaaaggctttcgcgcagaagaacaccatctgtcaggtacctgcatatccgaaaatagaatgagttcgcatattgttcaagaagaaattcaagtcacataaacaccctctgaggcttactttatgcaggttttctctgaagttctatcttcaaatcggatggcataaccaacttcatcaccaaggggaacactgagctcctgtgctactctcctgcaaatattcagattgccagcattcataatggcatcctaaaaaacattttccacacttgaatataggcatagcacaagactacactggaaaactattcttctctgtacatgtataaatatgcatatgctgtaaacatagtgctgctcgccaggaagaaccacttcaaaatttcttaacaagcaggttcttaagttttctccccttaaaacacttctaaattaaaataaatggcttggctatccagaaagcagctgcagtttttacaaacgatgttctcgtatctccaccatcacgattctaaatttcaagatgaatctgcaattttcgtatcccttaagtgctaatggccaaaatccaacacatctgagagcttttcaggcataaccagacccacacgaacccagtaagaatgtaccctgagctaaaaggaaaccaacatttgaaaataacaacatgaatagaaagggggaagttgtactaaactcccaggtagcagataacaacgagcgcgcgcaggtgcgaccgtgccaccgtgggggaagacaagcgaagcacggagtcgggttacctggaaaccgagacggcggcgacgcgacggggctgggtgacggctatggcaccacggcgggtgtagccgcggcggtggagtatctgggagagctgggtgctcttccccgagccggtctcaccgatcaccaccaccactgggttcgcctccaccgcagccatgatctcgtcctcgtgctccgagatcggcagctccggcggcgacggctgcggcggcggcggcggcgatggcatggcggaggaggccgctgggatgtgttagggttttgatttgtttttgtttttcctcctctctctctctctctctctggtttttccggccgttggactgccgcccggtgatgaaaggaaaaagtccaccgaaggtccctcaacttgtcatccagttacaaaatcatccccgaaccacaccaggtattcgacgtacctcaactcacagagccgttcattttaggtccctcggaccccagttttttcctacgtgacggctgagtcagtatgagacccatatgtgcccacatgtcaggatgccacgtaggctcctctcccttcctttctctctcacttctcctctgcaggatcacggcgggaaggggatgagtgcaggcggctggcggagaaggaggtcctgcgcggcgagtgcggcgtgcgtgtccgacggccaacaggggaggagggccagcgcgacgggcacggccggtgcccagcatgggaggaggccctggcccagcgtgtgcggcgggggcatctagcagccggcaggggaggagggtcgtgtgcggcgggcgtggctggcggccagcaggggggagtgcagtggaaaggagggccggcgcgacgggcggcgaggaaggagcggggctaggctgacgatgggcggggagaggagcggaggtggagacggacgcggcggcggcgccaccggcgacagcctcttcctcgccctcgccttgcgtcgtctcgctctccgctctgctcgacgggaggcgactccagcggtcgcccgcgcgtcctcctaaacttggcggtgttggccctcgttggcagcagcgacgctagctggcgaagactagcggggaaagaagcagcggccgtcggagaggagcttgacgttggcagtggcagccatcggctagacccagtgggcgccgtcctctgccaggaacgcgtagcggcgagaccggacgtcgagcccggcgggcttgtcggagaggtcgagctcgacgcccatggcgtgggcctgctccccgtttccgtcgaagaggaggagcacctcatcacggcggcatcatctgcgactttgcagactcaccggcctccccgcttcgccccgtcggcctccttcccacctgccggttgcggtggcggtgccggtgggggcggcgtggggggaggccctcctggtccggtgctcccgcgccgtcgcttcctctcatcttcttctccaaggccactataaatacacaatacacctcgccatgaacactcccaggcccagcacacagcaaagcagcagtagcagtgcaagctcgagctagctacaagtacaagctagcagcctagcaaagctcgatctatagcaatggcggcgaaggcggtgcttgttctagcggtgagcctcctcaccatggccgtggcggccagcaccgggtcgtcgtcgtgcccacgcgacgcgctgaagctgcgtgtgtgcgccaacgtgctcagcctctgttgttccctgctgctcgctgctcaacgaccttcccccgcgtcacagccgccgcccgctgcctcctcctctcctgcctcgccctggcggcctcctccctagctgctggccagctcgcctagagaagagaagagaagagaagagaagagtgagagacagacaggaggaggaggaaggcagagtggagaggaggggagaaagaggatgatgatgtggcatactgacacgtgggggcccacgtgggtcccacgctgactcagacgccacgttggataaatctagggtcaaaaccaccgaaggacctaaagtgaccggttttgattagttgtgggacgccggatatcttgttttatggttcagggatgattttgtaactcgatgacaagttgagggaccttctgtgtactttttctgtgatgaaatgaagtttcggcctcctgggctcgtaggcttctcaagcacaaatgttaacaatatggcccattcgtttcccttaattggatccatgccattgtaaatatgccatattggaaaaatgccactactattcatgaaatcgggtatgtcggagatatgggcccgggggtatgtggagtagaggagaattattttccttccggccacgtgactccgcaggttggccccactcgcgcgccacgcgagtcgtacaagcgcgggaggggggggccttggggcatgacgtcaccccctcgggctctcccgcggcttcgccccgaggccctcgctcggctgccgcgcggcagagagagagagagagcaagaagggagcgcatgctgaatagccataaatgtgcgacgccccaactgtccctcaccgcatttaatgcggtcaggacagacgtgcggcgcgcctagctaacccctgtccatcgggtatgaccggtttgtgaccggcccgtctccgtcccatccgatggataaggcaatcatgtcctcatgtcgcccttgtccccggcggagtgggggtgggtatgacccgtcacatccggacgctactcgaggaagggctgttgcatgtcatcgttcatttataagggaatgacagggctgacccccgtgtcaggggggacggcgccgagttccgcgcaagaatcggttattggttagcttccgagagaaggcacggtttgaaacccaaaaaggtggagtggggtttccccccccccccatggaggggaagtagaggtggcacatgtggtatccccttaagctataaaaggaggaccctgcccacctaggaaagaaaaggaggggggagagggccaaaaaaagaaaaagaaaacccgaactccagaagagaggaagcaagtgcgctctctcaaggaaaaaaaacccttgtaaaactcatccataatcccaaacacaggagtagggtgttacgctcaatagcggcccgaacctgtataatccgactgcgtgcattcactcctgagagtcgtagggacgagcaagcgactaacgagagacgagcctccggccgaactcacgaaaggagggtctcacgactccccgctattgagggtcttccctcgacagggtagataccactgaaatcttctaaaattagaaccatgacattccatcacgttttcccgtcatttttgtcacattttctgtcacgg

SEQ ID NO: 16902 - DNA, 8809 bp, Oryza sativa
ttttacaaaatttcagtagcaccaagtggatatcacgaattgtagtggcgtttttctgatttgacacatttgtagtggcatggattcaattaacccttgtttttctacactgattgactcaacacccaacagcttgcattaactcaaaaaggaagttccttctttatccagagtcctagtactagagcactaaattgcacactaagcgacaaacctgcaccgatgagaatataactctcttaaataaactaattaaagaacataaagaaactcgaacacttactttgacaaaagaaccatctgtcgaggtacaagcgagagaagatggctgacaattccgactttcttcgaaactccgttgcaagaatgttaacactccggcactccttcgtgaaattcttggaggaactttgatattttggagaattccttctagagcttcccttcactctctactaagccaacatactaaatattaaactacaagtgagctatactctagttgagctcaagttgtgtgtgttgaaggtgcatgagctcctccttttatagcctctatatgacggttgtaacagttatccaggccgagaatcgggcataaccatcattggaaagccatttgggacctagacatggaaggctaggatgagatgcgccagaggtggttcagctgaaccaggggttcgggtgacccctgggctccacctcctagtcttctctgttgactaggagactgattggtgggcccttatcgcggttaggatggtttggccccactttaagtcggtttcatttgtcaggtgggccctctaatcctggtactcgtgcatgattggttggagggtcattttcatcgcatgactagtgtattttctcattaaatgacctgcatacatatatttactaaaactattggaagtgattagtagtaaactactacgattaagttttgataatatatttgatatcttttatgcatgaattaatacctaaagtttgcacttaacgaccgttaacagccaaatggactgtagatttgaaacacatttatctcttttattataaaaatatagaataatagcatccatccatattttgccttttatagaagaaaacgtaaaatctataacgagaggcctcttgatctggtcttacgcagtgatacctggcgcggccatccgatttagtcgagaagcatcagagtttagaatttgagagaagcatcagaatgttaggcatccatgtcttttttcccttcttataaaattttctctcaaattacttatccggtctacaatccgattacaccattgtgttcgttgcaattaaatctttacaacaagatctaacatgattatattatgatgaaaacttacaaattacttttataattgttgatgtaaaaacacgaggcctgggaggatctgcttaactccagtgcaggtccaaaacttgcctttgggtgtgtgagcgtgccagttgatttgatcctacaatcaacaggaaactaagacaaagaaaatcgcggttaaatccataaacgatagccgatcggctaagtgccgatgagatatcatttatccttgagccgacgtcatatttgcatcgatcggcagtcattaagaaataaaaagaactaaatctactcgatcggctgcagatattaacaatatataatccttagatcgatatatacttaaatcaagtgattgggatagatcggtcgtcatgccgagacagtataaatcacttagatcgaaatatatactaataatgagattatatgtgttcatagcatagccgatcagatagatctagcatgtatcggctaatactccgatactactctatattaggatattaaagcgagtagaatatatcaaacaaaaagcctaatatacttaaatgcaacgagatcttaacataaagggcaaatttaacatgtcaaagaagcatgtaggataaatgtagttaaatcagataagatcggctgaaaccccaatactaccctaatcagcaaccaaagacaggctagagattaagattctaatcacgactcataagatcaaactcaactgatgaagctataagtatgaaaagaaggacaatatctagacaatcaagtcgtcggatatgtcatagagtggtagatatcctatataatctaagtcaacatcggtatttaacctaatcggctgccttctagtaacaattgttagccgattgtaggttagatagcgatattgccggagattatataagatatatgataactcgtcgaattacataaacaagattagagtatcatgaagatggaagcactaatctcgagaacgcaagccaccataacaagttttacctcttgttgaagatcgaaaccgatgcagctcaacctaaaagtaagaactcgtcgaaacaaaacgaaaataaaagggtggcgatgcgccgagattgtattgaacgtgtgttagtttgattacatggggctttgatctatttatacccgagaattacaaaatatgttcatatcggacacgactcttatctctaacaaactctaagataccataagtctttgcagtagacttttacctaaacatatctctaaggaaattacataaaatatactaactaatagatacaattgccttctcaggactctatccatgcgtggcaatcgtcatgaagcacgtcaacctaaaccgacaacatatgttgtgtcatattgtcggattcggctcaatcggctaaccccgtccgactcgaactctgctgatcttagtcgtagccgattcggacttcagccgatcttcactctgtttccgggacaatctctatctcgattcctccttcacatctgatccttggattaccaaattgggtcgttaacaataatatatctaaattacttttggatatcactaaattacttcttagacatacaaaagtaaatttaataaagtttaaatgtaatttacatatattatagaagtaacttcagacaaaacgaaagtaactttgtcataacattaggggtaattccattgtagggataaaaacataactctatctagaaactaaattaatcagcacaaattacggaattgactgaaaacaataataggtagtcacctcgtagcattatgaatgtataggaagtaatttaatcaaatctaaaagtactatacacacacacacacacacatatatatatatatatatgtatatatatgtgtgtgtgtgtgtgtgtatagccaataagagagcgccagtatgcatgcttatggatggacccagagagcagcttaatagagagaagtagaagtaagggcgctaagctgaaggaaaaggctgaatgctcctaagaaacacctgacctcaggtgcttttttctcttgccttctggatggttctaaagtagtgaacagcttccgaccattatgaccttttattgaatttttgattttgtggttcgataggaccagggagaggaccctgatcaccttgccaacgaattcaaggccttagaaaaatcatcctacaatggaccatagggactgagaacgaagaagacatcaaaatcaggttaggggggctttcacttcgacacgtcttcgttcgtgatcacttagagccccttttccatcaataggtactcccaaggcgtcgaccacacggcctaacatggcctttcccacaggaagcagtgcagttgccttctttctttgttcacctacattttcttgttctttattgaattggatttgactgaggacatcgttgtctaagcgtgcttactttgcgcaccggcacagctgaatgagaatccgctggctcagattgagtggctcactttcttgagaagggctttctattcgaggatttccaagagcagattgaaatctgtgttatggtttcagggtttgtcaaccaagtgcaggagggcgggtctcgctgccggatcaatgcgcaggacacacgatctacaaagctagaatttccaatagtgagaccagcttgacaagctacctttcctcttgatctgaggtgcgaagagaaacatctcttttttatgacttccacttctcgatcccggcccggaaaagtgaccgacccgaatgaaaaataagacctttgtgaccgtgacagatgctagggggaataaaaagactggggcctccgcaggtgggattgaagaaagggatttagccttttcaaaaaagaagctctgtcgctctcctagttgctaaagaatccggagctctctacgcattcagtagaagaagagtactccccttcataatgcttccttcttcaagtctttcgctagtgaagttgggggtagcattttacttttgttaagtcatggactggtttcttcagccctttttctatgtgttaaaaaaaggtgggggtcaaggtgtataatacgagctccactttcaggcaatgagctagcttaaccctgattgcttaaggtttaatacagttggataagggtgccagtgaagaaatcaagagaatatgctttgtgtggtcacaggaacaatcggcggtcgtagcatgaaaaaaagagtaccttcattttacagcatatagaggtattagggaaaacaacccggtggggtaaagtcgtcaagtggactatggttccaaccaagattattattcacgcacctacgatccctttcttaaagaaaagaattattacttgctaatcttcccctctaacgcgggccgggccgggcttaggcgactggggaagctgaggagagatggggaaacccaactgctgccggtcgggacggacaggaaaggggcggggttatcggagtgatcggggtgatggtgatagttgatccgtaactggtgatgaaccgcaaaggtttttggttagttgaccctgttaaccgtaaagaaaaggagacgaatattggttgccggatgctattcacatgttaaagcacaaaaggtacctcaaagtttatagttctaagctgaagaaatagcctgagtcaacttatcttctttacaacctccaaacaaacgatttaggaaatggaaattggaacatgaacgagaacatactttcgaattgtggtaggggcgaacccatccgggcgggtggaagccgtaagtatcctatttttggaatggaatttcagtaaagtcttttttttctgctttatccttctctcaatcaaagaaacaccaatttcttattccccccctttttcctcaaaatttctaactggtaaagctcctcagaaattgcttttaggaaagatgcgtgttcggccgcataagccagataagaggcgaaccgtcaggtccttagtagcgttgacaaagaagaagagctgttgaaaaaaaagaaagctcgaatgaaactatccatggaatcgtgcgccgtgtgaaacatacagatggttgaggagacgaatcatgaaggaggattgtgcgactccacagaagagtacgcgcgctagaaaaggcagccagcttaaaaacgctaagagtattcatgctctaggttggtctcccgcgtaggactcgaaacgacaagaataaaccaagttatgagcttttggttgagtcgagggtgtattattacccgtttcactgacatctgccttcccttctctggagcagtactgaagtttaggactacccagtaggatgcacctaagcaatggttaggagagagaatcaatgtttagtagtaggcccagttcaccaggttctaccactgttcggcccaatcatagtcaaaatctgagtttgcgaacaaccatctaaccgtcagtctgaactcccagtccatcagtaagagaaagcttccgtttccatcattcagcagtggaatgtctatcgatcaaattattggacccgtgctggatgccacttttcccccgggcaagttaccttccaggggagttcccttgctcctgctgcgtacaattagccagttctctaattctacttgagtgaggaagaccttttgtggctagacctctattttccatatagtcagctgacttgcccgcagcggatccggaaggacccgcttcactaggcccgggccctggtggtgactatggaaggattccgtggtagtctctgactccctccaactcaatcaagcaaaatgatcagcagtctcatttatgctatgcctcacaggaagaaacccgggaccagggcatgtcgtgaaagacgcacacggggcgggcgtgcttcatggaagagtttggggtccaaagccacaccttctttctcccataggaacagaggtcaggagatgccggcagggcgctgcttttaatttgactgatggctcaaagtcaggataacgagcgcggagcccgcttggcaggcggcaggagctgcgggcaagtgcttgcttccggcgtcggcttgtagtctctgcagtcggcacactcacgcgcccgccactaccctttgatagatagcaagcagctcctataacttgatcgacaggacccaaccaactaaactattgattgtggcaaagcttggagaggttgaccttccttggtaaaagagcttcattagtacctttaataatagcaatggcagcggctttggatctaggaaaatgagggggggcatcatccgcatcaagggctctctcatctcctatttgtttgagccattcattatggtggtggtgccggggaggcagctgtaggaggtgagaagggccctgactccgtcccaaacagtgtactactatcggccctaatccaagccaaagcaccggataactcttactgaaggatagacgaagagaaccggttgggttgacacctggtgatgttagaaagaagacaagtgcttataaggaaccccaaggtgagcttatagctcttgaatcttatctcaacgaaaaaagtgctctctgaaccgaacatgaaagttgttttccatcagacggctattcacgtaactccactctcggcttggatagtcctccccatagtacagatgttttcccttctatcttgttgctccacctcctcctgtatctactattggttgactgaaaataaaccaaaagcaagggtggttgcactagctagccactctcttcgtagagaaaataaaagcagctgctggataaaaaatagtgttttttcgaatctagagctgtttggcgttccaatccagttccaacaatgcacttctcggctccgaggtgtggccgggtgagcagtctacggaacgtttcactgcctggcctcccgggtttctgagtgctctcactacgtttgatgatgaaatctagacttttcgcacatcttcagataaagcccaagtaggacaaagaaatgcaagtaaagacgcattttctacgggatcccgaaatcaccagccaccccgacctaattcatgatgagcccaccaacttcctggcgaattgtgcataagcatagcatttctggtcgaaccaccgaaccacacatctttttttggtgggagggtaccataataataaatagagtcaatggtgacagagccgtgggaagagcctcttcttttttgctgcgggggcttccattcaccagcgcagacaccgcaaccgagaaaagaatgcatgttcggcatttttggtcttcacattgctccgagaagcttcttttagttagccaagcgggtcatgtggataggtcaagagatgcgtaaacgtgcccaacaaggggtcgggagtgctactagggacgatcagagttctggggccagaggaaggggaacaaaaggtagaatatgcgggttatcgtagaatagaagcgagtcgcttccggcgttggcttgtagtctctgtagtcgggtcacacgacaggtgcacgatcgactttgtacactccatccttcggcccttcgcctataggtggcttggcgggcaagctaccttaaccctgctttcacgtggcgaatcggtatgtgatcactttacggtaggccaaattggcgtattaccaaaccacgcccccattaacacagcccgaacccccctccgagaaccgtatatgagaatttcatctcgtacggctctgacacaaataatcgaccttcctggtacagtgagactagtggatctgatggcacatgcgctacgagtggagtcatatgagcctcattcctgagttctcgcttcgccccttctcccacttggcaggcttggtatcatgtcgattgctcaaccgtacttttgctatcttacgtagagctgaattaggttttttcggtagtagaaatggggtagtgcattgaccttactcagtttattagtgcgcttgcttgcagagagtcacctctgtcccttcatctttatgaaaggaatcaaggcccagcccggctcgcgaacagtaatgaaatgtctctgaatctggtatccaaacgttgtaccattttgggcactccttgattatggcataaatctcaaccggtggtagcagacagaggggcgctcccgcttaggcattaggcacgagaaaggacatcgttctcggccgtcccttagtttacttgttcttttcttagcactttatcgaagatactataaatattcagggatatttactgtatcataaatatgatctatcaaaggaggaaaatccaagcgaaaaaaccatgttccaataacgtcaccaatatgagcatatcagtgattaccagctcctaagattcgatcggtccaaaaggcacatttgcacctaatcaactgaagcagatgcaggatccgaagtattcgactccggtccggctcagacgaaccgagggatca

SEQ ID NO: 16903 - DNA, 858 bp, Oryza sativa
  unsure (1)..(858): unsure at all n locations
nnnnnnnnnnnnnnnnnnnnnnnnnnnnnnnnnnnnnnnnnnnnnnnnnnnnnnnnncggccgtcccttagtttacttgttcttttcttagcactttatcgaagatactataaatattcagggatatttactgtatcataaatatgatctatcaaaggaggaaaatccaagcgaaaaaaccatgttaccaataacgtcaccaatatgagcatatcagtgattaccagctcctaagattcgatcggtccaaaaggcacatttgcacctaatcaactgaagcagatgcaggatccgaagtattcgactccggtccggctcagacgaaccgagggatcatctccactggcgtgctttctcccccccccccatcgtttcgccaacaaagaatgaatcccttgagtccggccccccccaggtatcgacacgcggcttaatcccgatcacatcctgaggcaataatagagcgaataattctgagagtctgttgaattggaatggagctcacgaccgtgaaacccctcgttgtttcttgattgagtaaaaaagggatatatgaagttcgttctcttcctctgtgcatctcccttatgggtaaatccccataataaagggacaactttcgtgttaccctaagaaagaagtcactataaaacagcttgccctcctgaagtaccaaaggtgcgcggagctcggtgaaaatgaatttcccaattcactactaagtaagttcgaacgaatacgaaaaaagtgctctctgaaccgaacatgaaagttgttttccatcagacggctgttcacgtaannnnnnnnnnnnnnnnnnnnnnnnnnnnnnnnnnnnnnnnnnnnnnnnnnnnnnnn

SEQ ID NO: 16904 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnnnnnnnnnaatagcactacctttggattcaaattttttggcattggcctttttccatccttggggggccaccttggcccactcttggctattagaattttaccgataatatctaacaaattattattttggaaaaagtcctggtaaaaaaaaccctcccgatttaatttttattgtttccaaaataaatatttggaaacctatggatggtaaacttttccaaaatggaccgattaaagtcaatgggatcatatatttatatacgaaaggagtatatatctagtttctgtagattagggtgttcttctcgttttcctttgccaatggccggtgtctatgtttgccttttggagctaatccaatagataaagtgatttctaacaacaaaaaagcattaaagatggatgaagattgaagagctataattaagaatagagaattctggagttttatcttacgagatggtgggtcaaggaaatcaaacttcagtatgttgatatcaggtagatctaacgattttagatacaaaacacttccggcaagagaagaacgctggatttctgggattgtagcctcgagaaactccttttgataaatggaaattgggtataacctatagcacttcccaggccgagttcttccagctcgcccagctcgctggtcagcctgcactcttgttattcaagaagtagtatgg

SEQ ID NO: 16905 - DNA, 533 bp, Oryza sativa
tgcttttaaaataaatatttgaaaactatcgatagttaaaattataaaagtttgacccaaccatgtttaaaacgtcaaaaattatggaatcaaaggatgtatatcaaaagtgatcaaaacccgaaagtttagaaattaaatgaatataaaatatttaattaaaccaaacaaaaaatcaggtcaaataaagtttcactatataattactctgtcgtgcagatttgtttgaggtggttgtacgagcaaggagatgttttattggtgaagacatataatgagaagagaatgaaggaaaatctggacattttccactgggagctcacagatgaagagagggagaggatcagtcagctgccccaactgaggggcctgcctggattggaattcatctctgaccatgggccttacaaatcagttgaagatttgtgggatggtgacgtctagcaagctacttagatacagtggagtatatatctaaataatcatgatggatcatgatgtggatctatcttaattatgtgcggcaggcatgg

SEQ ID NO: 16906 - DNA, 733 bp, Oryza sativa
  unsure (1)..(733): unsure at all n locations
nnnnnnnnnnnnnnnnnnnnnnnnnnnnnnnnnnnnnnnnnnnnnnnnnnnnnnnnnnnnnnacattaagacatgcatttcaatcaaacaaaaattagtagtaaataaggacatacatcttccaacttttgccaaacagcaccggattcacttgataagaaacttgaatcggaagctaaaatatataattcttcttcaaactgcaaaggtcaaaatataataaaggcagataaacaaaattagtactaaaataatcaaagactgttaaccttgttttctcaccttaattactgtgctccaatgattattccagaaaagtacacaaggtttcttttcttcaaggtctttatgcaagcatgacaagctgcaacaataaaaaattgtacttcaacatgttctttttctgttagttccaaagtattctatttcaaaacatgtaaattaaactttatacccatgggcagtcagttgagggccctgaagaaaatctgagatctgctccactaagaaaacattgagtaaagaataatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16907 - DNA, 456 bp, Oryza sativa
  unsure (1)..(456): unsure at all n locations
cacttgagtttggaatttggaattctacttaatcttctatatgcttaagtggatattccgatgttgattttggtggttgtagaattgataggaaaagtactagtggaacatgtcattttcttggtacatcattgattgcatggtcttctaggaaacaatctagtgttgctcaatcaactgctgaatctgaatatgttgctgctgctaattgttgttcacagattctttggcttttatctactttgaaagattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16908 - DNA, 401 bp, Oryza sativa
atgaaggatgagcggtattgggcgagaaacctgcgcaactatgccacccgttggcgggaacacctgcatatcgcctttggtgatgttaagcgtggtgcgtcaccttattgcagcaaacatcatgttgatgagtgggacgccaggcgaaaacgcagccgcatgatcatgagtcggctggagcttgaagacgaagaaaccaaagagcgccgtcactcattgagcagatcgataaaagcatatcgaatccggcgctgcgccgcgtgagctgatgacgcgcatcggcggctttgagaaagtcgccaccgactccggttatgccggcagcttttttacgttgaccgccccgtcgaaataccacgcttacaccatgttcgggcaccgcaacccgaagtggaacggcg

SEQ ID NO: 16909 - DNA, 1182 bp, Oryza sativa
acaccattttttgccttccattgcaagaactccagagtggtatccaactttttgtgcccctgctcgcaacctgggtacaacgacgttctgtggtcctctaacatcttgtccaatttatgggcccccttttcactttcgcagtcctccttggcgtcctgcaacatctgaccaagatcatctgcaacgtcgttaccatcagcatccctttcctcctcgcccgtttgatttccttcaaatccagcgtactgaccaaagtccggaatattgtcgtcttccacttcatcttcttccatttcaaccccttactctccgtgggatgtccaacagttatagcttagcatgaaccccgactcaaacaagtggaaatgaatagtcctagatgcagaatactccttctgattcttacacttattgcatggacaacaaataaaacccttatgcctgttagcttcggccactctcaaaaaataatgcacgccgtcaataaactctttggaccaccggtcagcgtacatccattgccgatccatctacatgagatggaaaaaatcgtacacaaataattattcgtacaataatgacagtcatacaataattataaaataataacaaactctttcaacagtcatacaataatgacatatcattattcatacaaaaattataaaatattacaccaaataattcttatttactatttctaaagtttaaactaatattaatgtgttgtacttcttttaattttcattttagcttgttttctattatttaagattaactttcactatattttccttctcaactattttataaaaccttctttagcaaataaactaaatttctatatattctttcttccccacacaaattttctctctcatcaacttacaactaaattttagagacaaaaaattgtgcaaaacatagctccaaatgtaatatgacaaaaaaaacattggaggatgaagttgctaaccttttagccacctccgatttgtatataatcaccaaaataaattcactagaaattttggtatgacctcccatcttttttgaagaaattttgaagcttgctcgggcagctggaggaggaagaagacatatatatatatatatatatatatatatatatatatatatatatatatatatatatatatatatatatatatatatatatat

SEQ ID NO: 16910 - DNA, 5560 bp, Oryza sativa
  unsure (1)..(5560): unsure at all n locations
ttgcaaccgggactattgtggaattcggccgaccgatgaaagatggtttctccaccagtgggacctcaaagaatctcgctgttaagttgagggacctccggtgaacttattcctaaattaaacgaaatgccatctaattaatgggccagtctgaatctacagtgtgtgtcaccgtttgcctggtccttcaggactctcttcctagcccatgcacgcccatctatggcccgcacagggtaaaatttttatatattcttaccgatttaaaagtaagtgctaaaaataaagtacaatgaaaaagaaaaccaaaattaagtctgcaactaagttttaaaatttaaattttggctacagaaatgtccattattgaaccttcttcttgtatcttcatcaaactatgttcatcaggaaacaagagttaacctgttgttcataatctcctgtgagcagagacatgttttttttattactctgaataatcatttaggtttttcctaggactgaataattatttaagtagagacactactacaaatatttgcagtgtggtgtcactactacaacagtagtactccatccgttccaaaataaatcaacctgctatccaaattcattatattcatattctattttagattggtttgtttttaagattgagggagttggtaggaacacagcatcaacggcagaagaaatgttgacagagacatgcacatcgcataaacgatttatagtttactagtcttagctaatcttgatttgtcttaggagatattgatatcaaattatgcgtttgatctctgactactctgtcttgctttttcctctggcagcactatgagctggacacattggctaccgagaaagcaacagcaacagacggctacatgctaacaccgaaatatttgtcagcattctgaaagtactgtccttttggtttaattaggagataaggtcaaggtgatggacattttatggggaagattaggtgctaacttgttgcaatttgcaacgatttttcaatggccttttagcaaaggagaactgttgtttctgagaataaccgtgttctcacaaaggcaaaacttgatttctcgctcgtttcacttttcattctgactgaataaaaaaatgagagtattattccagttctaatttgaatgttaggattaagggtaggtgaatccgacgtgatacgggcaacggttgaggcgaccaaccatttaatattttcgggccaggggtgtgatgtaagagatgagatcaatcaaccttgagaaaatagatttgcggtttttgttggaaaagcaaaacaaacttcacaggaaataaacttattcaggtaaaatttctatattctaagtgatctgtatatagctccgcgtgggcaaattctgtaccaaattttgttaggcaagccttttgcgtatttaaaaaaaaatggtatatgtagctcacctgaataagaagagaggaaatttagtgagaaaagaagtcttaaatcctcaatctaattgttccctccgtcccaaaaaaaaaaagacaaaccgtgagttcccgtgccaacgtttgattgttcgtcttaatataaaatttttttataattagtattttcattgttgttagatgataaaacatgattaatactttatgcgtgacttatctttttaatttttttcataatttttttaaataagacggacggtcaaacattggacacggaaaccagggtttgtcttttttttgggacggaggaagtatctaccaagagtgatagacacgactggttccggcttagctccttaaggtggtgggctagatgacctgggttcgaagcctcacaccttctaattatttgatattagatccttccatattattcgtgccttttattattttaaataatactagagaaaatatcatgcgttgcaacgggcgaagttgattttaatcttattattgttatatgatttagttaagataaaatttactgtatgagttcactcggatatattagtgcctgataagtacaaatcccatctccatggtttcccggaatcggatcctctgctcagcattgaagaagaaaacaagatgctacagccgctcctagaaaagtgaagctaaacggtgcttttgttggaacagtaaaacggtcacacagtacaaacagtgacatgtactcctgttgttttatatagccatggaacgagagatcctttgtgattgggaaaatacatactggcagtatactgcatacttcatatgtgtacttaacaactgtcgttatattcacaaatgaacatctgagattcacctatgttttttactccagatttaacagtgagtagtttgtttactcatagatttatatgtaactaatccttttactcagaagacatggatatatatgagacgtctgagacgtctatttatatattcgatgaatttttaggtttgctgtacatagtttttctctattgagtatgtagtatgggtgaaaacagaacgaacatttcctgaccgtccgctcgacggaaagctcgtgggaaggatacgagagagaaaatgagatatctggtaatattctaattcgagtctaaatccgaatccaaacctgcaaacaaatatgggttaggataagcgaagagttgtatctacccgtatatccaatttgatcaaacatgtatgaaaatttattatgaatatgatgaaagattggttcatatttttttacgagctcaccaaaaaatattacttaattttttcttgactatctttttaagactaattgcctcactagatttaaaatctatgaattagaaatataaaattgataggatacgggataagtgatttattatctgataccatctgtgtcggttacagtttaaatggaaaatatggttatgatataggaattttgtgattcgaccataatttcacccatactcttaagtgcaatactactcctttgtcccataaaaacaaatctaatataggatgtggaacattccctatccagattcatagtactagaatgtgtcgtatctcgtaccagtagtctataaacatctagatagtagaatgtttagaataagtactatcaacctaaacatatctcatgtgacttctattgcatgtgtacggttctaatagattgacgtgcaatctttttgcgtcttcgcaggaaaaaaaatgtgtactgaggagttgttgtgtcattagcatcaaaaaatgtgtactgaggagttgttgtgtcattagcatcatcagctcaagtcagtagtactcccttccgtccaaaaaaggcaaaccctgggttttcgtatccaacgtttgatcatctgtcttatttagaaaaattatgaaaaaaaattaaaaagataagtcacgcataaagtattaatcatgttttatcatctaacaacaataaaaatactaattataaaaaaattcatataagacggacagttaaactttagacacggaaacttagggacatttcacacagatgcagaggatccaatgccccagtcaatttccccacgtgccatctcgctgcatccgccgccgtgcttgcgcttgcgattgcagagttgccattgccatcgcattcagttgcgttgatccgatggcgcagtagcaaaaccgagtctcctctcctccctccctccctcccttccctttgccatcaaacgcaagccgggagaagcaccaccacctagatagaacaataaaaattgctgcatccgtcagagctggccactacaaaaaccagctgcatcacaggagagagcaggcagagaggcagctctccagctcgcgtttggggttgaccagttactccggcgaaccgacggcaagccggcgccggcggcgagggtcgtcgggagcggaagagagggagaaagaatggccaccaccgcctccgtccgacctcccctgctccgacaaggtggatccctgcatctcatcgtgccctcttgtgctattgggtttatagtactttcttggattctttagattgggttgatttgattgatggcccaacatagatatcgtcttggaggagatgggagcaacgggtgtgttgtgttttgctgctgttcttggattggattggattggtttatgtttcttgttactcctgtagagcaacccaagaactcaacccattactttatttattttacacttgtgtttctgtgcacttggatctcaaggaatttattatgttatcagttgttagttgtgatcctgttctgtctgctatccggcccaaacccatcaacagtagtatgacctcctagcataaaattaaattaaattaatcagtagcattctctccttagagaaaaacaaagtgggataaagtaaactaaccagtagaataccccagttgggcacttctgattgattttcattccttctaaatgtgcaatagttgattacagatgaacataatagatgatgatgatgttggtacagattatgtaagttcagtattttctctcccttctaaccgtcctgcagaattgggaatcttaaaccaaattgcagtactgtgggggcaaggcaaaacataaatgtttcagttaggagtagacatcatcttggtagtacatgtccaaattaaatattaatcagtgtaccacactcctagcactcagtttctatgcaacaatttcaacactttgagatatcagatatgtggctgaaaaatgcttatctagatcttatggaaattaatagtagtatatctttttttttcgggcctgttcactttgatgccaaaaaaaccttatcaaattttggcattgctaaaattttagtatagttgtcaaaattttggcaggattttttatatagttattaaaatttggcagcaaattaaatgtagccacttttttagcaaccttactaaaagtaaggttgaaaatggcatcaaagtgaacaggccttcaatctaatttctgaattctggagctgcaaatctgcacacacactaacctgatgaacactactacctgtattgcagcagcaggttcagaaaaagcctcactcctttgcaaaccaaagcagagagcttctgtcagaagaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16911 - DNA, 1326 bp, Oryza sativa
catcaggacacttctcctttatcttgtccatgtggtattcatacctctgaagtgtgcagctcttggcagctccccacatgttctgagaaaacaatgtgccatgatacttcttcttcatgttcttccacaagtgcctcatgcattctcggtgttccactcctggatagacaccatctacagctccctctatccctttgcttgttacaacaaaatgacaaggcatgagatacaagtgtacatcacagtcatgaacaaaagaatgcaaaacggaaatcacttgttaatatacctgcatcggtgctgatgaccaatcctgtaggagtacctatggcttgcttcaagttctgaataaaccatgtccaactctccttagactcggtttcaatcaccccataggccactggaaatagccaattgtggccatcgactgcaacagcagctgccaactgacctctttaccttcctattaagtgagttgaatccattgcaatgtaaggatgacatccttgcaggaaaccatcaatgcatggtttaagagctacaaagaatctcctgaaacaaacatccccattatgctcttcagtgtccaactcaacaatactaccagggattgccttcagaagtgcctctttgtaagtaggcaatatatcatagctctcatcccacttcccatatatcatgtccataaccttctccttggccctaaaaaccctgaaatatgggacatccatcttatacttcttattgaccttctcttgcaactcctttggtcccaatgtgggtttctcctttaaccagtccaccaccctatcagctatccatcccttagaagccattgtatcaccacacttattgactgaaaaacaaatgtggtctggcccattaagcttaacctgcatcaaacaatcaatgggcttgttaaaattcacatgaaggcacacatgttaaaattcatgattgaaagcatggaaaaaaatcagctcactacataccttgcatccatcatatttggacttgctggtggatgcaaaaaacattcacttgcaaccctcctttgctcgcctacactttgccttaaacctatccttgttttttttaacagtttggaaagcataatcattcaagattgcatggtgggttactgctgatttgcattcatcaacatcacgaaacagcacatctacatcaatgcatggatcatcaacatcatatgaaaaatcatgaatatcatcacaatcatcatcatcatcaacaatttcatcatcatgttcgtagctgtatcggagtcagagcattcagaatcatagcaatcagaatcagatgatg

SEQ ID NO: 16912 - DNA, 3026 bp, Oryza sativa
  unsure (1)..(3026): unsure at all n locations
tattggctacttcatgagctatgttcagcgataaccactcatgcaattgctcatcactactaatctcaacccatgcatcatcacaaacacgccagaaagtaatgtattgtttagaaccccacacaattttagagccgatgaaatcaactaactgcagcaatttgaagctagctatgtccacatctgttgtaaaatgcctacttgtgaaataggtctttggccccccatctggcaaactgaaatgtgaccttactctaacatcaagaatcaaattacatggaacaggcctacaaataggagcaacacaagataaagaacaactttcagtaaaatttttaggtgcttgtaggaatggagacaacatacaacatataaaccctaggttagattagcaatggagacaccaagttcaattagagtaagacacaacatctaaaccctaaattagcactggacacaacatctataccctaaatttgcatggtattgcatatgttcctataacctagcagggtcacaaccacaagcatgcacggggtcacaggatcacaaccacagggtcactggaagagaatagagagaaaatacctttgtatggtaggaatcccttgcatggttgagggagcgtcgatgtcggctacctccgagctggtaggaatcccttccatggttgagggagcgtcgatgtcgcctacctccgagtgctggccctcccaccgtcaccgcgtgtagcacccgccgccgccccgcgtcccacagctcgctgtcgccgcccccacagcaaagccgtcgccgccccacagcaaagccgtcgccgcgccccacagcttgccgtagatcggcgccggcccgctccacatcaaactgccgccgccgccgcccccacagcgcgccgtcaccgtcccctcagatcggcgccgcnccgcgccccatcaaaccgcagccgccgccgcctcctcagttngccgccgcctcaccgcacagatcggcgccgccgcccccctcagatcggcgccgacccggaccggacgcgccgccgccctccaccacaacgagcgggcgccgccgccgccgcccctttcagccgccgtcgccgcatgcgtactcgctgccgccaccgcacacacgagtgagagagaggtgagaccgtgaggaatgcacgagtgagagagagaaagagagagtagaatagggtttgggatttggagggtattttcgccattaggaactctggaaagattttcttttttttttaaattgaaccctaacggagtcagtgaaagagggttagacggaagttttgtactcaaaaaggagggtcaaataagcaaagttcaaaatgtagggccaaatcggcaattacaatttaaaatggggtcaaataaacaattgcccaaaaaaaacgccatactacaacaaacatgtgttcacatattcaaaacaatggaatcatctccactgttgttttcaactggttttactgtttccaattgtgagttggacagttcgttctggatctgcatagtcagaaaatctcgttagtgaaacggcaacgcgcaatcaataactatcctgcttaggtatgagcttccaagtcccgaatccttttgtctcaagtctgccttggtaatgtgaccaagatccaaattcgaattggttcctggtcctgtttggacatagaatcgagtccttgtgaatgggcaattggatttggatagaagggtacattcttttattttagatagaagaaaagtttcttctatctaaaataaaagaattttgctgcttcattagttacatatcctgttcctgaaagaactccagaaggtgaagatccagcaggaggtggtagccattcttattgagaaagataaagaannnnnnnnnnnnnnnnnnnnnnnnnnnnnnnnnnnnnnnnnnnnnnnnnnnnnnnnnnnnnnnnnttcgattccacctcagaacgaaagaaaatgcaagtgaaagagaattataggacaagagctgatggatgatagaacaaaagagccattcaagttgtttggatgcacatacttttttcaatcctctctgattgactttatcagaagattcctatggtctggtttaccttaattacaattcccagtcaattcagttgatacaaatcaggatctagcgcgggccagtttggaatttctaccaccatttccacccgttgaacgttaaaaaaaaaagaggtaactacagcctacaagtatattgcaaaatccttctacttttgcacttgacgaaaatttgatcaactccttgtgaaaattatactttatttcaagtaggtatggtaatggccagatcgggcatggatggagagcaggaacacacctgaaaacactagtgaatagaaaccaatacctatacccatattcaattcataccgggcgggcatgggtaacctagtaggttgagcaacatatgaataataatcaacggtcttcaacatagcaaaggaaattttacaacagtgggagaggtggagactatgatcggggaattgagtgtctttctctctatagggtttcagctgactataaatatccacctaacatatatatcaggagtattttacaaaacccagggccaggtaggacataggttacccatgaacgaaatacaaaacctggctaagcccgctagggtctcggcctcttgggtcggacatacccatgaacaaaagatttaacccacagtaccgggcatggcgcccacccacagggccacagggccacagggccgggccagaaagcggaatcgtcccaccaacaagagactacgtaagcggtgcaccgaaggcgtatttccgggcgacgtcgaaggcggaaagacgtcagcgcgggcggcgtgaaaaggggtagaccaagtgggcgcaggccgcaagtcgactgaccccgccgggcccaacctaaccaaactcgagacggggacgccacgccttccttccacgcggtcgcgacccatggaggaggagatcgcccgcgacgacctctttc

SEQ ID NO: 16913 - DNA, 58754 bp, Oryza sativa
  unsure (1)..(58754): unsure at all n locations
ggggttgcgctgtgtgcaaggacgggatcgcgcagggggagctcgccacgcagctgccgtgcgcgcacttgtaccacggggcgtgcatcgaaccgtggctcgccatccggaactcgtgtccggtgtgccgttacgagctgcccaccgatgaccccgagtacgagaagcggcgggtgaagcggcgttcttctggtgactccgtggcgcaattgggtactcctatgcaaatttgagctaggattgcttggtgatatgtgttggttgcaattccgtggaattgagaaacttcactctctaactgctcattgggatgcttcgagagtgtcatacctctttgatctcaaaactttttagtgcgtagctgtcatgattggtaattgaacggtaagaacaattgctagaatttagaactgctgtaaatacgttgtgctgctccaataatacagaaaattgtttcaatgtttccccagaattgttagccttttttttaacttactgcatgagtaacagccatcataatttgataaaccaaactggaaagtagtcttccttctgtaccagaatactcaaccaagtgttgcttatttgcgttaattaaaaaaaacaattcggaagtgattttaggttcttaagtttcctcttcattaggcttaggctgctatagtgctatttatgataaataccatttataagaagttaccctctctgtccattttaagctaagaatctggataactatctgtccagattcgtagccaaaagttgctatattttgggacaaaagtagtatctacttgttattgtgaataccgtggttttgagattatcacacaacagtgtagcattttaggttcctcaaagcatgccattgctagtaagcagtagctaatagatgactgtgttgcatggtcctccaaaaatggtaaacttcatagttttgttttatcttatatatggtcagtactaactactcacaaataagccatacggtccataaacacatgggaagcaaagtacagctcatatccatttgcagggaacatgctggcaaaacaggtgtttattagctagcatgcaggatgaagaatactataattggcttattggaaacgtggaaaaatggtataaatgccatagtttcggttgtctcgctattaatgttcattgagttaaagattattccatattgtatttgcttatatattagtgtccccttcagtagactgcatagtatgtcttacaaacattcataaccatttatttgccgatacttctgcgtattcacgcagggcaggtctaggaaaacaagacactggagtcactatttactaatgtcacttatggtgcgtttggtttgagggcgaggttggataggacgggatgatacatggttctgttgctggggtgatctgcgttgagtgtttagttgggtggatgggaaaacacagaaaaatgttactcactccatgcttgttttatttgcattgtttcaatgtttggcacagaattgttagccttttcttgttttcgcttactgcatgagtaaaagccatcgtaatttaagaaactacactgaattattgtcttcttctgtactagaatactcaacccagtggtgcttatttgtgttaattaaaaaacaattaggaagtgattatagatgctaaagttttctgtaggttgctatttatgaccaacaccatttataagcagttatttacttgtgactataaatactgtggttttgagattatcacacaacagtatagctttttatttttcttcatacattcagtgttcattagcatgtgtttcttcatacattcaaaaatgttaataatttggaaccatgccattataattttgcaaagtttgagatatgcagtcggtatctcaatgacatgtaggacccacaggagtcaatgacatgtgggtcaggatgacatatctcaaattttgcaaaattataatggcatgtttccaattttccccaataaatatgtgttcattagtatgcgggatgaagttcactgtagcttgcttattgaaaacttggaacattagcatagatgccatagtttccatttctagtcacagttaatgttcattaagcaaaatattctcccatcttttatttgctaatatgttaccccttcggcagactgcatagtattgcttagaaactttcataaccgtttatgtgccataattcgacatattcacatacaacagatctaggagaacaagccactgtagtcaccatttagtaacaacacttaactcatacatatagttgtggacatggatttgggccgaaggtagttggagtcacagggacccccttggaactgtggaatgtggatctaacctgcatatgttatagcacacttgagctagtgtatcatggtgcggtccgtgggtatataattaaagaaaacagatttgtcaggccatggagaacttatctgcaaaatctggttattgatgattgtttctaaaattctgtacgtgctcacatcctttccttggccttgttttgaaattctgtttgagctagatctgaagctgtatcctattttgctggtgatattgcacaagatgagtgaagtttctggcacaagctcattttgcatcgctgtttcagaaatactccttttttttttgcatacctttgatcagattcgcatatattgaaactttgtcctgctatttttcagtgtatgtcaagatttcaaccatttaccctattttatggtcagggtacagaaatcaccacgattgcactgaaatttcaagtcttattaccatataatttctttcactgtagtagcaatacgtcaggggtgtgagcaacagcagtaggcagtggttcatgtctgacagactggcagtagccagtgatttttttactcaatgatcagcttaaatctcttgtttttaatgtctcacagaatggtttccttccttgagtgctccagtcagcaaggattatatttgggatactcttgtagaaatttgctagcgtgtatcttgcattcttgctgtttagaactaggagaacagatgaatcctgatggctgaacaggagaagatgatacaacacctgtttgacacaggttttactgtgcctgttgacttgactctagatgaggctgctgctacctacctgttctgttgttccagacctctcatttttgccttttacacagacatgaagatgatctctgtggtcagaattgcagagaaagagagcttaacagaaggtggtgatcttattttcctggttgagaagaacaggaatgtggtatgctgctatcatcttcatagtagtatatgatagtagaaaagaaggtggtgattttatttttgagaaagacaaaaaaaagaaaaagaaaagaagaggtggccatgactgataaagaagcatctatatacatttatccttgttgggccttcagttcaattgcagctcatgggctcgtggttgtcttgcaaaagcccaaactccaaaggccctgtgataatttgctggtcgccggtgttggtggtgctcggggactcgccgccggtgacactggatcactcactgatgctgctgctgctgcctttcatttctggcaacccaatacaagtagttagctcaagtctttcacaagtaacaaccctgaatcatcaaccactgttcgaccaatttgctggatatttgaggtatttggaacatgttctgttaaatttctatcattgtttttttttggaatttcaattatgatccgatgattttttttcctagcttcatagagattagtggacgaccaaataacaatcctaattaatctcgattaaggcacagtagctatgcacaataaatcaatcacttcctcctaatttaatcacctaatgctaaacacagatactggttttaatcttaatccattggcgccaaaattgcctccgcgccgcagcctcctcccgcttcctcctccgcctcgccgtcgccgccgccgcccgcggcggcgcggaggggcagcctctcccggagcgcgcgtgcctcctcggcgagccgcgcgttctcccgcgccatctgcgcgtgcctcgccggcgcgcgggtcagctccacggcgagccggtggttggcggcgcggagctcggcgacgtgcgacgacagctcgtncagctgncgncgncggcggacccgcgaccggcgcgccgactcgaggttcgacgccagccgcctcttctttctctcgtcgcgcctcgtnacccttccgctccgccgcccttcatcgnccgcgncgtcgtagctggttcccgcgtcgncgacggttgccgcgacgccggccaagaaccgatcgccatggacaccgaccaatccaggctgcggcgaggaggaggaggaggagaagaagaagctcgccgccaagtccaccgcgccgaacgattggtacgccatggctgcgatgtcttgttgcatgatttgattggatgccacaccgctgctgcaattttttttttttggcaatgtggaggagatgattagcaagaactagctaagctctttatataaaactggagggaaaaagattgagacgagtttaattagctcctttaacagcagaaaaaggaggagccctaaaagctgaagccactggcccggttatgctgtaagcaaacttgccttttgcagctcattgcgtctgcatcctatcgagattatcctgttgattctggggatttgccactgtcctcttggttttagttttgtatatatatgcacatgtcatcatcaccagggagaacttatatatgtcgcctgtttcattttcagaaatgttcttgtcttgtggagaattcttctgtcaggaagtaacaacactttcttgttttgttcaggggaatttcaaatctgtaagcatgggttggaccatgtagaaaccatggaagcaaagtctgaaaatgcatttgcttgtggaagttgatttgaaactttgtcaagatctcacctcatcttgctggatttttacaggtatcagcatagcagactgagcacagagaattgtgtattaggtcatttggctaaaccttttcggttcgtttcaaaaaaaaaaaaaccttttcggttgttgtggcaattggcaaagtaatggcagtgctttttaggcctttttgtgtcaagatatgacagctatatgcatatattgtatagcggcgccacaaaggattataagcacaagggcaaatgccagtagtagcccaactgtttggtccactttgaggttttcaggtactgtttggtcaatccctatataagaggtctttgtttgatttgatgtcttttgttcagattcacaaagaactagttcttcctacaaactcaatgcaattatgcaaatgcagtgagtggtgacatttctgaataccctgacatcaccatgcatcttcagatggatacatgatagatgcaatactgcattagtctgaacattggtttctttcaatattgtgtgccattctctggattatggcaaaaaaattatcttcgatttcagacatgagaaacagttcaatggccatcaggattcaaatcctatcgactgactcaggtgcgcacctccttcttcagtgaatgcataataagatattagcttctgtccaatttgttttatatataaatagaactctggacatgacatgacctcttatgcataataagatattatatctaggtctttaggtctactacataggattaattttgatactatataacaagtttttatttgcttacctaccaatgccattagcagcaataattgttccaatttggtttatgctagtacttctaggagacactcaaggcagttgtagtgtccaaagcagaaagtaatcgagtgatgaagaagtttaggacagtttagacatgtttaaagcggaacataccaatcagatggcaataattgcttatggtgactcttgttgaccatcaacttttggaaacatgcaacatgcatgcatatttcttaggcaaactttgcttaatttgctgccgtatgaaacaaatggctcttgcttttgtgctttctggtagaaatgcttcttagcaccagatgttcatgagatgtgctaaattgctctacgcatcaatcacaatgaaagcaacacttacccaagtaaaacttaatttcttgtgatcctgaattcctggtttagttttctattagttgggcacaagatcataactgcagtattgtatttaagattcaacacaggttcaatttgtcacaccctgtaatttggcatctacaatctgaaaatgaatggctaatcaaaaggctctgaggacacaaatggctaatttcttccatctagttgagaaacctttcaattatacaaatggaaaagatatggatgtgatttgtgggctgaaaaccctttatcatcaacaattgttagtgccttcaactttcaatgcacccatgttttcttgttacgtttgcaagatcaaaacaatgttggaaacgtcatctcgccaggtaaagcaatgaatgacgacaattaagaagatttttgctcctgaagactactaatgatggatattaagggtataataacctatccaggattgtgatgtgcaatccccttgtagcatacctgataagtgtggtgagttaaagcagtccatttacaaaaagaaaaaggaaggccatatctagcaaaaaaaaatagactgcatacgtatagtggtttgtgaaaaagttcaagatgcatacaagccgcagttttcttcagatagtgtggcatcttcttacttcaaggaaaaaaacattatgctagtttggaaataacttcaaatttgtccctgtgatggaaattaaaccattggtaagtagtctagcaatatcaaacttaaggtgtgtattgcatatgaattaggaaaaaccatgtcaaaccaactgaaaccaaggaaaatcaaccatactaacatacttaaataccttgaggtgagaaacatataaagcatacagagaacatgattagtaagaatgacgaagataaaatacactaaggtaattagggaaaacagcaaagttcatttggacatttgatatcatggaaagctatagaaaaatgtgtaccttacagaccgaaatggaaagagtccacgataaaaagtcatttttgcaccattttccattgtaatacttatcgagacaaatttatgcgcgcaccttttttcccccatccatccaaataaatttttattggtaaaacttgttgctttatgacagcaggaagtatcttttacaatctaatgtacccatcagtacaatattctagtagtatatctacaacaaaaataaagaccaagggcatgcttggcacatagaattttgtatggaattagttcaagtcatttgttaagcacataaatttggcaaaactctcatcttccaaattaaccttgcaaaatttaaccaagaaaaactatatactatcatccgttccatgtccttcctagagaaactttttatgcaaccatttttttttctcgacagggattattcgtggttactgtgtgcattaatagcattaataacagctagcatgtgagcctgttattaggggtaggcagaaagatctgaaccgaaaagaccgacaccgagaaattcagtcatcaattcggtcctatatagtgaaagaccgaactttgttcggtcaattcggttagtctcctcggttaaccgaatagaccgaaagaccaaattaaaaaaaaaatctaaatgcaacctacaatccaccaagttcaatataattaaactctaattttcacagccctacttcttctaggcatgcaacgtaataagagtctttagtcatacgtgcttatggatttgttttgtgatttttgtgtaaaaatttccattatttctttgcatatatgaaaatgttgctgaatttcggtcagaccgagaccgagaccgaatttgtcggtcatgatattttttgcgttgaaatttggtcttcacttttcgaagatcgagaccgaaaatttcggtcagaccgaatgcccacccctacttgttctctctatacccatatgtcaatgataattattattattatactccctccgttctaaactatgaggcacttcctttttaatgaaaaatcgaactcgataacttttaattaaaaataatactaatatatactaaatattatgcatgttatatcactatatttatattttaaagtactttcatgtaatgctaatttcatattcgttaaaatatagatattataattcaagatggaggagtacaaccaaacagtagaggatccacttcctctttatttatgccaagttattttagaaccatgctccacacaagacacgcacacatgcattgacatgtgctaattttgtttcgtgtggaaaggcatggaggccggttccccacaatgtccaatcgctgccaactctgcgagagagaagggggaggaatggaagcttgtgcatggcctaaacacacactttgacacttgactttgtgttggaatccattgattagccgctcaatgcagcatccccaatgcagaggtctcccctctactcctagctctttgcaaaacccaatgtccaccatttacttcaatttctcagtcttccttgctcatgtctcccttgcccttctctcaacttgggtcaacttcattaaatttctcctttggtatgtgcaaaggctttgaaggtgtaggcctggtgcaaacattgcaaagtcaaaatgtacggtacgatgcatcgagttactgacatggtaaatcttcccgattcccgtgtaaataaactactatttcattcgtttcatttataagatgttttaattttgttatgggtcaaacttgcttaactttgacatagtttattgaaaaaaataggttagaaaacttaaattcaggaaaaaaaaataggtgagatatcctagtataaccatcttggtttggttaagacatgccttagaatagacgagtcggtcgaaacggtcagaatcggtagcatctctttagaaacgacgctcaatcgacctgtaattgaccgtatttatcatttaaactattcattgtcaacattaatacaatgcaaaaagaaattagatttttttttataaatagtcaaaaatggtacgccagtctatcgggaatttatgtgaccgttttcacccctattcaagtgcatgggcacttgagttgtaaaattgacttgatcgagataccaacgtatatacaatttacacatcgaattgccgggaaattggactttgagatcattttagctccccaaggcgatccacacgtactctaccacaaaactttggttgtttttgctatcatctcaaggccactgcagcatgcgcattgcgcacgtacgagatgctactctttccaaggaaccgatgtctctctctctctccagcctccattgcttataaatatgttcctccttcctatactggtaatggcagcaaagcaaagaaacaaagaagaagaagaaagaagaagcagcagcaaaaaagttgatcagttaattagcaagtgtgttcttctttcttttggtgagagagagagagagagagagagagagagagagagagagagagagagagagagagatctcagaatggtgaatccaggaagaacagctagggcactctgcctcctatgccttgctctcctcctgctaggtcaagatacccattccaggaagctcctgttgcaggagaagcacagccatggcgtcggcaacggcacaaccaccacccaggtcagcagattagttcagtatcgtttcttcagcttattaaccgtggccaaatttgaattctataacttaattttagagttgatgtggatgtgttattaatcatagattatttctcaacattgggttttatgccgctaataacacatatgtaaaacctttacaaacaaattatttttcggtcgctaataagcgttacggcttataattttcctagtgaacagtgcatgcattttgcaaacttcttgttggctctggttgcaacttgcaagcacgcatatgcattgagagaagagttcatacacacactgtattatatatatgtacatttgggctataagatactaaaatgaaacaggagcatcgtgttctgaaatggcgtggcgttcttgtttattttcagcttgtgtaattgctggagggcaatagcatgggaaaacactctaatctgaatctgtgacacctggaacagtagcaccattcttgatggcataatacatgtacttaaccacatgtttatcgttggaatcctggtacaatgctccgagctgcatcgatccatccatgcgtgttacctccatgtgttcgaagatgctatatatttgcatacgacaggcacagcttcatgaatgttacttcgcactgtcttaacaaactccctcagtttcatattataagtcatttgattttttttcctagtcaagtatgaccaagcttatagaaaaaattagaaacatctaaaataacaaactagtttcagaaaatctaacattgaatatattttgataatatgtttgttttgggttgaaaatactaatatatttttcaataaacttggtccaacttaactagaaaaaaaatcaaacgacttataatatgaaacggagggagaactttccaaagaacgacattatcttaattttaagacatcgttattgtttttaaaataataataggatcactagtttctattacaatatatttgtaaaacacaataatatgacaatattatagaggtagtactactttttgagatttccatacatccaatctataaattgatcaaagtttctgcttccactctgtttcgttcgttcttgaaagttttcttctaacagtatgatgatcttgatcaatcaggaaccaagcagagagaatggaggaagtacaggttccaataacaatgggcagctgcagtttgattcagccaaatgggaagaattccacacggattatatctacacccaagatgtcaaaaagccataatggctgttcatttatgatttgaactagtactagtagcttataccttctgcgcgtcttttgttcgtttggagaggggattttcttgggatttagcatatgaactaattaaattaaatcccaggcaaatcccactcagcccattttgtgcagaagttgtcagtgttgcactgtataattatttagtcatacacaactactcctggtaactactcctatcttcgatgaattttctggttttgccagacgtgacaatagtccagtagcatgcagtaccctctcagaatccctgtaatttagcaaaaaaaaaaggaagaaaagaaaagaagcttccctactactttctccgtttcacaatgtaagtcattctagcatttcctacattcatattgatgttaatgaatctggatagatatatactccctccgtcccaaaaaaaaaggcaaactgtgggttcccgtgccaacgtttaactgtccgtcttatataaaatttttttataattagtattttcattgttgttagatgataaaacatgattaatactttatgcgtgacttatctttttaatttttttcataattttttcaaataagacggacggtcaaacgttgggtacggaaaccagggtttgtctttttttgggacggagggagtatgtctagattcattaacaacaactagggaggaagcccgcgcagatgcgcggacaatttagttattatttattaaaagaatgctaaaacatgttatcttaccatattttatttaaaatccatagattatcttatctctaccctaaaattgaccatagactttgatgatacactaaatttaattataagaatgtctctcatattaaaaaaaaaacctagctggttatatataaagtcccctatcacaactacttatttttgttctcttgaaagagttgggtgcctttttaataagatagaattgattattaaaaaaacaaacttaatatatcattaatacaataaaaaaatcatctccatttcataccgaagtgcacatgtctcacttgtgtctaaatgtataaatatttttaaataccacttctatcaattaataagagaaaaccattaaaattagatataaatacccatctaacgtgctaagttggccatcgctgctaaggatttattctataatgcctttaaatatgggtgccgcattgatgtagccatacccttcaagactatcgtcgatcacaaattttaatacctagctcacggtctatacacttataaaaaagtgtattagtaagtaggctagtgagttctcctaccaagagtgaaaggagtcatagaggactcgatggactgatcgtatgtaggtaggtacaaacataataaagttttagttttaaatttgaggattaggagggaaagattaatatttttaatcatacatgcgtaggtatgtttttctaggtttttttcgatgaatagtacatatttttctgtggtatggatacgggagattaatatggagagattactttgatacatctaaactaatgtttaaaaataataggtcacatgacggcttaggagcatttgtatgatgttcaatggtattttagtatataataatattcttgcctcaatgattggtggatagtagtacatacacagaattgatacaagggtttaagtgtaatatagaattgacacgtaaggcaagacatgtatgagtcaagtacactggaccttatatactatatactcagattaacttaaacttatactccgaagactaaagaggaaaagatcaacatatacacctcctattagtcttaattaagacatatcggtctagttcatttaattattttttatagtcgttgaaatgctaaagatataattatatcaaaatatttatctggatatatctagatttacattaatgtgataattcatattttaaaacagaaataacattttttagtgctaatcacaattagagtattctagtttgggatattgtatattcctttaaatattaaatttatgataacgtcaatttttctgaaatatttaactaacattactttgttttgtgaaaataatattattttaacatatcaatattttagaacagtggattttttagagtgctaatcagaactaattattatattttattttttgatattatagagctaatctaattatgcatgattgtgaagtgatatatgatgatatgatctacattatctatgttctacacaatatttttttattgttggatggcatgtgaaaggttcggatatgatttgaaataatggaggaacttttttttaatgttactcatgctttaagtgtttttattttttgtcatatctattatatttaatttatttatgaaagttttataaagtgatacattgttgttttttcttcttttttttgacagcttcaatagcatcctaaggttaggatataataaaaaataaatatttcttatgagttaaagaatgtagtacattttattggtatttatttggttaattaagcaccatgaatacgataatgaagaatgataaaatagacttatgtgcaaggttatgattattcctctatacggaaatgatttaaaaatattttttttaattgtaacaaatttaaaagaaagaaagagatgagaagattgcataggagggggagagatacgtacgtacgtacataccatagggaggagggtgggttggtggggaaaggggaggaaggtggattatggtttttttttctaaaaataaatctcgtaaatgaaaatagtgggtattctaaaaataaatctaatagatgaaaatagtgggcctagcgatttattagagagccacgtagtagcttaggagcgtttgtaggagtcccacgtgggggcttgagagtgtttgtacgaagtttaatggacttttactatataataatagatatgaatgtgagaaatgctagaatgacttacattatgaaacggaggaagtacaatatgcacaatgcatgatggtgaagctgaatttttcttcgcagcttgcagcttctgttgtatcccaatcggaaactctgtaagaaatgcagtaacgcagtgttatgcgcagggtttcagtgtgaatttgggataaaacaccgccagatcgaaagatagtttagttgggatgagaagagattatagattgagaagaacttgaagggaaactaattttgattattcattgcttaatctcaatgcccataacacgcagagagattgatcctattctcgagatcataaattgggccctcaccatctcagcccaccatggaaaagaaaaaaaaaaacaagaagaataatagcataacagagtgtgagttttcagagagagaacttggaagtatacctgggctgggctcgcaccaatttgggcacgaaccgtttcagcccacaaacccattatttcggttacttgcacattatttctgcaggattctttgagaaataaatttattcagcacttggctgagcatttttctcccccatgataataggccacaaccgattgggtagcttagctttgctgtctacaaaaatatcatacatgtggctttattttctctcgaacattcctcctacatgtggctcatagtccaaaccaaaaggaaaaagaaaagaaaaagaaataacggatctgccaaggatggcctcaattcccagtaatatttttgtagcgttttaaaaatatctcggcccctagatatttcaattaagaagaagcatacaaaaccggggtaaaaaaatatcacgaaagtctatcctccctacactaggaatatcgttctctacggatcaggtcttaactcgtgctttgaggccctagctatccatacatacatatatgtcgacttttagcccatgtttttgtttttttttttggtggaacaaaggaccgaaatttcttggtgggatgaggatttaaaccctggtcgatagcttcccaccggaagacatccaccaccattccacaagcacgtttgcaatttccagcattcttcctagctagctttgattccatcgtccatacatatgtatggtcctttcaccttttgtagtcctgttcctagctccattttttgacctggcaacagctcgcacacgtacgtccactcgcccttccactactcgatccatccatacctatatctgcttgcgattggtcgatcgatcgacgacgaaacactgaaaaaagtcgatctgaaccggccatattcagaaatcacagcaacgatgcagaattattgcagatcaacgtacacaagatgctggtgcagtgtgcgtgatagtgtcgacatcatgagccagcatcaccacacctctatccatctcttcgtctggtctcgatctcaaaaacctttacacttcatgcaatattatcactgattattagttacatatatatgtgttcatcgctttttagagaactgagacagatgcagtcaggggcggatccaggaaaaaaaattggagaggctcagttacacagtttcttcaatctccaaccatttagggatctttagtttaccattcattgtgaaaaaaaaaatcaaagggggtgttccagaggtatccataggtcttgtggatgtagggggacttgcacccatgttggatccgcccctggatgcagtgaaggatgatggatgcacgtaaaaaaatatagaaaagatgtgacgatcaaattcgatggatatacatatatacatctatatcttctttctccccagctaaaccaccaagctgaaagaaaaaggtgtgacagacaaggaaaaagatagagctgacgatggcgaagaaacgatcgaacgatcgatcaatctctctcctttcccccccccctgaaaacctacggcgaagtagaaaactttgtcttcgctttaactgcttgctgattctctcgcccatagttctcccatcactggtggagaaactatctttcgtcggtcggccgaattccacaatagacccggatgtaataaaaactggggctaaagatgatctttagtcccggttaaaaagggtaacggacatatttgatctttagtcccggttggtgaagatcatctttagtcccggttcaaatgctgtcagggcctgtcaagcccccccccgggatctttagtcctggttggtataccaaccgggactaaagattccactgggtgcattcccgtacgaacatgctaagtgtttcatatgtaatgcatccaacgcacattgcagattccactgggtgcttttactcttcgacctggaggcctgcaccgtcaacgtacatgactcaatggataaaaaagagtctacgtttgataaggttttcgaacttatagacaggtactgtcataagttcctatgttaattaagaatcttgttatagttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgtcgtttgtcatttatttatagtgcgcaaagcaaaagtagggaactaacttgtgaggctactacgtgtgcgagtattgccactaccttgtagaccaaatcatcaccacaagagagctcgatgtacgtacaaataaattcaaaatttcattttgtatcgatttgttgtttaattactaatcaatttcatacattcatatagtttattcgcatgagggataacctgatcacacacaaggaatttatcgtggcggttcaagaacaactcatgggatttatcaacgaacaaatccttgatcccaagggtgaattctactacgacggaaacacaattcataggtccttagcttctgagatagcgactactactacgtcaaaattgtagctagctaggacatataatggattgtaattaatacatgactatgtttctatatgcatctgtacacattttctataatgtaaatatatattttggtcatatatatatatatatacatatgcatttgcataacatatatatgtataaatacatatatattatgcatgtacatatgtattggaacatatataaatataatattttatatatatatatatatatatatatatatatatatatatatatatatgtattgaaacatatatatgcatgtatataaaccatgtagcaatagggccatgaaaaaaaaataggtcagctcgatctttagttccggttatttcacccgatactaaaggggattatgaaccgggactgcaaacgctttctccaccagtgcattttccgttaatttagcactgtagatagcatacgtggtgatctgatctgaatatatatctgaatctgacgcagatcacgctcagcatgcgagtatataggcttgtagtggcatatcatgggttgctgctgccattggcggtagctcatcgaaaagatcaccaactagctataagctggagtagcttgtagcttgcactgtggtatgcctgcttctgcggctgctgctgctggtagctgcatgcagatgtgtttgctagagagaaagcaaaggcgtggcgagaatattcgtgaggataatgcctcttccgagtcgttccaatctctgcaattctgcacacgctcctcttcttttatctgcacgtactgttcttgcagtagttggcatccaagaggcggacttactccatccgtcctaaaaaaaagactaacttttatctacgaatcaagatatagatatagacataacctatgttcagattcgtatattttttaggtgaatggtgtatttacgatgtgcactaaccaatataataagggtgtatttagttcacgtcaaattagaagtttggttgaaattgaaacgatgtgacggaaaagttaaaagtttgtatgcgtaagaaagttttgatgtgacagaaaagttgaaagttaatttgaagaaaaattttggaactaaactcagcctaaactgtcaatgtaggatggagcgcttttgatcatgttatttcatctttggttgtaccgcagtttggattgcagggagaaattttggatggatcacgtgtgtttattccttgaaattattttttgattttgtatatgttttaactaaggataacagggatgaacatggtggcaaaaatttccgaccgaccgagtatgattgctctaaactgttttcaattctaaacatataacaaatttgattagaatattttttgtaagtatcgtattggtatcgtcgctaaactgttatactaataaatatgataaattctcaagtgagtgcgaaaaacgtttctatagacatgatatcatttttgaccattttcattcaacaagatgtatcatagccaaaacattacgatgacaaatcgttgttagtaaataggaagggcttatttggaacacaagaatttagtatgattctcgcgttaaaagagatcgcatagttttcatgtgctatttctatattgcaatggtaaccatttaaaggaaaattttgcgacggtaacctacactacacagctacatctagagtagcatctctaactaggagagatttgatgatgagctaattagagcctaagctttttttctcagtgatcaagaaagtgcattcaagcttttttttttcctctgttatgctatcggcttgtttttcaagctgggtaatgaaagttacctgttgtcaaaaaaaaaaaagtgcattcatgacgatattatgatcgatcgatggcaagtgagaaaggggtccagatccccaccgagtggatttggcctaatctcaaccgtccttttgacttatacggctgagattttctctaatctctgtaaccgtgtttctttcttttcctaattaaattacaagtaccaaagcagcagaccatcgttttccctccagagccacaacagcttcatctttgtcatcgaactttagttcagctatggtgttaatattggcatattgttattcattgcctcaaacagtcaaactgaagattcaagggtatctacctccaaccatggtgaagaacataatgctaatgtttatttagatggttttgtgatggacaacgttgttttattgatattattggccggagaataatcatggttatggtgggaagtactaaaaaactaaatattttcctctaaatctatatgattaagatagttgattagaagaagagtaggggccatgatcccagccatagaagtcagaagaacggttaagattgagccaaatccaccggtggagttagccccaactctaggggatttggacccgtgagaaagagtcatatgctccaggatattcggcaggctaggcaagagaaatttttaaaagagattgaaattctgagccctggtggtggagacaatgatggcagggtacaaactgtgttgttcactagctacctctgtctttgattatctatgatgcagcggattacagtgagaattttggatgcatcatgtttgttttccaaagaatttctatttgatcatacatgcattctaaatatcataagtatacccttcgacaaacttattttaaaacgtaggaattgtcccaagtacttcccacctcttcatattttatttgtagcttagcccataacactagttcacattattaatatattatttagtccatgattggtggtatttatctctaatagcacttttgggtatttcaatatgtatttaaatatatttgctagttgctaccgtatctaagttattcgtatgtttttgcatcctgctaaaaattcatactaaggtatgtggtgtttaaatctcctgaagataaaaatgaagataaatattaagtgttttacgcaaaacaatgtggtaataacgtgtgattaatttagttttaactattacaaacttgaaaaatggattaatataatattttagaataactttcatatagaaagttttcacacgaaatataccgtttagcagtttgaaaaacgtgctacttttattaaaaatttattcaacttttgttggagaaaagaacagggttcctccgatataatccatatcccataacacattcacaccgacaagtcgtcggtcgtaaatactaagggcttattcgggcacaaagaatttcatatgattattgtgttgaagatcacctagtttccctgtgccatttctaaattgcagcggtaaccgtccctacactacatagctagctctacacgcccagagaagcagcatctctgactccgagagagatttgggctaatcagagccagagcttttcctaattctccatggcaacaaaaacccaacaaattaacgagcatatatatgaaaaattaagtgcatccatgcatccatgacggcatagatatgatcgatggcaacaaagttgcgacttggcgacatgaaacagagtaatatgctccaggatattcggcaattgaaattgaaaaaaaagttaaagatggaaattggtgagctcctggtggtggagacaatcatggcagaggggtacaagctgtgtgtgttccctgcctctgcctttggttttctgactaggcccccactcccaaaagctccttttcccaaaaacttctcaagaaatgaaggcgttgcacacggacgatccgccgcttccactagctagcaaatagtactactagtactagggtactttcgtttatgtatctcaccaaaattagaacaatattaaaaagaaataaaaaaaattagagcaacattactcagttcatggatgcttctgcgaatgacaggtagtggaaactaccagtacctgcatacaatgaatggagaccgaaattttgacaaagggacccttttgcaaaacttgtttttaagaatgaaccgtgaattcagcgccaattaaccctaatagcgtggagatatgactctcgctagttgcattagagattttattactcccttcaaccacaaaacatgttattttgaaatgttttactccctccactagtatgtaacttaaaacgtttaacactaatatctcgtcaactatgcagattagatgtagggaaatcaaatgtgtatatttgcctcataaagtaatttagtccggtttcctagtttttcaaatacaaattaatgatcaaaaatttattttaggtaatgtgtcaatgtctaaaacatatttttcgcgggagtggatacttcgatcttttttcccgaatgtaaaagtttctctagtattgttcggtcttgtccacaatatctagtgagagtgaggacgagagcgaagaggaatctaggcggcagtaacctcgacaaccacatcggcaaactaaggatatttgctgaattatgattttcaaagtttatggatggagtaatatttgatacaagtttaagaaattaaatagcaccgacgaattttacttttagatatatagagccgtttcatgcattttgccactcgaaaaaatgtctttaattatttttcatcctagtctatatgccatttgaattagatggttatatgaaatggcagcataatcaaaacgacaatatttattgtgtcaattcatattcctcaaaatttaaatactggtctagactcgaaataagatgatttaggaggacggaagagcacaaagcttccccattaccctctacacgctcgaggcgccgcttccaggctagccgcaacaaaaacacagaacgccctccttttggaaagtagcgtagggccccgaagtgacatgacttggatatcatattagcatcgctattggatttggacccctctactctacacacacctctctctcttttccccttttattttctcttccattttcttttctatgagagcaaaaaagaaggaattcttggatgatgatcactttggaagaaaaagattttgggggtgaaatgaaacctatgggaaggaattgagaactggagggaggaatcgatcagtcaatcagtcagtctgtcactcacccaagtcactttaattgccaatctagttagttatgctaaggaatattacttgccatcaaacaagtaataataatgatgatgataaagcacctttggcaaaagatggaggtatgtcagccattgataatggattagataagcaaaaacgtatggttgatctcaacttaatggcaaaagaggtatatatacaatgcatagttattcgcgcattggccctgttcctgataccagcttgtaggtaaaaggctaacaattaatgccaattaactaagaggctacaataccaattaattaagagatgttttattggcaactctgccactggtaaactattttgtttacttcttccgtttcactataagttaatttagtaccacaggtgacacattctaatactacaaatttagacattatactgtccagattcttagtattaggttgtgttatatccagtactagataaacttattctggacggagatagcactttagaaagaaaaacgaggaaaaccattagctagcatatgattaattaagtattaactattattaaatcagagtaatagattaatttgatttttaaaagaatttctatatatatttttcataaaacatattgtttagcaattttaaaaatatattcactgtaaacgagtgattaacccaacccaaactcactttctagaacgctccctaactgcagtttaaatgcagtaagtagccctgcaagccagtttacagatgtttgtgataaggtgtcattataattcataacatcgatcatgaattcggtacggtcgttgacaaattaaagtgaacaaagcacatcaatttggtaagaatttgccccttttgttcagtttctaattgctcaggaatatatcctaattgttcaataattaatagcagagatatctttttgttgaaaagaacaatgccaatttttttttgaggcaaatggacatacaaacaaatggatcatggatgcacctgatcgtacaaagtggcaacagaacatacgaccttatttctcctttgattaaagttatcttatttaatttttttgggggagagaagtcaatactcaaatgtctcaataataatatatatcagatgtggtcttgtatgcagggcccatagttttggtaaagtttatacatcttgaatgatcgccgctgttgtatgaattccacgcaacgtgtcgcgacacactttaattgcacttatttttaagtacctgagtattttcatttgctaagaaattaaactaactaaagtggtttgatcgatctaaaaaaaaagccgctagaagggatatccaaaccggttttatgatttgagattttatacttcagagcttaaatggactttattgatgtttaaaataaactgtaaaattaactaatgttaatttatgattagtttacttcacaggaacgcattgatgcatacccatatatggcttgtatagcatgtttggcatcaccatgagggggtgggtggtaaggttataggatgcgaagagagattttaactctagcatctccataccaaagcatatgacaattttgttgatgaactttacctctttttctttttttaaaaaaagaaaatacattaggcaatcgtaatatatggaaggtctcccttttttttttacctctcgatgtgatgggaggtaacctaaaagttatcttatccatgtactttcggaaataattggagtgataatcgaggtcatttatcttaggggtgtaaagttttggcgtgtcacatcgggtattaaatagggtgtcacatgaggtgttcggacactaataaaaaactaattatagaatccgtcagtaaaccgcgagacgaacttattaagcctaattaatcgggtattatatagcatgtcacataaggtgttcggcactaataaaaaactaattatagaatccgtcagtaaaccgtgagacgaatttattaagcctaattaatccgtcattagcaaatgtttactgtagcaccatattgtcaaatcatgaagcaattaggcttaaaagatttatctcgtaaattagtcgcaatctgttcaattagttattttttagcctatatttaatacttcatgcaagtgttaaacgtttgattgcaagtgttaaacgttcgatgtgacagggcgaaaaattttaaggtgggatgccttattgaagttgatttgttgggaactgtggatatctacctcagtgaattgatttgttctgagaaatcgctcgataaaccggtcaaatttagaaggaaaacaaactagatttttagcttttggcaatttttgctcttaattcgttttcaagatgatcgacccggcttttcagaaagcctaaaacataacaaagtcttttagagaacacaatttttttaaaaaaaacacacacgagcttacccaaattttaccattaaaattttcagccaaacataaccaaattttgcccattttcacggtaaccacactaaaatcaacaaaagtgaccggtcccccactatgcaagagccccaaacaccactgtgtatgtgtgcatcatctggccatctgcactactcgtcctatctgttgtgctctgcagcttcttccttccttgcgacccccttgtactgtagcagttgaagaagcaaaaaaacacaagttccaaccaatcgtgcatgcggccaagctactactgtaccagtgctagcacagtagtaccggtcagggtgcgcctctgctctgtcgctccacacgaattttgcatccatcacctcaccaaacacacgattactctgccctgccccccacaaaaaggttgtggtgtgagttgtgaccaatctgaattccgcaaatgagtgcttggtgactcattgccatggaggaggttgtccatgaactcatctcactgatcaatcagaacaatgatgaacagaaatcatcggaaaaggaagaaaggaagagatgagatgagtggaaaaggaagaattttttggagttggaaggggaagaaaagccttgatgcatttattggaagcacaaagctttgccttttgtcagttgcaacaacaaaccaaaagacttgaatttacagattccaaagccgaagctggccaagaattcgacccaaatttgacctctcgtctcctctccatgtgtgctagagctagcagccgatgattacaggggtggaaaaaattaattcctagtagcaaatctcacgaacaaaattggtcccacgcgcaacttgcagcacgggcggtttcccctacggctcgccggcggcggccggtggcggcggcggggggaggacgaaggaggagagcggcttggcgctggcgaggaaggacggcgcggtgtcgccggccatgatgacgaccaccttgggctcccggtcgagcggcaccagcaccttgaccgacgccgccgccgacgccgacgaccccgcgtcgccgtggttcttgcggcgcgtgcagaccagcacgagcagcgccaccgcgatgaggcccatcatcaccgcgaaccccaggaaaaggtacggcgtcggcgtcctccacatccccgggtgcccaccaccaccacccgccgccgccgacgacgacgtcgccgccaccccgcctccgcctccgcccaccagcttcactcctcccctcattctcgagctctgcgtgtgtttgcctctctcgctcgctctctgctgcggcggtgaggagggagaggggagaggagggggtatatataggtgggcgaggagggcgcgcgcggttgcggctagccgctgctgggttttgtgggcgcgacgcgacgcgacacgagcgcgggcgcgtcgcgcgcgcgcgcgcgcggcgctgctgggtttgaggcggagtctgcctggcttttgcttggtttgggtgacaggtggccgacacagtggccagtggagagtggagatactactactgttgttgtatccagtgtgaatgtgtgatatggactgtaagtacaaagttgcatgtattgatttaattgatttatatgtggtgtattttggagtgtcattaaatgtgaatctggaagtttcttgtggagacaattgaagggagtgcaaatttaagggggtgattaaatgagtctcttctgcttttaagcatgaagagagaaacattaaaaggtttttggaagatatgaattaaatcctggaacttcttcaattggtctaattatattatgccttatatcataggttctctgttacgtggtaaaagatatctaaagcaatagtctagttacttttccttcgttccaaaaatatatagcaaactaagataagattggaaattttctagtattaagaatttggacatgagaaaatatctaatttaatcctaagatgctatattttacaatggagggagtgccctttttttcgcaaaacggtattatactatgttcgaatatgtagttaccagcctgatactcatagatactaatcctggttagcaggcatatatcagacgtggcactcgtgcggtaataggatgggtacttataagtacatcctataatgtgctattcttggagtactctctcacatggccgcgcctcctttcccatcaacaatagtcggagttgaaggtgacgaccctcgctagattgttgtggtagtaattgttgtacaagaactccacctccccttagctttagcaagaatgagggaaacaacggggccactcctagttgtgcaagttatcggcgaggaggttaattatatttgttctagtggtgcagtgagccagtgaggtgagtgtggagggggattgttggccgacatcaatggtgcatgccagaaaaggatgacgagctcctcaatggtgaatttcttgcggcggaagtcgtagatgagccaaaggtgggatttagaaggtcgcgctgggcatccaaggtgcaggagaagatgttgtcaatgtaactagagatagccttgaagtggacgtgttaggatagcactcctccatcgccgccttgatctcatcaatcagctagaacgataccggtcgaccaagcagcagtggtggcacaccgcacacacctttctcaaccgtgcgcatgggcggaggtgcggcactgtatcatcctgcgcgtccatatgggatgatgtcccataccccttttttttcccaatatttttagagatttttatgtaactgtgcggtggagcacacctagtagttaaatggaaaaccgaaactcgagtgtacatgtgtgcaggggagaagtcacgtctaataatggtctaaagcagttaggacttaccctagattagcttatactccctccatactcataaaggaagtcgtttaggataatgtttaagtcaaaccttgggaatataaatcatgaataactttcaagttattgagtttgaaaatataaaaattatatgtatagatttattttgaaaaatactttcataaaagtatacatatatcacttttcaataaatatttttatagaaataagaagtcaaagttgtgttttgaagaccgtgtcgttgtcttaaacgattttctttatgagtatggagggagtattttctaatttattatactcagatcctcttaaatccaatgaaaattttggagaataaccctgcccagcggtcgatagttaaatgcgtgcatggattcagtgaacctggccgtagtgggaaaacgtcggaaggacgaacctacccgggttgcttggaatgatccattccagagggtcatatataatagtactcgcgtccttttgtacatttgtactgcaaatggctcgccgtcgtacgttgctatccacaaccactgtgagcagtagacagtagtagtgcactagtgcgcgttacgtaatactactagtagctaaaccgcgtcttttggctctaattggccctctctccccgtgccttttcttcatccattttcgctgtgctccactgaggacagacaggcgatcgaccaactactcctctaacccttttcactggaaatcgacatgcattttgtacaattgtactgctagtgttagctcgctcgcgtatgaaacggtgacagaaaaagattaattaggcatataaccatgacgagataaatatattaactgtgatcgaatcacgtagtagctggcggcgaatgcggccggctgggcggcgacccggcgtgcgtcacacacgggagaaaatttagttggctgcgtgctcgatcgatcggttgctctgcgtcggtcgtctcgcgtttccgagtcgccgcgcgcgggcgccggcgcggcgtttacgcacacgccacgcgagctgtcgtgcgtgtgtgtatcagcaggaggtgggcgcggcaggtggcgtatgtactgcgtctcgaggcaagcaaagagaagcaagcgcgttatgtcgtaggagtacgtacgtatacgtgtgagcgtcgtgtgccgctagcctttggctattcactccgccgtctcacagataagattttttttaaaataataattatttgtatcgaagtttataaaattggaaataaatatattaaccgtagataaagaaatagataattgtattgtgatttgctaaaatgaggatattttgatttttggttttatattgatatgagtaaaaggtaaatttattttaaattgggacagatgaagtgtacttcagaatcagatatggggatcaaattcgatcgctagctgctgcacacatgcgattttccaagtgctcgatcgcgtccgtccaacgatcgcatgggctactagcggctgtttgttgttcgaagtgtctctttgctactactccattctcgttcggatcgagtagcttctggagtgatcgtatatatcatcgtacacaaattgcgtagaagtagcactgtactgcatcctcacgtctgcgcgcagaggtctctgatcaaccgatgcatcgcctcgtgtgcacgaaaacggccgggaaaaaggcaaacttcgctactcagtagcacagtacggcgtacctacgcacagtacactgatctactctgctcttctttgaataacacaagacagaacacgatagagagaaaggaaggagaataaaatcacaagcgaaacgagaggccatccgtcaattttgcgcgacctgcgtgcgtgcgtacgtggaccggccggccggccgcgcgccggcgcgttcgcgacattccttgcacacccgaagacaacgagtcgacgacgacgctgacgaagacgatcgacgacgtacgacgaaggcggcgtcagagacaatggtggagcggttagttttgacatcacgcgggccgggtcgccgcgtgcgtatcatcatcatcgacaacagcaacatccggatcagcagctggctcgcgtcgcggcattggtttaacttttacttttgaggcagattttcctctcttctttctgggataaaggaagattcgagcgcactactacttcgttagtggcggtaattaattaagggtacccattaattaattcagtagtgcgctaatggcgtaattaatgggccagggcgaaaggcggtttgttgggggggggggggggggaatttggtaaagtttagtactgcttgaccaggctttaggtaaaaagctattcttaaaccaggtgctgaagttaaagttagttgtgagtacgttcatccggaagtacaacgaatgttgttgcgagatccgtctctcgggtcagtacgaaaagtgatgtgatttcctggattactatttctctcgtcacactctagaagaaattaactttaactttgccatgatatatagccaccaattgttaaaaggtttgacttgcacatgccaaagtacggtttaactagttgttactagctacgatcggtatgcatgactcatggattaaagcgctaattaacaaattaagtactggattgctacacagttataaaaacgagatcaacacaccagctaaacctaacaaacgttgcatggaatatcataacactcatcaaggggttattatattgtctccaacaagaagagattttctgctccagaaaaaccggtttaatcatatgatctgaactcaaatctgtataggtggtgaacatttcaccaggaggaacagatgcaaatgcaacatgaattgcacatatttccatggccaagactagcttagcaactgctagtaaggagtaaactagctagtacatgggcggatccaacacccacaaaacccatggatacccccctaagccccccttcaattttttcatcatagttgataagataagaagtgctaaaggtcttataatagtattttagcatagtttaatactgagattatgtgtttatatcggtgtactcggtatgttgagtcccctcaactttttttttctggatccgccctgctagtactccctccgtttcaaaatgtttgacaccgttgactttttagtacgtgtttgaccattcgtcttattcaaaaaatttaattaattatttattcttttcatatcatttgattcattgttaaatatactttcatgtcacatatagttttacatatttcacaatattttttgaataagacgaatggtcaaacatgtgctaaaaagtcaacggtgacaaatattttgaaacggagggagtacttaaaataacagacaatcgctagtgcccagatctttgacaaacagaaaagcagcgtcgctctcagctcgatccggcccctctccctgcgatgcggtggctcgaccggcactacattaattacacgcgccaataatcaatcacgccacaaattcttgtcatcttggaccgacagccataatcatcatatccactcgatccatcgatacgatcgatggcgaggtcaacattacacagctacccacagtacgacgacggcttcatcaacacctacgtggctgcacgtgccatgcattttcagccgattcatcggcgccgccttgcgattccggcgtgataaacgcccgctccgctccggttggagcactcgatcgatcggtggatggtggtgatgcgacgatggcgaaggtttcagattggagatcgcgatgtggcagaagcataccagcgctctctgtcagctgtctctgttaatttgtgtttctgcccatcattttcgggtggagaaaatggcttctgctgaaaagttgtttcttgtctggcctcttgcttgatgggccgcgtcaaagcccagaaactagttggcccagctactgtataattgaggaattttttatatttatatttattttctaaaagattgaaaaataaaatattgttctaaagtttttaaaaatatacctctcccgacataccgtagggtggggcatataaaataccctatggtagggcgggctctgtacgtgtcacaagatgaaagaggtgccgtaccatgataaaatttgcatattgccctttctcgtcctctcctaggatgatttacttcggtgatgtagtagatgtgctatggcaattttgtaggtgccccgctccccagcgataaatcgcccacccaagaataatttatcgccgagagggggctgcctgccaaattatcacggtgtaccctctcgcgggatgccacatcatatagattaccctttcgtaggacgatttatacgtatcgtgctacaataggacaggaggagtatatttctgtaaaaatttgaaatgagaattcatttttaaatcttttgaaaaagaaataaaaaaataaaattctataattgagctctccttggagccacaaatcagagggatggtaaaaaacagaaagcccacgagctaaggagatgcttagattctcttaaaccatcacaaaagttttggagaaaacccttaacttgttaaattagttgagccctagtcttaagtgctccttgctaccagttaagggcttgtttggcacagctccagctccagctccaactccactcctcctagagctagagctcagccaaccagttttaactccatcaaaaccgggagtggagctgggtggagctctcttacaaaataaactagagttgtggagctgggtttgggtagctctacaactttactccagacccaacttctgaagctaaatttagcagttggagccgtaccaaacatgccctaagtaatggtgagtttaagcctcgttctaaacaacttttatgctgaattgatttgtaaaagaaaaagaaaaaaatattagtatataattaattttctaagtattaattattacaagattataatttacatttataattattattaaaagaaaccttcatatgattttttatgtgaagtgccctgtctagcagtctaggcagtctagctgtacatttagctgttgtgaacgtggccgagagttaaatgcatggacttaggcctgctttagttacaactttttcttcaaacttttaactttttcatcacattaaaattttctacacacacgaactttcaatttttctgtcacatcattccaatttcaattaaacttctaattttaacatgaactaaacacacccttagtgaacttagacgcgtgaaaacgtcggcaaagaacgtactggttgcttgggatgatcccgaggcgcctacaaatcagactcaaatcaggcgctgttttaccaaatagatcgaacatgtttcacataatagatcgaaaatgtttcactcttttagaaaactaaaacacaaccaaatcacctcatgaaacattttgctacaatgtatgaaacaactgtcagggttatagataaggtatacctcctatcctgcgacttatgaaatataccgataaggtttatcttcacgtatacggattgttcctatgaatgtcatgaggaaaccgactcatgttatggaaagtatctctacgagtcaagtgatttccaaagttctactcggaatagatagagtttctgttataccgtatcagatccgatatcctcaaacctttcttggggatcaagatgatacacggtatgaaagggaccccctggcaggggttcaagacatccaattcaatcgccaacacacccaacaaagtttatgaagccggagtacgcggagtcaactcgccgggagatctcgtcgaatccctcgactacgatctcgtcggtaccatttgtttcgactactctctttgtaatctgttctcatcatcatcaatctcatataaactggattagggcaattacctgacaaggggcttgaaccaatataatccttgtcttttgtctgcttgatgccgtactacgtagaccctcgttccgacataccctaatactctactcatcaggtccgtaagtatcactcgtcgacaacaacggtttctaaaaaatcagatgttgtttcaccctatataaaaacaatgtttcagtaaatagcgaaagaatgtttcaattcttaaaaaatgtgaaacacagtcagatcgctagatgaaacaatttggttcaacgtatgcaacaaacgatttgaagccatttgcaacacttaaaccccgtgtacatcaacaaaccacgtgtccatcagatggaaaatattaaacaatacaaaaaatccactgcaacatttcattcatatatagtaaaacatcacaagtacacttgctgaaacattgttggtggaacaaattaaaaataaaacggattcccttaataggacgtttccgtttatatccgggcggttgttgcaatggggacgctgttaattgacgtatgaagtaattagaaaaatgtgttagaaaaatgtaattccttaataaatacatacgtaccccacttttgtgtctcccgaacggcactgacaaagtatggattatcggcatttctacctggaatgccggcggtaaagaagaaccttgcccatgactcaccaatggcctgcctagcttgcttccccttctttgtgaagaatcctatgtcaatgcgtgtctgcacagggaacttggcagatgctagattgtaatctcttacagcaggtgactccctatgagatgtagcccttcgtagcatactggtaattgggttacttctacctttccgtgcctcgagctgagcggatccactcccaccaccatgctcataagtgccaccacgctcctccacgtggctcctgaagttttcctcttgtcatgaggctgccatggctgcttccatttgttcctcctcgtcggcatcacctgttaggtcataatagttgacccctgccgcttcaacccttctattgctatcattctgacgcttgtcacctgtttgttttatcctctccaattcacgcttgaagaaatcacggacatccggaggcactgaattgcaatatgtaacccccttccctttgtgtcccaagtgcatttttagtcgtgtggccccaccacctttcttcctctgatggcaatacttacaacgccatccaggtgcaaaatcctccccgtgctcccacacaaggtccctactttctgccatctccaccctgtatgaaatgcatgaaaaattatcactaggaattataaacatacctctcataacgcaataatatgtatacagctaagcttgcacccaaattcgggcatgtatacaacaaaacaatcaaatgtactcacatgcatggttttaggcaagtacgggcaaccaaattcgctaataaactcatattcccaacgtacttcacataatccccaaatataattcatattcacaatgttttcacctaatatgttcatatgacagtataaaaaaacatataccacggtttcacgcacggtaaccacggtatcaaccacggttaccgcggtttaaacaacgattaccgtgctcaacaatagcagcgaacgtaaataacaggctacgggttctcttccaaaccgcacggttaccggacaaatctcgcggtaaccgccccctttcatgcgcatacctgttggtgggcgagccagtcggtaacccgcttctaccacgcggttaccgctgcataccgcgcggaaatcagccacgccggcacggaggcggcggatctggcgcggcagtcctcgtcgccccttcgaagcaatgcgcagctgtgagagagagaggaaagaaatagaagaacgcgacagaaaccaggaagagatgcggtagatattttccccccactgttgggccttattgggcctcctgaacagtgcatatttggcccattacattaattattttttctattttctaatcgacattagtttttgcgctcaaatttgaatttctattactatttttcaagaaatttttacaccataacaacatacaaatcaagctatacatccatgattttttttggttatttttgaaaattttgaatttgagcaaaatttgctcaaaccctaccgtcggtaagggttaccgaccccccgcggtacggccggtaaccgcggtaaccggcggtagggtgaaccctgcaaatgacatataatatgaaacggatagggaagaacttaaaaagcaaaattaacggacaatcgatcgctagtagtgccaggtcttttgacacaacaggagcacctagcgtggctctcagctctatcgatccggcccctccctgcgtctgcgatgcggtggctcgaccaataaattaattaatttaatcacgccacaaattcctgtcaccttcgaccgacagccccatcatcattatctccatgatgaggcggtaaaaaggatgtaaaaatggcaacggtttcagattggagatctctgtctgtctatctgttaatatgtgtttttacacatcattttcgcgtggagaaaatggcttctgctgtgaaaagttgtttgttgtctagcctcttgatgggctgcatcaaagcccaggaatcagttggcccagctactgtcgttgggcccacgatccagggagatggtggcggcccggcctactgagttggttcttggtgggccggcccagcacgtgagacgttttctgacaagtaggcccggcgcgcaaaccctagatccgtggccgcagacttacacgacgacgcgccttatctcccccggtcgccgtgcccgcccgtcgccgtcgccgtcgccgtcgccgtcgacgccgcagcagccgggagggaggcctcgtcgtagctcctctcctctcccgcctcagggtcggggagcccccgcccccccgccgcgggttccgttgacgtggagccctagcgcgcgccaccgccgggcgtcgccctcccgtagcgacaccgccgccggcgtcgccgccggtggaccgctgatccatcgtaggtaacccccgaagtgcgtctgctacggttcgtgaatttatcgattcgattcgtccggcaaaacttgattgttcgacacagcactataaagagaggcggttatattacttcttagctttgtaaaatttcgaaagattagtgtattattggcctcctccgatgaataaattttagtgcttccgctccgcggctgcttgcgggtttgggattctggcaggagtggtactactacttgttttactctgaattcagctaatttctgccatcttagttatgcaattggccattatggattcttggtaaatcttgtttacatgatttggaaaagtagcgtgaatgcgtagttattattatgcctgaatactgggctgggcaaggtacacaattcctgtgttgtcgaatttgaaattagaagggcagctagccttaaaaccttctttaaagccctgaattcctgggtccaggtcacccaccaattcgatcataattggacacgtgggaccagctaaaccaatgtttaagttctaccgttcatcattacttgaccaggcagagtttgtgcttcacaaccacactgttttacacccctgtagtttcacatggttgcccttgtttgaatttacaaaagagaaactacaaggtctgcaggtctgattatgaaatccttgaggtaaattgttctgttggaaaatccatataatcttcaggattctcgaatcttgcttattaatcgctaagcaaatagttgctttcctactaaggctaactcatgtgactcatttccctgaaagtcacaactttttacataagcctaattgttggattgatcgcttgtattttaggacataagcgctcatggggaagggagaaattgtggctgttcttcaagtaggtggagaattcagcacagatgctgatggactaatgtcttactctggtggagaagcacacgcaatgcttgtcaaaagtgactggacgttcagtgcattcaagcatgaaatatcttcaacgctgaataatatcagagtcgatcagtttgtgttcaagtatttccttccaaaaaataagaaaaccttgatttctatttccaatgacaaggatctacaccgcatggttgagttccatgcagaatctgagactacatacatctatgtcatgaaaaagaaggttgacaacaggtacctatctagttttgtcgtaaatttcttgtcaatttctttgccaaattgacacaagacatctttgcagggcatcgattgttgttgctgactctggtactcctgtagataccactgcagttgtgccaacgactcaggatgggtctaagaggcagaagatctgtgcaacatggaagaatgtgattactggagttggtcaagtgtttgatggtcctaaagatttccgtgatgccttacataagtatgccattgcccataaattccattacagatttatcaagaatgattcatctcgtgtgactgcggaatgtactggtgaagattgcccttggcgaatacatgcttccaaatcccctgccaagaagcaattcatgatcaagaaaatatctgaaagccacacctgtgaatcagagacagtcaaaagtcatcgtctggcttctcagcgatgggttgctagtgttataaaagaaaagttacgcgatagtccaaactacaggccaagagatattgcaagtgatcttcagcgtgagtatggactatgcctaaattactctcaggcttggcgtggaagatcaattgctcaaaaggaacttcatagcacacacgatgaggtaaccagtcagctaccttggttttgtggacggatcatgcagacaaaccctcaaagtgtggccactgtagtacctatggaagattcaaaatttcgtttgtttgttgcattccatgcatcgcttcatggttttgagcatgggtgcagaccattactttttcttgatgtaatatctgcaaaaccaaataagcagtggaagctacttactgccacttctgttgatagtgaaggtgatgtgttcccagttgcatttgctgtagtggatgatgagagcagtgaacactggcattggtttcttgagcaacttaaatcttctgtgtcagcttcccgtgccataacattcatatcgaatggagaaaatggactatgggatgaagtgcctttggttttccctgacagtcaccacggatactgtgtggactatcttattgaagaatttaagacacaattggatgatgcatggaccgaagaagcaagagatgtcatggttgagcatcttaagaaggccatatatgcatgcacagttgacgagttcaatcagtatattgaactaatcaaaggtgaatctgacaagcttgctgaatggcttctggagattaaacccgagcgatggtcagatgcctttttcaaagggtcaaggcatgggcagtattcatgcaattttcctagcactattgttgagtggatccccaccagatacgagctttcaattgtccagttagttgacatgataagatgcaagctcatggagatgatgtacacacgcagggagtcttctaatgcgtgggctgagttattaacacctgcagctaatcagaaattgcaggaagaagtgagcaaagcccacaccctgaacgtcatcccttctgaaagtaatgaaaatggcaatgtgttcaaggtgtgtgatgattctgttaatgttgtcaatattgatgcatgggagtgtacctgccgaaagtggcatatttctgggttgccatgcatgcatgcaattgcagtaatagagcggattggacactgcccttacgattactgtgtgaagtatttcagaacagaatgctaccgcttgacctactccatgtcgataaatccaatacccgatgttatgctgcctcctgctatattaagtgatcaatctcaaagtccagtaacacatgcaaccccaataagaacccgacgacgggttggcaggccaaaggagaagccggcagacccacgcatcgcaattaaaagggcagtgcggtgcagcaggtgccagggttatggccacaataaagcaacctgcaaagttcctctgagcacatagtctacccatgggttcagttctcctatgtacatttaggtggagagttgctcttgtttgctgtaatacgagtgatgctatttctttataactcggtacatgcatcagtcattgattctagctctaaattgctttgtatttgcttgctttgttaggctaacatatttggtcgtaaaatcgcacattgtaatggacgcaatagagagacttgggaggtttgctgttatgtaatgctgtccaatttgatctggtttcccgttctagctattgtgtgccaatctgatcatctcaactctcaggcaaggaaaggaatatatatagactgtagttacttgaaaaacctttgtcagagtatttgaactttgcattattagtttgtttggtttttgcagtagcatacattttatctgttatgtacaaagtaatttcttattcctagagcactggtgaatataattatattttaacacagtcaactgattctctttgaaattccgttgctgtgatatacttgtattgactatataatctacagaacctgggggcacaatgaggatgaggatgatgagctattttgcagcagcgttgagccaggtaatgttggtgctgcttttccatgttcgaaatttctgcttcgcttgctttgttttttgcttcaagatgaatttgttctttttttatgctcaattttttatgctcaagatctatcacctgcatctgaacttaggtgtgtgatcttttggggaagatcttgtcagggaagggtattttgttgtaacgaagccttgtatctgtgaactaatgctgtaaactcaaaatatcatttcatggtgttgttcagcgagtgcttctatgctctcgccgtccagctagagctgtacgtacattgcaaagtaatgttcataagtacatataaagttgtccctcacgataatagtactccctccgctttttttaacgtagtttaaaattgaactaatcaaccttaaatattaaaggatgagggtagtatttctcttctagtaacagaatgctacttatcaattattttttatttttagtcctccgattaacatatgctcaaaattgtttctattctccctcttcccttgtgaagcaccatagcttaagtttctagtctttctggatgattgatcacttgcatactgtgtccaaaaattcaaggacaattagaatttgaaattctttcaagaatacaacgacatccttggatttcccatctcaactaatcataactcatttaattttctcatctactactttatctcaaccaatccagggataatctgatacaaatacgccgggttttaagtctcccgctatagctgcgctatctcccgctatagctgtttgagaaaggttttagctatttgctctcatatacaatttagtcgctatagctccatttggccctctatagtttgagaagctaaccgctaaatgtcttattccgctatttaaaacattgaaatacgtggtacggcgatattgtgatatgtcatattttcaaaaatatatgaggatagacaaatatatataataataagtaaaatttaaaaattatataacatgaagaaataaaaggttaatgttttaaagagagctattcaatttgatcaataggataatcacatattccctctgtctcaaaatatgaagtgtatttagtttttgcccgatctactttggggattccgtcccctgtgcggcgtgaggggatggcgacttggagccacgcactccacagcgtaggcgggatgcgttttctccgccacgcatagactcgcgggacgaaaaggctaacaggtgatcgcggcgatcgacactcaccctcctccacgtgttttcctttttttggcattgcattactttcctattttagtaaatttatgcacctaaagtttttgtacacctcaagtttacacatctaaagtttagagacccaaagtttataagtcaaaagtttatatatccgattcaaaagtttacgcatagactcgcgggacgaaaaggctaacaggtgatcgcggcgatcgacactcaccctcctccacgtgttttcctttttttggcattgcattactttcctattttagtaaatttatgcacctaaagtttttgtacacctcaagtttacacatctaaagtttagagacccaaagtttataagtcaaaagtttatatatccgattcaaatttgaatttgaattcaaatattttttatatatagtatttctatacatctaaagtttatacacctaaagtttatagacccaaagtttataagtcaaaagtttacatacccgattcaaatttgaatttaaattcaaatattagtttatagacccaaagtttatatgcccttttcaaatttgaatttgaattcaaatattagtttatagacccaaagtttacatacccgttttaaatttgaatttgaatttgaattcaaatattttttatatatagtatttctatacataaatttttccaactttgtatttttattttttaaaaaaatttatggtgtagtaggaagagaagaatgggatgaggaagggggagaggagcgtatagggggggatgggggtgatcgctgtgcgatcacccgcccattagccacgcccctcgcgggagggttagaatcgcgtctcccgaagcgagaggcccatcaagagcgtgctctggctgacacttactacctccatcccaaaatgtttgacgccgttgactttttaaaaatatttgaccgttcgtcttattaaaaaaatttaagtaattgttaattctttttctatcatttaatttattgttaaatatacttttatgtatacatatagttttacacatatcacacaaaagtttttgaataaaacgaacggtcaaaaatgtttaaaaaagtcaacggtatcaaatatttagggaaggagggagtactatgttaattttctagttggcgatactaacaggcccgttgacgaggccgtgcgaacggagtgtcagcgcaggccccccaaatcagagagaccagtacaaccagccagccttaggattacaactgacgtcctatgtgtgttcatgtgcatgcatgtgaaaccagctttgatcaacaatgacgctgcccagagcagctagccaactacctcgtctaccatattaggttcctttgaatcaaagtaaaaaccatttgaattttagaggattttatcctatagaaaataatactatagagtcctttgaaacaaagaattgtttcctatcaatttctttgaaattcctatggaatgaaccttattagagcaattttggaggaaaataagtatgagatatcacctcatgttttcctcttcatgtgtctaagattcctgcgtttttcctgtgcgctaatcaatattgtttggagactttcctgtgtttcaaaatcctataggaattcaataagtgtggcattctattcctacgtttttctattactctgttttctcaatcctgcgatttaaagggaccataaagagttagactggacaactggtaattaagtcaaatactgaattgttcatactcaattattgaattgcatgcatgtatccatgcatgatcaattgaatgtttcagtactcttcttttaaatcaaattaccatgaatataatttactaatttaaatgatctattgaatcaaaagtaaaatgtaggatctcaaattatatttcgttccggggtccccgattccgggagacggccctaggtccgaagtaactcgccacgtctactctctatgaggagtgcgggtagcacacttgaggagcttaagcctccagctagaccaggaaccgagtaaagaaccacacttcacgatgcatgtgtcttaaacaatacatgttagtaggtcccacccgtgttagtaggtcccacccatctctcttttcacatccatgtctccccccctctctctcttccctttgccttccccatcgcagcggtggcccaggcggtgatgcgccgggcgagaaacggaccggcggcgcgccgagtcgggaacggatcgacggttgggtggcacatctccagacgatgacgccattgagctcccttttcatctccctctctctatcctctctcctcatgttccaaggggcaagaaggcatgtacgccggcgcctccctccccctacgaccctccgcagcgacgaactctcggcggggtcttcctcgcggaggtcaccacgcgaccttgtcttcctcgcgaaaccgggtggagcaacagcccgagcggcgacattgggctgagtggtcagatgtgtcctaggctcactggatcaaggtgacagcgagctcgggcgtggcctcgacctcgagctcctttccttctccgtgctttcctcatcgagcccgcgagcttctccgacaaggacggtggcggtggcggcggcgcagagctcccaagcagtgtggcgacgaactccccggtgacaccgaggtcggtgatgcggagcagagcgcagggacgaggacgagatcgacgacgcagagcgggagagacgctgtggagggcacgaggggatggtgagtcggaggcacaccctccacagcgcgggcttcaggcgttccctccaccgcgcgtggtctcacgcgagcaaggaatcgcgttgccttgtgtgggagcgagcagctcaagaaggacgcggtccggcgcgacacgtctgcgatattcctagctggtgcaaggaggtaacgctccacgtaggagcatgtgagaggcctgaaaggcgtaggtgattcttcataggttagcgatacgaagtaactcgccacgtccactcgatgaaaaggttcatctttcgctttttcgtgttcagctggagatgtcagagcctcatagtttggcctaaacagccaaagaataagtcaaaatttgaatttttgaacttaattttgaagttgattttgagatgcttttaacgtaagttttgttaatgttagcttttaagtcgctatgaacaaatctataaaagttttacttataaattaatttgtaaaatgggcaaccgatgggagccttagatggaagacagtacttcatctgtaaaaaaaaaaaaccaatctagaaggagatgtgatccttattagcacaataaatatggacaaatatttatctagatttgctatagtacaacgaaatccatctcatgataggttggttttttccggaccagacatacactccatctgaccgttgtctgaccggcaatgaattctgagagggagagaagccggcctgaccaaccgacctccgccgtctcgtcccatccaacaccatctccgaggagccaccactccactccaaccaccacgcccaggcaggcagccttctcgccgcgttcacactcactcacacggctagctcagctacctgcgacatcgtggctgtcgcgcgcttctcccactctccaccgagcatgccactctccgccggctcactgcggcggcggcccaagttcgccgcgccgctgctctcgccggcctgcctccaccggctggttcgtactactccgagtccgatcgaccggagcccggacgtgacgagctgcgtctcggtctcaccagtaacgtgatgtgatcatcgttggtttgcagagcgtcccgggcgagttcgcggcgaggctggacgacgacgacgccgccggggtcggggaggaggaggaggaggagagtggccgacgggcggcggcggtgctcgtggtgggcccgctcggcaaggtctggcgcgtggagctgcgccgctcgccggccggcgacggcgaggcgtggctgggcggcggatggtcggagctcgcggcggcgcacgggctcggcgaggggtggggcgtggtgctgaggctggagcggcgcggggtggcctcgctcagggtgttcgacccgggcttctgcctcgcgcgcttctgcactcctcacgcaggtacaccaaatctcagcaatggcgtatgtgtaactgtttatccatttctatatgtttttctataatgattcatgagccaaagttgagttaaattatttttgcttgaaatatgactaatttggttttactttgtaaagatttgtagcttttttttttaaacattcggattatggttgcatttacaggtatgagaaccaaggacaggcctcgcttcatcaagctgctccaacaggaagacctggaaaagatggtgagcattcaccaagccatcatctttaccttttttttttttttggaatacgcaaggagcgtatctttgtattaagaaggaataaatgtatgtacaaagtgggccgaaaagacaaagcgaaggggacagggtacaggaggagaaccaagaaacaaaagcttaatctccaactaaattttgcgacccttctccactaacatgagctaccaaaacagggattgcagctctagctagccgccacagctccgcttcacccgtcataacccttgcaacttccgcccaagttctgctcttctggttgattacctgcttctcttcttcttatgataatgcactctggccttgtttgatttagattgttaagcggattatcgatcgattggattatggggataagttaaatgctttaagaaataaacttaaacaaataacttaaaacaagtggtaacgtatttttcgaagagtggagcaaataaccccgtttcaatagttcgatgaatgagatgaaaagaacagggccgccttcagctaataagctagtgctagtagtactatgtatttgtggaattgataggctattagctctgaaggtgatgcagttatatgtattatgtgctcacagcatgctctttcttttgctgtcaacattctttcagaaaatccctgagaagtttgtgcagcaacacctgactgaaacctacacaaacaaccaccagaatgccattattgtttgccctcttggcaagttctggcgagtcgaactacaacgggagcaaccggacgtgctactgcgagacggctgggcgccatttctggctgctcatgatctctccgaaggcaacatcctgctgttccggtatgaaggtaacatggtgttcacggttgaggtgttcctacagaacggctgcctgaaggagtacaaaacggcagcgctgtacttaactgatggtaccgaaggaccgagcaatgcgcctcaacaaagtaagccagtagcattccagctccgttgtagtttcaactatggattttccgtgtttcttttcaaaatgtaattatgcaggtgcagcaaaagttggagtttcacctgtcaagcggaaaaggacgcgaagaattgagggtacatgcttagagggaccaaacaggaaatctagggcttccccaatttccgtgaaggttgaaccacataagaaacatgtcagcattgtgtcacagaattcattcacaaaggaaatgacggcctatagtattcatagcctacttgtgagcgcttcagcttctgctgtttttatctagcttaactgcttatgagcttaagaacaaaaaaatgaaattaatcaacatgaaagatcactgacattttgtttcttctatttctgaaaactatctgttcaggtctaaatatggatgatttttttggtttaatacgagcttaaggaaaaaaatatagaaattatcaacatggaaaatcactgacttttgtttcttcaatttctgaaactatctgttaggtctaaatatggatgattttttttgctttaaagaaccaaatctgtaattgtaaaattgtcatacacatagagaaaaaggacactacaacatgatatcaactaaaaatgtagtttatcatgagaattttggttaaataccatcagttaaatgtcgagaatttcctgacaagaagtccttggctgtttattttgaccattttgtagtacttgttattgattctgatatgaaaatgaaaatttcttttgtgtttctcaatatattttttttgttagggaaggcaatacagaaatgccatacatattcttaatctacagtgtgttgacaataacaatccttctgatttttgtgaacgtttattttttcaaaaataatgaaacatctcactactattttatttctttatattgctttaacattgcagtctgtgagaggcaccttttgctctcaaattggtctgctagaagcctgtgcgatcacactgaagatatccatgaagaaaaaaggatcttggcgagtggctttcaaaacagcgaacacctatggctacataaatggaccaggttggagaaaattttgcctggaaaatgaggtaaaagaaggtgatcgcctcaccttcaacgccattgaaacaacggtctggcatgttgttattgtgcattgctagcacaaaaaatgaagaacgcgaaaaaatagtcccactactttgcctagcaatgccaatcccagttgtaggtttgaaaatatgtggtagaacatatcactgaaaaccagctgtatatatcggtagcccagttagataagtctgaacaatggttttgttgaatgttggtacgccagtagacgtatcatgtactgaaatacgtagtactgatctctttacttgtcccgtaccaaccttctgcagttctgcttctgccaacatatcagtgtgtatgatactaaaatctgttcataattcagctagaggttcagagaagataagagagctacgcacatgctacatgcgcttgttgcatagcagagaatcgatgctttgggcagccttttctcctgattgaaagcaaaattatcaggtgtggcttcaaagtgcaacttgttctcatcatcgaacgcaagctcgatctgcgatctatatttgtcatggtggaatgaattttgcggcactttatagatgagaacaatctctgaattctgacatatgcatactgagcaatctgctggtaattgccccaaagaagaactccctcttttctttttcagattccatgggatacagcttggcaaaaaaggaccaatgcaaatcttggctatagccaggttcttgtcacttgtctaatgatagtgtatttatgtaagatttaatgcatattgccccatcaaggagctatctgaattagaatctcatgtttggttcactgaaccaatacatataataccaatacctatgatgtcaaaatcaagaatccataatttattagcttcaggatgcttaaaggatcatttgaaaacataaaagggaaacctttattaggtacaaaggttcaatctcattgtaaaaaatagtttataactagaaagtcctaacaagttaggctagcattcatttatcaaaatttgtttttttttcttccagaaacctggtgtactatggatgtactttttccatagtaactggtacttccaaagtactgaaaaaaaaggccttctttgatagccttttcacacatcatgtgctcacagctgtgcaacaccatgtgaagattgctctcctccgtccaatgctgcccaaagaaatgacataattttgcacgtttttgttcctatcaacaaggggaaaaatgagaaaaagaataaaagactgtttctgagcctatttgacgctatgtcctgaaaaaaatgtcccttgccaagtttgaaatttggtgataatttgaaatccaggaagtgtcatagatacttctacaagcaaccattcagcttctgaaaatccatgaacaagggtgacacaaataggcaattttgtggcacatatggcggtgtctattgatttgatcatgatgtccaaatcatgcaacagtggcaagcacatacacaggctattatttgcagatgaacatgaacaggaaatctcgcggacaatctcagagtttggtacagtagaaaagcgaaagcgcggtatatgccaaaggaatttccgctttctcaaaacgatatctccaccatttcttgagaatattcagattcaccagccctgtcctctcaaacatgcagagattgacaggtcaaagatatagtaattgggtaattgcaactccactgaagaatgtaatgtaaccggtatatgtaaagcgcaattccgaggacgatgatccggtgccattggtacaaagcaacgatcttttctgataattttccaacacacaaggtccagtgacttgtcacaaatcattggctccttcttcttatctacctaaagcaacacttgccatgggaggatttgataccccagccctaaagtattgatgatggcttgagaaggggaattttcggacgttaagggaaagaaaggatgagagttcagagacaaattcaagtgatccctctaagttggatcgaatcttaattttgccggggaaagtgtgtatcacaggttcttgggagcttaagttgctgatgatccttgtcgaatgcgtttttttttactgcaattaataacattccgtatgaaaaacagcttactagtactaacctgaattttgaagttttcggtgaaatatattcatatggaagagatgtgttgcaagtgaaaaaaattgactgaacagatatatgtaaaagttaattaacagattgacaggcaacacatcacactgatttttaaaaatagaattagaatgctgatcagtgatggtttggaggaaatgtcatgaatgaaagcatcaagtgacagttgattaatgatttagtgtgacagcagattgctaggcaggaacatggttacattgctaggctggaacatggttctggcctatgagatcccaccgtacatgaaacggggacaagtaatgcgacaaatatgtttatgataaaagcttttgtcgggaaagattgtcgcgcctttcatgttttgtttttaaatgtttttattttttggttaggtccttaaaatggttggtgatatgtagctgtagaatatgttcattgcactgaaaagaccatacggcaaaaatatatttggtactatctgttggtacaaaatcctggtaatttttatggcaccaaaactccattgtactgacgaaatagtaggcaattgattttttgttttactatgcaatatttgcatccaagagactgtttagataagtatcgtccagcgagccgagcatttgatcatcttttcccaagataagcttgaatcttttgtatccatatgtcaaaccttttcaacttacataaatataacaattttcagtaatatcatgtcttttaaaacaaattaacttcataaatgttgtaagaaaattagttgcagcagaaattcagttagaggcaagaaattaagtactgaaacaacataaatgttttttttttattttttgaaaatgagatgcgatcgaatatcatcacaattcttgcaagggttaatattactcaatcatggatgtataattggaagtaaacatatatcagctactaaatagtgctaagtgttcaatcaaaactgttactccaataataatgtgattcctcaattatttcgcattaactttattaacgttcaccatcacattttactgtcaatctatagcagatctccttctaaatatctgaagaagatgaactaatcaaggcatcaatagtaatgcttggatgcaaaggctgaggtttgcataacttttaatcagtaagtccttaaattgtcatctctttgacaagtatttagccaaagaaaacatccatcgtttttctgtaaatgttggaaactctacctcgacttggtaaagtgctatgagtgaaaatagcagaagggtaaaattgaggagatccactgtggaatttcctttttctctgactttaattaagctgaacataatgttgtaatccgttacagataagctagtcttgatgatgagcttaccgatcgaggcttcaagtatatcattatatattgttaatttgctagttttcaaaggaattaatcgaatcagctagctagtaaaactaccggaattgcattgttaatttagtcgtgaagggtagccaggtaagtgggtaacatagtctataagcatttgtatgaagggcaaggctagttacataaatattttcttggtcaaaattggaaaattggaaagcaaaaaatcagcattcctgatatggctagcgagaggatgccagtctgaatcagcacttaattcacatataaactgcgtgccaaataagttttgtgttaattacctgaccagccacaacatctttgtagagttcactacttagtactgataaataattaatccttactggaacttctgttctcctaatgcaagtaattattaattcactgcatcctctcaaatcccatcaagcaataaacattgcatttcacttcagatttcagagaccaactcgttgcaagaaacatgtacttacatacaacagcagcttgtgcagcattgctcttatttagcagaataataataatacagatttacacgtccttaattacaccgattaagtacatacattgatatacacatacatatatctatatatgcataggactagctaattaacacagttaattatacaagaagagaagtaaactaaacgaaccaagcagatcaccagcatgagcagcagctagctagagagagtgacccaggtatagatccaagaaccaagatatctgaagatgtcatcaaattaggctcaattcaagcctccacgaacctagccgaggcatggaacttggcgatgaactccgccgccttcctgtcgacgtcccgctcgccgacgtaccacagcctgtcctcgtcgctcggccgcaccttcctcgacgaccgtcgcagctcgtacgccgccgccgccgccggctggtcgtcggcgatgtccccgtaacctgaaccagccgccgccgacccgaagcaagacaggtttcctcccattgtgtactcagtacagctgcttgcttaattagctacttaaatacacttgtcaagtagctggtagtgatcacttggaacacacttgtcaggtagaggaagctagctctgcttaattttggagggtaaatggcttggccctctccaatttataggggagggatggcaaccccccaaggagatcacggacggccgggattcgctcgaaccgcggccgcgccgtgatctgacggtggagattgctgcagagaacgtgcgtaccgcgtgttgtgcacgttgcgcgccgcgcgcaggggtggtggtggtggtggtggtgatgctggggttcaggtagattcttcggaagacaacggcgcgtgtgaaactcgatcagcaaagttcctagcttcttcagacttctgggtggaaggaatttcagaggaaattaatttgaaacgatttcattaatccttaggaaaattttcttatatattaactcctttggaacgaaggaatatactccatccattctaaaatgcttgacgccgttgatttttttaaaaatgtttgaccattcatcttattcaaaaaatttaagtaattattaattcttttcctatcatttgatttattgttaaatatacttttatgtatacatatagttttagacatttcacaagaatttttgaataagacgaacggtcaaacatatttaaaaaagtcaatggcgtcaaacatttaaggaatgagggagtatatgattaagaaaaataacttgcttcctacgtatgtcccaattctaaatgaaaacaaacatgaggtcttatctcatgttttgagaagtcgcatgcactctctcttcccctttctctctctagtatctctcgtccattaaattattttcaccaaccttctgtcgtttaatttgtttcgtacaaaccatccaaatgcccaaagtccaaagttcctatacagcatattttttttattgccatattgtaaagtgtgcttagcgatatatattttttcctttcaaaatccctcctccctgatatagtgatatgctaaaaaaatatttttagtaattgtctaaagggagtgcctagatccactaaaaaaactaatttgtttggaagtgtcttatattggttaatttggcattatcgcaatgatatactattcaatgataaaaaattttctaaccattacaggttatcttcatgtcttccttccagttgactccatttttgttctggatgctttcacagaaggagcatgatactgtgtgcagtgtagctacacactcttgaagtcgatagctagatgtctgttgttccactttggatgttgtagtttttatagaatatcgttatagattttatatgttctattttcggtttttcagctagatataattaggagagagatgtgggtttgtctcataacctcaagtatttatttatcttttctgagtcattggccgcatgcaacttgttggcagaggtcggggatataaatcattttccttatctaaaaaaaatcatgaaacaatagatttagtagtaaacttattatgaaaaaatggaattaagattgagtatcgcaaaaatatagatatactggtaaaattattacaaaactacatgtttagcgccaatttaatcacaaaactataatatatataactccaacataatagtagtgctaaagattaaactctaaatgtgtagttatgtgataacttcactattatatctgtaattttgctttatctcaccttaaatctatagttttatgataaatttaatgttcaatttgtaattttgtgatataacaccttaaatctgtagttttgtgaaaaatatctatatgcagttttttaaattcacttaaacttttatatttctattgctacaggtttgatgatagaaaatagaatttgatgaaaagatcttaaaatcaactctaaattatgtatataattattattttttttgctgtggccaacaagtacacaatgagagagttagaatttagaaataggatttttcttaaaattttatatctgtacttatttcattcttcctgctatcatgattgaatgtttaatatatttcctgataaatataaacttatatgaaaagtttccatggtttttctttcgaaatgtaacaatgagagttctattggtcaccaaagctgtctgcactcagctctgaatcctgcaagcctgatctgaatgaacagggcgctagtacagacaatgacagtagtgatgtagtataggcatagcgtgatgcacgcattggatatcttggatatgaaatgtcatgaatatattaaggtaataatggtggcgaaatggtattttggtttcgtttcacatgaagctgtctataagcattttaacttgaggaaataatttccttttctgaattcagatacggagcaactgttcagataagaaaagtttatggcgataagccggcatctcagagtcactaatacgttcggtcatttcaaggccaattttttttatatataattaacattcatcaagatttggtctagctatatatgcaggcgatcactcactacttgcaaaaaaaaaccagctgcttgatttgcaaacatgcaggcgtactgtatatggcctctagctagtaagtctcttaatggngtaanttncagcgtttttcacgttgcatatgtctagttgtgtctacaactaataaaagcaatgtgtacaacttgtttatacagttgtaataaacaaatagaaatatgttcacctttacaacttaaatccactcgttaactacagtttagcttatattaacacaataatatgcaaatcttttgtatatatatataattttataaaagacataaatgtacagtctagtcgtctaaatgtaaagcaatgcataccaatccgaagaaaatttccccgtttttacctatcagcttaaacctctgctcgatgaaacgatgactatagcttaattacattgaagaaacgaaatgttcaagcttttgagagagagagagagagaaatatctttcatatagctctcttcatctttaccatattcggtgcctagctaaccaccctaactagcccaaagtttcacagttcaaatggtaccttcctccttttaacatgcattatttcgccaaggtcaatgcaactaacataaaagattaattagtactaactaatcaggtaggaccagtcaaaaaggtggcattaaattgccatttcaaagtgcaaattggatgcataatatcgatcctagctagctagtagaactttcactgtctttttgagaaagctagagttgcagtgtttggtttgttctggacgccaaactgcatatataatctctctctctctctctcgatcgtgtagtgccatcatatcgtgcatgtaatgcttgcatgctgtaaccacaatgcttatatataataactagcttttaggcagaatcttatgatgataatgatcacttgttcagaggtctagctagagccgttgttaggcgagagcaaatgcctgtggacgacggatcgatgtagtgttagctatatattcctcattggtttgtgtgcacgttgtgcagagaccagaagtgtaaaacacttcttttttttatacggagaaaagccatatattctctaaattacgcggctgataaagttacaccaattgtgatatcgttgcgggctgaaatatatctctatctacaataaagaagaagaattagttgatagagataatgaaactctcatacatggatcttatccattttctcaacaaatgtgaaggataaaaggatataggagatattttcctccatcagcaaaaacaaccaccccatcttacactcagccggcctagcactagtagagaccaatcctggccaaaataattttcctcttgcagatagaacattttcctagattttttatgatatttaccaaaacacttccctcctcttctctgctagccacctgtgtcaccgcctgttgaaatatatctccatcaacagttagaaaaagattagttgatagatagcataattaatgaaaatcacatggatggacatggttatccgttttctctacaaacttatggatgcctacacgctgcaacgggaatttagaaacacttttaacaacacttgaaaaaccacattaactaaattagtataatctctttaattaaagaattaagttaaacatgagtcgaataaggtggaaacaaatggacatgaattgagatatattaaaaatataaatatttggatatatattgattataaacttaaaactgtaagaaaaataaataaagaacaacaaattgtttgatacatcaatcaattaaatgttaagagtaacacgcaagagccaccctataggaacattagtgctaggaaaatatatgaatcgagtcaataatcctaagtaagacgcatgctccaaaatcctggtttagaaaaactgaactaaaatttaaacggtttcataggcaaaaggaatggtaattttacttgacaaactaatggttgtgatcaagtacttcagtgataatttattacctccgtcccaaaataagtccattcatgagttttcgtgtccaactttgatcgtccgtcttaattgaattttttttatgattagttatgcatgacttatgtttttagcttttttttaaaaaaattaaataagacggatgatcaaagttggacacagaaactcatggctgcgcttattttgggacggagggagtatcatttaatattattacagattaatttcaacattggaagagaaatgttgccatgacaaccaaattaataaattaatatcaataatgtgcattcttccttatcaacccagagagctagccaacgtatgcatgcatgtgcattgcaaattgccttgtaattgggaataaagtacacctatatatgttttcaaaagaaaatttttaataaagcagcaccgggacaagagagtgtttaggctatgagcatttttttccaggttcttctaataaacctgaggagtttctcttctacttgcatagttgcatgccctaaaagatgcttgcctttacattaatttctttaattataccctttctttgtccttgacatctttgttaattactctgatcgaggggtttaatgtttaaacccaagacgatgatagggcctaacatattccaggttcccactcaagcgtagctagagtttgaaccttttatttttcttatcacttttgtttatcttctcgatctcttctgctttctgtagtaaaggctatgaacttattgctgtctagtcatttgatccaagctaggtcatgcatttagattcaggtgcgttcttagccactggaactcaaatcagtttccttcaccatcaagctcaaaacatttctcaactcaaattattgaggctctaaatgaggccttaccaaatgtttggtgggctgaatatatttatgctacataaattaaaggaataaattcaccgaaggcccctcaattttccttaatggtgagatgttttgaggttctttaaccacaaaaccaccaaaggccttaccagatgttttgaggggtggacagaaagcttgtcgctcgttacctagctcggctcgtgataggctcgacttggctcatttgaatttcctaacgagccgagctggcatttcagctcgttagagagcttgagctggctcgcgagccttaatgagccagagcaaatgaggctcaggcgcccagcccagcccaacagcccatccccttctcaaaaccctagtgagtgaatccccttctggcttgtccccatccccaatccccacccaagccgccgccaggcgccagccctcaacgctgccgctcctccccggtgccgatgccaccgcccgtgcctctcctccccggcgccgacacggccagccgtggacgccgccgcccgcgccgctcctcccggcgccgacaccgccgccggcgcctctcctccccagcgccgacgcggctggccatggatgccgccgcccgcgccgctcctccccggcgctgacgccgccgtggatgccgtcgcctgtgccgctcctcccggcgctgacgcggccggtcgtggacgccgccgcccgcgccgctcctctcggcgcccctctcggctcctcccggtgcccctcctcggcttctccccttgttcgctttctctcgtccccaaagctcacgagctaaacgagctagctcgagcttgctgacgagccgagccgagcttggtttctagctcgt

SEQ ID NO: 16914 - DNA, 12237 bp, Oryza sativa
  unsure (1)..(12237): unsure at all n locations
ccacatgtcagctgcacattttttttcttcttttttcttctccttctcttctctttcctctattctcttcttcaggcccaccacgctctgctcgcccaccgctactcctgcttctcgacgaactccacctcgtcgccggcgacctccttctacttgaactccctcaccatgttggccacgaagtactccaggtggtgcatggcgaagttgagccccacgcagatcctccgcttgacgccgaacggcatcatgcggatccccttgctgcccgtcacgtccactccctcgctgtcgccatcagggaggaaccgcttcgggatgaactccattggcttcgcccactcctgctcatccctgctgatctcggccaccatgaagttcaccgttgcgcccttggggatgaggtagccgccaacctccatgtcctccattgccttctgcggcagcacgaagtgccccggtgggtgcttccggagaccctccaggaccactgccctcaggtacggcataccgtggacgttctcctcggagacctcgaccttttcgtcaccggtcttcgccgtgatcttgtcgtggatatttgactggatggacgggttcttgaccagcttggccatgatccaccacaacgtggtggacgtcgtgtcggtgtcagcgttgaggaactcggagcagagcttgatgatctcaacgggcgagtgcagcggcagcgggcgagcggcggctctggcactccttttccactcgcccgccgcgtcccctgcccctctgctcttcccgcgcccggagccgccgcttcgcctgcctccggctcgcccgccgacgtcgccactccccttttttggcaaagacaaaaaaagcaaaagagaagaagagaaaaaaaggaaaaaataagatatgtgggcccgatattttttcatctcacttacatgtgtgacggagcgtggggctcctcaccgggagaccgcacaggcccccctttgccggttcggccgggggcgctaagtgaggttcttcgccctcgatctgaggaacgtccgcgagagaggaagcgcacaagacacgggcgacgtagacaggttcgggccgctgagaagcgtaacaccctactcctgtgttctggtggatctgtgtgtgaaggaatacagagtgccggagagccagacagagtttccgctctagcccccccccgtcctccccccttctcccttaggcctgggcctcctttttatctggtcaggggtcaccacatgggcctctagctgcctaagaaaggaaacatgctttttacaatgagggctagtctacagccggaagtgatctttgacaagcagagcgcacgtctcctgccccgctcgtcagcttttccggaggacgcccatttcaaacttcatttaatggccggcgacttccttgccatacttgcgctgaaccctggaatgaatctgaccgggactgacataccaactccaggagttagcacgccggctccggctagggacgagagccaggaagctctcatcattccgacgggacggggcgaggcgtgtgacaggcccgcctgtgccacctaacccgcgatctgaccggtctgtgaccggtcacacaccgcgactggtcacggaccggataaacgtgcgctgcgccgcattaaatgcggcgtgacgcgctcattcaatccgctataaatgcggttaggtgagcgccgctgtgctcacctaacccacacacgtggcgccaataccacggggagtcggggcgccccagccctcggggccgaaacgggagcggcccgacccctcggggagacagagtgtggggtggccacgtcacccttgggcccgacccccccaagggggtcaggccacgtgggtgaccgcggctgcccaagcctctagtcatgatacccccggtcccatgtcaccgacagtagcccccggcgttacgccagggcgatcgcccccctcgagggaagcgctcgggcgtgacgccactccttaggcctggtgacaggtggggccggtctctacaggcgggcagaaacccagcggtcgcaaatcgcgtgcatcggcaagggaaaaccgaccgacaataatgagcggtctcttcaagaccgctacattactcgagcagcgcgcgaatcgggacgagccggttcgtttcgcctggagacatgatgatggcgctcttctcggttggcaaacgtagttaatgcgcgcacgatctgtcccatctcaaccgccacggccgcacatctgccgcgtgcgccgcaaacgggcgagtgggattagtggaggcgtgggcgcgagaaacgagggggcgagatagtgggcgcgggaagcgaggagccgggcatagcgttggcaagggaataaagacgccgaggaagggattcgtttccttcctctcgccactcttccccttgccttcgccacctgtgctctaactcttcgtttcctgtgccctacccttgccgcactcgctcgctctcaagctcctcctccgccggcgtcatggcacggggctccgcaccgctcgatggtagcgtgctgccgccttcccgcatcgtgagcgagaggcaggccgggctgccgcgccgattcatgccggaatctgccaccggccgggaggtggtcgcgctgggcgagggacgcctggcgccagactacccggggcggtccgtcttcttcctctctttcgcaatggccgggctggtcccgccattctctaatttcttcatggatgttctggagttttatgatctccagatggcgcatctcacccccaacgcaataatgacgttggccatcttcgcgcacctgtgcgagatgtttatcggggtgcgcccatctctccggctgttccggtggttcttcaccgtacagccggtgtcgccgccgacggtagtcggtggctgctacttccagccgcgggggcaggtgctgcaccgctacattccctgcgtcctccgcaagaagtgggacgactggaagagcgattggttctacacccccctcgccgacgaagcgcgcctccgacttccgagccagcccccggcgcaggcctccagctggcgggagacggtagatctgggagacggctacgacgccgttcttgaccgcctggcgggtctgcgatcccaggggcttacgggagccatggtgttcggcgactaccttcgtcgccggatcgcgccgctccagcggcgcgcccggggcgcctgggagtacaccgggcccgaggactacatgaggacccaccaggggcgcaaatgggactgggtccctgaggacttcaggatggtggtccaacgggtgctgaatctcagctccgtggaggcatcccttatcccccaaggtgtcctccccctctgcagcgatccagatcgcgccaacatcctgatcatcatgcaggcggtcggggcgtcgggggagcgggccccccgaggccacgatggcgcgggcgggagccgcaggaggaaacaatctaccccgggagggggtcatgcttctgggccccgcgacgggggcccggggggcagccgccctgccgacgcccgggggaagaggaagcaggagggcacgcccccccatctcctccccgagggggcggggcggtgcgtgccagcagcaggcgcccggagggtgccgtgccgacgccgcagcccgagggggagcgaaagaagaaacggctccgcaagatgggggggaccgagccatgccgggggaacctcatctcgcctccgaggtggtcgtttagccgacctccccgcaggttcgtccccgcgcccaccgcgccgtgttcattctcccatctcccaaggcgagttttcactcgcccgtttctttttgtcttctggtttttcttctgcctcagcgagatcccgtcgcgcccccccgccattccaagtccggccggtttgaggccgaggagacggcgaccgcggaggcccggaggcgggaagctgaccggcgagaagccgcagaccgcctccgggaagccgaggaggctgcctaggaggccgtccgggttcgccaggctgaggaggccgctcgggaggaggccagactccgccgggccggggagtccgtccgggaggaggaggcggcgcgcgcacgccaggcggcctgccaagcccccgacccgactccgcccgaggcgacgacgacttccgaggccacccacgacgaggccgcggacgcgccgctctggcccgacccctcgggcgatgcttgggacgagccagcttcgggggacgcccccgggtccggcacgtcgatcggcgggccgagctgcgcggcacccacaccgaggcggctctcccctctgccttccgctgctccactgagcgcggagcccctcctgcaggccttagccgccgcgaacaccacggtgctggacgggttaagtgcccagatggaggtcctgcaggcagagcgggcggagctcgacgcggcgtgggcgcgcgtcgaggaggggcggtgctcggtggaggccatggtggaggcgggccgcaaggcacaccgccggcacgcctccgagctcgaggcccgtcgtagggacctggcggagatcgctagggaggtggaggaggagcgggagactgccctcatcgccaccgccgtgctcgacgaggtgcgggacgacctccgcctccaatacaggagccgggcggcggagctagagaagaagctctacgccgcccggggagtccttgacgccgccgctgcccgagaacggcgggcggcggagatcgaggcggcgtctcggcagcgcgaagaggcccttgaggctcgcgccacggcgctggaggagcgcgcccgcgccctggacacgaaggagaaggacctggcgggccgcgaggccgccgtcgccacccgggaggcaacactggcggcgcacgaggccgcctgcgccgaagaggagtccgcactccgcctccgcgaggacgtgctcaccgagcgggggcgagctctcgaggaggccgaggccgcggcgcagcggctggcggacagcctgttcctccgcgaggcagcgcgggaggagcaggcgcgccacaatctggaaggcgcccacgccgagagggccgcactggatcagcgggccgctgagctcgaggcgcgggcgaaggaactggacgcgagagcgcacagcggcggggcggccgcgggcgacggcgacctagccgcccgcctcgcagccgccgaacacaccatcgccgagctgcagggcgcgctggactcgtccgccggggaggttgaggccctccgcttggcgaacgaggtagggcccggcatgcttcgggacgccgtctcccgtctagactgcgccgggcggcaggcgggcctctggggcgggcggtacgcgaagtacgccgccaaccaggggggcctcgcctagcgcctctcagagatggccgggaccctcaagcggctccccgaggagctcgaggagacgatcaagtcatcctcgagggacctcgcccggggggcggtggagctcgtactggcaagctaccaggccagggaccctgacttctccccgtgggcagcgctggaagagttccctcccggaaccgaggacggcgcgcgcgcgcaggtccgggatgccgccgatcacatcgtccacagcttcgagggtacggcccctcggctcgcgttcgccctcgactccgacgaggagggtggcgacgacggtgcggacaacagcgacgatgaggccggcgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtttgtatgagacgaggatggtctgtgccgtggtacttctatgtcttggcttgaacaagggctcgtgcccaggtcccatcctcaaacggcgcgggtcggggctagtgcctggggagatccacgtgtcgagactggccaggccgggagcgcggtgaccgagggttatggatgacccgattgtgggcctttgccgattcccccccggagttcaccacgccccggggcacggctcggttctgggccccgtttggcgattttagccgacccgggccaccgagggcagggtcgagcacgagcgtgctaattcaagccaagattcttcaaaaggaaaacgatggcacagacacagtccttaggaaatcgaaaatgcttttattgaaatacggaagagaaaaaagatgagtatatgcatgtggtagcccccggccaaccctgcacgcccggggggggggggtgcggggttggcccgagcccgagacatgacacccgacccccgctaggggtagaagcgacgaaggtgttcgatgttccacgggttaggcagctctgtgccgtcgcccgtggccagccgaacggagcccggccgggggacgccgatcactcgatacggaccctcccacattggtgagagcttgctcagtccagcacgcgtttggacgcggcgtaggacgaggtcgtcgacgcagagtgatcgggcccggacgtggcgctgatggtagcgccgcaggctctgctggtagcgcgcagctcggagggccgcgcgccgccttcgctcctccaaatagtcgaggtcgtctcggcgaagctgatcttgatctgcctcgcaatacatggtgacccgaggggacctcagggtgagctcagatgggaggaccgcctccgcgccgtagatgaggaagaaaggcgtttccccggttgctcggcttggcgtgattcggttcgcccagagcaccgctggcagctcctcgacccacgagtcgccgtgcttcttgaggatgttgaaggtcttggttttgaggcccttgaggatttccgcgttggcgcgctccacttggccatttcttctggggtgggcgggggaggcgaagcagagcttgatgcctatgtcttcgcagtagtcaccgaagagctcactagtgaactgggtgccgttatccgtaatgatacggttaggcaccccgaaccgagcagtgatgcccctgatgaatttaagcgcggagtgcctatcgatcttgatgaccggataagcctcgggccacttagtgaacttatcgacagcgacatacagatactcgaacccgcccggggcccgcctgaacggacccaggatatcgagcccccagacagcaaacggccatgaaagaggtatggtctgcagggcctgggccggctgatgggtttgcctggcgtggaactggcacgccctgcaccgccggaccaggtcgaccgcattgttgagagccgtcggccaatagaaaccctggcgaaaggccttgccaaccaaggtgcgtgaggcggagtgggctccgcactcgccttcatggacatcggcgagaagctcgacgccttgttcccgaggaatgcacttcaggaggactccgttagccgcgcgccgatagagggtcccttccaccagcacgtagcgcttggagatgcgccggacgcgttcactcccttcgcggtcctcgggtagagtcttatctgcgaggtacgcctggatctcagtgatccaagcaatcaatctaggggagctgggagcgctcccctcgggtcccgaggcctggactccgacgggcctcgggggccgttcaggcgcgtccgtctcccctagggggtcgggtcgcgccgatggctgggcaagcctttcttcaaaggcgcccggtggggtctgggctcgcgaggaagcgagccttgagagttcgtcggcgaccgcgttatcccgtctgggcacgtgccgaagctctatcccgtcgaaatggcgctccatacgccgcacatggcgcacgtaagcgtccatctgcgggtcagagcaccggtactccttacagacctggttaacgaccaactgggagtcgcctaacactaggaggcagcggatccccagtcctgctgccactctgagtcccgcaaggagtccctcgtactccgccatattgttggtcgcccgaaagtcgaggcggaccaggtatctgaggacgtctccgctcggcgaggtcaacgtgacccccgcaccggcgccctaaagagacagggagccgtcgaactgtatcacccagtaggcggtgtgaggcagctgcgaggggcccgaggtggcctcgggggcgaagacgggctcgggagctggggtccactccgccacaaagtcggcgagggcctgactcttgatcgcgtggcgtggttcaaagcgcaaatcgaattcagagagttcgattgcccatttcaccacccgtccggtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggtatctcggagggcctcgctaacgaagtagacgggccgctgcacctttcggcggggccgatcctcttcgccaggggccgcatctccagggcgctcttcgtccgagaggccgcgcggggcgcactcggcttctgtgccgacgacctcggggtcagagggcgacaggcgtggccttcccgcagtggccccgaggccatcctgggggtcgggagcacctggcaccgtcggacaagcaggcggagggccagctccggccgtcgggggccttgggccgccgttcggctcgggggcctctcctccctgctctctcccgggtcgagtcgacacagggtggggatgcgcggagtgagggttgtcctcgtcgcgctccacgaccaacgccgcgctgaccacctgcggggttgccgctaggtagagtagcaacggctcatctggctccgggacgaccaggactgggggagaactgaggtacgccttcaactgagcgaaggccctctcagcctcctccgtccaggtaaacggcccggagcgtttgaggagcttaaataggggtagcgccttctctcccagcctcgatatgaaccgacttaaggcggccatgcagccggtgacgcactgcacatcctttaacccgaaaggcattgtcgtataacaataagttcctatgggggtaatgaatgcagttttttcctcatcctccctagccatgcgaatctgatgataaccagagtatgcatctagaaaacacaaaaggtcgcaccccgcggtggagtcgacaatctgatctatgcgtggcagggggtaagggtccttaggacatgccttgttaaggtcggtgtagtcaatgcacatccgaagcttgccgttcgccttgggaacgacgaccggattcgccagccactccggatggatgacctcacggatgaatccggcctccagaagtcgcgccacctcctcgcggatgaaggtttgacgttccggggcctgtcgccgcactttctgccggaccggccttgcgcctggccgcacggcgagacggtgctcaatcacctccccaacttcacattgcaaacggtgggggaaaccacaatcgcgatctgtcctccccgggcaacgcacggcgggtggtcggtctggtcgaaggtgagggtaacctccgaccaccgcgcccgccgcgtagcctcatgggtaggggccgcggccagaagctcgcgcttcatggccttgaggctccggcaagaaacgtgagcgcacgctcccccatcgacggtggcgacggtggcctcaggctcctgaaaccccaggtcatcgtcgccatcgtcgatgtcctcggcggtggccttctgcttggcctcacctcgccggttgccggcgggagccgccggggccttgccctcacggcgctcctgcctcttctcctcctcccacttcctcgtccgctcagccaaacttttgaccgcgcggcagtctgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggtcgaccccttcttcctcctcctgtcccgccgccctgaccgagcggcggacccgggggcggccggagctgccacaccagaaccggaggagttctaggtccaggcctcctccttgcgagccacacggtccgcgagctcaaaaagctgcgcggtggtctggggctccttggaggcgatcttctcgagcatgcggttgtgccgcacgccccccctgaacgcgtagatcaccgcgtgtgcggggatgcacggtatggtgttgcggacttgacagaaccgctggatgtacgagcgaagagactcatcgtcccttcgctgtactgcatgcaagtccgcttcttcacctgggcgtggatatgtgccctggaagttcgtggtgaactgctggcacaaatcctcccaggagtggaccgacgcgggtggcaagttcattagccaaccccgcgcctgacctttcagggccatggggaagaaattcgccatgaccctgtcgtcacccccggcggcctcgatcccggtcgtgtagatctggagaaactcgacggggttgacgcttccgtcgtatttttcggtgacggtgggccggaaccttgggggccaacggacgttccgaaggctcgccacaaaggctcgacagccggcaccaccaaccggggacacggggggccggcccccgtgcccggaccgaagtggcgctccggacgaggaaacgccctccgttgcgtgggtggcgcgacgagcgtcgtgccggcgctcgatatcgaggcgggcatccgacccccacgcacatcttcttgggtcggaggcgttgacgagggaatggcggacgaacggcgggtaacggncgccgttcgccgcgcccttncgcttgacgacgtggagccggcggcggcagcgccagaggcctcggtgcggaggaccgcccgccggcgcctaggcgctgctgcgccgtcatgaccaagtcggccacgtcatccagccaacgccggctggagtctctggatcggggacgatgggcgggtgacgcaggagcgcgcccgcagcctggagcgcgccctggggcatgccgccatcgccgtagacgaggcggcgacgcgccccgtctcgccgtcctcctccgtcgctcgcgggcggcgaagtcgcagatccttcgaccccctcgagcgccttcccccgcccaagatttcggcgagagggggacggtggggtgcgagcccgacggcgcgggttctgctccccgtcgtcaccgctagcgctcggagagaggttgtgcgccactgcccgttcggccattgggctgagcgggagaagcttggcgcacacgaaaggaggacgagggctcagaaagacacgcgccccctacctggcgcgccagatgacggagcgtggggctcctcacagggagaccgcacaggcccccctttgccggttcggccaggggcgctaagtgaggttcttcgccctcgatctgaggaacgtccgcgagagaggaagcgcacaagacacgggcgacgtagacaggttcgggccgctgagaagcgtaacaccctactcctgtgttctggtggatctgtgtgtgaaggaatacagagtgccggagagccagacagagtttccgctttagccccccccccccgtcctccccccttctcccttaggcctaggcctcctttttatctggtctggggtcaccacatgggcctctagctgcctaagaaaggaaacatgctttttacaatgagggctagtctacagccggaagtgatctttgacaagcagagcgcacgtctcctgccccgctcgtcagcttttccggaggacgcccatttcaaacttcatttaatggccggcgacttccttgccatacttgcgctgaagcctggaatgaatctgaccgggactgacataccaactccaggagttagcacgccggctccggctagggacgagagccaggaagctctcatcattccgacgggacggggcgaggcgtgtgacaggccgcctgttgccacctaacccgcgatctgaccggtctgtgaccggtcacacaccgcgactggtcacggaccggataaacgtgcgctgcgccgcattaaatgcggcgtgacgcgctcgttcaatccgctataaatg

SEQ ID NO: 16915 - DNA, 1662 bp, Oryza sativa
tatatatatatatatagatatttctgtgtatgtatatatatatatatatatatatatatatatatatatatatatatatatatatatatatatatatatatatatatatatatatatatatatatgaccaaaatatatatttacattaaagaaaatgtgtacatgcatatagaaaaatagacatgtattaattacaattcattatgatgtcctagctagctacgatttcgacgtagtagtagtcgttatctcagaagctaaggacctatgaattgtatttccgtcgtagtagaattcacccttgggatcaaggatttgttcgttgatgaatcccatgagttgttcttgaaccgccgcgataaattccttgtgtgtgatcaggttatccctcatgcgaataaactatatgaatgtatgaaattaattagtaattaaacaacaaatcgatacgtacgcaatgaaattttcatattatttgtacgtacatcgagctctcttgtggtgatgatttggtctgcaaggtagtggcaatactcgcacacgtagtagccgcacaagttagttccctgcttttgctttgcgcactataaataaatgacaaacggcgagagatctaattaatatacacttttatgtatttgaattggagattgaatataaatgtagagcatgtgtactcacaggaaaattgaacttccgcctaagtctttctctccatttgccgcggaccaaatgacggaaccgataccaagccctacatggagtttaaagctatgattcgtagtagtaattaaatataacaagattcttaattaacataggaacttatgacagtacctgtctataagttcaaaaaccttgtcaaacatcgactcttctttatcgattgagtcatatacgttgacggtgcaggcctccaggtcgaagagtaaaaagacccagtggaatctgcaatgtgcgtgggatgcattatgtcgcgtcccaaaacgactctaaaatacatcctcgaaattatgcctagaataattaaaatccgtgtgaaagcctccaacaattaaaatgtgcaaagttaaaagtcaaataaggcttggaggattttttatatttcctaaaagcctaaaaggcgtaaataaattttagtggaattttcagagcacaaataataattaagaagaaataaacaaagttaaaaaggttttataaaaagaaaaaccctaaaaagttccctttccctccctctctccctcttgggccggtccggccagctccctccccctccctctcctctccccgcggcccattcggcctcctgcccgtggcgtgccgctgacgggcgggcccgcccgcctccctcgctgacaggtggggcccacccgtcatccccttcctcccgtcgctcccgccgccccgcccgcgccctagcgccgccgccgccgccgcgaatcccgccgcccccgtccgccccgcgtgcaatcaagaggggggaaatattccccgtgattccctccctctttccccccatttttccctctctctctccctcggattcgtttggaaacccctcccctaacctcgccggcgccatcaatggcggccggatcttccgcgcccgtttccccctcgtccggccgctctcttcccctcccaaccctatataaacct

SEQ ID NO: 16916 - DNA, 4404 bp, Oryza sativa
acgcgtgggacccacggcgccggcaggtgcgagcccgggtgcgcccggtccaccgtggcccgtggggctgccgcgtgggccccaccccagtggacccggtccgcgcgcccctcccctcggctgacgcaataaatccattttaaattaaaatttaaatgaagaaattcgcaaatattcatttaaagagcatataaacttcaaatggccataacttggccatttgaactcggaattggaccgttcaagtctctaatttttccttaagaagtcaagaacccatttttgtgctttgtttctgcttgttatatggagtttcttagtgtaaaagccttttcttttccgttggtcgtgtagacgctgcagcttcggaagatccgctcttcgtggaagttgaagccggcgtttgggaaagtgagcaaggcaagtcacatcatccttgaacatattgaatcccagtttataaaattatgttgctttaaaattattgcattatcgctttatttaaattcccgcgttatcactgttttatctagccatgcctatttacctttgttatgaccttattattgttatggttattattaccttgttcaccctaggataaacaaaaccccaactagtgggtactctattcatggtcccactagtatgaatttaggtagatgcttcgctgattaattaggcaacattaggtggttttataactctagactttgggatattcatatcacctggacactttggaattgttggagtattgtggaattggattcacaccgccccctctattcaaaatccccaaaaatggttttaggctgggctcggggtgcatggttttgatagtagcacctcggccatataaggaccggtcttcgggcctctgttgcaaagcactaccgtacttccacatgtctagtgggtaaggcttagtttgtagctcagactggttataaacaaaagtacacggatggagatggacgaagtcgggggtcgatggacatctctaggacaaatgaaggctacacgagctgcggcccggtagtcgagatatcatggcacagggccggtgtcctgctgctgggggctcagtcctgcctacctgtcccgggggttccggccgtaggtggggttgggtcggtactcttgtttatggctaggatgggttgggaactatgtcacgtcttccatccgtataccgtggtggtatgtggcacgtggttgcacgtgaggaagatgtgtcttgtgggtaaagatgtacacctctgatcagagtataatctattcgaatagccgcgccctcggttatggcaagccgagcaatgtacccaagttagtgttttaattcttaaaacctgcttaacaactaaaatgtggaatggttggcctgggttggcttgggacgaggtgggacccagggtcgggttgccggttcggtctgaatcatcgtaggccttgggttaaggcaggttcgtgtgggttcacggccttgataaataatattgtatagttctagaatcgtgtttacaaaatagctttgagcaactaagtatctttaaatgctgtttactgcaaccctaaccctttatgttataactcccttgtactcccttgcatttattatgcacttgtgggtgtgtcttgttgagtacggtggttgtactcagtcttgctcaattttttcccaaacccagaagaggagtctctggaagatgaaggttttggtgtctagctcgtgcctgccgtcaagcgcctgtggtcgtcgccctagtcttccgctgtttctcgtttgtctttgtgtgtgccgggccttcgctgcccatgtaataattaactatttacgcttccgcttgttgaactctgaattgtatcaacttttggtgtaccttgcctcctgggacaaggaataatgcacgcacgtaaggaacgcccgttgggttatttccggtcgtgacacattacatatgaaacacttagcatgttcgtactgacaggcacgttatcccgcacaacccaaccgctgtgtcgtacgtagttcttggctgcttccgccggggcactaggttagccgtctttgtccactttcgttatgatgtgccgaccctctagcttcttcgcggcacctcgttgcccacgtgccctcttctgtccagcggagggttgacttccactagcctcctctacctggttccattccacatccctctccacgttcccctcctggttcccctccgcatccctctccacattcccttcctcgttcaagtactggtttggatcctcgttcccctcttcttcgttctagtactggttgcttccatccgcgattgtatcgtacattatctgttcctcatcgcgatcaaccatctgttcatacaagaaatagttgctaagtctataggtcatttttgatttaacaatcttatatgctaacaatcatatatgctaagtcaaatatgctaagtctaactgtcgtctattagaaccctacacaatcttatatgctaagtcttattacaaatctaataatcttatgttaaactttaataattttatattaaaactcaaataatattgtattaaaactctaatagtcaactatgctaagtctaagtgtcgtatattaggaccctagacaataattatatactaagtctaattacaaatctaataatcttatattaaaactcaaataatcttgtattaaaactctaataatcttatattaaaactcaaatattcatatatgctaagtctaactgtcgtatattagaaccctacacaatcttatatgctaagtcttattacaaatctaataatcttatactatgctaagtctaagtgtcgtatattaggaccctaggtaatcatatatgctaagttgtctaagtgtcatacattacaaccctagataatcatatatgctaagtttaagtgtcgtatattaactctagtagtcttaattgcattaaaaatctaacaatcatatatttacatcacttgcatgcgcgaattcctttgagggctagctaccactccggcttgagggatggtgacgacaacgtcttttctgcaacatacaaaaagatgtattaggataaacgcaaagtaacatatattgtatttcatgttcgcgttctcgttaagttcatgtttcgttcacgatcgttcacgttcgcgttctcatgaagttcacgtttcgttcacctacgttcgttcgtttacgtgcgttcacgttaacgtacgttaagttcatgttcgtgttcttgttaagttcacttttcgttcacgcacgttcgttcgtttacgtacattcacgtacaacgttaagttcacgttcgttcacgttcacgttaggttcacgttcacgtacgtttgttcgttcacgttctcattcatgtatgtttccttcgttaacgtacgttcgttcgttcacgttcacgttaacgtacgttcgttcgttcacgttcacgttcacgtacgttcgttcgttcgttcacattcacgtacgtttcgttcgttcacgatcgttcgttcgttcacgtggcagcaacggagcggcggagtggcggcagtggagcggcggcgtggcggcgcggctgcggcatggcgcggcggcggcggcgggcatcggcggtgcgcgacggtggcgtgccgcggcggcgtcgtggtgtctcggcgtcgtggcgcggcgggcgtggcatggcccggctttgtcggcactgccggcgcgacgtcgtcgccggtgacggccgcatcgaggtcggggtcggcatcgtcggcgcggcggagtcgtgttcggccgcgatgacgtcggcggcggcgtcggcaacgaggcggctggcggtggtttggggagagagagagagatcgaggtcagagagagagagagggggaggcggtggcggctctcaccccagagatgcggcggcggcggagacgacggcgagatacgacggcggcgtcggcgcggggatgccctaggtagtggcggcgaaggagaagccaagggagatcgatcggggaaaaaacttctaagtgttggtggagaagatgagggcgcgcatcgggaatatatatagccctatatctttactcccggttgttctcatcaaccgggactaaagatattttcccgctatttccaaattctttttaaacccggttagggttaagaaccgggactactgataaacgcattgaatattgatttccattacatatgtgtttctaaaatagaaaataatgcattaaaattatttaaagtcgaaaaattaatgacaattacttcgaaaaattattgttgtttgtagtaaattaagtggataaaacgtaataagcaaatatatgatttaaaattaataaaagttctaataatcatataacttagcatatgaatgatattaa

SEQ ID NO: 16917 - DNA, 1677 bp, Oryza sativa
ctagacatgtccttcatgtaaaagacttgcgttacatcattggcaaggacaaaaggttcgtccgagtatccacccttgttaaggtcaacggttgtcatcccactgtcatcaatcattacgcctccaccagtcaacctaacccattggcaccggaacagaggggccttggggggaccatagtcaagttcccatatatcctcgatggcgccgtaatacgtgccagttgttccatcgtgtcccatggcatcgatacgaacagcactgttttggttcgtgctcttcatgtcttgggctctcgtgtagaatgtgtacccattgatctcacatccctggaatgtcgcgatcgacccagatggtcccctcgccaggaaggccagttgttggttgatcgtctcgttacccatgagatgttgttgtagccacgcggggaaagtatcaatgtgatgccgtgtaatccatgcatcggacttaccgatgtttctggcgcgaactagagccaagtgctccttgatgtaaggagctaccaatgaagattgttgcaaaaccgtgaaatgggccttacggaataaattgttgtctaccgtcattattgctttcctcccgagagttccctttccccgtagtctcccttcatggcgtgattcaggtaccccgattgggcgaaggtcttcaataaattctacgcaaaattcgatgacctcctctgttccataccccttggcgatgcttgcctctagacgagcacggttacgaacatacttcttcagaacgcccatgtacctctcaaaaggaaacatgttgtgtaggtacacaggcccgagaatactgatctctttgacaaggtgacaaagcagatgcgtcattatattgaaaaatgaaggtggaaatatcaactcaaaactgacaagacattacaccacatcattctgaagggcttctaatatatccggatcgatgaccttctgcgaaattgcgttcatgaatgcacatagctttgttattgtttcccggacattgtctagaaggataccccttattacaactggtagcagttgtgtcattaacacgtgacagtcatgagactttagatttgtgaacttcttctccttcgtgcttattattcgcttgatattcgtggagtatccagatggtacctttatgctctctaagcattcaaacatactttccttctctgccttgctaagagtgtagctggctggactcaagtaatggcttcctttctcctttggttccgggtgaaggtcgccgcgttgttccatatgcttcagatcattatgtgcttccagtgtatctttcgactttccatatacacctaggaagccaagaaggtttacgcaaaggttcttagtgaggtgcatcacatcgattgcgtggcggacgttcaagaattcccaatagggtaactcccaaaatatagagttctttttccacatcgccgcgtgaccatcttcgctctctataggctggcttctaggcccctttccaaacactactttaagatctttaaccatagcaaacactgttttcccgctgcgatgtttaggcttcgtacggtggtccgccttatgttcaaagtgcttgcctttcttccgtacagggtggtttgcagcaaggaatcgacgatgacacatgtacacaaccttcctacagtgctta

SEQ ID NO: 16918 - DNA, 17958 bp, Oryza sativa
  unsure (1)..(17958): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccttctagttcaatatataatccctttccagtctttctatctcaaacatcacaaagataaaaaccgagaaataccaagacgataataacaatcttcaaggctgtgtagtctacacgctgtgctgaaaaatcaggtaggagagcgtcttgtacgtgcgtgcggccgcgcgagtgtgcgtgcgacacgcgcgcgtcgcgcttttggacttcgatgaggaccacgcgacgcgacgggtccgtggcggtggcgaggccgtcgcgctgcggttcccgatttcgggggggacccagcgagctctcgctctctctcgcgcatgggacggggcgctgggcgaacgtgcgcagcggcctcgggctccggcgaccgcatcatttggtaggccggggagcacgagggccgcccccgcaccccggcgtgccatccaaccccgcgagcgcgacacattttctgccttgaatcaccttccaaagcactactactcctagtaacgaccctctcgcatatcgcactaccagtaccacatgtgttccctacacacgccaaagatgcaagtgacattgggcccttggaacatacaagttcacgactattctactgggaacaagactattttgtatttcgaatcgcatccctagctcaactgcaaaaccggatataacgcctctcctaacttcaaaaattggtgcaaatatactacaaaggcaggattgggcccggttatggctcacaagacatccgacgcggcgtattgattgggtcttcatcccatgtcagtgaaaagaataaaaaacggtaggccccacatgtcagggactatctccttcctctggcctctcccctctccttgttatctcaaggcggcaaccagcaaggagatgggcgacgacgtctcctctctatgagcagtgcaggcgggggtgcctcgtcgggaggcaacgacccgatctggagtagttcctgactgctcctacccccgttcccccgtgagctcgatgaggcccacaccgtctgctgcgcctgcaacctcaagctcgagatccatagtcgtcgtcgcatcttcgagctcaatgacaccgtcgatgcttgcgccgctcgagagggaggacacggcacaccacccacgccactcccttccatctttgttgcgggagcccaagctccatctacaccaccgcaaagctcgaaggccacgaggttgttgcagtcaccgctcgggtaagaggacaccacggccagcgtgaccccaagctctcctattctcttgctctagctcccctccatctctgttgcaggaacctgagctccgtctgtgccaccacgagctcgtcggccactgggctgctacggccaccgctcgggagagaggagaccacggccggcgggaccccgagctctctcgtcgcgaaagaggccaagcctagcggcgacagtcctcttgctccagttcctcgtcatctttgtcgtgggagcctgagcattgtctgtgccacgacaagctcatcagccactgggctgttatggccaccgctcgggagagagaagaccatgaccgacaggaccccaagctctcccgtcacgaaggagggccaagcctagcggcagtagtcctcttgctccagctccttgccatctccatcgcaggagcccaagctctgtctgcgtcaccgcgagctcgccgaccattaggctactgtggccactacaccaaccctcgacgtcgcctcaacgacctgtcgtctctctgtctcagtttctcttctagatctaatgccgtcgttgcctagggtttgttcggttgaccaaccggattcacctcctagcctcgcctccgaccttcgactccttccacatcatcgttgacttctgcatcccatcgttggccaccgggtccccgccactcctgatagcggcccagactcgtgccaattcaccacaactggtcatgtcctatggcctcttgcctccatggttgcatatgaggagagaggaagaggtggaggaaggataaaagaaatgtaactcgcatatgggcccactatatatattttgccatatttcactgacatttaaggtcatgcgctaactcagcgagtctaaccgcagtcaacctaccacgtcagcaggaactgctttccaaaccatcgaaggagcatatttgcaccggtttttgaaattgggagaggtgttaatatatagttttgtggttgagggatgcgattcgatcaagggttagagatgcaaaatagacttattccattctactgaatgcatacagccggccgtggcgagaggccttggtttgaacctgggctatcactataaatcacattcaggcctcaatcctcagctttgcccttttcccttcctagtttcctagtctaggcctcaatcatacggaacccggtctagcagtcctggaccctggtcagatttgggccgaaaaacagttataacagcaccacgagtgtatgaaaatgtattaaccgattaccatccattacccataactcacgagtgctaatggttactcacaaataagtactaatatttgcatatcctttcttactataaaattataacccactaattctaaaactcaacatgcaaacatgccacctcatcatccactaacaataattacatgcaaaactaatacaagcatgcaacatcatctataattcattgaatttacatatcaacatctaatcatcctccttcacattatttttcacagtatttttaacatgtatatatccaatatttttataatccttaacatatattcatgcatataatcaaagtgcgggatatcatgtatatttcatctacaatctcatacatagtctattaaatgtatttatctcagaacatagtctgtcaaactaattttatttgttgttaataactaatataatttttatttttatctcgattattaaaaatttttaaaagttacttaggaatttccgcagcaaagcgtggggaatcacatagttcaccagattgtaagtacttaacacggctacgcagaaactgaatagtattaaaagggcttcactgaagaaaggtgatgcataaactcacacaatagagccatttcaaggcttcaagctcagtccccagaattatgacgaagtactgtaactagcttattttcttcagaattagtacatgatcagacaataaaactcgcgagagggacaaaaaaattcccagttttgttagatcacatctttgaaatgttcccgtgtgaaagaaaaactggacagtataatgatacaacaatatgtacatgacatctatgtaagaacggtgctccttagtgctccacggcagtgtcgttcttgaactcaacaaaagaatgtactccaaaaactcaaaagggttgggaaagaatggctatttcttttcaagaaacaactcaaggagaagacaaggccttacccaaatcaatataccttccacagcgtatttccgaaaaaaaaatacacattccacagccagccacaaacgaacaaagaatgcaaacggggtaaatacagatgactcacaaacactaacctttcagtattctcagctcccagaagcataggttactttgaaacagtcaatattgcacaacttgacggatgtcaccgacctcatcatccctccaaaactgtcacagcaatgggttgcaacagtcaaatctcatctggtaacaggaatccacaaagaaccgtgaaaacaaaacgagagcatataagaatacacaccgatcgatgcttctccgtggtctatcaggttgatccacactagcccttggcttatcaggatgatctatactctttctgcttttatctctcctatctatgcttcctcttggtttttcccgcctatcaacgctatgcctgtgatcaatgcttgacctagatttatcctttacatccgtgctttttcttgagctctgcatactttctgatcctatttcacaaggatctgaaggacctgagctccctgaggattcatcttttgtaggtggtaatttctcaatggccatgacaaacttttttaggtgcttgatgtattctggatatagttccagattacaatgatttccacctttgacccacagaggctcatactttattttagagagttcccacagtgccctcccatgagaacagtcgacaacttcatcagctgtaccctgcagatgacataattttttgttcttttagaaaaatatttgtgtacactatacacgtagctactcaatagtcattcttcatccaaaacatcataatcagaatatcaaaatagaaacagccatcaggcaacaattacaagtgtgacaatggatgaaagattataactgatcagtaaatacttttgttgttaacatacaaagttgaacaagaaaagggtaaaagaaggtcaggaaaagacaaaaaaaaaaaagaggttcatttcgaagtgcatattgaagtactccaggaaaatgatatagttgtcagatttaaaggcttcatgctaaaaatgatatgagaagaatactcacatggattactaaaacaggacatttgaccaatggaactttatcaatattctgcaaataaaaaagtgcatattagatctagcaaagttaagattgacataaacaaagaaatgttatcaccttgtatatgtcaaaccagtatgtatgctttacaggatacatcactcttaagccagataaaatagggctgtgtaaaacaacagccctcagatgaggcaaacgggatgccaaatctaaagtaggaccgctgccaactgattgaccatacagaatgatgttttcctctgtggctccataagtttctactagacacctatatgcagcctctatatcagaataagtgttctgctcacttggctgcaacaccaaagagaaataaatccatcagttatgcaaacttaggagggaaagaattcactaaaaggaaaacgaaatgggtaaaaaaggaaggaaaaacactttcctaagaaaggatgattttataccttccctgatgattgcccataaccggaataatcgtaactgtaaaaatataaatatgaagttactttatgttaagatatcagtgaggcttatcacattgaaacaatcatgactagagaaatatcaaatgaagcttatatcataatcatgattcagtgatttaagcaagctatgcggatactgaatgatcatcaaaatcaacaaactgtaattgccatcatgtcaaagtaaaagcataatagaccacaaccaggtccctaccaggataacaaaaaaacttggtgataaacttttcatattactaaaaacaaatgaccaatatgagtagttgaatgggaatgcagaacacagcaatcgatcaacatgataagatcagaaattggctataacgtatctgtgttagatccaggtaaccacccaatgactatccaacaaacagatcatctgccagcctatccattgaacgtagtcatgggatcaatgcctacttccttcactaaaaacctagtactgtattaaaatgtaagtatggaagggagctatagacaatatttccagtattttttattcactactacacctaaaccagaaataaaaacccagactttaattgagaagagccaaagggcaacagatttaatggaagcaggccaacagaacgttcatcaaagaaccctctcatagaacatgtatttctatcgaaaaactggtaaatagaagagttaagaatcaaactatgttctaccctccctctaaatgggtgcaaatagtcttaaaatgtcctgatttatgaccaacgttggcacacaacttgcaatacgataagatccataatttaaacttaatttatttaggcgattaacttctgtataaaaaaaacagaatggtatacagtatcggtgtccaataaaaatcatatacaaatatgcacatcaccaaatacaccacaaggcacatacatcaataaacaattctcaaaaaatatcagaatataaaaacaactcgtcatcttaccaatcctttgatataagccaatgaggtgttatttttatcaaatgtggcaactacattgggttccactatatctaaatatctaatctaccagttccataacacccattgccatttaacaccagatcacagggtactaacagcctagtactagtgatatgacgcaaacatccccacctattgctaggacagcacagtaacctccaaactttccagtcagctctaaagcttagtacataaactaatcatcaacttcaatcaaatctatcaattattcaccacaatagcctcacttttcttgagccacacagccggataacaactgccgtgtcagacattcccactgatgcaacaacacatgaatcttccaccacacttcataacccaatacacttcgagacaactatgaatagcaacagtagcaatcgccaccttctgcgaatacaaaaccaatcgcaatcacggccttgaacattatgaaatcttccatgattccatcaaattcgccaggcactcaaatcaaattagtaaaaagtaaagagcaccgcataacacatttttccctcgaactaaaataaggccaatggcactatacctgaaatataactcctaaactgaaatgcaaaactgagaacagtagtggagaccaaaacattgctacccatccatcacaagatcctaaacacgcacaatcaaatgatcatgaacttcctacaaactatacttcagagatccacactttcgcctgaattaagcaactagtatgcatcataacgcaaatgataaagaagagggtcacgttccaaagcaatccaatccgagagagagagagagagagagagagagagagagagagagagagagagagtgacgtggcgtaataccccatgaggttgacgttgaggtgggagctgagctcgacgaagagctcgtacatctggccgaggtcggcggcgttgccgtgggagtagagcagcgtgaggcgcgccccgggctggcgcacgtacatggccaccacctccgtgccccgccccgtcggcagccgccgcgcctccaccccggcccgccgcggcaccccgctgagctccaccaccgccccgtcctccgccgcggccgccggcgacggcgacggcggcggctccacgccgtacgacggcggggccggcgggaagaaggcgaagcgcgccgacaccgtagacgccaccgccccatccctccctccccccctccctcctcgccgccgggcacgggcagtgcagggaggaagagcgcgctgctgctgctgctcgctggagatggtgctgcgttcgccggggcgaggagagctcgggtttttttttttaatggcggattcttcgcggaagctgcggcgatcggagaagaaaagggagacggcgagaacggcagcagaggggtggcatagtataattagtcattaaaaggttaatgatgttgattaaaagagggattaagcttcaaaagaaaaaattactgtaactctttcctatcataaataagtggcattctcagataagtgtagttaggattagaatataagggttactgtgccactgacatatggatcatatcgaagtggaatatatatatacagagagagaggatataaccataagttgcacgacgttagaggattcactttcatgtattgtagttaatatgcttctaactttgaccatcagaaattctctctgaatattttgattcaacttttcaaaataatatggttagatttatcagcttcaaaatattgtgacattgatatattcttcatactaggttttactacttagtaattattaaataaattattggtgataatgttggtttccaaaatatcacttatttatgactggtgggagaatgagcaaacatgaggattagcgaaggcctacaaagcgtgttacaaaaaatgtatagaattctcatgtaaaattaatacgaaccactccctcaaacgttcacaaaaatcctttaaaattcacacgttcagagcaaaacctcaggctatttgtttgctatagaaagttggtcattctagttggatgattctctattgtgcaatcaacatacaccttttgaactttgaaggaaaaaaatgcccatacataagacttgggaattatttccaacaccgacaaaaaaaggaaaacaaatttgaactttgaaggcgagttgtaaaacaagagcaagttgggggcgccaatcttggcgacagccatgataaagatgcggaaagccagcatgtgaagcaactaagcttagcttagcttaagcctaatcttaggcttaggctgcggccggtgggggcgttacgccattgctttctgaaaaggacactgtcccctttggctaactgcaagctactactgcagcttaacatctctcactatcaggtggggcccacctttgacagatggctctgctgttcagtatagtagggtcccaatttggaagggttaaagagcttttgttgtttttttttaattattgaagcagattatttgcttcacatttaaagaaaaattcaagaaaactttatttggttgtattgtacggttataccctttatgttttgagctacttgtatttgttaagattatttttaaaatattaaatttatccatataattaagtaaaaaatttgtaacaacaacccacttaattatctattttaaactcagccttaaagctaaaccaagtaattgttcttcccttgtaaactctcagacagggtgtcattttcagctaagatatataaagaattcagttaagaaacagtcaggttttaaggagacttgtttacgctttaactggcaacgagatccggtaacgagattcgcatgttacgtaggcatctcatcctggaactgaaagcgtcgatctggaagctaatgcagtaattaagctttaggtttaggtataaacaaatgtgtaatgtgaagcataagccacggggatgcatgttactgccacgcgtctctcgttggagatatattcaggagcatttttaatggcaaacaacttcacatctcaacaaccagctcatcacccaaagcatcatcctgctagatgaaagggtttacaggtctattagttcttaatgtgatcttaaagacagtgtacactaacactacactatactcctactaaacttcaatcggaagccttgattagagcagtgaaacctggcctaatgtgtgaagctaaagaaaccggtaaataactaagcataaaacaaatatcccgtttcaaccatccagtaaataatctaaaaagaatttaggggctgtttagttggttgccacactttgccacgccacactttagtcatgccacagtttttttaggcatgtgtttggttcgctgccgcaattgtgttatgccatactttcttaactttgggacccacatgtcatgctctcaaatttagagctaagcatgccacacttgtgaccaactatttctaagtcacatttgtaccaccatgctacaactagtctaaacttaggtatggcaaggttaggcatcaaccaaacatccccttagacttcaacttctgttccttggaatgagacttcaaattcacatgttagtgacagcgcaaacgagggatgattgcacttgaaaatgtgtactccctttcaaccccatcgtttggttgtttggtggaataagccaaacaacatatttgcaaataaaaaataatttgtgaataaaatatttataaacatattctaaatgatctaaaaacaaaggctgaaaaataaattacaatgaaaaacccctaaaatcaactccaaatttagagttgaaaatttaaattttggttgataagcataagaaaaaagataaggttctttgttttataaaaaaatacaatcctgttctaggtttattttttttaagtacgaagggagtagtacagtccaattccagttgatctattgatgtaaatttatggaagtacaatgatggttcttgtcaacacataaatgtatagagtaattaggatcagtttacatctggtactactagacagaaattccctatcagtcaaggtaacagtagtacagacaagttggagatgtcacttgtttctccaaagtgaatgtaaggggttgtttagttcacgaaaagaaaatttttggatgtcacatcgaatgtttgaccggatgtcggaagggttttttggacacgaataaaaaaactaatttcataaatcacctggaaacagcgagacgaatcttttgagcctaattaacccgtcattagcacatgtgggttactgtagcacttatggctaatcatggactaattagactcaaaagattcgtctcgtgatttccttcctaactgtgcaattagttttttcatttatctatatttaatgctttatgcatatatccaaagattcgatataatgtttttaagaaaaaaatttggggaactaagttacttcttaactgaagtagtacacctcaactggcagcaacactgctaagcagtgacccactttctcaagaggcaataattgtgtcttaatccatgaaacgaaaggatacatgggcaaaaatcttgtcccggtaaacaagccttgtttgtttagataaaaaaaaattagccaaaaacatcacatcaaatgtttggacacatttatggagcattaaatgtgaggaaaaaaaccaattgcacagtttgcatgtaaattgcgagacggatcttttgagcctaattacgccatgatttgacaatgtgatgctacagtaaacatttgctaatgacggattaattaggcttaatgaattcgtcaagcagtttacaggcggaatctgtaatttgttttgttattagtctatgtttaatacttcaaatgttcgtccatatacttcaaaaactttacacccaaagaactaaacaaacttataattgattattgtcttgctgaatgcagatgagtgtatcattcggttgaatcatctgcatctgcatgtccaattaagcagaaactgcctattaccacattcagtgcactgatactagtctgttcagtgaggtcccatttctaatctgtcaactgttctgtacagtacttcttttttactaagtttgcttcttatgaaggacacagctcatactaactacagaatgatttaggtccaagcttttgccaaactatatagaagttacatctgcttcacccggttgttaatctgcattcagatgttagttgtgagttatggtagaatcaacttactaaatgccttacacagtcacattctaattgctcaaacaccctaaagtttttcttttactttctgacaagaccttcaacattgacaaggtgggcaactgggagcataattgtttttccaagtgacgtaatgaaaacaagatgattgttttcgccaactaagtgttttccaattctcagctagcttgcaaatcagagtaaattatttttcaacaaaatatcatttggggccctctatgaattgatctctgaatgattcctgaccaacatctaaacttgtggctctaaaccctccatctgcaatctgtctatcataatcatacataaattaattgccttcatgtcaagaatttcctctgattcaaactcatcaatcatatattatagtgtcaacataagaatgcaattttgctagtgccagaagtactttgccagtgactgaaaagataagcctatcacaactaggaggattctgtcattgtgcccaattggctggatgtgataccaagtatcctaacaagagaatattagcgaaaaatacgtcagacaaacttcaatgttcctttcaagggtccctcatatttggtagtgctcttatgcataatttgctctgttgattgcttggagccttgacctttcaagatgcaaagagtatcagctgagcttggtacctcctgttcaccagaaggcaaataagtagtgttatggatctttctttctgaactctatgtgcaattctaagattggcccagggtagacactctgatgcagtgtgatgaaaatttagcattgtacttttcaacatcattggaaaccagagtttttcaaaagtaaattaaattctcatattgccttaattcaaacatgcagagacttgacacacaagtgaaagtccgaaagatggcaacaacagccattccaattttaaatcgacactgagtccaggttcacatagacatttaactcatctgaagtatttttgaaactgtacattattgtaaaccaggcattttaaagccatacattgcttgtggatacaagaacactaacaatacagatatcgcgagcagctcaattcgaatttgagccggttcgcacagaagccacgcagattcaaccatccaattcattcgagtgactggaacctcgaccgctgaccaagaaatcttcgttcgctggattccaggaaataatttcccttcacagcatctgtgtctcataacatgaagccacgcttccttcatcactgatatttgatgacattcctttggagtctgacattcatgcctcctcttccttacggaagatattcattgcatcgctgtataaagcaacagaattggagaggacagcaagcacgatcatggttacagccaagatcttgtcacgcttggatgcgattccataaggatccctagaaaaaagaaagccaaaatgttatatgtcaatatgaaaatgcatgaacacagagggaatatataacacatcgagacataatttagttacctaagtataaccatggcagggaagatgaaaccaatcaggacagcagcagttgcaccagtaaactggaatgcatcccaaatgctcggtatgaaaatggcagcaagataaattactgtgaggagtgagatagtgattatggcaaatctcttgttgtcacgagaaatgtgccttgatgtggggaagagcagtccatccaagttgagcctaagggcaaagaagactatgggaaagacaagcataacgtgagcagcatagctcactcgcactatatcatcaaagacggaactaaatggaatcccaagatttgcatcgaagttagcgagaacatcatctagggtaccctcgccgaagaggagatatgcaaagaaacttgtagcaatgtaaacactggagcagaggaacagggatgttcgcacaataggtttaatttgtgttctgtcttcaagctcattgtcaatgctgtgaactgtgaatcatgagagcgtgcatttagacatcagattattgaacacttgaaaaaaaaaggtctgagcactgagagtgcataccattgtaatggcagatgtaggcagtgacaagaacagggacagctgtgaagagcttccagatggaactaagaccatctagttctggaaaaagtttgggcatcgctacagttccattgaagagtttgatgatagcaattccagcagtaatgacgacaaaaaccacagcaagagcaaccgatagggcagaggtgtatctcaatgaatctacaaggcatgacaattgacaaaatctataagtaacatcatgctgccaataacatcaaatacaatgaaggatattttttctttaccaatatgaaaacactaagacgtacccagacgcttaaagctcaccaatggagcaaacacgaaaagagtcgtcgcaagaagaacaatggcacgtgaattccagagatgagctccaaaccagccctcaagtataccacgatggtgaacaccggttgatgatgttccagataatacatcacctattttacaaatttaagaattaatatcgacttcagttaggaaaaacaaagttatctgtcaagacaggtgttgttaggaggaattatcctatgactccacatagcttagaatggataggtcattgtttcttttcagagaagcaaagattccagttggtagtaaaaacctgatcaaactagctgacagcgatgacaaattgtattggttttgcttgagaatgaagtgctaagaaatccaagcctacagctaagctctaaacctctaaataaaaatcacccaaaataatggggtttttttcacaacaaaatgtttggccctaagttaactacactagaataaaagatgttctacccaatctgtagattatttgcacaaagtccagctcagcaatttttggttgcacatctaaaaaagtcaaatgttcaaatgtaacagcagagcatagaagggataccaatgataatcatgtaacaatcatcacgccaatgttgtttatgacgacagaggcctgcagtgcaattcttccccactgtccgtaagcctcacccattagccaaccataagatgtaatcttgccctggtggctgcacctgacaagcatgtcaattgatgcctctgtgagcaacgccacaacgatgatcatcagaatccctgggatgatgcccaacatcttgatactggctggcaaggccataattccagccccaacaatagtggtcgataaattgaaaaccgccccggaaaatgaagctccattgaactcatgaaacccctcctcctccaccttgaccggcagaagtggtgttgtctcatctcgtgtttccttttgtacaatctgctggctcccattcggcgattcgctgctgatccccattatgtctttcactctcctggatagcaaggattcagtcagatttttatctggaaaaccaagtatgcttattatcatgcatctaactttctttgaatcagacagttttaacttggtttccatttcttatgctgttcagctttaatattccccaaaatgaatgtatcacatttttaattaatgcaagtatggacttatggagagaagaaatttctgatactaggtactcccttgaagcaagaagttcattctctcttctaccaaaagactttaagaatttagaaacgcaactctctaagtcaaaacataaagtaaataaaattatatccagaatatgagacaaaacgcacaaagaaacaagctgcaagatcatgttagaccaactaaagctcagcccaaaaaatccaacctttccaccacaattcacaaccacgggcataagcctacgaggctacgacacggttgtacgaatgatacttcaagtccatcctaatcagcatacatatccaaaatttatccccaaaatcactgcgacccacgaaccagctactcagaaccagtcttctcctagaattgatcaggaatcccaccaccgacacaaagccccccaagaaaagcaacgatcttcccaatccaagcaagaatcctcaccaagaactcaaaactgaagcaaaagaaaaggggatacctgataacttcggaggctcagtcccctcccggatctgaaaccagcaagagcaggcagaaccagacaaatcgccaagaaatctgtggagggcggcctcgccgcagcccggctgcggccccgctcgttttatagccaggggagacgaagagcaatcaatcaaccagcttggatccaaaaccactcgctttcacaagctacagtacttctccttgcccccacctccacactgtgatttccgtcgacatcaacggcaagagagggaacaaaaaaaatatttccgaatcgagaacgcgcgatccctcccctcccgtcgctgtctttgctgtcgtcggaatcttgtggggggcgcagggcagcgagaggtggtatccgatgattgattgatggggtcttgcttgctctggtcctgttgctgctttcttgccgtcttgatgttcctctctcttggctgtttttcctcgcttgctgcttcgatcgatggcggcgcctaaccgcgcccgccgtgacaaatgtaaaaacgggggagcatttaactatttgcaaacgtgacaataaaaaatttaccacggtctataacaacacgtgacccttacatgtgtatatatggtttcatttatagatccttaattatcgcttataagattgacaaatagttaaatatctcatagaatggtaaggtctaaaagctcacgctcacataaaaatagcgaggtataacagttgcaccatccgttccaaaaacaatcgaacttctgaagataaatttggatatatagattcatcctagagattggttctttttaagaactaacccctcattaaaaaaaagcccaatcttaatgagaatgggacatcactgcaacaatgaatttaggcaacccgctgtccaaattcgttgtcatagatagtgtgatatctcatcctcattaaggttgggatttttaaaacggagagagtaagctaatataaccaagacaagtagaaagtttttttcggcatgtacttccttcgttttatattataagccttgctagtatttcccaaattcatataaaatgttaatgaatctagacatatatgtgtatagatttagatgaatgtgacaaagaaagtattataatatgaagtgnatgaggtacgtcccacttgtgtcaaagctactttaaaaaaaatgnggatgttatttttttttcttccaaaattaccactacaaaaattggcaaggtaataaaataaaatattaccaaattttgtcttcactgtgtttggtaacaaaccaaatacaacctacatttcttaaccataccaaatattaataccaaaatttgacaggtagcaggatggtcgtaaaatgagttggtcaaccaaacaaccagcagcagcagtagcaggatggtcgtaaaaagtaacacatctcaccgaagtctttacccacggtgaaccactatttagggcttattcactttgctaccattttcaaacttaccaagttttagtattgccaaattttggtaaggttgccaaaatttggcaagatttcatacgtactcactaaaatttggcaacaaaataaacgtagccaaaattttggtaactttaccaaaaaatggtatggttgaaaatgtaatcaaagtgaacagacccttggatgcgtatgatattaaaatggcggacaattgtcatctatcgaaaaagttaaactatttcataaccaattttctttgattaaaaatcaactatcgaccaaaaacataaaacaataatgatttttaaaaaagggggcaattgcttatttaaccctgttttgaactgtaagtgccaatttgtccctactttttgaactttgcttatttgaccctcctttttgagtacgaaggtccggtctgaccctattccgtttggatgaggtgacggtgttaattttgtggtaaatagtccattttgcccttgcttatttgaccctattttatcttgtttgcttgcttgtttgatcctattttgttttaccgtgtatatattcaagaatgttgaaatatttgtaataatttttgctcaagaacagatttggcattaatttggcaaatttgaatcattttgtcaaatttgacttaaatttgacagaattttgtgaaaataaattaaataaaatatgtcacaattatgacagatttgccataaatttgaaaattttgattcattttgacagatttgactaaaaagttgtcagaattttgacaaaatgaattaaacaaaattttgacagcataacttctcattttgtggattccaaagtgtattcaatatagcataaacatatagccaaatccaacaagttcatatccaagcatgtgacaacatacatcagt

SEQ ID NO: 16919 - DNA, 877 bp, Oryza sativa
tatatatatatatatatatatatatatatatatatatatatatatatatatatatatatatatatatatatatatatatatataattctactacgacggaaatacaattcatagttccttagcttctgagataacgactactactacgtcgaaatcgtagctagctaggacatcataatggattgtaattaatacatgtctatttttctatatgcatgtacacattttctttaaagataaaaaattttttggtcatatatatatatatatatatatatatatatatatatatatatatatatatatatatatatatatatatatatatatatatacacatatgcatttgcataacatatatatatatatatgtataaatacatatatattatgcatgtatatgtattgaaacatatatatgcatggtttttatatatatatatatatatatatatatatatatatatatatatatataaaccatgcagcaacagggccatgcaaaaaaaaaaggtcagctcgatctttagtcctggattggtagtcccggtttgaaaaccgggattaaaggggggttacgaaccgggactacaaacgctttctccaccagtgtcccttaacaacaaaaccagaaatgtgtacccctaaactcactcaaaccgttcaaaggaggtcccatggcagtatatatgggtggttttcattgacgtggcatccaaatcagcaaaaaaaggggtccacattgtcggtgacatgggaccgggggtatcgtgactagaggcttgggcagccgcggtcacccacatggcctgaccccctcgggggggtcgggcccgagggtgacgtggccacccctccctctgtctccccgaggggt

SEQ ID NO: 16920 - DNA, 18205 bp, Oryza sativa
  unsure (1)..(18205): unsure at all n locations
tctaaactctcaatcgccattgaagacggtcgcactagtcagtatcggtaccactcagcaaaggcactagtagtatgcagcagggttggaaattttggaatttcggtcatttcggtgacccccgatacgatattaattcgaccgaaatttttgaattttttcatgaatttggataatatttgttcaaattcaactaaaaattttgttcaaaatttcgaaaattttggaccgaaatttcgggatttcggtgacccccgatagaaacccctgaaccgatagagtgaaccctggtatgcagtatgctctctgtctctctctctgggtagttggtagtagtatcaagtcttaatcgccattgaagatggtcagtactcctcaggagtaatcactgatcacagtactcctacacatgagtgatcaaccttagttactacttcatcagttctataatgtaatacaatggatccagggatataaattttgtttcaaattagaaaaaaaatccattttactatcccaaactattttacctgaggatctcttatactaaggggtatcttatattatgatttatgggacatgattttgtcaggtttccgtcgggtaatttatcagactatttaaccatctatttcaaaaaaaaatcattctaaaaataaatataaataaatacttgttcacatttattctgaatgatttttttacgagagagtgccataaacacataatatttattttcctaatccataaacacataatatttattttccttagggttcttaatattaatatgtaggtaccacaccagagtcaccaagcttctcgctggagctctgggcggtgaacgttggtagtggaagggtggatgtgcggctaggaaggaggtggccccggcattggcatggaggaggcaaacatggttgagcccatagttatgggctgacttaagccacaggaacctgggcccagtattaagagttttcactatgttgtccaacctcatgaaaaatcagtaggttggaccaagccttacatttgggctggatatgcctttgctcctagtccttaggacgcttctatcccatggttgtggcactaggaaacaccacttccatgggaagcatggtgtggcgccgacgctcatccttctagaacgcacacgtcatcctccgccaccaccgccatctcctcctgtccgcatcctcgtagtcgtggtcatcggagtcaagatccagctccgagaaaccttttttgatggaaccgaggtgtgatggacaccccagtatttagctgtgcatgagtgcatctcgaccatagcagcaatggtgttctccctgcgggtagtggtagaagctatattgtcactgtggtcgtcattgtagtcggagtacatcttggcgctggtgagacattttgcctgcatcagtccaaacaattgcaccatgttgtttattgttttgggggaggggggagagaggatgaacacaagggaatagctaggggcaaaatagacttttctcatcattagtacattgacataccatacagccagagtggcaaaaatggtttttttttttttaagaaaccataactctctagtgacaaatatatagtgccaattattgtatatgtggcaaataaagagtggagcaacaaatagttaaatttccctcaactttgctcgtatatataacttaaattaatttgtggcctggtcgtgtgtatatatatctactttgtggactgtggagtgtgtgctagtattgtccggccggcttcgtgcagccagcagaagtgaagtgcagagagtgcaggaaaacgaaagccatatggcgcagcaagcacacgctgctgccgtcgtcgtcggcgtactgctctactgctgcctctgcttgttcgtcggcgtcgtcgccggcgagcatggcggcggcggcggcgatattaagaggcagtacaaggccatgttcagcttcggtgactcgctgacggacacgggcaacatctgcgtgaacatgtcggcggtgaatcgtaccgagctcaccatggcgcagcctccctacggcatcaccttcttcggccaccccacctgccgctgctccgacggccgcctcgtcgtcgacttcctcggttcaattcgatcgccattgctgatcgatcgaagctgcttattatttcatcgatatatataatatatgatcatgaaatgatatcgatgtataatttgatgcagcggaggggttggggctgccgctgctgccgccgtcgaaggtgatcggcggcgacttccgccggggagccaacatggccatcgtcggcggcacggcgctggacttcgacttcttcgagtccatcggcgtcggcttcccgttctggaactacggctccatgaacgtccagctccggtggttccgcgacttgctgccctccatctgcgccactgctgcaccacagagtatgtacgttgtttcatgtgtttagatacttgtagctgttttttttataaggaaagcacagtggaggaggctttcacggtatatatattaaataaaaaagggctatataaaaaataaaagcaaaacaaaataaaagcaaaacaaagcaaattatatacttgtacctgttgatcaacaggagtactatttttaaattttaaccgattttcaaatgtttggactacgtgaacagaattttaatgtctttctaaatgatgcgaaatattttgataacataagcatcttttttaagagttgtataatttttttctgttggagttaatttatttctagaacataccagcctactctctaaccctctctactactcgtgaaactaaagtcaaggttgaagtccttgctctataaattttctagaacagtgtagtgtgtagacatgcatgatgtgatttgacagtagtactagtaccagtgaagtttgacaatgtagtagtactacaagtctctagctaggtcctgaagcttcctacatatcggtttatcaagcctataaatagaaagccagtgcatgtgtatagactgatgatggtgtgctgcccaacgtacaagcaagtgtactgttcagccctcaagcaagcaagtaaagaaaccagttaaaactagcacaagcttctctgctcctcttctctgatcccctgcttaggaaatatttagcaccaacatggactacgtgaacagaattttaatgtctttctaaatgatgcgaaatattttgataacataagcatcttttttaagagttgtataatttttttcccacaaaaagaccaaagatcatcaaatttaaacaagaataatgtcgtggcaagtacttcctttgccccccacaaactccattttataaataaaagttaacaggttaatggtgagggtagggacgtagggttgtcaattttgttttggactaaaatttcggtgcactgaaaatttttagaattttcatactttttgtccaaaattatttgaaaatgcaataaaaactgattaaattttaataaaatttgatcaaatttaaaaaatacaaagaaaaaccaaaaaattttggccgacatatttgcttgccgacggaggacgaagttaccaaaattgacaacctaggtcaggataaaagattaaattgtttattattaagaatatggactgtataaaatttctcgatttgcggggttaaggttagttataagagaaattttttcctttttcaacaaagatgaagggccaacatgttttttttaccagagggagtatttggctatctgttcgactgttcctagtagctagctagctgtcgttacaaacaccattatttctttcagctaattactccctccgtttcaaaatatttgacaccgttgactttttagcacatgtttgaccgttcgtcttattaaaaaaaattgtgaaatatgtaaaactatatgtgtacatgaaagtatatttaacaatgaatcaaatgatgtgtgtcgacgtttgatatctcgactacggtatttgcatggcatggggatcgttggtactaggatatacgcgagactgaggtaaaagagatggagacagggatttttatacaggttcgggcccctgaattgtcaggtaataaccctacatcctgttggccgaagccggagttgctttttattcaccataatcacaccagtacaatatgtgaggtaacctatctaactgttgtcgacatggtggtctgaaggtctgactcgtagtcgacaacagggtagccttcctcctcgaatccgtgcccggcgagatcagagatagcgcattcgtctctcctgacagtatccggagacaccgtaggggactagccgtgcctatctttgatgtcgatatctggcgtcttgtcttggcgtatgttggcttgtatcggcttgtggctttgtggcgtctatattgtccgtgtgtgttggttgttgtagtgcccgttccgtcgtggcgcctagtgggaaaactatcttttaaaaatcctaaatacgaaaattgtttctttatttgttgtccagtgtccgcgccatttcagatctcaaatccccaatccatcatcgaatccaaaccctaatctcaaatctgtcccaaatcaaatcctctcgaaaagtctattttgcctccctcaagtttgtgggccgatctcttctccccggcccatttcctctcagcccatctcttctctcccctccatccttgcccgcacgtgcgaggcacgtgcgccgcccgggcgcagaccgagagagagagagagagagctcgctctctctttctttcctccctctctctctgctctcgctccctctcgctccctctcccgccgacgccgcccaaatcgccgcgccgttgcttcccgcgcgcgcgcgtgccgtggtggccgaccggccagtcgccgctgccatcagcacctgccacgcctgagcccgcgtctgacgccctgtagccgcgcccttccaaaccaccccgccagcatcgccgtcgtcatcgacccggcccagccactcccagccactccactccaaggaatggaggcagagctcctcctccttctgcctcatcgccctctctccctctttctttttccaaagtggcaagaggcaagcctcctttccctctttcttttcttctttttcttcctcgccggcgtcatgccctctgtcgccgttttggccgtgagcgccgagcgccagctcgctccctgaccgccctaggtcggtttccaaaccgacattgccctcctattaaaccaaggcgccctttcttccttcccctctcccattcactctcgctccaccgcgccattgccgccccctctgtctcgcttccgctgaccgccgtcgtcgcgtgtgccggaggagccggtgcgcgctaggacgcggaaggggactccgggcgctcgtcttcttcctcttccctgacccgaggccggagagatcactcccgtgccgtcggcctctcgtcacagcgctcgtctcgtctcggtagaacacctctcccattcttcctcctcgctctctctcctccccttagatttggcggtagcgatcgtagcactcctcgtagcctgtaggcgccgccccaagtctcgccgccgcccggcacggtctcgccgccgttgccgctcgccaccgcaagccaccgctcgtcgccagcccctctcggcgtaaccccgcccaatccggtgctaggaatgcaatcccgtagccgcgtagatgctctcgccgccaggaatcggcccctcatggtctcgtcgccttttccctcttttgccgccgccggtgtgcgccgccgcgattcaacgttgtcgagccatcttcggtgcatccaagccgaaggcatgatccctctcgttcttgtcgtcacaccggtgcatctccccttggccgaagatgtcccaacgagctccggtgaacaccgccgtcgcccgccgtccatttccggccggtctcccttcgtcctcctccagccggcccatgtggcagccacgaaggcgccacgtcggcgccagctcggccgcgggccaggacggtttgaacccggttagccgttccttcgatccgttctctcgtgcgcgcgtggtccactgagagtcagccggctgcgcgtgggcccgccgcctcctagtccacccggtgcaccatctgtgaaccgcgtccgcaaaccctagctcccccgtgccgcgtaaaccctctctcccgtgcaccgagtcactgactcgtgggctcgccccgggaccctgcacgatggatccgggtctccctctctctctccccgcctccctctgttggaccgcctcctgaggccgcgtccgcccaattaattggtcgagccgcgccaactcctctcgggccgcgctcaagccgcccgcgaagtctacatctcctccctatctcgtttctaatccaaaaaggaggttactaaatccttttcttttagcccagtaaatcctttagtcttagaaaattccaaatcttctcaaccgtacatccgtttgactccgttcaacttccaaaattcctcaaatctcgagatctatctaatggcacgcttagaggtcaataatagggctttatttttgccgtttgttgagttgtcccgtttcgcgtgtagtttcggagcccgaagacccgcagtgcaaggatttcgaggatcaagctcaagatctcgagcaaggcaagtcacatttgatcatcttgcacctataatttaaatctaagtatttctcttccgcaaatattgcgtgaataggtttaacacaagtaattcggccgcggcttgcgagatagcctaccggccccaatcctaattgctgcaattaccctccttgaattattgaacaattaaaactcctttgtcaactgttgtgcttcgatgcacgggccttcgagcaagtgcatgggagcacctcccctcaaacttaaaatatccaacgatgggtaaaacttggggttttacaaaagacttggaaaacccgacacctgggtcggtgcttgcgaactaaatgaatttccaaaaatcacagaccgggggacgtgccgggagcacggtttcccgctcttgcacttaaggaccgattcctttggaatttcatccgtacatataacaagtacgaccacatgggtggaatgggacacccatggctgagtaattagctaatcaggggagccttgatgccgggagacaagtggattcgccaggatagtgtcggggaggacccctgggcttcctggcacagtattatctgggacctaacctgttgttggtctggcatatagtaaacctgtgtcggctctcgaaatgccttgtcatgaaaacctcaaggtcaccagacgtggctgttctgcacgggctgggtgatccgggttagtaatgtcgtgtgagtaaagtgtgccccctctgcagaggttattaaactgttcgaacagccgtgcccacagtcatggacggatgtaaggtgattccttagcgtagttttgtttgactactgctctgtgaaattgctgttgtggacttgggttcgatgtttggaacatctgtggctgacgggatcagctaggcccgggtggccatttgaaagttgtggccgggtggcaaatcttgaatctatcaaagactgatacattacacatactccgaccggacgagatgcactgtctcatccgtgtcgtttgagaagcactcacttagttgttttaaaaaggagtttaactaaaaatcaattgtaaaaacaacagcctttcctttgaatccttcattaaacacaaaattcccatgactttgcggagtactcctgtactcacccttgctctatataaatatcccccccagttgctgaaaaagatgagatggatcccgctgacgaggagttcttccaggagcaagtcggctatgatgagttttagggtttcgatctagttcctaagtcgtgcctgtgatgtatggtccaagtcttggcttccgctttcctcttttgtaatgcagttgtgagctcggggtctgtctgtagcccaacatgactgtaaacctactctataataaagagacctctgttgctgtgatattctgtcttcctgtgataccagcactgtttcctgggactggtatccgttaacaggttaatttggagcgtcacgggttggttccgttcgaggctagttcggggcgtgacagttgtcttggttgtcccctctcctcctagggggtcttgtatttatacccataggtgtccccttgtccaagtagaattagggataccaatatggatacaatccgagtatttcttgtcgtttccatgtagaactctggttgtctttccttatccggaactcctcctatatccgcaggttgtttccgtatagaacatggtatgtggtgggtcctgccgagatctagtcgactactattagatatatggtatccataaccctgataatatgaaaataataaataattacttaaattttttgaataatacgaatggtcaaacacgtactaaaaagttatctgtatcaaatattttgaaacggagggagtagttgacaaaagtacaatctgaattaatgttattatttgattttgacctcgatcgatcaagttgcagagcctacctggccgagtccctcttcttgttcggctcactaggcggaaacgactacaacgctatggtcttgttcggcttcaccattgatcaagccaggaactacacgcccaaaattgtcgaccaaattgcaagtggcgtcgaggtaattaacatcacatatactctttccgttccagtataagtataatttaatatagatgtgacatatcctatttaagactaaaaatcttgacacgtatatactagcttacacttatattggaacgaagagaatattaattagagtaaattgtatcaagtgcacagatttatatggtgggatactttttttttcgtctttcctccttaattggtctaaataatcttacagatagagggagtagctaagctagaaccggtcataatcaaataattcgtgtggagttaaccttgattaattgatctctgcaaaatatttttgaaatatattttcgtttatatttgaaaaaaaaaatctgccaccaacattttcatattacatactccttccatttcatattataattcggtttgacttttttcttagtcaattattttatgtttaaccaaatttatatatagcaacatctacaacaccaaattagttttaataaacataattgtttgtgttaaaaaattattatatttttatataaacttgatcaaattaaaaaaaattgactatgaaaatagtgaaagcgatctaataaataccaaacagagggagtactatatattacaagatagtcattctataaaccgtggttatctatcatctctaaaatgaagtttatatatctgtagggacgaagtgcatatatctcacatttttccatagtaaagtactgccatttagctagtaatagtaaatcatatggcaatcgcatatgcagaagctgatagcgatgggtgcagtggacatcatcgtcccgggagtcatgccgttcggatgcttcgcgctctacctgacggagctcaagagcagcaacaagtccgactacgacgactacggctgcctgaagccgctcaacgagctggccatccaccacaactcgctgctgcagaccagcctcgccgccgtccaggccaggcaccgcaggtcgccgtcgtcatcgccgtcgtcgccgtcgccggcggcggcggtgaggatcatgtacgcccgactactacgccgtcgtggcggagatgatgcaggccccggcgcggctggggttcaggagcggcatcgcggcgtgctgcggcgcggggggcggcgagtacaactgggagtacgtggcgcggtgcggcatgaggggcgccgccgcgtgcgccaacccgtcgagcgccgtgtgctgggacggcgcgcacacgacggaggcggcgaaccgggtcatcgccggcggctggctcaggggaccctactgccacccgcccattctgctctagatcgaataatagaataagatatatcattcagcatatggatatatcaataattaaacaagaacatcatcatcatatatactcccttccctccgtcccaaaaaaagataacctaagatatgtccaaattcgttgtcctaggtgatattaaatcaccatttaggttgtatttttttggacggagggagtatgtcgatatcacattattgtctgtccgtccatcatcatttatctttggaaaatgtactctcgtagaattaaattcagtattgtaatctttggacaagtttgtatggggagtagatgtcatatagcgaactctcagtaacaaagggatttggtttgtgtcaagtgaagtttgtttgtgaagatacatagtggccgcgtacatgtatttgggcttaattggttgtcggtcatattttgccacgtctaaagttagctaactatgacttaaacaattgtatggtttcaactatagttgtgataagattttctttgaacttatcttccaatatattgacgtgcaatccttttgcgcattcgagaaaaaagattttctttgaacaaatcagatcccacgcgttgatgacttgaagaaatgtgatagaatttcttggacttgctaaggtgtggtaaagattttaatcacataaccttaagcaatcatgacaacttttgttggtaaacggtggtcagattctgatcacatgaacttagacaattaagacaattttgttggtaaatagtaacagactatgggttgcaactgatggtcatgtatatcatgcagatagctgtttgccgcgtgactgacggtgtttacatacgctttattaatttctcatattctacatcaaaatgcatgcaattagtcatttacacaggtcgatcttgctgttgtattaaggcacacactccacagtaattggctcgctctgctcattagctgttctgacaaagcacacggctagctagctatagctgactggctcttacaagttggccgacgacgagctgccacggcggcgagaggtcgtcggagacgacggcaggaggccttccctcttggccatctcgtacagggcgatggcgctgagcgccttggcgtcggcggtggcgcgccacagctggctgtacggcaccacccgcagcttgatcagctcgccatggtcgcgcagcccagtctccttcccttggagagccctaagggtgtcctcgtcggcgtggcctctgtacaggaacagcccaatctcttcgtcgcagccaccctatgggtaaggagacagttggtcaagactgaagagctcgtgatagatcaaaaaatttgtaatcttttatgcaggttactgtacatagcacagatctatagcacattcagagtttcagacccataaacagtggaaatctcttgtaattcttgctactcgattacatataggcaggagggattctgcacagaaatgtaatttcccatccctctgcatcgcatctgcatcttgacgctattttaattcctcttgcaagaaaacatttttagcttctctatgtgttgtctaaatctgacttgcgacaagtaaaacacaaggaatgaccaggcaaggactagtggacgaccaagcaagaataatatgcccccctgatgcagtgatgcctaatactcgagccaaattgagtaacacactaacactatacacctatatgcttatacatagcttcatttcttgaagagaagttatgccagatattgcgcagagaagggaaatatttgtcatttaccggtgaaggaagcattctgcatccagtgtcagggttcagcaatgcagtaaggtcaatcatatcctctaaatttagcttaattccagtttcttcttcaacctgtcagtaatgaaagaccctttatcactatacttcaaatatggtgaacttctgactcaatgttatatacagtattactatggtctgtgaaccaaactggcaaagaccggacgagtgctagcattactaatctccaacaacagcacatacctctagataaagaaaaacagggatactaacctcacggactgcagtgccaacaaaatctcccttttcatcgtctagcatcccagcaggtagttccaatataaattttccaacaggaactctaacctaaaattttcagagcggtcgatactcaacacaaggttctaataccagaatatgagccattcacagtaactgatgataacatacctgttctgtaagaacagcgtaagtttgccctttagactccaaaagaatcaacacagcaacagcaggccctcttgcaaatacaattcctggaatctggatatattgtcaaaactcaaaatataatacacacaaaatccgcttactttgaatcctatacaacgaccacatctaattcaacatgctacaaggaatatcaatgaattcacgaaacatatacatagacacagtccaaaaaattcatttgaaaccataaccattttgtgccacgatcaaagcaaaacctggtgccactaaaacttactcgtgtggagactatggttatacgatattctgcatcagcaattgcaaaccatggtggcaaaaaacatatttcagatgaagaacatctatttgtaacaagcaaaacttgagatattcatatcagtttcagtagcaaccaattttcaaggatactcattccagtagagtaatcagcagactatctaagatgtaatcgttttttcagggatcttccttctagatttctagtagagcaagctgcagattatccaaggttttaataaaaagagagcagggaacggcggcagcaacatttcgatcaccttggctttggtctcctcgtcgatgatgtcagccttgaacttgacaaaccccacgcgtttcccaaacatgtcaaccccctgcacccaatgcagcgacgaaaattaagattcacgcaaaaaaaatttgcttgcgcagctcatttttgatcgagaaatgtagcggattcaacacagtgagacagtagcgtggctcacctggatgaggatttgcctcaggttcagcctcccgtaggtgaggacccccttctcctcctgcaggttcttcagccactgcctgaacagcgaggattccaccgcgctcgtgaaatccgcctcggtgaggcccggcgcggccacgacgcggacgggcgcgcccgcgccgggcaccgcgacggcggtgctgagctgcggcgcgtggtcgccggacgaggccatgcgcgcgccgcggcggctggacggagcgggagagggagcgcgcgtgctcaggagcgggagaggcggcggcgctgcttgtcggaatccnagnagacnnngangnncngccgccgccgccatgctcgccgagaagagaaattccacgcacccatccaggtccagtccagtccagtccaccaccatctgctatccttcgtgggccggaacggcccatcaaaagcccattacaatgtaatcctagagtttatctccgggttaagtccaccaaacgttcctcatgttttcatcgagcttaaatcatatctctaaaccgcaataccgaaaatattcaccctccaacttataaaattggatcaaagcaagagagaaaaagaggagacgggagaaaagggtaaagaagagggaacagagatggtgacccggtcggtgactctttttgccttaagccgcttcgccgtcagcactcttggactcctccctcatccatccacgccacgacatgtttttttgatggcctgcatgagagggggtaaagcggtggagggaggagtctggcggtagcaacgcctccacatcgtgtcggcaatgacgacggcttcacatcacgttaatggcggcggctctcctcgccctgaggcctgagggacaaggggatggatgagggagagaataggggaggagagtgaggatgatatgtgaggtccactttatttttgccagataaacttctaattaatacgagtggatcaggtcaatttgtcatgtcggtaaaccaactatctctaataccggaggacctaatctatctattatatctttaaagtaatagaaaaaggagtctccacgttcgctctcatggcctaaaaattctcacattaatcaaaaaataagaaaaaggaaaaatagaactagattaggattagttaaaaattaaaaactgaagaaagaaagaaaaaaggcatattaagaaactcgaatcggacaatcgttaaaaacaaaaaaaaaaggaaaacctaatcatactactggaaacggaatcggacaatctgtcttaaaaaaaagaaacaaacaaacaaaaaaaggaaaacctaatctactggaaacgaaatgtacaatcggtcaaaaacaaaaaaaaaaagaaaaacataatcatattggaaacggacaatattttgggaatacgtgtgttcacaccacttttagaaacattgaaaggcaaaacaatcctaatcaaactctgccgtttccgaattgtatcagtattgtcatgccaataaatacataaccaagccaaaaattagcaagccaaaaatacataaccacgtttgctgtggaggctagaaattcccacattaatcggagaaaaagaaaagaagagtccaaatagaaatacaatcaaaaatagctgaaatttggaactaaaaatatgcaatattgaaagaggagtccatataggaactcaatacgtgattaattaaaattcggaataaaaataaaaaaaatcgaaattagaaaaaggaaaaataggagttcgagtaggaatacaatttaaaaataactgaaattcagaattaaaaataaggaatattgaaataagagtccatataagaatccaatacaagattaattaaaattcggaatgaaaatttttaaaaaaatcaaaattagaaaaaagaaaagaagagttcagaatacaatttaaaattaacttaaattcgaaattaaatataagaagtgttgaaaataagagtacatataacaacctaatagtagattaattaaaattcaaaataaaaaataaaataaaatccgaaattaggcgaattaaaaagagagttaaagtaggaatacaattttgaaacaattgaaattgaaaataaaaaataaaaataccaaaagaacacaatacgaaaaataaaataaattgtgaaattaggaaaagaaaaatactaggaataccatttataaataactaaaattggtgataaaaaatcaagactattgaaagaaaataccatctaaaacacatggcgagattaattaagtaacatgcctataaaggagtagaatggtggcggttgatacgacatataaaaactgttaataaaacaccaaatagaatcctaataacgattgaaatgaaggacgacgggtaggccgtgaagcaatcgatcaaggcggttgccgggacttctagaaagtaaaaaaaaacaatgctaatcatattggatttttaaaatctcaatgataataaaaaggagaagcagtgggcgggatgtatagtagagccgccgacggttggcgggacttctagaatataaaaaatgaattccaacgatagttatgttagatttttagaatctcaatgacaataaagagtaggtggcggaagggcagaggagtatagtgacatcatttaacgggatttctaaaaattataaaaaagaaaccaacaagactataaactctaaaaactacgaggtccaatttttaaaggtttggaacttctaaaaagtaaaaaaaacacaatgataatcatgttcgattttaaaatctcaatgacgataaagaagggaggcagcgggcgtgccataaaggaaaacaatggcaaagccgctgacggtttagcgggactttagaacgtaaaaaatgaacccgaacgataattatgttcgatttgtaaaatcccaatgacaatatagagaaaagacagttcacggctcgtagaggagtattatgactgcgtttgacgggacttctagaaattataaaaactatatgatctgatttttaaaggtttcaaatagtggtagatcaagcaagcaaataaaaaggatatgatagaagtaaggggtagtagctggtgtgacttttaaaaactatataattagaaatacggggatgataagctttggtctttcaaagtcttaagacaacgtgatagcaatttaataaattttaagtaaaatcatactgaaaaatatatgattttgtttgggtgctagccgcgcaattgcacgggccacccaactagtttaacttgattttataagttggaggttcaagatttcagttgttgcggatgccaattaaataagagggattgttggtagacatattccattatatctacatgggcctaaagcctaatgataaataggctttgggcccatgtggcaactggcccattgtgtaaacctcgccttcctcctcgaatcgaaccgagcggcggcggcggcggcgaccaagggagcagtgagaggcggcggcagcggcggcggcggaggaggagatgccggggaaagggcagaggcggagggagaagaactaccgggcggcgcacggcggcgaatcgcggctgcccccaccaccgaagcagcgggagctcgacgcgctcccgtccaagctccgccgcctcatcgccatccaggagaagcacaagggcggcgagaagggcgccgttgccggagactcctcaggtgcgctccccttacgcctttcaccccggctgccgctgaactgtagttatagcctgatgaaattcctacgtcctctacagggaaacaaggagagagcgatgcggcgaagaacaaggctcgcaaagacaaggtactgcggattaatttcctggataaacacggtatctttaagtacattttcctgctattacgttgcatttagtccgttcatctggttgctgtaatacttttgttcatcgcattctatcgtttgctctttggaaatgcaagagaactctactactctagtattaatgcaatttgttagcttgtgcccgatttgcttccgcagttggtaccttgtcatattctgtatgttccatgtagaaaactaagaagcagaacttggagcctactgctgatagcaaagccgcagagattagtggcaaggatggaccggttggcgatgagaacgcgagtgtagatgaaaaccgaaggaagcggaagagggggaaagctgtggatcttcgttttaaagaattagatgaggcagttgcagtttcaaagaagcagaaaaggaagaagtaagttgtttattgtctaaatgtctgatacactagagatatcactttgattatttctttgttgcatcatgtaaatcgaagattgcccttttgtttccaagaacacggatattcccttatgaattgatgctagtctaataatctctattggaagttggacatgtctgatgattgcctaaagggaatcgttgtgctatctgtctcacccattggaaggtatagacatgaataacatatctcaatgtcacaggtacctggatgaaaagaaaaagaagcgcaagggcgacaagatggaaactcttccagaattccctggacgtgaaaaggttaaattcggtgaagttgttgaggctccaccaaagttgtcattccctaaggtatcttcccttctccgcaccctaatctctcaatccaaactcctttcacttaatctattttctggattaaatgtggtattcttctttcgaaggtgaagaatgctttagacgctactcgtgagatgctaagaaaagaggcgattgagaactacagaaatatcaagggttggacatcaaggcctgggctccagcttccaactctagctgaaaataaatcattgtgaccatttatttcatatcttctcattgtatccttagcgaacttactctgctgaaatcagagtagcttatagtaccagggtctctggtaccctcttgtaggcaattttgtaacaaacgttgatttttgtgttctgggtcatctactctgtttattttcttgaagtaatctttttaatactggtaataggttttatgtgattgataaaatgtttggtttcattctcagtaggtttttagcacaatgaaggctacttttcctt

SEQ ID NO: 16921 - DNA, 1453 bp, Oryza sativa
gcaaacccaagcacatttattaacagccattacctaggctcctgtttagaccacggcagaaagccttttatcccagttgttgttgtttaacagtgtgtttttcccttgcataaagaaaacaaatgttcctttgcttaacatcttttggactgttctcattttagtaaacctttgcttttatggtgatcagttacgaagatggaagcacacttttgtgggatgtacgaaatcctggtctacctgtatcctcagtgaaatatcactcagaatcaggttgctctccattctgaaaattactattttagttatttaacctatccttttttcagtagtagctatgtttatatctttggtgtttggaaataatgtatgatctaataagagtctggtgtgcagctttatccattgctattgatgggctatgcaatggggggatctcaggaggtgctgatgataaaattgtcatgtttggccttgatcatcaaaaggtgtgcaccaaattttctgatttcctgtttcctgctacacaaatctttactcttgtcgtgaaaggtgcaccttgtgagtacaaaaaaccatgttatgtacatgcagtacaaagctagcccaagttgacattgattttatgctttctctgatgtcgtgctattaattatctccaattatctgctagtcattcaattatataaagaaataagctgctaaggagatctttgcattcattatttttctgtaatattgacttcaacgtcatctgctattgtcttcttgacaaggttcataagcatttcaatttcctaaatgatgcagtatactgaaggttaagtttagcagtgtttaacactcagaagtaggcctagagttggagactgcactattatccttctgatatccacttctgacatctgtgatatttgaatcccttcatatctgaagcaagaaacacgcgcacaaccatggtttttttattagctagatgggtagtaattcttttcctcagggaggatagtagttatttccagttacaggcatataaacattctacatttcataacaaaattatcaccgctggaaaatgcatttgcttctgttgtagcttttgcaattacattagtgaatgctggtttaacttggtaagccatcttttgatttactggcatgcagttttgttccaattacagggtgcatttattctcaggaaagaaataaaacttgagcgaccgggtatagcaggcactgcaattcggccagacaacaagattgcagcgaccgctggttgggatcacaggtttgtttttcccattctgttccttgatgaccaggatgttaacataagctatttttagtggcttcctaaatcctgaattaacatgctcaagttagtaggtacattatacatatgatttaatatatataatctattaagtagtaatacctgagtgacgagtacaaa

SEQ ID NO: 16922 - DNA, 11861 bp, Oryza sativa
tttatgaaagaaacttagcttgtgaatttgatgtgaaggaacacagaacggaggatccagttttgccagagctagcgaccaagtgtactcgtggatgcccaaatatagacctcagaaacatatctcttactgctcgctataagagatgtttttcgagaaacacaataaacacataatagatacaatattttcactattaagagatatcttattcttttgagaaacctgatttttttcctaggcgggtatggtccttagagccaaatggacgcctacgataatgtaacatgcttgcacaatcctgttgcgagatataggatttcagtttagagcaatgctccagtactctctactggtagtattatattactagtagaaaatttgaaccatttattattaaggataaattagtaatttgttaacagagtaacttagccatttacatatttctttttagggtaaatgggtccctagcgtcaggcccatttgcatcgtggcaccggtgggccgttttgatcgtgacactagctgtggctggcatggcagcgcatcgtcaatatttcatcagaaaattggatcgcaactcgttcgcccgacggcgcttttgggtggcgagtggctagtcctccggcaggaggcgcgtgtggatcccgccggcggcgacacatccccggtaatccgtttctctgcatcccgctagcgatacgtgtagatctcgccggcggcgacatatatccggctaaccgtttctctagcctttaaagcagaactataaattaaaactagcacgggccagcacggtggcccatacagattgcgcggctagtatcattatattttctctcatataatagcatatatgttttctcattattttattcaaatatattaaaatgacaacataattttaaattttgcaataactttacaaaactactaatgtgtaatattcatattgtattttatatacgtgttagtaattaattatttttaatatcaaattttagttatttgtaaattaaaatatattcatatatggagtctagattcgtcttttaatatttctttttttaattctgaattttctgtaaattgtatttctatatatactctatgctcttcttccaatattatttatttttatttctgaatttttgttatttctaattgtatttctatgtggactctaaactcatctttcaatattctttaatttttaatttcgaatttcagttacttctaaattatattcctatattgactttaaactcttcttcccatgtttttcttaatttcgaattttagttatttgtacattgtatttttatacagactctaaactctacttttaattttattatgtttattttaaattttagttagttttaaattcctatatagactctatactctacctctaatattccttattttttaattccgaatttctattttttttcttaacgtatttctatatggactctatactctacttctaatattctttatttttaattccgaatttcagttatttcctaattgtatttctatatggactctatactctacttttaatatttcttatttttattccgaatttcaattatttcctaattgtatttctatatggactctagtctcctcttctaatattccttattttttaatttcgaatttcagctatttctaaattgtatttctatatggactctagtctcctcttctaatattccttattttttaatttcgaatttcagctatttctaaattgtatttctatatggactctattttttctttttcttcgattaatgtgagaatttctaggccatgagagcgaatgtggaggctcctttttctattcctttaataatataatagatatgttacgtttggattttatccagtctgttcaaaccgggtttaaaaaaacacgtggttttttttatcatgcacacataaattaaagcagaactactatttttgaataaaatatgttacgtctggatctcatcgggatggtctagaccaggttaacaaccaaaaacacggagttttcagtggtgcacacgtaaattaaagaactattattttaggataaaatatgttacttcgcggtttcatccgaatggtttggactgggtcaacaaaaaaacaaatggtttttcggtcgtacacacataaattacggctggatttcatccgatctgttccgagttaacaacgaaaaagcatgtggttcttcggtcgtacacacataaattaaactagaactattattttatgacaaaatatgttacgtccggatttcatccggtatgcccggactaggtggacaaaaattgcatggtttttcaatcgtgcacacttaaattaaagcaaaactactattttaggacaaaataggttatgtctggattcatcaggatggtccagaccaggccaacaacgaaaacacgtggttttcggttgtgcacagataaattaaagcaaaacaactatgttatgataaaatatgttatgtctgaatcttatcgggaaaacacatggtttttggtggtgcacacataaattaaaggactattattttaggaaaaaatatgttacgtcctaaattcatctgaacagtccacaccaggtcgacaacgaaaacacatgggttttttttgtcatacacacataaattaaatcagaactattattattttagaacataatatgttatgtttggtccgttcggactgggtcggaaaaaacatgttgttttttgggtagtgataaattcccctttttataaatataagttcgtgcacgatccaatatttttgttctttcttttttttttctaagcagttctatacatggtatgtccgtacgtgatcatattttcctgttcccactgcggtttcttttcctgtttttatgcattccaatcgatacagtttttattttttaatcacacccatgacattaaatatttatttgttttctcgatattcacttattttcactgtaaacttttgctgaaataatgcccttactaatttatccttctattctcgttagatgagatgatagtaaaagagataacctatataattatatattaacggttgagattgctttctaccaaatggaggagagagctgatgtacttcagtttatgtttttgtctctcccccccctccttttttattgatagttctgcacacgcttgggatatactcaaacatcttatgtcttaatagagtaaattgcagattaggccatgtattttgaccatagtttcacattgaaccatctatggttcaacttttttatttaacaccagatctttttacccaaagttacaattaggactagtggcccacctgtcaatgacgattgaggatgaaaagggaaaattggagctactgatcgagtctaaattggagctactgatcgagcagactcgccatctccatagtttgcgtttgtggttgagtatggagttggatgctagctagggccatgctgccggcggcgacggcggcggtgaccgtctctgctatcgatgtcggcgacggcgaggagaggccgttgtgcaggaacggcagcagttgtgacggaccgacggcaactcatcgcccatggtggccgtggtgtcagtggccatcagagagtaggatgaagcgggagctaatcgtctaggcaaaggccgtggcatccatggccatcaggggtcgatgcaattcaaatgtattgcacctatctaattcctgaaccctttctctttgtagagtgagatccatgttttttgaagcagctcgtatagtctgtttgaatcttaatcgatccattgattgatgaatcggcctatacatgccccctttcttttttcttttctcctgcgaaggactctaatcgaaggactctaatctcatagtaatgcaggtggagagatgtagagagatgtaggcactaataagtgggcaactttggtaaaaagatctggtgttaagtgaaaatgttgagtggttcaatgtggaacaatggtaaagatatatgtcccaatatgcaatttactcgtcttaatataaagataagcaaatcatgtatttcctaagtagtgttcctccacaatgttaactcaacagaaaaaagaataacggagatatataatacattacgcataaaaatatagacatggtggcgagaaattggtctaattatgttaattaatagtgattttttaaaggtttgtttcagtttactccaaaatcttacccaagataagatttcagtgtcatagtagctttggaaaacgtaatttaacaaatcaaacacaaagaacacaagcaaatatatggaatgatctgatgaaatatatatagtgttgccgaacgggaaaggagagcaaaaactgtgaatataacatgtcttaaagtatgaaccttatcatgctggtggaataaaacatgagcagtactagtgccaagtaccaactagctccactaacagtaagagaaatgcatccacgaagaaaactcacatgatattcctattgcttaagctcatggatataaggaaatactcatgcaagcagtatgccagtaacaacttcataatttcacaatgagctgcagagagatacttctgttgataactgaaagttgcaaaactaaggtatcacactcaaaatgatgttggttgctggatggctgattgccaaatgagttgtttgcaggttctgaattgtggccagtatttcttaaaggtctaagttttttttttaaaaagataatggaatataatccccaacctttcaccaaagagctacaaacaattattacaccaatttaacaaaaactcacacttaaataaacaaaatcacacataaactaataaaaactcccacagcataacaagatcataaaaattgttgaaattttatttgtgaatctccatccaaaggtctaagtattggcagtggtttagcatttgatgtttcaaccggcacagtttgttcaaatgcctatagcaacaaaggacaatttttagaccaagccttgtttcatttgtttggatgggctgaaatcccagccctgtgctgggagaagaagcatcaaggtctcgacggttttttgggctttgccgatgagcagtagttgtctcatgacgccggccgtgcacttccacaagttcagagtttcaggtaaaacttgcattcgttcttctatcaacacaccttggcttcaaacgcatcacatcactgaacttgtttaggaattcatactgaaaccgcgagaaaaacaatttcataatctcgatccaaaccccttggatcgatatttctctctctttcagttccaggtaacgatcgaaaagaatacgtactattccgaggcgcgagacaatggtggtatcgtggagaagtgaagaaaggtggcgttttagtggcagcagccagcaggtcgcgttttagcgtgtactattattttagcgtacaggtacagcacagaaaatagaaggggtgaggcacggaggcttcgaacccagaccggcaaacctaccaccttatggagctagtcggaaaatctctgggcgtttctctacatgtacaacacagcggcgggacgagtttagcgtggagaagggccaatcgatgtaaactctgaaccctcacgtcattgtctcctttatttgacagtacattggtgttaaaaaatgagcctatatatcaaaagataccgtcgtagatgttgtgattttatagggatcaatacagagagaattgcaaacgtaacgagaacatgaaaggtgtcaaggagtaatccctggctcgccttgatctgcacttctcctcactcactcaatgcggccatcccgttgcagaggagctccatctataggggaagatcacgtggtttgtgatgctgaattacggatctctagggggttcggagtctaattctccaacttacgtaaaaaaaaagtataattctccaacccctttagaccttgttcagtttggagtggaatgaagagaattgaaggggattgagggggaataattccacaccataataggtgtggaataaatccccttcaatccggggattaaacgaacaaggccttagttagtttcttcaatcatcgatattcgaaatatgcacaaaataaaaaagaaaaacgtaaaggggttcaacactattaaattttctgacaccttggatctatgtatttttttccttagagaactacaggggggaagcggtggagggcgatgagtggaattacgtagctcccctgccaagatactttagattatgcacatgacaatagtttcatgtttatgttattcttcttcgtcccattattttattgcgtagtgaacatgtttaataactcatatttgcatataaaagtgaagtgtgaaaatattagctcaaaatgcatggagggtgctatcatgatacagagtagagaactacttattaccaataagctcaaaatgcatggagagtgctatcatgatatagagtagagaactagttattaccaataagttaataagttatttgaggatcaagatctgcaactttagcagttgcagtgcagccgatggataaaaaatcaacggctcaggtggcaggaaaatgctgttcagaaaatactgtagcaaatttgtactatatcgattactgtagcatagatggtgaaacaggatgacagcgaatccggcgttggctccatcgatccgatggctataatgtggtccgactgctaaagttgcagtcgttactactacagcaccatatctgaattcgttatttgagtacaattcaattcatatacatggaacaagaacccatgcataaatacataccatcattttagtgagatgtacataattttattgataagtaacaatgtcatattataagcaaattccgtgacgatattttttatacacctcaaactttcatttgagatactaacaaacatttcattcgatatattaacaaacataaatagtattgaataaatggataacacaatatagtattaagggggagcacaataaaattctcatacaatatacttttgataagaatacaaccaatgcaaccacttagtacaaccacaccaggcatacttagtacaacctccaacacgagacgtggtaccaaaataaaaatgttattttttaaatgaattaaggtaaaatgaaacataataaactatggtacttcacaccatcttcttgttttggtttcctccaaaatctcaaatcacatattcactgcaaatatgagtaaaggatgtactggtatatatacacagtgtgtcaagtagggagagagagagaggtacaatcaacacttcagtcaaataaggtgtgataaatatctcaattacaactagtggtaaggaagtcatgaaggaaatcatgcaagcagtaggccaataacaaagacataatttcataatgagcttaagataaatacttttgttgataactgcgagcagcaaatccaaggtggcacactcaaaatgacactgggtactccagtactggatgaccatgtttgcaggttcgaaggttcataattaattagtttaggtatttcgaaaaggtctaagtattgacagtgatttagtatttgaagtttcagttggcacccttagttcttgaaatcctatgaatttcctttgaattaacgggggccttaatctgttgtcccgttgacttacttcgccgtccttgctgttaccgataagcactgccggcagaagataacgtgcctccatgggtgtcgagttttagtcaccgagaccccctctcctgcaattttcatcataactagtgaattaaatcgcacgtttttccatttcggaatgcaaaactttttaaagaaatcatgatcaaattcacaaatatttgaaaaaaagtccagaaaaatgctcaaaataattgcttgctagaggggcgaaattcctgaaatttccatccctgacctttgtgcgactaggatagagatggcaatggatatggacccgacgggtttccactgcacgtacccacacccattaaaactaaatatgcccactaaaaaacccacacccgcccacgggtgagaaattcccccatacccgcacccgcatgggtgatgggtacccacatccgttgcaacaatttcaattgtgcacaataataactcaataaggttataggctgcagtgatatgtacacagcaagattgaaaaactaaggctcaaacaaaccatacaggatacatacagcctgtcacattgcaaaatcaacaacaagccatctctactcatggtcatggccccagccggatccagcgacctacctcactgcacctgcggcggcgctcctgccgacagctgaccggcgcgcggcgtccctgcccctaagcggcgaccgacgcggtggctatcccgcccccaggaggcggcgtccctggctccctggaccctgccccaggcggcgaccgacgcggtggatgtccgcctccacgctggcggctgcccgcacggcggcgcccctactccatcggcgcgaccgagaccggctggcggctggtgctgcggctgtgcgcgcctacgcggtggtgtgccggcgtgtggcatgtgccgtgcggtgcgaccgtggcttggccgcttgggggatggggggcggcggagaaacggagacaggagggagaggagaggaggagaagaggaatagggtttagaggagtgaggaaaagaggatttatacctagggttttgatggttgtgggccttgcgccatctgcatattgggctaggcctacgggtattttcaacccacgggttaatgggttcgggtgacagcagaacgtacccacacccgtgtacccgatgggtgaaggttttgcccgttaacgtacccatgggtatgatgtttggaacgtttatacaccctaatagagtaaaaacccaacgggtttcggtcgcggggcccgttgccatctctagactaggaccatccttataagctgtgtttgagaagttattttttctatatattattttgattgttgctaactatttaaagtttatatgtaaaataacttgttcccctcaattaaatatatccgattagtgcgaagtaagcgtagctcatctggttaggttccttgtggaggaactagtccacctacattcaaatcctaaatttgttcgcatttatggctaattattcttttaatggtagacgacgtacccgtcgacagcgagacgttggtgacttcgtcaatctcaagatttgttggtccaatcttccgaagagactcatatggataggggatatgcgtgtgaacgttcatagagatgagtgtatacgcactatgaacgtctcaagaaatttatttgattggtcatatggtccaaaagactgtttggcctgttcgaccaagccagcccattagacctattgacagatcaatgaggcaaccactccatcaaagtgtgttgttagtgcatgttcagattgctgttaaaaataaacttttctaaaatttgccaagttagcaacattgccaaatttgatcggatagattaaatatggtgttgccagaattctttagacaaccaatatttagtaacaaactaaatgcatccacatgtttattgattttacaaaataaaatggtatagttcaagatagcaccaaatctgaacgggctcatagcctttttcttctctctctatattttacccgttcctcatcttgatggctaggatttttgctttggtattttttttttccttttgtgaatcccattgccattatttgatacatgacgtggcttatcctggttgcttcttgagtttcacttcagatagattttcgttgtgataccaattatctctgctatctattgggttgtgctgcgctgcatgcgctgcatgaatgccaccggcagccgcgaccacttccataatccccaaggcgtcgtccgtaacctcctccggtggccaacgccactgtgtgccggtaggacggtgccagtgatcgatggcagctcgccggcgtctgtgtcgcgatggaggcggcttctttaatttggctcaccgcccgctggagcccgctaccatcgccatgccggccgcctctcccaccctctccggccaaccccgtccagacttaggaagaaaagagaagaaagaagaggacggctgatatgtgagtcccatatactttttttggctgactaattaggatgtcatattaacgaaatcagagatccataccgctattggacctaaatttatggttttgtgtagttttgcggtgagaggaatctatcatgctggatgtaagcatgaaaaactaatactaattaatttgactaacagtatggaagcatgaagaagctcacatgatatacatgctgttaagctgctggatataagcaaatacgtagaatgagatgaaatatcctattaactgtccgggccttccatttcatttcagcagcattgcccccctacttttaactcggggagcatactcttaaaactgtctatgtgtaaagctgctactaccaataatttagagctagtttatgacttgtttcggtattttcgaaagaaattgagcttgtgtaacttgagaagggaaaagagctgaatgatccaaaaggtggtttgttctttgatgttttttttaagataaaaaaaaggtgtgccgattcagctgtcaattttactcaaaagcaaccatgcatctgaaaattcagctgtcgattttatttcaaagcggcgttcgcaaaaaaaaaaaatatttcaaagcgaccatgcatctgaagatcttcaggccctcgagcgttgaatcggaagtcaccagctgccgccgctgctcggacggctcgccggagaagaattgcctcagcttgtgctaatgggccttctgtaacctcctccggtggcggaggcggcttgtcccggctcactgccggcgtacggatcataaggagaaatgccaatagtttgatgtttatatatatgttcttgtttttggtcccattattttagtaatgaacatgcttaattactcatagttctacttcttaggtgagatggaatcagagtggcacggaaacgattgacttccagtattatttcctgatcaaccacagcgaaatgtgtttgtggattgcccaaagttagcaagactaacatagcacaaacatggcattgtgtatttcaaaggagtaagtattaacacatggcattgtgtatttcaaaggagtaagtattaacaataacagtggttcagtagctgtagttccaatcgacttgaattagaatttaacattcctataaaaaaaattagaatttaacatgaacacacggaacaaataaacttgctttaagtgtgaaatattttgccaatctcaaaatgcgtgtaaaggagttatgatgatatagggtagagaaatggctatgggagtagaattcaattcatatactggaataagaacccatacataaataaataataccaccattttagtgacaagtaatagtcttactattattggtcgaatccaatgctatctttatatttatatatatatatatatatatcatacgactagactccaccatcttttgtttcaggaagctaatttctttctttatctattgtattttcttaataaaaaatatcccaatgtaagctatctttatccattgtatttccttaataaaaaaatatcctaacgtagactattaggtatatggtattgccgtattctaacaactcatatataggatgtatgtttattcctaacactagtaaaataaaatagaataatctatgg

SEQ ID NO: 16923 - DNA, 4300 bp, Oryza sativa
cttcaaggcaatgacaaaggtatccttgtcctagtacaatgccaacagccagtctataatcaccaatgcagctcctaatttatcatcaagttcctgcttcttccgactatttcttgaaaactaacattatgctttaaaaaatatggcaccaaagacatggtgagggctaaccagaacctaggagtataaatgcttgaaggttctaccaagcaagagatcagatcggcaccagacgtaccaccttatgctagctcaacctacatttggtatggttcataagacaaaacaattacagcagaagttgtggagatgaacctctttgcttggtcgggtgatcagccagattagcgctgcctgtttcaggcaagcacattacctttattgcgttatcaatatcccaaagttcaacctgtattcactttgttatttagtgacaacatgaaaaaattgaaaacagggcaagaaaatatgtaggcacaaaaaaaacgatgaattagttatgttctattgcatcacgctatgttttgctcaaagtcaagattaaaaactaacctgcgatgattcttgaccagcgattgccattatatttggtcctttacagcaagtgcctaggaaatacaccattaagtcaatcatgaagagagtcactaaggagttctctgacaccaatttcttgtcaagagtgatcaagtttctagttgctctcttttatttgagatgctgaaatcatgcactacctagttcacgttcttcagtaactgtgctttgtgactcaatatcaccagttgcggagatcaagccagattgtgtgcagcatgtagaacatgttgacttaacgagtgacattttgcagaaatggtatgtacttgttctgattgtatatagggccctcctgaaagaacccaagaaattggatttgcatgccacggaaactcaaataagaaacacaaatgaaacacagctcaaacaaagaaggttgacaagtatgtgttttaccatattccttctggaccttacacttatcatcttaattaggacaaggtgctagtcaacaaataccgaggaggctctgactagtttgtttaagtttcttcatcaatttaccactacagatcatgtaaagtccattgacacaagaatatgatagcactaagttggtatatatattcttttattatttaagagctataagatcttcaagaggcatatggggacctgccctacagactataatcaggttaaatatactgacaaaacattaatagcattacacttatgctctggtggatgcacttgcagcagaatgaggacaacaggatggagtatccaattacctgagcagatggactttgtggagcagatgcaataaatggtggagtatatagcaggtagtttcaggatagatacacttggtttggtggcatcaaacctaatgaggcctacatgtgtaggagtaaaagttgtcttgcaaagacttctcttgatgggttgtatatctcttctagtattcaaaatatcttttgtctatatgtatgcccatgtcttcttctccttgcatttacattggtaaagcctactattaaccaagtcctaatttatgttaaaggtagcatgttctattttttctttttaaaaattgtatgtcaatccttagcatgttccatccaaagaaagatccaattctaactcctattacacttcatgtgcaatgagtcataccgtgaaagcccagcttcctcgatttcccagcatttgcatgatccatccctaccttgactgcctcagcatcagaaacagatatatcgatcaaaattcaatccaaatcgtaacaatgtgagaggcactcaactcaaaatatgctactaaagttatttttatgttccatctgtatagtacaatgcgctgatgctgtctagactgaataatcagaaagataatacggtcatatatgatatgaagaggttcaatcctacttgcaatgcaattccgatccgaaaaggctgtgtactcaaatcgaaaatattacactgattcaacccgatgttttaacgcataacagctacggatgcttcttatctagcctgttgcaatagcatcctataatgatgcaaacctacagccagcaactcctgaaaaaatcacctctgttcactcacctaatgattttgtttccaagtctggtgctagcagccactgaatatacaccagccgatccaccatgagccctgcaaaatcgtatgccctcgcatcaagtatccctcaaaacgaaccaaccataatcgttgacgcggaaataaattaccaaaccgaggagacagtgcggtggctcgctgtgtcccaaaccctgagttccccgtcagccgcgctggatgaagagcaaaccccaaaatgcaaaaaagcagaggagatgttaccgagagcgtgatcacaagcgcgagggctcatacacacgcgctgctgcggcggagaatcaggcaaggggggttttggggggtcgaggggagagcgtacccggagaagatgagcgggagggaggggtggaagcagacgtcgttgacggcggcgcggtggcctcggagcaccgcgacggggtccggcgcaggtcggcggcggcgcggcgggttctcggcttcggccagggccatggctcgggctgcgagattagaactttctggaagcttcggcgtgaggtcgaagtagacagtgaccagatgagaatggtttgaggcctactagagagccgagtgggccggagggctgggcctgggaactttattacatggaaaaggaataagttcactttaggttcctctatttgtcgcccagtccaaaattcatcatagaccgcaaaaccggatacaacacatctcctaacttacaaaaccgtgcaaacgaggtccctcgatgctcggtagtattgtgtctgcttttagctgacatggcgcctacctgactcctttcactatgtcttcgtcttgtgtggcattaacatggcacttgcatgccaattcaatctcgggaaaaaaattaaaaccgtgggacctacaaatcagtttgacatacaaaataataaaaaatagtgaggcctatgtgacccaacatatcatcctcactactcctgcttttaacaatttaattaattttatcaatagaccatgccattaaaaacaagagaagcaaaataaaaataatagtggtactctgattatcatctatcccctacctctttctctatctttccagctggtggagcggcccatcggtgtatcgggtgggcgacgcctggagtggacgacaggcagcggctggagcaggctagcggcaagaagggcgccaagggccgggagccactctcctcctcctcctcgtcggtcgcgggaggggagatgtcggtggcggactcgacagttgcggcctcccctcgacggattctttcgggacggcggcggcggcaccagatgactcagcggaagggctcgtcgcctcctccacctcggcgccagaggtacccaccagggcctcctcctcctctggctctttcccctcttctctctcaccgaaccttagctactccgaccttcggcgacaatgtcgacgacaatggtggggttgtatcaatcgccagagggggagtgaagagggacgacttcacggtgttgggttcgccaccacgcgcggtcgttgaggaggcaacgatggagatgaggagcacaacggtctcagaaggaggtgctaggattgagatgaggagcacgatagtcacggagggcaatgctaggatagagatgtgtcgtgcgccgctcctcttctgtcgtccgccggctgcatgccactccaatcccgcggtcccgccgctcgccactccactcccacggcgtggctaaaggagacagaggtagagaggggtgatgttgaataagtgggacccactgacatgtgggtcccacatattttgtttcgattttttattttcaatttgctgcttttagttttttttatcgaattggcaagtaagcgccacgtcagtgacatgtgggataaagaccaagccaaatgagccacataggcgccacgttagccaaaaccagggacaatactatcaagggatcttgtttgtactggtttcgtaagttgggagacccgtcatacctggtttttgcgaccaagggacgaaaatcgggttgagaacaagtagagggacccaaagtgaacttattcccaaggaaaatgaatttatggcaataatgtattttacgatttgctccagaatttgtatgttttctcacaacaagggggatcc

SEQ ID NO: 16924 - DNA, 9468 bp, Oryza sativa
  unsure (1)..(9468): unsure at all n locations
caaatcgtaaaatacattatgcgtaatatagagagaaacatgcctaatattccatccatacggtatcctatgttaagacaagaacatgcctaatatgcctaatatagagagaaacaaatactatgaaaaaaaacaatagtataggctttgtttagttcacacaaaaattaaaagtttgattaaaattgaaacaatgtgacggaaaagttgaaagtttgtgtgtaggaaagttttgatataatgaaaaagttggaagtttgaagaattattttggaactaaacacggcgtcaaacttatttggatcctgacacttaaacgcggaattcggcccaaatagtacaagtgcccacgccgctgaacaggcccaccagcccatataacatatgccacgtcaccgatccgtggtgctgagctctccaaccaaccagcgacgagcacacggatcgtgtgctttctacggcctatcactagccgtcggatccgatcgcgatcccgaaacctttcctcaaacggtcacaagaaaccgcctcggtccacgcgtccactgcccccccgcaacccacgctctccagccccgcgcctataaaaatccccccacctcccctcctccctctcactgttcgcctttccacgccagtttggtcgctctcgatttcgatttcccccaaatccaccgcaagagaaagccaagtcgccgccgagaagcgaagaggagatggcccgtacgaagcagaccgcccgcaagtccaccggcggcaaggccccgaggaagcagctcgccaccaaggtgcgtatcggcgtcgtcgtttcatctccttctcccgttccgatctggtgctttgtgatttgggtggttctagggtttgcggttttgctgatttgtgttgttgtgtaggcggcgaggaagtctgctccgaccaccggcggcgtgaagaagccccaccgctacaggccggggacggtggcgctccgcgagatccgcaagtaccagaagagcacggagctcctgatccgcaagctccccttccagcgcctcgtccgcgagatcgcgcaggacttcaagaccgacctccgcttccagagccacgcggtgctcgccctccaggaggccgccgaggcctacctcgtcggtctcttcgaggacaccaacctctgcgccatccacgccaagcgcgtcaccatcatgcccaaggacatccagctcgcccgccgcatccgcggcgagcgcgcgtaagccgccgccttcgacgcggttgcgttgcgtagcgccgaagcgatctggggggatcaacgacgacgacgtgacgtggtcaacttgttgattcccctctcgcttccgcgttttagatctcgttttcattagcagctttgtaatagggtttggtcggttaattagtgtaaaaacagggttcggttaaagactcaaaatcaaatgttattgccgttctttggattttgcggttaagcaaaacagtgttgaagactattaatattcgtttactatatggagatttgttcgtaatctgtttgcctgtgattgccagctgtttggctcgtgattcgcctgcgtactagtactgcattttttttccattattacgtctgcgccgtggaatggaagtaatgcgtgcgggtggcacgtgaaacacggctgtggcggtgacgcccttggaatttgaatggcaaccgctcgtattctagacttgtataaattggtaaaagtaaaaatggagtgaacgcgtataggcagtgtaagacaaaaaaatattgttgccgaaccgcttgggctgttgggtttctgggcatcctctggcttgtaggcccaatactgaataataagcccatgaactgacaatacttgaataataagcccatgaactaatatttttgctcatataccccatcagaccatatccaatcctttgcgctgtgtggggcccacctgtcactatggctctattttctttagcaaatctgcactgatcagtgatcagcttcaaaacagagtctgccttttgtggcattccacaaatgttgtggattgatgtttgacaagtcaaacggcatcgttgggatgggctagtgtagtttgaggcataaattaggtttatcaatatttttcaacttcaatagtgtttagtgtctatttggtttgaaccaaaatttttaacatgcctaagaaaatatgtcatttcaatagtgaacttaggctattttaacttcaatccaaacacaactttaaccaaaatttttgatatgcttaagaaaataggtcatttcaatagtaaacttaggctattttggcttcaatccaaacacaactttgcctgatcaaattttgttatttctaaattttactaaaatttagtaaggtttatttaggccacaaatcaaaccaacccgaaatggttttttagtatgagtatgtaggcttcattaataaataatgatgattaatgattcctagagtaaaaaaaaaactgtaggcacattggtgatcggtattttggcagaaatattcaccacaaaccacagtgcatttatagtttattgctttctccccgtgcaagtaattaacctgttattacagtttgcataatatttttctttgttcataaattttattactgagagaaatcacttgtaacatctcgttttctgcgtataaaactgtgagaacaagcaacctccaaccaaccccaaaacacgtagccaaaaaccttcaaccgaaagaagcacacaagcacaccccacctcacaaaaccctcaaattctccccaaaaacaaaaccatctctcaaaattcaaaccacccaacacccgcctctctcccaatttgaatccaaactaaaaaccccaaacgaaaacgcaaacccgcaactccaaatcgggttcagaaacacctcccgaaaaaacacccgaaaaaacacactccccatttccccaatccctcccaatcccccacctccccgcggcgaaaaggtccagaagctcccagaatcggcatgcgcggatcggcgcgccacgtgtacggccatgattcatctcccccggatcccgatccgtgtgaggcttcctccagccaatcgcggcgctccgccctccggtataaaccgcgcgcctctcgaatccgcacctcgtcacgcacacagcagttgagctctttttccactacgcactagtagtagcactctggtattctcccatggcgactgcgaccgaggaggttgccgctgcggctgctgccgccggcgaggcgccgccgccgccgccgccagcggtggtagaggaggcgaaggaggctttggaggcaccgaagccggaggaggcgccgaaggctgaggagggggaggagaagaaggcggagggtgagaaggagaaggagaaggcgaagaaggagaggaaaccgagggcgaggaagccccgatcggcggggccacaccacccgccctacttcgaggtgaggggaaaatcaattgatcgatcgatgcagtgatcatgtattgggttgattcgagtttgtgagaattttgtgtggttttgagccagatgatcaaggaggcgatcatggcgctggacgggaacggcaaggcgggatcgagcccgtacgcgatcgccaagtacatgggggagcagcacatgggggttctcccggcgaactaccggaaggtgctcgccgtgcagctgcggaacttcgccgccaagggccggctcgtgaaggtgaaggcctcgttcaagctgtcggctgccgaggagaagaaggcgacggcggcgaaggcggccaggtccaaggcggccaagggcgtcgtcggcggcgccaagaggaagaggaccccgcgcccctccgccgccgccgccaagaagcccgcgtcgtcggcggaggcgaagaaggcggttccccccgcccgcccagcccgcgccaagagggcgaggaaggccgcccccgcgaagccgatgcagccgcccaaatccatccgctccgccatctccaagaaggccaacaaggccagcgcctgatcatcgccgccgtctcgccgcccgtcgccgccgcgcgctgtatccctgtatagcctaggtgttgtcgcttacctagtagtagttcgccatcgtcgtctcgtctgcttcgatcgatcgagcgctctgtgtccggtgtgtgtgttgcgttgtagataaggtttgggtttctttttgcaagggaggaagaagctactgtagcatatcgccaagaagctgtagtaataagatgatctggcgctcgcagctttgccttatgatcaacaaactgttcatattcttcttcttcttctttttttcagttagtttctgttttgaattctgatcaagttaaattcttgttaaaaaaaaaaagaatcatcaagttcattcagcctctggatcattcgcgggaggatgagaatgattttgttccatgtcaaggtgtagggtgccgcgtggcagtgtggcactcgcattggggcattgggcaagctgatgaactgcaaaagacgcactgtaggttggatgaggacggccggtgtgtgctgactgctgaagtgctgagtgactcgcggtggctgtcacgattggtgtgatgatattttgcatctgatccttcttcattatctgtgccccactaaagcgtcattttgatttttgatttctgctaaggttgtgtggaatcaataggctggtttggtttgagacataaattagacttaccatggcaattttaataatgtttagtgtctatttggtttgaagccaaattttggtatgtctaagaaaatataccatttcaatagtgaacttagactattttagctttaatttaaacataattttatcttactaaaattagttacgctaaaacttgtcaaaatttagtaaggtcaaaccaccccaacattcgttcggctctgcatctgtccaccgttgtctctttatgctgtgcctgtgtgtttactagggagaaattggaatttaatcagatttaacactaaattcaacatgatactatatgtccaacatttaatttattgtatactactataaataaatttaatatgaaatattgcaacaaatttaatatcgagtattgcaatagatttaatgcgaagtattgaaaaaaatacaaatttagtagcgtacttatcacaaaactgaaggtctaatgacaatttaacaaaatcttcgtttataacttagaaataacattagtgacacgatttaagccacaaacttatagttttggaataattttattattaaatatttagttttatgatatttagtcttaaacctataatattgtgataattttttaaaatatgtagctttgtgatgcatcaccttaaatttgcggttttataataatttgatcaaaatatctaaatatctataactttgtgtgaaatgtactctatgtttttgtaaaaaatagcaagctaaatgattccacgcttctgataattcataatacagtttttcgttaaaggaatctgaaatacagtattcaaaatcgatattgtaatttaaatttaaaactcggttgtattggaagttccggagcaggagaagatgacctcaacaactttcagcgtagtatatgcaaatctcaaattcacaatttacaataataatcattaaattgttctaaatactcttgatctgtgccacgttaaatttcagcagtttcacggaagtaacacaagaatacacaaataataatctttgcttcactagagactagaatttactaaaccatttgagatggggttaccgtcaccttacgatttaacagttaacatatgtaccgtatttttaaaataaaaggattatcatacgtgataaacaaaacaatatcacggttttataaaccttgccggagagacaaccagcaaataatccatccctcccctctccccatcaagccgcccccatctgctatctacccgcaagcactcatgtgtcactgaaccgtgggccaccacctcctcccctccccaacgcaatcccggtcgctgctaccctcctcttgctccccccaaccctcgccaaaaaaaaaaaaaaaaaaaaacagaaaaaacagtagcggtggcggcatcatcagcagcagcagcagcagcggtggtggtggtcgccgtagcggctgccagctttgacccccacctcacccgcctccggcggcgccgccgctcccgttcctgcgctcgccggcggcgcggcgggtcctcctcctttccctctggcgcgcggggccccgccccctctcccacccccaacatggaagcctctagaaggaggggaagctgctgatactgtagggtaaactctctccctctctctctatttccgcaaattgaggagtggtttccccccagatttttcgggtggtttcgcgcattggataagggagctcccgccgcgagcgagggcgcgcgcgtttttttggcggcggtgttgctcggtgagtgggtgggtgatctagggtttagcggaatccgatttgggcttagacgtgggtttttccagcgtcgggtttnnnnnnnnnnnnnnnnnnnngccagcggaggaaaaggtttgatttggagctccaaattacttcgtcttgcttcaaagcgctgaatgcacatgcatgtgatgtgaggtagtacttggatgatggagtggtagtagcagtgttcatgtttgataagatcgttttggtggtgtgattcgagcatgcgcgttgggatgacgagcgtgtgagtgcttctgcttgactgcttccatggtagtagtggagccagaatcaggtgctatagtcactcatagccagttttggtgtggattatggatatgcgagttgaaattttgtgttcctctttaatgattgttgaacttgttgcgtatttatctttccaaaatggcgtggaactattgcactaattgtttgtgacttcgtgcatcttagatgtaacggctggtttgtcgattatctaaaaagtcagtttagtgtggatgctcttctctatgccgtgctggctcaagctccatacattttctgctgagcatgagctttgtctgtttagatatctacctttggtcgaatcaacctctgtaaagtaggaagcagctggagatagggcaaagctagcttcaatgctgtcgtcatgtgcggcttgagtgtataaaactttgcagatttgtttctgaggattcggttaaggtgtttgaacactgggctatgatcaggaaatcatgtactagtgtattcagtttcagtatcatgtagtaatttgaatagccaaggctttggtgatcctcacattgcttctttgctcagtacttgtgcactggttgtggagccaatgcataaatctatttcttctagagctttaaagggataatccgcacaattgacttattgcttgtttataaccatgaaccaaatcatgccttattattactggactcgtttttaccttaatacttctctagaattttactgtacccttttttccttgtatacctgtcaactttaaagtctctgcatggctatcctataccgaacagttataggcagatacatcttgcctgaagaagtcattcctcttcctcttgggttcaaaagtcaaccctctctagactctatcctatactgaattgtctctgtcgtctatcctctatcgcattttctttagttcccccttgagccccaagcttggtcctgacctagctagtttaccattggcatttggcacataccttccctggagtaacatttgcggtaccatttatctttgtttcttttcttatttttcaggtgatcgaataattgcccctttttctgttacaagcaaatgtgataatggacaaccttggccatagagaaaatgggaggcaaaggccagaccaatataaaggacttcatacccaggtttgtgcatcataagaatgcaggcatgattttagatttatttatattagtatggcacatgcaatatctaccattgtttaatatatttgctacgatgttcaattggattatttccctagatgaatactcaaaatgtgcatatatgttttggttagataaaagactgcttaaattctgactgcaaaagtgcaaatcaaaacattatctaaaaaaaggtgcaaatcaaacaaattgaaagatggggatatcagctgtcctgctttgctgtactgcgtgacaaaggcatatacatgtcaaagtacagaacaccttctgctacggcacttagataaaacttatgtgtgctgtccagtcaaaagttccacatatgcaagtttttaatgagtgtattacgctcacattgttggtattttggaaaataaccgaatactcaaattatggagatgacaaattttgatgggtgggaactgttttggtacaacatatccaatcagccgcaatcatttataactgttcatgtatgttctacttttctgtacttattcctgtattatggtgcgtgtggtatttaactgctttccatgttggaaattaattactgcgggtccaatgtaattatgtcaatcatgattttaagaaaatagaccttttggtgtagcttgcgtttagcatgcattcgtagcactattgtttacataggctttacctatcttattctttgtcaataagatatctcacataagtgctctagatggtcctagttctcttgcaatttacaggataactcagttctgttagattgtaatttatgctttacaagtgtgaatgctggcttgcagggaacatgcatttcttgtggaacatttgtgttatgtctgtgtctgtgtccaatctgagttttatgaactagcttcaggctgatgtatcttttcatgttgcgagctttttttgtccttttcttctacgttttctgtgctatgtatgtccttgttatagcaggaggtggatattgcaacctccaaaagatctttcagaaatgtgcactgttcagctttaaatgtataacttttcagctagatcacaaacaaaacaaataacattatgaactgatttaccagcatgtattgatttcatttatgaaagttctctgaagatagttgttataaagaatcattctctaaaagaatgtgccaaccatgtcaactaatatatccactcaatgtttttttcagtggatgatgccccagacccaaaggcatctgaaggaccatcaaagtatgaatctcttggcactgatgaatgatagagataatgccatccgagaaagggaccatgctctggctgagaagaaggcagccatagctgagcgcgatatggcgtttactcaacgggatgctgcaatggctgagcgtaatgctgcagtcgtggaaagggacaatgcccttgctgctcttgagttagcacgtacaaacggattgaacatgaataacgggaatggattcccccaaggatctctcagcggatcaaagaacatccaccaccacgaccag

SEQ ID NO: 16925 - DNA, 471 bp, Oryza sativa
gcatcatcagcagcagcagcagcagcggtggtggtggtcgccgtagcggctgccagctttgacccccacctcaaccgcctcaggcggcgccgccgctcccgttcatgcgctcgccggcggcgcggcgggtcctcctcctttccatctggcgcgcggggctccgccccctctcccacccccaacatggaagcctctagaaggaggggaagctgctgatactgtagggtaaactctctccctctctctctatttccgcaaattgaggagtggtttccccccagatttttcgggtggtttcgcgcattggataagggagctcccgccgcgagcgagggcgcgcgcgtttttttggcggcggtgttgctcggtgagtgggtgggtgatctagggtttagcggaatccgatttgggcttagacgtgggtttttccagcgtcgggtttggagttcctgctgcaattagccagcggag

SEQ ID NO: 16926 - DNA, 9079 bp, Oryza sativa
atttttgaaaactatttagggatcatctaggaaaaattaaattgtgatatagactcaatcatgttaggattaaaagaagaggcgaaaacatcattttttaatgatctccagtagtcaaatattcaaatatataaactgtaatccagggcgaacttttgtttccaagaaattttacttttggttaatgtacttctgtgaaggaatgaacactagtgctgtagtccaaagaagctaccaagagaaggccttaaacaacaactagacagagcatttgtgaaacctaaaacgtaataaagaagcagctacttactggataatttgaatgattgtcctttgagctgagttttcagcagtaatcttcggacatttggatcaggtaatggcacatatattctctttacctgtttataggaataaatgttatggcattcacaaaaaaaggagcaaagctagttcaaattactggctcctatacatactactacaatatataagcactagaaattcaggagtaaaaggtttatataaacaagctgcattatgtaccaaaatataagtgctcagccttttttcaagaatatggatatatgcattatttataagtaataacacctcagactcttctttctaaaagaacctggctaccacaacaagctgcctgcttgtaaacagtgaaaaatagcattttctttagtccagttcctaaccaattgcttgtaccacaatacccacgggcaaaggtggaacttgtaccaggcattaagcagcagaaactattgcatagaaattttgaagacctaaatgcaatgcaggaaacatgaagccaaaatagtggcagtagtcccaaatatatatcaatcttaccagtctacggagaacagcatcatccagctcttgtggcttatgggtagcacctaaacaaataaattccattaatagatgacgcaagtaataaagaagacacttagtataaaagatatggggacaaagaatttttgtatatcgttttaacatacactcactaagtgagaaaacgacctacatacatgcactaaaatcaggaaagctgtatcactcaagatcacaaacttttgctgataatgttggaaactatttagaagtatcctagtatacaaaaaataataccaaaaaaatgagtttggagttatttaacaacacccgaacacacttttaacaatttcttatataaatgaattgaatcaggaaacaaatcagtagcatgtcataaatactttccctatttcagaaatgcttttaacatggacactcagtaatatatgaccatgacaaatagttatacgatactagtagtaaataaatattttctccataaccaatcataacacaagctaacttcaattaagtaactagaaaaagatagtgatgctaacctataacaataacaagatcatcagggtttgaagtgaccccatcaaactggataagaaattcagatttcaaccgcctgctagcatcattctcattagctaaccttgctgacatgacactatcaatctgtaaaaggcagtcaacatgggcaataagcaactatctaaaataataaaaataaagtagctaaacacattaagatcctagaccgactaagctagcacagaaagccagatatgcagataacatctttgcattcatctatatttcttgatagatttgaatggaaaggaatgctttagaaccaaacgttaacgttctggtagaatttgtggacaacaataacaataaaaaaatattctcgatgtattaaacaaatgacctcagcaggcaagcatcacaaaagttcaaaataataaaaggggtgacatgaaaccatagaagccttaatgacaacatcacagcataacagagtaagcctaatagcagaatgctatgatgagcacattctggtattctgtggaaagtttacacaaaacacgtgtgatgcagaacacatatatttacatgttctaatcacatggtttaaatggatagaagttctcagaagcaaactatttagagaaacatccttttttttcattccaaaaagatgatagacatggttccaactcatgttgatgggctacactaaaaacactcctaaggaaaaaaatggagtcgagaaaacattttgtgttgacatcaatttatacttcataaatttaactacaagtgcactacaagaagggtttataatgaggacctcatccataaaaattacagatggttgtctatcgacagcgaccatgaagagtgtccgtacaagcttttcagcctctcctacctgttttgcaatgaaagaataaacttgattcagagtggggaatatgtgtaagcatgtaacgtatggagggatggccacatacccactttgatgtcagtgaagaagctgaaacattaaaaaatgttgcttcagattctgatgcaacagctttggcaagcatcgtctttccattccccgggggaccaaagagaagaagccctaaggtatattatgatgtacataagatggctattattacaaaacaatgtatataacagaaattatcagagcgaagatgtttacctctagcaggcctccgaagaccagtaaacaaatcccttcgcttggtaggtaaaatgaccatttccatgagtgcttgctttgccttgtcaaggccagctgcagatcaaagcagaggataagaacactacaatgaacactaggttttatttgccatagcatgaaaaacaaattataagcttcctaccaacatcttcccatttaacagcaggacttctatccacaatggtcgtatttatcatttcaacaagcttatcatcatagtttgcaccagctctttgcacaggtttggcacctccactgctactcttctgatgagaagatgcttgaccacctctattaaaggtagggctaggctgcgaagtaggcctatggaagctagttgatgcggctctgtcattcctattaacaggattgtttgtaacaacctgtaaaatataatacacagctattgaaaaaaatacataatcgattcgcttgccacaagtaactcgttaagaaaatacagtgttcaaaacctcaacataactttgcaaacaatcttacttaattttcttagattggacattttgctgaacgcatgtcattaaagcagcaaaccgtcaaagccaaataagtagagacctaattgcattttgaagtttcatgagttacttcaattttcaaattttattattgaaattacaaatactcattagaaaaggctacattgatagcaatcacacttgaatggctaagtcagaagtgaagtgtagaaaataaacagctgagtaaacaattattgaacaaaaggaaaaaaaaccaacaggcacgctcgctccacctagaaaacatgccatcttatttagaagtaagagagttgaccctactgcatattcagtttcgcatgcagcactcatgttaattgcaacaaacaaacaccaatgcactaagattcacagcctggaaaacaattaaagctaaatttgacagaattacaacgttaacaactacagttcaatgaaatccataccttctttggcactggtgcagccgctcctgcaaaatcagatgatatagatagttaactcccagtgaactacaatacaaaaccaaagcaagcacaagtttatgtacgttaacaaaacaaaagacaaaagaaactcaagcgtccatgtattatgttggtatgaactatcatagaaactgaaaagcagaacattaagacctgtaactgaaaacacaccccacttgcttgttgtttaatccaagcatacaagcaatggacgttctaagcttctatctatatcatatacgtaaattcctaaattaacaccaacacgcaggggcggaactgggcctagggcagcttgggcccgaggcctactcgtgagagaaattttagtggacttgtactagggatggcaacggggacccgaatcctgaatccccgtggggaaaaactctattaggggctataaataggtccatattactccccatggggttgttaacgggcaaaagcaagccccgtcgggtggggcgggttcgggggcgttctctaggcccccgtccccgaatccccgagcccccgagtgtagcacatgtgcacctctcctcagcccatctagagatcagaagcccaactatccaggcccaattcacatggacagatacacatataaatagagaaaccctaggtcacaacacagctcgtttagtcactcggctaggtacccaagcgccgccacacacccaagctacagacgccggcgtagatcgatgcatcaccgaggcagcgacgactccaggctgtgccccacgccgcgtcctgaccctctgccgttgttcgccttgggcaccggccgcgtcgtcgcttcgctgcgcgcctgggctgagccgccgccgatgtagcggcctgccgatgcaaagcacagcgtgagagctgcacagcagccacatgaactttgattctactgcttttgattggtgcatagcttgctcttgggaattggaatgaatcatgtaacttctctcttctgattcatggatctgatgtgtgtctttatcaaaaaagaaagaaagaaaggatttgtcatctgggtgcatgactaagcatttccttttcttaattcttgtgcatctattctctctactcccaaattcccaaacttttctgaatttgtatttgtgtctcctctcaattcccaaattgatgcaccgtgctgcactgtgtttcctctcgggtgcgcgcccccgtcagagccccggaaccccggttggggcggggacgggaggaagattgcccccgactgcagggacagggatggggagcgggggatttccaactgctcgggggaggggacgggcgggcactatccgtcggggatgtccccgttgccatccctaacttgtacccatatattttcagattttgtcaaactccaatggcccagccctatgcgtggccattctcagcctcgtgtccttcaacccaattggaagcccatagcagcccagtagcaactaaccctaatccccaccaatcccaccgtccccctagccacgacacacgagcgcttgcgccgcatctgctcccaaccacagccattgacgcagcaggatgctcgtcgcctcgccctcacctcacctcctctcgtctcgccacatagatggccacggcacgcatcggcatcggcagcgagctagcaacagcaacgacgtttccccttcctcagcaacttcgtctcccaacccagcatctttgctcaagtctcaggcctcaagtcaagcacccaagaaagtttgattcctaaaatataggttggtcttctctcaaatgttcgatccgtattctcattgtgcatttggtagctattaatcaattagaaatcttgtttgatttcctagatgaagagcagagtgataaaatcattctatcaagtcttccaatgaatccacaccaacctcataaatagtataaattgatgattcctcgcggtattaattgatgaggcatgagatggcgaaaagcaatcgattgtttccgttgccaagtgttgctcttctatcttagattttttaaaaaaactaaactaatttgattgccaacactgttaattaagactgagccttcttagctatgtatataattaaaacatagctcacaaacaagatgaatgatggctggatgaatattgcatgttatgctatattgcgctagatttgtttgctagcattgaaaatcggcggattatactatacttctaccgtactgcagtgtacaaattttcatgggtagttttagccttcaatttgagccctaggcgtcgagaaatcctggctccaccactgccaacacgcaatggttcacgagtaaactatggagtacaagttaatgtctctagacgaataagtggaggacatggctgggaaaccacatttcatgagctcggtggtagttgctctctagacgaataagacggaggtaaattgatggggggaaagaagtggatcgactcaccactcctctggccgagcacccggagtcgttcctccacctgagtctgccactttgcgatcttctcctggtagaccctaacctgccccctctcgctgcaatcaaaaacgcactcacgccaatcagcaatcacaaaccctaaccgcgcagtggggaagggaagggcgcacgcacgcacggacctggaggatacggcgtccgggacgcgggcggccttggcctcgagcatgacgcggagcgcgttgcggtagtgcgcggcggcgtcgtcggggagcccccactcctcggcgcgcacggccttgtcgatctcctccttggccagctcgaagtatcccctgagcttcaccgccacgcgctcccccaccaccgccgccggcgacggcgccgccgcggccccgtccatgtctccccccttcgcagccgccgagtacagcagcgacgacagggagtccgcgagcgcgcggaggaagctcatgcgccgacggcgagcagcgccgccgggagcatccggattccgcgacgcgcgatcgagttggtggggaggaggaggaaggggaggatcgcgtattcgcgtgggcgtccactagtccacgcaagcggcggaggggaacgaacactatcgggctcggggctacatgggctcatgggctgagcccaatacaataccgctatacacttatcaggccagaccagtgggccacactgattcatctcccagtctaaataagtctatttggcatccctccagtcttgcccatggtcgaattgcatcgcatacctccagacttattccgtataagagcacttcagagatactccaatacttactacacaggcataggattattcatgtctgttatgttagcatcctgataattcaatttcaagtcatgtgccattgatttgctcttgtgatgaaaagagtaatacactacttcagagatactccaatacaggctgcacaagtcatagtattatttcagatgaaaaaattggcccttggagttattttctgctgaagctccttgcctttgtagactcttgttactggcttactgcagaactcagcctctcattgttgaattcagtttcatcttccctgagacaagaacaagggagcttttcgaatcattgtagtacttcagacaagaacaagggagtagtatattttttttagaccagaggcgaggaaggtcaaacctatttacagtatttaccttctcgtgtagtcatgtaattattctcgctaaatatatttgattaaaaaaatctccaaaatgactcagtatgttctctgccgaattaattgtttttctattgcagacttccagtgcttcgactgttagcttgttgctaaccaggggcggagctacattgaagagggggtgcccagaaacccggtcaataaatttttttagttgtagttcatttattttcaccatataggcacccctctaatccaaactcaggcactcatatcaacctaaactcggcctaaagtagagtaaagcaagcgaatggcacccctctccattttgttctagctccgcccctgttgctaaccaaatccaaggatgaaagcaagccgatatttcctccattttcccttgatatgaactaagattagatttatggccatgcaaagttggaaaccttggggtgaatgacaatgacacggcaactgataaagagtcgtagagtctcatcttttcgcttaggcttatcagccaaaatttaaactttcaaccttaaatttagagttaattttgagttttttttatcaaaatttattttacaacctttatttttaaatcgttaagaacatgtatataaaaattttatttataaaatatttttcgtttataaatatcctgtttaacttattccctcaagaaaccaaatgatagggcgtgtactctctctataaaaaggaatccaattgtgattttgaaactgaacatacacgcactttggataattggatggtctcggacagctgcgacgtcacgcagatgcagtttgtcagatttgccagttccaatcaacagacttttttcgtttctgcatcccaatcagatagagccacaacgctcgtgacaatgaagtgaagtggcgatggccttcagcttctagaaggaaaccacaaaaatgcactattccataattaatgcaattgtccccagcagtatgtgtcgccttccgaaaggaaaaagtcggagagaaggccgcccaaaaacaggtacccctccgtcccataaaagtagtcattttaccccttgctaaatgtcccgtaaagactgtcgctgcagttccgtgctgccattactacctcttctggtgattctggtccattcatttgaactgagtgcatacacattaattcttttttatttctcaagcacttaaacacactgacaactggagggcacattggtaactttaactgtgagctaatttatctcataactactagaacgtccacctttgtgggacggaggtagtattatcataaagtcgttatataagatgaaatgaaagtatgcatttacgtatgcagacttgtaaaatacgagtagtatttggttgcaaagtctcactgaatttgaagatctcgtggatgacagttctgcagttcacttctgctcaacagttcagaactgagatttattcttcaccaaccaaaaaaagaaaaagaaaaaacatttgagattctttagagcaatcaaacaatatactgttatccatatgccatagcacatgacatgactgcctaaatagatactcatattacaatagtagacattgtagtacttcagaaacgggatcaattattgaaaagagacgtgttcttctagaaggcaagggatgcacacaaaaacaaaagcaatggccctgtttggatccggaggccctccagaatcttgttatttaggagtattaaacgtagattagtgacaaaacccattccgtaacccctaggctattttgcgagacgaatctaacga

SEQ ID NO: 16927 - DNA, 986 bp, Oryza sativa
attcagatcatcgacagctttgtgatgaaactgatccatcagaagagagagcaaatgaagattgcagctgactatgtaagggactcaaaattctatctgtaatgttgttttctacagtttatgatatcatgcctttccaaatagctcatgtttctggagcaacaagtagatgcataaagttgaatttgctagtgaaataacagcagcttcccaaatatttcattttcaacttgcttgaatgcagttctgtggtctgatgtgctccacaaatccaaaatgaactctgaatttagtcactctaagttttcttaatacaaaaaaatataagacagagctaacatactgcattgttttatttctaattcttttttatggcacgcagaaaaccaaagaggacatcctatcaagatttgtactagcaagtgagcaagatcctggaacaatggatgaccgctacttgcgtgacatagtcctcaacttcctgatagctgggaaagacaccacaggaaatacccttacctggttcttctacctgctatgcaagaaccccatagtgcaggataaggttgcccttgaaatcagagagtttgttgaatggagcaaggaagataacactattgaaagcttcaccaaacgactggacgaaggtgcaattagcaaaatgcactacctccaggctacaatttccgagacactccggctatatcctgctgtcccagtggtatgaataactttcacggctattccctgtatagagtggagttgaactaaaataaatctagtcatgatttggctcgatatggatctggtattaagtaggtcacatgccaacaatggatattagtattggaagtgttatctcatattgaagggttcattcctcagcatggaaacctacattaccatgagatatctgaatataacagtaaataatgagaaacaaagtaagagaatcttagttatccttgggaattcttgcccaaaag

SEQ ID NO: 16928 - DNA, 1225 bp, Oryza sativa
tttgctagggccagtctttgtaaggttgtcattggtttgtagcggatgtaggtagaattttgtgtttaaagttctgtaggttcttctctcccgttctgaactctgaattttctcgtggctctagaacgctgcagcccacgagaattaaaaaatgtaaccgtagtctgcaggtattcatcgtcagatcattgtatagtttgacaaccagatttatgtggtagtagaccagtagtgaatggcatatttgtcgaagaggccatttgcctgaatcgtttggtagctagcaactgactgaatgtgaagctaaacattcagttgccaccaaacgattcataccaacatttttttgctcgttcggaaggctgcttgcacaacatctgtttttcaagggaatctgtacatgatgctactctgacaagaggcctgcaagaaacaacagaaatccccaaactctacaggattcagttagctaaatcatgccactttgtatcaatcaatatctgttactcactccgatttcgatttaattttaattgacgttttagataataacacaatatacaaaatatacatttaaccttatttttcgattataatatacacaagaaataaatacatgtttacttttattatagtgttttgaaagaaaaatctatatatgttattctagtttctttaaactaaatatttttaaagttattattgatgacgaccaaagttataaaagtttgatctcaaccttataaaaaaaaaagtcaattattatagaaccagagggagtagtagcttaattgatgtacttagccatagatcacacagccagttgaaacatgaaaacacaatcacaaaacccaagtctgcagatgcatcaatcgtgaagccaaacactttttgggatatcagttacagactcagtttgtacggtgttcttgcaacaaagattcagatagcagcagaacacaacacatccacacagaaaaaagcaatcagaattccaaagattttaaactagatggagtagataggattagttggcgagagggttggcgtggatggtgacgcggttgagcctgatctcggcgagggggcggtcgccgggccccgtctgcgccttctccatgaggtcgagcacctcgaatccatggatgaccttggcgaacacggtgtagtggccgttgaggtgaggctgcttggcgtatgtgatgaagaactggctcccgttggt

SEQ ID NO: 16929 - DNA, 8937 bp, Oryza sativa
cccttatactagagacaaaattggagaaatattgagtttaagaactatttttttagaaaatatattacatgttttacaatacccaattgtagtgttagtacaagtgttgaattctaagttttctaacacaaaaaagaaatgagatcagatctataatcattatactatgtgtgatttgtgaaacccagtccaaagtgtaaatgatggtaactatatatggtgttaagtgaaaatacaagtctaactctagtccaatgtgaaattttggtaaataaaggttgaccaaagtgaaatttactctttaaaaaaattaagtaattatttttttcttagttatttaatttattgttaatatatacatatagttttacatattttataaaatttttaaataacacttaaacatattttttaaaaaaatcaacagcgtcaaatatttagagacggaggtagctaacaaatttgatttgtatctttcaagtttttagcctctttacctctgaaaaagtttttagcctctcattatctctaaaaaaagtagtacttattagtagcttatcagttatagttaaattataaaacttcaattgtaaattgattttaaggtcttctcatattctatttttcagcatttgtttttaaaccattaataacaggatataaaagtttacctataataaattattgataagttatcttttcatataaacataaatataattttatctataaactacttctaactcctttatttatttcttcacggtttgtcagctcctgagttttgcgtttgaatatttgtttctggagataggagacaacggccacacaagaaaaaaactgatcaaatagggcttttgcaatacatttcatctgaattctgtaaccaacatgttctttttttcctatgcatgattgttccattgtttgtgaaactgttctagtgacaaaaatgaaccccaataaataaataattttgatgacaacatatgagtcgcgtccaaaaccctggcacaagcaggaactgatttacaaactcacaaaacaaaaacccaacactagcttatgtcacaatggacctacagagagaatgaacttatgcttgatttaacctatcaacagatgggcaattttctatctgaaacccctacaatggaagcagctgagacctacagatcaataaaagcaactcagcaacaactttcaaaagaactgttgttcttcaacagatcaatacaaacatggtcctgatttgtctttgttccagcaaaggcgtacgattgctcctactggttgttaggagtagttcccatggtaaagaaggattataccatctttttcctctatgccccctggattctctgtggagtacctggcaaagcagttattccattccatgacaagctcgagaggataatcctggtgtttcaatgattcggtttatggctatctgtaatcgtcctgagcctttgcactaagacagggatatcatgttcgctcaatgtcgtgaagcaacacctgaaccatccaggctcgatgcaatggcaagatgaacctggagtgacattgacctttgcctccttcaataacctatcctaaagcttgcgctcccctttttcgctgtaagacctgatgacttgctcatgtctgcccagcagtagaaccctccactgctctagtagcactcaataccccacttgatccaaagcatcaacaaacaatggtacatcttgcgcaatctctctctattaacttttaggtaatctgaaatgaacttttggtccgagagcatggcaacaagcaagcgttgtgttggagttgacacagacgagaacctagcaatcttagcagctgctgtcacgatgctttcattataggaatatattaccccaacccgaaacccggcaagagataggtctttcgagagtccatatattatgtgcaccctgcctttgtcaaagtcttctagatcatcaacaacctctgccacacttacaaattttccagatccatatgttgagccagcaaacacttcatcagatatcaagtggatgttcttctctgcagcaaactctagaagatcatgcagtgtttgcttgggcacaaagcttcctgtagggttatttgggttggatatgagaaccccacgaacctttattcctcgcttctttgcctgattgtaggctatttctagagcagtgatactaatgttgaagttgtcagtgctacggcaaggaacaggtatcaactcaattccagtgcgccattttatgtccctgtcccacctgcagaaatgaagtgacagttagtaccttcacttccaatacgttcatacagatgaacctagagattggagaagagacatacccagggtagtatggtgatggaacaagaaatgcatttcctggatcagcaaggcagaaactcagtatttccattgcaggagttgcaccagatgttataaccacctgagatggttcaaaggacactgatccttgcatgatttgcctcataaatccagcaagagcctgaaagagaaatttaacacttcatatcggaaaatttgcacacagaagaacacaaattaatcatggagaaaatagttcaatgtcaggtaacagatcaaaaccactgtgtggaaaaagggtaaaactgagggatgctagcaaagatatgcagattttggacaatgttgaagcatgaagcacaagacaggggaaaggaaaactataagcaatacaaagtactgatcttgcaatgctcacattgtcatgtgtttacatgttcaataataaattcagtgactgcacaacaatgagttcctgagaatcatatgctgtactagattggtggaacagtccagttctaatgaaacatcacaattgaaaaaaaaaagctttatagattcctctaatcatttgaatggaaaataggtcaaccaaaatttacaagctaatacagaaaataagcaaaaagataaagtaaacccgcatgatgttaaggtccaacagcagacatgacaaatttgccagcttcagtatgataactggtgattatcagcatgccattcaacaatgaactgtgaagcgagaccattctagcaggtatgatataatatgaaattttattcaaattcacgcggatttacagcagcgtaatacagagtaagtcaataatatggaactcttgattattttttttaattctacgaaagagctgatcaagatagtggatcttttcagttgaagtcaaggtttgacagatggcacaattgcagccaccatagcaaaaaatgacatccaagaataaacgcaagcgacacctcttctgcagataacatacatgtggctaccaaaaaaacaagagcagaaggaaacaaaaatgcacagtaccgcgtcaacaataatattccaattcaggcttaatcgctaataaggtcagttgtaattgccataattcttcatccatccaataatgaatcacacactgttaacactgttattgatcgagctatgtcatccaaaaatttgtctatgtgaccacatccatctaaacagaacaaccgcttaaaacaatcaattttaagcaaagctttcttgaaacatgagaaaacaaaagtattctttttgtgtaagaaacaaaaagattgaggtagcatcactggggtaatgggctaagtgcaaaaaaagctttggaagaatcaaaacagggcgagttgttggattcgatgttctcatggatgggatcaggggggattctgcaacatttttgttgccagagacagaacctatctttctgacagaaatggatgtttattttttttcgtcgtatggaatcagggggggggggggggggggaatcgtttggcttaccatcttcaaggcaagtatcccgtcgtacggctggtaggcggcgaggcctctgatggagagctccctctcgtcctcgtcttctccgcccgccatggacgccgcctccgccgcgtgctcctccatccatctcccaaccaaatccagcgacagctgcacgcaccaatcaccagaaaccaaaccgcgtcatcaccatcgtcggcttcgaaattaacgatagagagatagagagagagagagtattgcgaacgtacgtagttctcggcgaggccgagctggatgatgccggaggggttggtgaccgggtggtaggggtcggcggcgcagcggcggaggccggcgtagtagagcgagtcgtcgtcgcggacggaggcgccgcgcgcggagatggccgggagcgcggcgcgcggggcgaggaggccgcgcgagagcgagcggtggatcggcgacaccgccgcggcggaggcggccgtgggggatccgggcggcggcggcggcgaggcgcggttgcgcttgatgtagagctggaagaagtagaagagggcgcaggggatgagggagccgagcacgagccccccgcgtccctgcaccaccccctgcagcggcaccacgatgcgcatcccgccgtccgcccgcggcctcctctcggacgccgcgctcgcgctcctcttcttcttcttcttcgccgcgccgccgttgccgctccgcctcatgggacgccgaccgacgaggagatgacgtcacgtcaccccgccgcccggcgccacgcgcggcgggcgtgcataggcggggggtgtggagggattgggttgggttgggttggcggggaggagagggatttgggagggggttttggggggaggaggaggaggagaggggcacgccggatttggcgtcttgcctcttctttctttcgtacgagtacgacgcgacgccgggggtaaaaaaaattgagattttcgccgtgattccgctggtttcggcggtcgaacgaacgaccggggaatggacgaatggttagtgatggatggtaaccagctgtttgatgttaaaataaaccttgtcaaaatttaataataccaatagtattataaaatttttggtaaaattgacttaataatgttgccaaattctattcacattactaatggtaacaaataaacgtagacacgtaattatcaaccaaataatggtatggccatcaatctgaacatgcctccaattttcacagcttttacaaatgaacctttaaaattgagtcattagtacataattaattaagttattattttgagattagaaatagattaatgtgattttctaaaacaacaattttatataaaaaaacaccgtttaacaatttaaaaagtatgcgcacagagaatgataattttttttgcactcattccgcaaacaaattgcacgttggcttatcgtagctaatattataattttaaagcttttccaagttaattttagggattttcctttgtattgctaatatcatgaaataaaattttaatctaaaaatcattatttatgcctttttcaaccttttgagtttggaagttttttctcgcggcttatttattagtcgtacctgaaaatggcaagaaaattcagcttctctaaattagcttctgcacgagcaaaatttgttttcagcccaaagttcgaagctttgcctatctagtgatctcttcaacgtaacgacgttgttgccacggcatgctataagcgtagcaaaagaatatacacttcactcggagttggtgatcgtcgtggttaggataggattttcgagtggttctcgaggcttgtttgtaatttgcaaattgcaaccctggggttcacgatgtgattgtgtcaagtggagtgacagaaatggattgatttgggcgtgttcttcccaactctcatcttctcttcctcttgctgtttggaagtacttgcaaactcaggctttgttcatttcaccaatcattttttttcttcttcagagaactcatttcgtattttcgttcaggcctgaagataaaaacggacgagagatgcatatggaattcagtgacaacaacaatgtattggacaggtgaaaccgggaagaaaacgcagctggggttgtgaacaaaacactcttgttcgcatctgctgcaagaagcctaggacgaaatctcaacctgctgccaactgttgcagagagggactggttggctgcttctgaattcccaagagccgtattggttttttttgtataacaaaaggagcttccgaagctgctggcctttgcctgttgccttctagtgcaaattttcatcgcctcagttgtgccgcaagagacgagcacttgggcagaaagtatataattatatcccaagattcttttttttaaaaaaaaaggagctttgattgcattggaagcgttaaataatcgtttgctgcatccagcttagaatagtactaagaaagattccatggcagcagtggaagtcagttaaacatgaagcattgctcgcttttctgcagcctcggtgatttctcttttctgtttaataacagtgaaatgcatcctcagttaagcatgtaccaaaccagggataaaggagctgctaaatgctactactagcatcttggacatgttcagttaacctgcaatacactcttgaagatcgagacgacgatcttttcatgttgctggcggcaaacgagtccagttttagctataaacagatacgcatacactgtctttgcagcactgtcggttggctaggctgattataaatcataacaccttattagcgacaaaaaatagtttataaatatattttttatataaacgtcttaaaagttaacgctgaaaaagaaagtaggtttaaaataccctttaaaacaattctaaaagtaagtttcgaaattttggtgtagtgaggataacaaactaatccataccacatattgaaacctagaataaatggttatgcgaatatttgccaactacggatgtatgtatataaataaacttgaataaatgtttatctattaagtgttggtgttattagtttctgcatcattatttcctggggttttatgtgtttttcattaaacgaattgtgtaataagtagttgtagctttttaagcaaatttcgaaattcattatattatcttttaaaaaattctgctccagtgtagcagtgtgtttgtctagaaaggaatgcctttctctgatgaaacgaagttcagacccctgttcgcagagatatctgaattttgaagaggaaagcaagagaaatactctctgttggcaaatagcccagtgcccacacttcgaaacaacccgagcatcgggcaaactctcttgatcttgtgagattcccctgagagaatctgggtcacacaatgggattgcactgttggctgtttcctgtgtccaaccacaaaaattgtcgtagactggtacaagtagaatacatgcagaagcactgtccccgcagcggtgggcgactctggtggcacgcagttgtcggattggccacagtcacagtagaagcacaggcctatcatttccgttgaggcaatcaacggtgagcgttaacgcgatgactaagcccttgtttagttttaaagtttttcttcaaactttcaacttttccatcacatcaaaactttcctatatacataaactttcaatttttccgttacatcgttctaatttgaaccaaacttccaattttgacgtcaactaaacacactaaatcgtgtttctatgattctacctaataaaatgtaaattatttgtactttgttatttggttcgttgaaaaatcgaaagttgtactatactttattacaaagaaatcataatgctaaacataaaagtactcatgtaatagtaacttcaaagttttactatccaagtttcagcaaaatgtgcctattcagataaatgatatcacaattcgtctggttgtagtcatgccactcaaattttaaaaaattggaatcatgtcatccctgtcacgttttccatattcttccccatctgcacgtggaacccacccgtcatattcatcttattcttttcaccctcccttatcttctttctccctatctctccgtcgtggcgaggagcgcggacaggatgggaggagcagcggggtacgtgcagccaacaccactaccgaatagcctctgggccatcccgccagacaccatcgtcgtgtgggatgcgtatcgatgcaagaactactcatgcttggtgcacggtgactaggtgagttcaacctgtgcggcctggagaattgtcggtggatacacgattacaacgaggtcgaacgacacagtgcgcatcaagctggacattggcgacatgtccatcacgttcgcgcaccgcacgcgtgagccctgtggcgaccatggccatgaactccagtcaagggccttagtgcgaacgcaccaagggcatcgctgctctttccgtcctacccgcgctcctcgctcctcgttgcgacatagagatgaggaaggaagaagttgaatcaaatgactatgtcccatgtgtagacaaggaagaagataaaaaaaatgtgacgaccatggtatggatctaattttgtaaattttaagtagcacggatacgaaatgtaatggcatttatctgaatagatatatttgcaatatcacggatcaaattaaccctttatattattccttccggaaaaaaaatactacttgttaccaaggaattagtgaaagcaaccccattttgaaacagtgaacgcgatcggtcggcacgcatgaggactggaccaaaaccagaccgtgcagatcccactgtagcacagtgcatcacacatcccatccgtgctacagaaacctgccgggtccgtccggtccccagcaacaggtgcaaccatgtagtactaccaaatcaccgatgcaggtgcagcacctgtctcctccccgtaggctctcccaacctggatttttcacattttggtcattttaaaaaacttatttcgcaaatagacccctaaaaaaacttatcccaaaaatggtcctttttggggc

SEQ ID NO: 16930 - DNA, 8485 bp, Oryza sativa
ccccccccccccacccctcacctccattcttgtttctctgtatggagttgcaacggtgtcatttttgttttattttttcggatgtattttcacacttaagatcacgatacaaccaaccacaaaaaaaattaaacttgaactaccacttagctaagtctgaaaatagctagcataccacttaattagtctactttgcaccttcactaaaattagaccataactcttttagtaaaactctttgatcaacatgttaaacataggagagatcctttagtaaattagactatataaaattacttaatctaattcaaaatataaccacatgaaataatagccataagttaaccagtatagagagatgcaatttttttatttttatttcatttttttgatatttttttcatacttaggagaacataggaaccaaccatataaaaaataaactcaaacagacaaattatgtgactcgtagaattttccaaaactctaccgaaatggacaaaatatgtgacttgtagaattttccaaaactctaccgaaacggacaaaatatgccatttattgaaataggcgtaactttctcatacggactcggaatcaagcaaataatatatccacggacatttacagaaaaagttacacccgattctcttcagctttgccggattcggcgatattaaaacctccaaattccacttgcaagattatgttttcgaggagagaagtatttcgatagagctttgaaaaatttcacaggccacatatttcgtccgtttgattttattttttatatggttggttcttgtgagttcctaagtgtgaaaaaaatatcaaaaaaataaaataaaaataaaaaagttgcacatctctcttctctgcactagttcagagagaggagagaagagaaaaaattatacaggtcacatattacgtccatttgagtttttttttatggttggttcctatgtgtccctaagcgtgaaaaaaatatcaaaaaaataaaagaaaaataaaagaaaaataaaaaattttgggggggagggggcaccagccactctggcgcgctccccctagtcacctcagcatcgccccgacacgttggcagggggacggcgccagccactctggcgccccaaaaggaccatttctgaaataagtttttttagggatctatttgtaaaataagttttttaaaaggactaaaatgtgaaaaatccagctctcccaaccgtaacgtttacctcttcttcatcaacgccaagaggcatggtccaaagcctctctgcacaggaacagcagcagcagcagcgcgccgctgtccccggaaagagagggacggcgagagattggcgagtagcaagtggcggagccctcgcccggctagacccagcagccgcttgttttttttttaaaactaaaccggcaaaagaacagccaattatatttttaataagtaggagtaaaaaccctaaatgggttacaagaaaaaaaaaacaccggctggttgaacagctacacagcacacgccacaattcattagcaactgaaaccactaatggaacccaacgtagagttgtcgttaccaagcttgataaaaacaacatgtagggtttggactttgcaaccgtgttatcgttgtcgagcttgccgccaaagcgacacaacagctccgactttaccagcaaccgcttgttatattgataagttaattgatggtaaaatttctatagcaaatactagttatattaaaatttgttcggactcaaaattctttctgactccatcactgcgagtagcgtggcggatccaccccgcgcgtgactgcctctgtgtttgtatgtcagtatgtgttatccttagcctttggttggttcagcgagacgggcacgctggcctcctcctccggtttgcttgcaaacttctatcgtgacacaacacacaggaacggctgctacttgactttgctttgcagcgatttttttgactcgttttttagtactgtagtactccagaaaatttgtcatggctgttgctcacggatgagatgactcttcttatgaagttatgattgattttttttcttcttcacacatattgaactgatcttaggtatggtttagttcctaactttttcttcaaactttcaactttttcatcacatcagaactttcctactcacataaacttttaacttttctgtcacatcgtttcaatttcaatcaaacttctaattttatcgtgaactaaacacacccttaaataaaagggagactgaagatatctgggggcaaggaaagctggttaaagggcgagaggtttggataggaaattcttcttgctgtcagtcagtacggcagcatacatacgtcttctttttctctttctttacaaaaaggagacgaggaaaacacttcagtacacaagcatattgcgtgcctacgcttctcctactttacccctcttttcctcgtgttctcagcaaaagtctaaataacacgagtttcttcctttcggcgcacccgtcttcttcctgttttttttttaaaaaaaaaaagaaaagaaaaagaagaagaggaggaaaatctgccggaccacacgtgggctttaaacaaacaaaagcgttgtgcaaatctagcccagcaatatccttctggcccattacttctgaaccaaaacacagaggccaatctctgggcctctgaatctccgaccagcccaactccaccacaacagcaacgccgccgagtcgccgacgacgccttttggtgctcgcggcggccgatgtaacgagcggttttagagaaagaaaccatgggcaagaacacacgacttcgccccgcgccatccaccatcttcttcttcgccgacgtctcggccggggccttcccttcgtcgctctctctatctctctctgctgctgcacagaaacagctcgtcgtctgcatgcgtgtctggctctctgtgtcgcgttaactgcgtgcatcgatatctgtcacctgataactcaatgcacctggcaatggccacgcggcgccaactgctattactccgtccagcctaaaataacaacttgtattctctaaagtttattttaaaatataacaacttctacactaacattcttttctcaaacaatcaggtaatcacaaccctctaccattcaattttttcacatacatctacttctcatccaaacacaattctttcctatttaattctaattactttcttaataactgtgtccaactttaaaaatacttatattatgggataaatgaaattattccatatttaattttaactactttcttaataaccgtgttcaacttaaaagttaattatattttgagacgaatggagcagagtaacttgtactacctctgtttttcaatagatgacaccgttgactttttctcacatgttcgtcttattcaaaaaatttacgtaattataatttattttgttatgagttgttttatcactcatagtaatttaagtgtgatttatatcttatacatttgcataaaatttttgaataagataaatagtcaaatatgttaaaaaaagtcaacggtatcatctgttatcaatgaatctgaacgtgagaaatttgttctttataggacagatgtttcacaaggctggtccgctggtgtgctcatgatgatcatgcatgcgcagcaacagcacaggtagcgggcacgtctcatgaatgccgcgaggagtacagccactgttgctacgtgtactcttctcctctacttttgttttatactccaacaacgcagcactggagtaaatgcgagggcacgtctcaggaggatgcatgctgctgcgtgtacactttgcgcgtgctactgcgacaactacggttgccggccggccggccggccacccgcggccgctacaggacgcaggtgagggtggtcctcatagctagattggccatacatggcatcacactcaattcaacacgggacaacactaattgtttttcagctagcggaaatttaggccctcttcgattcactgaaaaattataagaatttcgtttctataggaattttcttatatggattttaaaatcagaagaatgaatattatggaatcctacagaatatctcattccatacaagttttaaagtaaatttaacatgaggtataatctctagaaagctttccgtcgagtctttatgtctactcaaatttatatgtttttcatgtggttaaatcagacaaacattcttatgtttttttatgtgttctacaatcatttattttacacttgaattactgttagaatcctgtgtttttttatatgcttttccattattgcgattcaaaatatgtcattaaactataaaactcgtttagaattgatgctgatgttcttttttgttataatttatttttcagcattgtttttgtaagttgtgagtcgtgaccatagcagctacactacatggcatcacactcaactgaaacaggacaaaactaaagcagacgacactccaaataccaccgccgttcctgcatccattttgaacggacaaatttcaggctgcatctgcaattccgcacccatccactactccctggaaaaaagaaaagaaaaccttttctgctctgaaactcgtgtgaagcttctgtcttccaagcaaagtgtgaagcatagcgattcgaatttttttgaacccaaattcggttcaaaaattaaatataaatcacagcaatcaaggaacagcacggatctcgatgcgcacactggacgccgagtgagatacgctacgccctgcggatggacggacgcctgtactgtatgtagtagtagaatggaacccgacaagagctgctctctcacaacatcggatacccacgcgcggtttccgaggcacacgccaaagtacggttttgccccccgcgaataactgcacgggcctctggttttttccttacggagcgaagggtagaatcgggaacagaaaaatatttgttgcgctccggggcgaaacgaggcgacgactcgccgattacgtgcgcgtgggacccacccaaaaggctcacagcgctctcgcaacatttgcagatgacaccctgaaaaattctcctaatcccctccatgttcaaccttacgcttttttagtacggggaggtgaatgtgatgaagtgcagggggtgatttgtaaatgctgccggggtcaaatccggcactggcccgatttcttccggtcccgaccccgcatttcaaatttcctcctccgcctcctcctcctcgtctccggccaccgttaaatacctcgccgccgaccaccaccaccgcggcggccctgaccccaccctgcgagccctagccatggacggcgacgacgaggatatgcgcgacgtctcgtccacgtcgtcctcctcctgcggcggaggggagggcgcggggttcgaggaggggatgggggagggggtgatggtgatggaggtgaggtggttcgaggtggacctggagtacgagttcgacgcgcccaggtggttcgacctcgccgtggaggagtcgccggtggaggcggcggcggcgcagctgtggttcgcctccgcgcccagctacccgccctctcgtgcgtgcccatccatccctacacctcttaatttattgtgatgtttttctgcatggcggggatgattcgggaaggggggttgggtccttggggatgggatttagttcgatcgatcgattcgcggttgaaatcgtcgatttagtatgtgcgccattggtgggatttctattatgcagtgtgttctcccttgcattattgatccgagaaaggaggtttgggagtccctaatttcgaagtgcttctaggggcagcatgcacatgaattttctgaaatactcccaacattttcagaccagcatgattcaatagagtgtgaaatggttgagtgtcatcaattcgggtcagcattgatcacttagatggatgagggatgcatttaacagagattttcctgtttctaattgtgtaatttggcctcgatgttaaagtttgattgtcaaccgcaatgagtccattttcctgataataaatgaagaagaaaaagctatgctgttctcaaggaaaactgatgttcttgagatgttaatggtagagaaggcacccacaggtatccaggcccatagcaaaaaggaatgtatgatgtagcaaggcaatggccattggccttttaggtttctttcatgagcatccacaactaagagacatcttggaacatgtgactgcaacaaacagactttggttagttgcaactaatttggtgtattcaccctaaaactttgacaactaatgctagatataaattgtaagctggtagagttatgtttgttagtatatactttcctggtatttctggtcttctggaattgattaaatttacatgtgttacaaacccaaaatgatatgggaggtgaaagtgaaatatcatccttggttgtatgcatcaatttttggacaaaactacgatggatagttcattgttttactactcaagccttttctattatcattaatatgtaagtacaaatatttttttggttatttctgtagttttaatgtttagctcatgacaaagatagaactatcatattacatgacagggaaacttatggttacaacactagcaaggtagcataaaaaacagtaacaagaagtgaataaaatatgtactactactataatgacacttgtttgattatttgacctgtatgaattatggaaacgttagatgttatttttacagtttaactcgctattgaactgtcattacattcatttttcctttttaattggttattgccctttgttgtcaacttaatatgactgaaattttctctgttgtttctgcagccttaattgccaagatgttggctgaagatcttgggttgcaaagtttaagaagcactgtggatatagatgcagcacattgctctaaatcctctcatgaatgttccaatggtgctgaacaaacgatccatcggccacatataccaaatgaaggtccctataagcccaaagttttctccattatgttttttcctattgcatttcttaccatatttgagcatttcatttagcctgttatgctttgatcttttacccagcttcttttatgtaaaataggaaggataccttgccatcaagtttcagcgaacgagcgaaaacatggcgttcgaactattggaaaaggaactatcccaaagaggtctacactgatgaagcctacagccagtcaattagccaggcaaaacagacaaattgaagtgaagaactccacacagtatgtaaatgttatgccttatgctaattcatattctttagctgtcctagggttggtacatacaaaatttggagtattattctctgttggatgattttataacaattttctgattttgaagagatgcatttaccctgccatacttgcagttccatgaacatgtgtttcttgttggtttactcacctgccattcttgatgaattaaccatccactagcattgatcttaaccgtttatgtcagtatatgcttgtgtagccatcacgtttttctctttcacttcattatttccggactttcaccacctttccttttgttttagatttgcactgcaaggatttttcaatacatttaaagcaaatgctgtcttcatgtttctgaacttatgtaccaatttgctttactatcaggagtaaaaagtacggcttagagggagttgaaggcacagtgtaataagcaaggatagcacagtgagaactgcgcaagtgatctgcagcctacgcaagctgctaaaaggcagagactagaaagagggcatctcaacaaggtattttgctgttttttattttctggggggtatgaccaccccaaattatctggtgaagttgtttcttaactgtaaaacacagtgaagtttgtcggtacagttttaacttgaaataccacataattttggtagggcatttacctttagttttgagattgcatactagaaactagattatatttgtctggattaatcgagaatacttaattgactacagtcatggttctcatggcaactgacaatggcagctaattttttctgttagcatcgccaaagtaatagccacaaaaccatttatactgttttttcactacagagtgatcagtgcctatttgatattgatttgttgcataactagtcactgaagcttctttacttattgcacaggttgtttcaactaatcaacctgagttgatccataagaatcatgcaaaggtcaagacacctcaaacatttacttctctctcatttcctaggaatatttcagctgttccatttcaattctatagaaaaaattagaaaattatttggactttttatactatagtttttcttaaagtgcttgacatactcctgcaactagccaatcatagctgttatactatgcattaacaatt

SEQ ID NO: 16931 - DNA, 3647 bp, Oryza sativa
actcagagcagtgtaaagtcattttctctcgctctcctgtttgcctgaatgtcaagtacttctaggcagctcatgtccttttcttgaaatttcaggccaactaattcaaagcagctaaacaaacaggcggcacaatccatttctatgacacaagcgtcatcgattagaaaggtggattacattactgttgggtttttgcagcttgttctggttgtcttcactaactattaaaaaataaagtaggttactcacacttacatacatgagcgagccctgccagacaatatgtatgactcattctatggttttcaatttttggaggatggcaatactcagtttgtttgatagagttccctaatctcaaagaattttagaagacggtggcacctgtgaggccacagaaatattcatagcagagatgtacatgtcaagatctcaagagaatgttgcttttttaatgtataatagcacagcgtcttggtggctgatagtgtaactgtaactgtgacagttcagaaatggtttcatttatgttttgtccaaagaaacaaataatttgtagaaatatttagaaaaaaaacattcagttcaatcagtgaaagtcatacacatagtttttaaatcatcttttccaatttattatgtgcccttgtacactattctggatctaattgcatggttgaagctgttctgtttactgctattttctgccctcaaagttgaatcattgtcctgtactaggacaggcacctctacatttagatggttaacttttaatttgcactatataatctttattctctgtgaataggttgaaacgacttatcatatacacactatccatgcctactaaaaacttggttctctggcaggttgtgcaaccttctgggcgcaatgatcatcagcatgcaagtgttccacatcgcggtattgggtcaaatgtgccagtgtgtactgctaatcgtccaaggcatcttgacaagtaaggcttgttttttatatacctcctcacttctagtcccattactatttacataatatccatcctattcggcagtacaaaggaaagtaaaatatacctcctactattctcttgtaagtatttcctgtaattttctagttttggtcaggacaggtttcttcatggaaccaaataatgcaatagtaaagactgttatgcttttgattctacccagtacctatgattttcccaaggcagtgaaacttcagaatgatgtgatcttctgtaaatagagctgaacttgtggctattttctgtgctctgttaacagcatttgcaaaacgccggatgagtgcagagatgacctgtttaaatttaaagctcgaccagtggataaaaaggttggtgctgtggatggatcttctatgcttgctttgaatcttttagttcatactgctctggacctgtttatctttgaagtttgaaccctagtttccaatggcctggatagcgcctagttgtattgattgatatacctgttgcaatttcatgttctgggtgtcagtggccctacttttataatacagataggaattaattgctgaatatgcagttgcttaagaaacaaccctacagacagaatataggaaagttctagtttcacatatttgattaactgcaaatgcagccattgaatcttacattttctttgccttggaacagatactaggaagcaaaggagatattggtgtatttcaaaatgccaaaaggagcacaacagttcctaaggttctctctttctctgtgtgtgtgtgtgttgtgggttgttataaattcctcactcatatttcttgcttgaaaatcctaggaatttaagttgtcaactggtaggaagggtaagcaggctccattatctgaactcttcaacaaggtacgtactgatagaacagaaactgattgcccttactccttagattatttgctctgatgtttactcgtattatttttgaagctcactttaactactgaagcacgccgtgctttagatcaccggactgctgatcttccaaattatattaccaccaaggttctttccttgtttcaatttagcttgtttttactcccttgcgcctttaaacaaagtaactaaaatatcactcctaatctaatgcaaggactgcaaagagaacatgattggtaacatgcaaagctagctatggtaggtaagtaatatttcactgccatacggggcatttatcatgtcgcttctcaagttagaaacaagtgcatcacacccttccacattttaccatttttcagatccagtcagtcaagacatacaaaacataggaattcttctctttgacaattcctggttcagattccttttctccacctgaacaaaggtaaacgttaactcctaatatttcaggtttcatgattcgcaatttcgcacagtgcatcatgtcatttcacaccctggcaactttccattatttttcagcaatacatttgggtattttcatgacactgatacttggggtgaactactgcattgacattgctctctactaccatgtaggctaagcgtctgttttggacagtaggatctcgacttcatttgagttttgacaaagatggagcgatacattattttgacttgaaggcaccgaccaaggcaccgtcccggccatccccggcaacctcccgtctccgctgccgtgcagctgaacataattccgtacctgctcgcggccatggcggagatcgatttgtacagagaaactaaccatgacgccggtgtgtactccagatctgtaacttgttgccaatcatcatccagcaaagttgcttgcttgcttctctctccttgcatcgttcaaattactgggaaaacaatgttagccaggaaccatggagatatagtcacagagatactaactccatgggacccgtagctctgaattctgatgctggtcgggcaaagacgggcatacaggcttgtccaaccagaaaaatactgtggcatggtcagggtgagcacctgatggctgatgacctgacctgacctacatagagtagatgccatggcagtggtgtcacggtgtacgtgtgagccaaactgtacatgtcaaacaagtgtagccatcatactggagtagcatgggatcagaacggctcaggcatctcatctcaacaaaagttagctgctgctgctgctgttgctgtggctgcgtgttggcacgtcgcgtcgaccggggccaggccggctaaagcatggaagggacatttgctcgcagatctgccattgactagcagacgatgatgcacggaatggtcaggacgccctggccgtggaggacactaggacggcttgcgttttgacgccccaataggagttcacagtccagtccagtttctgctagaacctgtgacagattcaacatcatttgacgaaaaccaatcaaaaaccacggaatttcgaggttccaacgcaggacgaaagtagattccgggtgaaatgtcgaatggtttttgagaattcaaatttgaaatggttaaattcaaatgaaatttattcaaaatttgcagaaaaatgcaatctcgttgggggctgggatccagcactcaatccaaaaggtgaaccctagtcctagccgagaagattgctactgctaggaagggt

SEQ ID NO: 16932 - DNA, 3270 bp, Oryza sativa
ggatacaggcagcagttatgaatatcattcaacagtaagagcagccagccagctacactccatgtctgatgaacagacacagcaacgagccaacgaagcaggacataaatactaggcatggagattcagagtttcagaggcagcagcagcagcagcagcagcagcaaacagacgtacactaacagcacagcaagagtgaggcagagcaactaataaataccgtcaaaaaaagggcatttacattagcacaatcctgtcgatgcaggaatgcatggtttcaattcaatgcggcgtcgtcacacaccccaggatccaagaactgatggcctccctctgcctctctgatcaaaatatattacatcataaagacggcgacttcatggcgctcacgagacatctctgaacctgacactgatctactcactctctcttgaataccatgaacaacactagtatgtcactgcaaattcctagggacaatctttgggcaatcctagatcaacaccaagaagaagaaagagtcaagaacaatggcattaacatcatcatcatggtcatctaacttcagatcctacatctagctactatttcctgcactgtgctactatccttttagcatcttggggaggagaaaattttggaggtttggagaagatcacattgtgtgcttggatatgacctcgccgaacctgacgaaccactgctcgtcggaggagctgttgtcgccgatgtcggtcacgtcgtgccctcgcatgtcggccgccgtcgtcgtcgacgccagcaaccgggagtagtccaccgtcttgggcgttgtcatggcggaggccggcagcagggagagcagcacccttgcaacctcgtgcatggtcggccggtctgaagggtgcctcttggtgcacagaagggcgagctggaaggccttcctgaccagtcccatgtccgtgcacgtcactgacacctccgagtccactgcctccatgactgtgttgtcatcagctttggagagtatctgaacattgacacaagatcttgtcatacaaatcatccattggatcatgctagaaaagttctagaattggtgataattttgcacaatgtgatgagaggatggagtggaactgtggaagtggggtggcttaccaattgatgcaagttcgattcgttgtcgacggccttcttccctgtgagcaattccagaaggacgatgccgaagctgtacacatcagatttctcattgagcctggaagtcctggcatactccggatcaatgtagccgatggttcctagcacataagtggaggcatgggacttggcagaggggacacatttggctatgccgaaatctgagaggtgcgcttcgaagttctcgtcgagcaggatgttggaggacttgacatctctgtggattatgcgagggttgcagtcatggtggagataggccagcccttgtgcagctccgaccgcgatcctcagtcttgtgtcccagttgagcttcactttctttgatggacctgaaaaggatcatatatagatcataagggagatgcataatgataacaaattatccatgagccaaaggtttcaagccctaaccgtggagaagatcccacaaggaaccattttccatgtaatcatagaagagcaagtttccatgtggagatagcgagaagccatggaggctaacaagattcctgtgccgtatgctgccaattgtctctagttctgtttcaaactctcggaggctatggttatactgactgtaaagccgcttgacagcaatggccttgccgctcttgagttcacatttgtagacagtgcttgaggcgccatagccaatgatgtatttctcgctcaaattctctgtcagcctcatgatgtcctcgtaagtatggatagccatgtccatctggagaacaactagctttggaggtcctgaatatgattaagaaaaggttaagatgaattccattatgccagcatacttgctgttaatttcatcgacgacaactggaggggtgagatatagcgcacacataccttgcactggcttatcggatcctttgacaagtggctgtggttgatttgttttatatatagccaacagcagaacgcagagcaatatgataaagcctaagataatgcaagcaattgctgtctttgaaatattaactgcaatagaaattaagtgaacatgtgtttagcagaaaagcaaatggagtgaaaagctacaaggggttagcttcttgtctgatacctctttgtccatgagagtgtccacagctggaatcttggcagtaaacatgcagtaatggattacccaagaagctgcatttatgatttatgtactggttgcaatcagaaattagaagatgctaatagaaggataacagagattgtgcatggtgccatcttatacctttccattgggaatttcgagaagttctttgccatcgggacatgtccagataaattgttgtatgacaaattcctgaaatgcacttaaggataaataatcctgcccaagttatcaccagtatacaatgctacagagcagagcttgcacacaaaacttacaggttatttaagctgaagcagttggccaattgagcagggatctccccaaccaaattgttgttgttaagaatcctgcatgataacaccatagctcagtaaaatatttaggtgattttcgatctcacacgcataatatgaatttatgatgatatacaactcacaggctatcaaggttttgaagttgtccaagttcctcgggcagactaccagataagttgttgttggacatatcactgagaatttaaattttggttcagctgaatcatgatgataggatggcttcaaacagataatagttagttacatgtgtttcaagggaacacacttacattacttggacgcttctcaagtttccaaactcagcaggaactggcccatcaagatggttcttactcaaattcctgcagtcaaagcataaccatttaggcatcaagtaataatggccatatgaaataagttatggttttttcattaaaaacagtatggtttctaggaggttggtccgcaacatacagttcaagaaggtgctctagatcaccaatggtagcaggaactggtccagagaattcattgtaggaaagatccctgttcaaaaaataataataaaggaacatcatttagcgcccagcaggtcttgtaacaccaggtaaataattatagctaaagtttctacttacaatgtgtccaagttgatga

SEQ ID NO: 16933 - DNA, 751 bp, Oryza sativa
gaatcctaagccaggattgcattgatgatcccagcctgatctgcttccttccttccttgtcacatggccatgaagaacaagtctttggcgacactgtggatggacatcactcctcctaactaactcggccgcccaacttaaaaatcactgctccctcctctgcctccatcgccatcaccgacaccagccgacccgacaaccaaatctacttatcaaacccgtcacgagtagctcgcagctgccactgcagcctaaattctccaatttcttatctatacagggatcagaagcattctcaggacggttgtatcatcttgatgtaattggtcgagttcagtaaactctcgccgcgtgtcatcggatatcggcggtttgcaatcactcactgacaggtgggcccctcgccagcatgtgaacttcgtcccagctcacatgtcatctgcaatcgatcgaataccggtggtgagatgaggatttgtttcttggttcttggtaataagaaacagtgaagttcgtatgctcatgatcaggatgtacaggggaggtggaccaaccataggtggtgtggtgctgctgctgcgagatccagctctgtgcgacggcacatgcattgcgtccatccgcgccttttcttttcttttcttttctccgtgatgctgcgaaaaatcgcaaatgggggcgctaaatgggccatgcggatgagttaacgtccacctgctgctgctgccatggcgatcgcgacgctggcttc

SEQ ID NO: 16934 - DNA, 1396 bp, Oryza sativa
gattggtagagctatttgcctcagtttgaaataggttattgtacatattgttgctgcagattatctacttgattatattttgattatatggatggacaaaatattttgataaataaacttaacaaatgacctaaaataagtgatctaagaaatacaatatataatataagaaagtttttttttgagaaaatgcatttttaaagcgtggagcgcaaataattcgtttcaacaatccaataaataattcaaaaagaactaaagccaaaggttttaatagacctgggcatcaactgatggttcgctcgtgtgttcagtttcagttgtgatggcatctcaagaatttgatcttttcaggctttcagataggcctgcaagagggcagaaagagttcggtttaagtgacgataactgaaataccagtatatggcatggaattcgaaagtatctgcacacggtacaaagaaagtaacggaacagtggtatatgtaaatttttagcagtgtttgtttacatgactgttttggtacgggttgaagctatgggcgtttatttacaccgtgagttcatctttagcttcccctctcaaatggctcatgaaatatagggttttcttgtacatgtacatgttacagatggcaagggatatcaatgcctgaatgggcgcgcgaccacttgcaaaccaatagttatgttgaggagatggtaatactggccaaattaaaactgctgatgcatagggcgcaccattgtctagtgtcaacttgaaccaaattcttcgttccatttctctagctcgtcccacttgctcttctgcaggcttggcctaatcacagtcatggctttcttgaaatcttcgtatttcaggggccgcaactacaatgaagtaagaaaaggagggatatgattaggacacttcagaaagctcacactgtatgaagatgtaactcgaaatacctgatttgcttttatagtgagaatattttgtggaccaagctctctgattggcatcatggcagcttcctcacacaatgctctcagatcactcccggaatatcctataacatatttatttcagcaccaagtaacacatatgtcgtcttatcagaatggcaatataccagaaaaataaaactaccttcagtatctgcagcaagcctttcaagatcatgacctgaaaggggacagttccagatttagagtggtactacatatacaaaagccgaaagacatgcagacatacagaataatctgggaaattccccagttctttcgaactagtctttccacaatgcagtgatcactaagtgagaagtccatgtttcaggtaaggaacaaaaggctgatttccaaagaagcttttagtatgaaaatccagagttggtgacttttgaagggg

SEQ ID NO: 16935 - DNA, 1804 bp, Oryza sativa
tacaaccatgagtctctgaccgcctgctactgctgtctgtatcttaccaaatactcctaccaactccaatctctctcaagcattaacctacagaatttgcagttcttcacggtatcgcatttccagctaatatttttaacgatgcaagttgtatccaacctattaaatgaaaaccgttatctaaaactaatgaaaatccatgttaataaatcttatattcgcatgttttactccaagaggacatccaaaagtattacacatttgcatgtattattcaaccatcgcttaattctaagctaatagtacatatagtttattcaagctcacaatgatatttagctaatcattttgggatgcttaggtccaacaaccgtttataattcttcaactacacgtgcagttgcaagaatactattatcctatggttcagtccaactaaaaatgcagccggcgaagtttcattagtccaaccatttgtcttttggtgtcagttagcatgggcaaagtttcagagtaggaagttgaacaatctacagccgaacctaagtccaacacagacaaagacaatctcgccgcttccgatgtcgcatacgagcgtctcaatgtctgaatttttagatgttagtaaaagtctcgagtacaatgcgtctcagcaaccgctgattagctggttagcatgcatgtatcctggttcagagttcagatatacatgcagagaacagaactgttcaccaaccctttctccaaatccttcaaacaacttgatctttcaagtcacaggatgagtcacctgcaggtattcagtttgaactttgaactgtacgttttcttcagcaatcggataagggtaatctgaggcttttgatgcgaagaaagaatttgctttaacaaagcaattgttcagacaaatccatactcgatctcgaggccacatgtcatttgtagtcaaatgtacatcaagattccacattagcaccagtgcaatttgacaggaacatactaattttgattacttgatatacaaattaataacatatagatcagtgcgtctgggcatgattactcccaagttggtgttcagaaaaaactgctgcaactgccgctatcaaagtacttctacttaccaaacatgtcgcaacagtgcatttcaaaaaattgcagtttgaccagtctagcacgtgtgatatcgctctctggatgcatatgcatcttgaccatttcatctttgtgtactgacgagacctgaacaactgaacatgcagcagaggaagctgctccgttcttgtggcaagttcaccttttctttacctaataattaagtttagcataagccttgtgtaacatgagttgaatcctgaatggtgttgggatttcttctgaccatgttgacaacaacgattaacgctgcaagatgacaagcttgagaagttcctttcgtggacttggcctaacgtagttgaaagagttcagatatctgaagaaacaacatgaaagtttaacttttggaagaaaaaagcacaactttactcacctaaccatgcaaagtatgaattccaatatgagacgagtcatgcttctgattaaagagtatggagcagaatacggattacgtaattctgttgagttcgtgttagttagcgcttcatgaacctcttgttttttctttaacacatcaaactcctttttatggactactttctgctagaatatatgcacataaatgagtttttcgcctcaaagaaaaggattaattccttgaatcctcgtatgccatttgagcattcgttcacatcatgcttctgaa

SEQ ID NO: 16936 - DNA, 8450 bp, Oryza sativa
aaaattcatgtgtttttttaagtagtactactaccaaacaacatttttacaaattactctggatccacttcccgtaggattcagtaagccttgacaactattcatgtattttctaaatcatgtctcaaagcaacctaataagccagcattcttctcctcaaaactttgggtgtgtttagttcacgtcaaaattagaagtttgattaaaatggaacgatgtgacggaaaagttgaaagtttgtgtgtagaaaagttttgatgagataaaaaagttgaaagtttgaataaaaattttggaactaaaactcggcctttgtggattagatgatcacatctcaaatgctagtcacatcaaacaatggaatgtccagaaggttaaaatactggtacatatctaaagaaacatttgcttcactatggaccaacatgcgttcagacttcagagacaccgaacctgaagaataatgctgtcgcgctcgtaaatccagcacttggctgccgtcggccgaagccgctcaacctactccggtccacgtatccgaaactccgaatccaccgataaaaaattcaatattttcttttatatatactacgattttgagaagctgtgatctcatatatgaaatgaaaccttcaggttcagtgctcatatgaaaccttccagggttcatcacacctactacgaggaaccggatgactgacacgcaagaacacaaggtctgaaccggttggtttttctctcataggataacagcaacatgacactatgacagcagcatcaagtagtagtagaggctgcgttgaacggattgagtcacttgcacacgaatatctcggaggattattcagcgattccaatggcaacggcgacatctttgcccctgggctgaatcaagccaaaaacattggccgaaatcgcatcttttttatttaagtagtgctagtccaggttcaccttttcgattgagtgctggatcggcggtacgacatttttctaccaaatttcgacaaatttcaatcaaattttggtcaaattttactgtttcatatctgaataaaccatttaagttttcatccggaatctgcctttgacgtcgtaacctcgaaattcttcgggttttaggggctgtttggtttccagggacttattccaagtccctgtcacatcggatgtttggacactaatttagagtattaaacatactctaattacaaaacccattccataagcttggactaattcgcgagacgaatcttttgagtctaattacgccatgattttgacaatgtgatgctacagtaaacttttgataattatggattaattaggcttaaaaaatccgtctcgcggattagctctcatttatgaaattagtttttttattagtccatatttaatactctaaattagcgtccaaacatctgatgtgacatgggctaaaaagtattagccccatctaaacacccccttagtactagtagactagagtagaggctaacgagaatccaagaggtggccgtttctttcccgccttttcttcttctaacaccggctactactcactccgtcccaaaaataacctaaccctggatttgaacctgacatatctgtgtccaagtttaaacctaacatgtgtctaggtttaaatctaggattgggttttttttggatggagagagtacggagggtccagatttaaatctaggattgggtttttttttttggagggagagagtacggagggagtacgtcgcaggcagatgcagtggcagaatagttttctactactatctttttgaaaaagctaatgggacaaatgtaagcactgctcgaggtttccttcacagccgattattgatttcaaagaaaacgaagtgaagaagaatcacagcaacagagacaccaaaggaatggcaaaatcttttctggactttgcatgtattattgtcgtccttgccatgttgaattctaagagagaaaaaatacaatggacaagagggggatggagatcgaggagattgagacgcccctaccaatcccacacatcccaatctcatcatctcatctcgttgcatccatccactgctcaaagattgaaatctttggagagagagagagaaattattaaaacgaaacaaaaacaaaattctcatctcattgcatccaaaatgaacaatggtaaaaaattgtcatgaaatgaaatgaatgaagcaactaataatcgaacgaaacttatttgttcctcatcttattctctgatgaaatttcaaaaggagagcgaaacagtggacactgacgcttgcgaaataaaaaggtggcgccagaaactccggcgagactacggcgacgagacgcccgacgacaacgaccatgacacgatacaaccacacactgggtggagattaccgtcggcgacggcgacgaacacgacggcgacgacgactgctcagtgcgacaggtacaatggaggaggagaaggaggtgcaagaactcctcgcgtgaacaccaagaagccggcgatggctgcctcggtcacacggtgagcccccgcatgaactcccactcgtcgtcatcctcctccgccgcgccggcggccgacccctccgagtcgctgctcatgccgctgctctccccgctggccatcgccgcggcctccgggtcgaacgacaggtacggcattgcgccgaacgccctggcgagcgcggcggcggtggcgccgtcggtcctctgcttgagcacctcgaacatcacctcgggctcgtgctgcatcgagcggagcacgtcggcgcacgacggccccgccgccgcgcgcgtgacggcgaagcagtgcggcccgtcgctctgcgacacgcgcaccacgctcggcccgccgaacaggttgtggaggccgccgagggcctcctggtaggcgccgccgaggaacatgccgaggtagtagccgcgggtgccgtggacggggagctcgtgcagcggcaggctgtgcctcccgccgatgaagtggtcgaccttgccgtcgctgtcgcaggtgaggtcggagaggacgccgtcgaccgcagggcgctcaccgaggcgctggattgggatgatcgggaacatctgcccgatcgcccacatgtccggcagggaggtgaacacggacaggttgatgtggtacgtgcgcggcggctcggcggcgcccatgccgcgggcgacgatctcgcagaggctgtccaccgcggcgaggtgctccaggccaagaacgccgtccttgaactgatcggcgcagcgccgcttcagctggtcggcgtacagagcgcaggtgtcgaagtcgccgcgcaccgcggcggccatgaggttgcggtagtcggcgtggcagtcgtcggtgagctcgtcgagcaggtagcccgtggccgggtcaatgcggccgggcgccgaagccgagaaggcctcgaacaccaggacagagtggtgcgacaccagcgcgcggccgctctcgctgcagatgatgggatgcgcgacgcccttgcggtcacagacgcggccgacggcggccaccacggccgccgcgtactcctccaagctgtatgccacggacatgtcggtctgcgccgagtgactcccgtcgtagtcaatgccgaggcctccaccaacgtcgatgacgcgcatggccgcgcccaggcgggcgagctcgcagtagatctgcgcggcctccccgacgccatcgccgagcagagcagtggtcgggatctgggagccaatgtggaagtgcaggagctggaggcagtcgagcataccaagggtcttgagcttggcgacgacggagagaatctgcgcggcgttgaggccgaacttgcccttctccccggacgtggagccgaagtggccggcgtgcttggtgcgcagcttggcgcgcatgccgaccaccgggcgcacgccgaggcggcggctagcgtcgaccacaatgtcgagctcctcctcctgctcgagcacgatgaccgtgttgagccccatggtgcgcgcgatgagcgcgagcgagacgtactcgtcgtccttgtagccgttgcagatgagcagggcgtccgggttgccgcgcgcggcgaggcagctcatggcgagcagcagctcgggcttggagccggcctccaggccgaagcggaacggctcgccgaactccacaatgtcctccacgacgtggcggtcctggttgcacttgacggggtacacgccctggtacctcccgccatagccggtggagcgcacggcgtagtcgaacgccgcgttcagggcctccacgcggtggcggagcacgtcggggaaccgcaccagcagggggagcggcaggccgagcccgccgccggagcgcgggccggcggccttggccaccaccttggcgaggtcgatctcctgcccgggcagggttgcggcgccgtgcgggcgcacggcgacgtcgccgtcgtcgttgacgaagaagtacggcgcgccccagccgtccacgttgtacagcgcggacgagaggtcggccgaccacgcggccgcgtccggcttctccgccaccgccgcagccgcggcggcggggcccagcagcggcgcggggaagcgcgccgcgtcgcacgcgaaggcgtgcgcgacaggtgcagcggcgtccacggcgagcgcaggcatctcgtcacaaaccggagaacgctaaaatccacagaaaaaggttagccttccttctttttttttcttttgctgtaaatctgttgtctgtttcggtggcgttagcagcgaagaatcaaatcaaaggaaaaaagaatgaggttgtttggatggatagatggatcgatcgagattagcaacaagaagaaggataagaaatctaaagcaagaagaagaaatcgaaagaaagaaagaaagaaagaaagaaagggaagggaaattgaatcaaggatgccaaaagaggaagttttggaaggggaggtagaagaactctaggacgggattttggatcctgttgtgaggaagggggctttgaaagccgccgaggccggagccccggctacccccgcaaaagaagcaggctgggggagcgctcgcggcggaggaggagtcgtcgccggtggtggagctggggcaccccacgccggcggtcaggagagcgccctcgtcgtcgcagccgctatccacaacccaaccaccctcgtcgtcgccggcgtctaggagggtgttatgaccctaccggcgtcggagtcgtcggaatcgtgaggcgtagcggcgagcgagcgagcgagcgagagatgagatgggaaatgcgagggtttgcgggtgggcgtcgagccgcttttatagcccccccgcccgccctcgcggcggcccgccttggcccatgggccccaccccccgccgcgctcatctctcctcccttcctttctgttgctggcggcgtccgcgaaaacgtaaataactttttttttccttctttccgttttttcctgggagacgggtggtaggtgcggtttgaccctgacaaagcggggcctacgtcgcagcgacacatggcaaaaaaaatggcatatggctctccgggtgtatggatggatggtggtggttggggtcgcggacagcgcccggtaatcgctgcacatctgcttggctctctctctcgcctcacttcacatgcctactcatctcggcaacattggtcatcgtctctccaattctccatcaccccacggtggttgaatgcttcaatcctcctctctctctctctgcttcctccctcacggggggtcacgttctttgatccctctcttgttctgttgcgcggggcggttggctggctggctgctgctgcagctagcggcgatggatgatgatggtggtggtagcagccagccacggtacgatctgggccgttcgttcacgatccggcggcggggagcgtccgagatcggacttgtgggaggttttggatgcagtttatacgcgggtgggagataataatagggatgtgggattcgctgcgctgcagcaggtggtcgaccgatctgctgccgctgccgctgccgctgctgctgcatgcgtgtggggggcgtcgcggtcgactgctcgatcggccgaacacgactggagatttgaacctccggttaattctggattttgccggttgctggattaagggcatgcttagttggcaaaaaaaaaatttacccctacatatcacatcagatatacgaacacatatttaaagtattaaacgtagtctaataacaaaataaattacagattccaccagaaaacaactagacgaatttattaagcctaattaatccatcattagcaaatgtttatttagcaccaaattgtcacatcatggcgtaattaggccaaaaattcgtctcgcaatttcctgacgaattgtgaaattggtttttgtctatatttaatacttcatgcatctgtctaaacatttgacgtggcagcatggaaaattttataagccctaatttttctttattgttagtttgtttttttctcgtaagagttcagcttggcaggggataacgagctttgaattgcggggaaacgcttgcggtttttttcacactagctaggcacgcctgacgaaaattcagcatggttggtggtccgaattttttataggattttgcgcacggggatgggattagaaaaagttttgtgtactaaaggaaaacacttagtaccttgttttgggttgttggaaaaacactttaaaccaagtatgtatgatccttacaaacaagatccaaagcagacgacaaatcaacaatcacaatttggttattctctcttttactctcgtaaatctcaaagacgtgagacctgtgtttggcaacgaggagatggttagacgtactagttcttttccattccttcgctcatagcgaaatgaaggatcttttgttgtggctgcaatacaacgagaggacgtgtaaaccttttgggtgtgtatatccacaagtgaatatggataccgaatttctatctattatcttttagaaaataaagtagataagatacatagctttgtgactagcaaagtttatttagtgtaacatagagctcagatgtttcgtactaacataagaaaagacaaaatggatgagaaaacactcggctaatggtttcaatgggttaggagccgtgagataaaagattatagataatgaaatattttattaattagtggtgacatggtaaaggatatatatatatatatatatatatcataatgtgtgtatatcttcttataaatatagatatcggatttatatctagtatcatcttaaaaaagaaaatagataagatagagggtcttatgactatggacagaattaattgagtgagtgtgaacatacaaccaaccaagatgtttgataccaacataagaaaacgaattgacgaggaaatactccattaatgattttggtggattaggaggtgtcagatttttcgcgaacgcacaaaaggattgcacgttaatatattagaagaaaagagtttttcttacacaacacaatcagccagcccggcttatgctaggggaatggagaaaaagcaaaataaaaaactaaagcttaggatactacaacaaccaaacacaaatccaaacagcgggaagggaccaaaccacgctacactccaagaagtccataaaagcggcaatgccagctaaagaccacatatcaccctccgagtggatgaactctagaatcagagtctgagatcgaagagagcgcaaagtcgaaaacatgaagtttcgttctttccatagatgccaagagaccaagaggtgtcagatgaaatatttgcagttaataaaatattttattgatcagttatgatatgatagagtatacagaatactagtaactcataacgtgagacttgagtctatcaatctacaagtaaatatatcttccttccatcatcgtccatttctgtacaccgtcggttatgggttggtatgggtttattcggtgcgtatagtacagcaccactgataaccactctactgctatagcactatacgtagtacgtaactgctcgcatttgcaaatttgcatgggtcggaagcctaggaggaaagcgcagcatcatccgaacctatccgagctcatatccgtctgacttgggacgagggtagccgctcatgggttcaggagggctataggccgtagcagcgcgcgcggcgacggcgagattcgatcgatgggcgagaaaaaaaaagcgtcgtttctttctggaaaagcatatcggatgggcctgcctccgccggcgttgtcgcctcaccaccacccattcattcatttctgagtcggatggatggatccaaggagaatccgcgggtggaccgcgtcgaggcgccgcgtggctgcacgcgggcccccacctctccagccacagatctctcgcgcagatgcgtcgtccctgacctcacgctcccccc

SEQ ID NO: 16937 - DNA, 13765 bp, Oryza sativa
  unsure (1)..(13765): unsure at all n locations
ccccccccccccccccactcgtcaaaccccgccgctttcggcttcggctcgggtttttttgccgttcgcctcgccccgtcgtccgccagcaaatgttcccccgttgataaaaacggctcgagtccggaaatatccagattttatttcggggatcccgatgggcggcccggatcgccgcatcctgttgactggacggcgatgcgtgcgtgctccaccctggccgttgccgcgcgagccgttttcgccggctcatgcggaattccggattagtattatatactccctccgtattttaatatatgacatcgttgactttttgaccaacgtttgactattcattttatttaaaatttttgtgcaaatatgaaaatatttatctcatgtttaaagaacatttgatgacgaatcaagttataataaaataaataataattacataaattttttaaataagagaaatgattaaacgttggaaaaaaaaatcaacgaagtcatatattaaaatatgaaggtagctatatcggctttcactggtactcgtactccaatagcgactagtgacctgcagctagcacaccggatgcagcttggagttctgttcttttttgcatagagtgcacgtacgtacgtgcaggacagattttatgtgagaggtcaattttgatgtcttgtttcttgtcaagagatattagcgtgcctccgcgccaaaaaggagaaaaatgtgaacaacgccacggacagagttacatttttcactccgttctcatcactttctaagtgacaaatatctaccagggattttgttatgtttactacgactagagtttaattccacttgcaagtgccgcgattttcacatgaaaaaactgaagatttattatagatattatctattactactggagaaagcctttttcctctcggttagtaacccctatactcctggttttgcaaccgggagtagaaatccgggattaaagatgagtatctttagttattcgggattaaagatgagtatctttaattttaggtgaaataactgggactaaacatccatctttagtcccggttgatgatgccaatcgggactaaagatggcagcgccagtcccggttggctactatatttttttcattattttttcccaaatcgatttggaactgcacaaatctcttcccaaattgagttgatccccatatccccaaatcaaaatcaaagtatcatcacaaacatagattcacatcacaaattctaaaaaaaatacatctcaaattataaaagaaatacatcacatatcaaatcaatcacaacttctaaaaattctcagatccaatgtatcacaaattcttaaaaaaaaacaaaatcgagttgccgttgcgccaccggtcgcccaccgcccgccaccctcccatccgtgcggcctaccacgccagccgtcgcctgcccgcccttcacgcagcctaccgcgccagctgccgccgctcgaactcggccgcctggagaggaggaggcggggaggggtaggagagggggagggggaggaagaagctaaggggagaggggaggggagatgactgagatggagaggagaggttgttaatttaatgagaggggagaggaaggggagggggataagatcgatgacgacgactgtcgaccgagaccgaggcacgcagctcggggtttttagtcccgattgtttataacaaccgggactaaagataattggggccctgactcgtcttgacaactttttgaaccagaactaaaaataatctttagtcccggttcctattcgaaccaggactattgtggattttgggtgatcgatcaaagatggtttctccagtagtgtatatatgtaacttgtgtaggaaaactaatgtccaagccttgcaaattctaaaccatttggatcaacaatctaacctagatttcatcaccaccttcctaaataaaacagctcacgtctcgtctaattggcccgtattagggtatagttagccgccgccaccaccatattgctccgctcgatcctgcctcgtgcgccacttagagcaagtttaatagtatagccaactactagctccaaattatctagagccaatataatagctgattcatacaatagttgattactattctattaatatctagtcccacctgtcatacacatgttacgtcttagagtccgtgctgcagctggctacagatatgtaggccgctgctcttctctctcttcctttatctctttaaaatatgtttatagctggcttatagcatgctattgtacctgctcttattgtcgttcctccgcgttattccttccgtcgtcttagagcaggtataatagtagacggtaagactttaaatattatatctgtgatgacatggaaggaagagaaggttagaaaaggcaaaggcgagcgcttcatttagcactagctccagcacagcctccaacgcaaagtggtggggcccacgagtgggagggtatggccagccaattggatggagctaagccgattgatgtgcacagttagttgaataaaatattagaagtaactatgatgagcttaagtagtatttcttctttttatttacttttgctaaggtggattattttgtagctggcagccggctgctctattaacctgctcttatttgtctagatatattaccatcattcgtcacctcgtaatctgcattcttccttgccatcgtcaaggattctacccactgctcagtgctcactaacaaccccgcgaaactggcacaactatcaccttagtgctccccatcatcgcagccctctaaaccaagaaactcccccatccttccactctacccagctttgtcctcccaccctgaccctaattttgaatcatattttggtcaagcccgctactctattgtatcgtggaagggtcgttagagttgctgtgagtcaccgaagctaggagcctaggaggaaactggtgtgcaagtatttaagccaatcggatgatccataatcttattttgttcgtcgattttttttcgtcaaagaacgttagaaaatccgttaattataatgtgatgagatttcatacgatcgagacaatattttcagttaccggtacaatttaatactcctcccgtgaaacatgtacgactcgttaagtcagtgcacccatccctgcatgatacatcccgcctactagatgctgtgtacgtgacggacgcccggccggcctaggggcctaaagaaaaccgagaaaaacgttggaacaggacgacgtactacgtaaaagcaacgaaagtagcctgctcctccccctctcgctgtctctcgctgattgatacgcacggacaggtggacggagcagactggcccggcatggagacacacacctcgcccctactagcgcgagagatcgccgcgccgcgcgttgcggctggatgatgagttcgccatgtgccgccgcggcggcagcgggcgtcgatcgtccagggcggggagggtgcaacccgggggaagcgagatgccgcccgggcgccggccggggcggggccccgaatccgcacgccgcgagaccgacgtttgctgagatttcgtgggggctgcgcaaacgcaagcgcgtgcgagatcactctcaaaccggtcgttggcttgttgcgtgactttccactaccggtctcactctttcgcatatacaaatcaacagatgttagagtataattatttataccatagggcttgcacatgatcgaaggggttgttgtcatgtttggaacaaaggagatatataccttttgtgttgattctagaaatttttttgaaaatatctatttttttgaaaaagatttgtgtttacatacactactataaagaatttacgaaaatatacctaatccgcagatcagttctgcggtagcgcaactaaagtatggcatggcagcgtggagtagacggccaaggcgtttgcgcggaacggggctacgggacggagccagtcccgcatgccggtaacacggaaccgacacactcccgcaatgccggtgtgcagaacggcggcgccagcatttttttactgcgtggcagtatattcaatactgtttgacactgttttacacagttccatgtcaattccgcacaacagaggcgcggcaccgggcatgcacagtgtatgaacagtgctgtacagggtcaaaacagtgtataaactgtgctgcacagtgctgaagtcgctggccactgcggttccgcgttttggagctgcgggatcgcgacggttccgcgtgaccatcccgcgggatcgtcggtcccgcattttaaatctgcggaaccgtcgttggatgagtatatttttgtaaaacctccccatacatgtatataaacataaattattgaaaaaataattatatttataatttttttccgttgattctatcacctttgtgaaaccaattgcaggagatctacccttagcttcgtttcttcaatgagttggattctcaaggggtgatacaagacaacgccggggaccctggatgagggacgttctagcatcatgggaggaaacgtaaacctttgcctcgtatctagaaacatttattgtcaagttattgacatccgagcaagtactaaaaatcttgatgaaatcttgatgcgaagttgattgaagagcgagacaaagtttccaccactctgttgcatcacatctagaaggcaaagaaaacatacactaaagccatttttctttacatacgtggtggattaccctccccttccatctcaacctagtacaatatatgctggggaattgctctacaggcaatcagtgtcatacttatcaagtattattataacatatgctcatattcgttgtagtaggatatgttctattcgatattagatagttatattttaggataaagataatatattggtacatactatcaacagaagggaaaaagatctaaagtcgtgaacgtttttcaaaattttagtgttttcaaaacaacattttcctccataataaaaaacaatatctttacctgtagggttttgtgaaattggtgtaacatgttcctttgaaaaggtagatacacatagtgcatactactccgtctaaaaaaaccgaattcctagctatgaatctggacacaggaatggtctttttttttgggacggaggggtagtcattagtaaacgaaggtgacccactttttttggttttacacagttcataggttacacgattttttcttcttctaaaatctcatttcatcttctaaaaccatggatctcacatgcaatttctccatcatacagtggtgccgataaacatcgagttagatccttggtttgaaaaagggccatttgattgatcaagtaggaggtgagagggccatttgattcggatctaaccattgaggaagtggagatatagatctaataaaaattaaaaatttatgtgaaaaataaaaatgagaaacccactaaacacctgtaaccaaacatacgaagaaaaaagaacaagctgagatttacaatacgtcgtggtcacctcagggcgacactctaacatatctggtgactcgggataaacctagagtcacccggcggattcgaatgggatttaagagtttcctttttatggggaaggggtgatcgaaagttgagactatgacataacaatgccttcaggactaagacgtacatgttaatttcgtcaaaaggtacaaatcttagtaaactactctcgtaggatgaattgatggctgaccgtatctagtggatgatgggattgcttgtatgccaccgtcactttgcaaaaaccgtgttgataaaatgtggcctgctaggctgtgacaaaaataagtttatgatgcatttttgtatgtggtttttatactgacaccagtaaacgattcttgtatgcagggataattatgacccgcctacggtatgtaggaggtttggttcgaaaaaatcgattatgtagtactgtgatggggtagtctgaatttatataaaaaaagtgttacaaatcatagttatagcacgaaccaaaagcttgcttaaactaatcggcagtcgatgtcaaaatgtcgtaaaatttagcacccaatcaaaatgtccctcctgttcgaaggaccgtgggagtgggacagacagcaaagcaaagaaaaataactttctgaaaaataacgtgagcctacggctacagaagtactacagtactgtattttcagtacagtgtagcgtcaggccagttaacctttagctctgattctctgaacagttagcaacggcgtcttgtcgcgatttatctacgcaatctgcagagcactgtacatacgtgcctagattcgtgtcgctcgtcaccggctggcccgtcaacgattgcatctccggcgacaaactctgacgctaatgttttgggggataaataattgaatcttctaatgcagatttggttggtatcagatcgacaagcgaaaaggagataaaagcaccgtcagcatgcaccttcgattttactatgcaaagttaagctcggtggttctgcttgcgattcgcatgtgttactgtagctgtcatttccaggaagctaggttagcacgtgtgtttaccttacctggtcaaaggttttactacgtaatgacgtaaacttttcttgaagaaacttctaaacatgtgcaagttgtcacagagcacgtacgttctctgttggttacagtcctagggaaagatatcgacaaagacactgaaataataactagtatcaaatcttatcgtcagataaagaaaatgatatccccggctgctatcctaagtggagctattagttcaagggcctggattagtttcatctctcttttttttttttggggaaaagtttcatctctctttaacgtcgtcacaagtggtctcttttttcgcattattgaatcagcaaagagttaaagagaatgctgtgacctacttgataattgagacctaattccatcctctcccctttcctgtggatataccgaattaatctgccatgttccaagttgcatacctgaaaataagaaaaggagatggcatcatcggcaaaaggcctaactgaccgaagaaaacatgcgttgtcgccgatgtagcttgcagatacctaaacatggcgttgttcatccaacctatcctatgtttgtgtttcttatcgcctaaagacgcacgcatctgatagaatggtgatgcgtgttctgctccctgctccctttgtgtcctatgaatcaggtcataagctactgtttctgtgattcttgttggttgtgataattaattgcacactgttttctccatgagcttaatcatgggtcattgtattaattgtttgtagctcgtttgagtaaaggccggatattttattccattatctaaaaaaaaattatgagtctttgtatacttatcattactattactagtactatatactccctccatacttgtaaagaaagtcattttggacaatgacacggtctccaaaacataactttgacttgctgtttctataacaatatttattgaaaaattatatatgtatacttttataaaagtatttttcaagacaaatctatttatataatttttacattttcaaactcaacaacttaagagttattcatgatttatattctcaatgtttgacttaaatattattttaaacgactttcttcatgattacggagggagtatacttgtcaatgtgaactagtaccaacagaaggatcgtgtgacgactgcgttgggggcaacccatgtgtgaagagaagcaacgatgggtggaaagctttgtttggtcgcggctcgtgagcacatgtatttttgtgcttcaggatcagcgcatccatccggtcgatcggccgccgtctggcctgtcacacgcacaggacagtgtgtcgcgggtggagagacgtctcggcccggacgcatacgggagcaacccacgtacgccacgccgccgccgtcgccgcgcggctcgcatcgcaggatgcagcgcgtggcgcggcgcggcggcaaatgcacgtcacaaggcggcgcggtgttggcggacgtggtaggtcgtcagccgctcgcagcaccggtggtgggccgcggcgcgcgtggatcgcgtgcgtgtcgtggactggactggtcggggagtccgcgcgcagcgggtgcggggactcgggacggaagaaagtccaaaaacgagaggagaagcggggagcgcgccgggccggtggtttccttccagaggagaggtgaggtgaggtgaagcgtgggattgggccgtgtggcaccgcgagagcatggcggaaaggccgagaacgcgcactgcgcgattggctggaccgggcttccggtacacacgaaatcagttcagtacatgtgtttttttaaacttgtaagagcatcaatatacgtgcttggacaggagaacaaatttatgcacatcaatatattagcaggagataaaaaatttacaattatgacctgctgtagcggtgatgagagttttacacaggaagagaggagggcagttagctaggcaaaactagaccctgaacaagcaaaaagacagaaaaataggagataaggattatataacaataaaaactgctagaggactcgacttcacttccctccagagcctaccctcctgtgggatacgagtgaccaatgtatgcacctggaagaggaccttattaaagacacgagttgtcagtatcctgatctatattctaatatcttacgacactacgatcctatcaaaacgaaatgataccgattttacctagtgtcctaattttcatagtatcttgatcctactatttaagtaccacacgaccctacgaaatcttaggtagtatcccgattctacgatccttacaatcatacaaaatattatttaaaacaaaatggtttgaaaataatgtaaataaatatgctcaagtttttttaaatcagttaaatatatcaaaaactaatgtggtttctctcgataaatgtctctatttgcatgacatatattattactatatttttttatatagaatggatataaatataaatattaattaaacttaaaaaaatctcatagtatcccgatactactatacgatcctatcatacgggacgatactcatttgagcaaaacgatactcgatactacctaatattctaatattctgatacttgtaaccttgaagacacgagcattcctttccaaacatagacgctaggtaacgagaaagatgagggaatcaaatcctttcatgagataatcgagcggttgtcgacgagagcccccagcatacttcaagtgtggactgtcaacgggacgaagaagtggccactggccagtcctatcttggctagcaactcgtgctaaacttgtcacgcactcaccggattaggcccattatcacttttagcttgtgtggtcccaagtgtagagtgtagagctagactttcgagtccaaatactcaaacaaggccgaagcaaagctgaaattaggcctgtgagaagtactaaaacgggccaaatccatcccaattcgagttaaaatctgtcctatgtagattccataatgagctaattcaatcccgacttgagttggaatcagactccataaagagctaattcaatcccgacttgagttggaatcaagccctgatatctcagcctgtccaagctctcatcgacaagtacttcgagacccataacatccggtctgatatgtttttttgagcccatacagcacacacaatgcttcactgagtatgctgcttattcatctgtcacatggctatagcttaccttcttttgcgtcgaaagattctttgcttttgcattgtgctaacttttattttcaacgagggggagtgttcagtttcattttgctattactatggttagtctgaattaatttcgtgccctgaaagatctgaatctgttgaaacttcctctgcgttttgatctcaacacagcagctttcgaccgttttataccgtgtagacggaatcgagacgcagggaaaaggaaattatggtctgtgcgatgagtgtccacgcaaataagtaaagtttgcaatgcaaaccaccactttaaagttggccactatgcgagatactttaccttcttttggagccatccatccatcccttcccttgtcttctttgcttttctagtgtaatctgattatctccaatgtcatgcatatgggcagctagcttagcttagcttagcaagctgcgagttgggggatactgtattttaaagagaagctgcactcaagcaagagaaaagtagttgaggaaagctaaagtgctggctcaaattgggatcgatcgaccaattctttcccacaagttcgtcgacatcttgcagagatgttgtgtaccgacctggctctttcagtcggcagggcagagaggagtgaaccttggctctgaaactgaaggcgacgcacttgattcagacatgtaactgaactgaagagtctcaagttcgtacagcaaatcgtttcacttcaaatagttgtggctttgggtggttgttctatttttgggacaaaatgcttgggacctttatttattcactactacactttaaacacatgaattttctttccaccctttgttctgattaattacaagttactagtatatcctaggttggtttctctaatgggctaattcagtatactgaaaagaatccaatgaaagctcagacttctcaagcatagtacgtaagaaaagaacagatgccaaagacaaacgtagttcttactactagttgctactagcaactaaaatcaattgttactttagatggcttaactgttatattctttatgttggaatctgtccacgtagtttcaatttttaagttccagacttacggatactcatatttgtaactgattatttcttcaacggtagacgatgtattcgacaatagtgaagcgttcatacgtgcatggtgatttcgttaatatccatatatacagatttcgttaatctagaggaaatccaacattgcatgaaaagaaaagttttgtcccattttgaattgtccatgtcaacagtgtaaaaatcagcatcgtcgttcgagcaacaagggaagaaacacgcacatacttctatgcaaccaaaggaaaaaaatgtacggtcgtgatctagggaacctcccttaaccaacggccgatgacacgattcaccatcgcaaagccgaaagtaatacagcgaaatctccttataaagcagccgtgtttcgtttcggacaccacatgcatgcacgcgctttttgtttatggctaccatttccaacgttgtcacgaacacttattgtgcttctcccactccactgctccgccggcgagccaccgccatggcgcttcgtgtacagctcgtcctcgccgtcgccgtggttgtgccggcgttgggggtggcggcgggtggtgctaccttgggggtgaactatggccaggtcgccgataacttgccgccgccgcaggcggcggccatgctcctccgctcgctgaacgccaccaaggtgaagctctacgacgccgacgcgcgcgttctcagcgcgttcgctggctccggcgccgacttcaccgtcggcctcccggaccgcctcgtcccgcgcctcgccgccgacccgtccgccgccgcggcgtgggtgcgcgccaacatcctgccccacatcccggcgacgtccatcaccgccgtcaccgtcggcaacgaggtgctcaccggcaacgacagcgccatgctccggtcgctcctcccggcgatgcagtcgctccacgccgcgctcgccgcttgcaacctcacctcgcgggtggtcgtcaccacggcgcactccctcgccgtgctctcctcctcgttcccgccgtcctccgccgcgttccggcgcgagctcctcccgtacatggcgcccctcctcgcgttcctcgccaagaccggctcgccgttcctcatcaacgcctacccgtacttcgcctacaagggcgacccggagcacgtggacctcaactacgtgctgttcgaggccaatgccggcgtcggcgacccggcgacggggctgcgctacgacaacatgctgcacgcgcaggtggacgcggtgcgcgccgcgatctgcagggcaaactacggcaaggcggtggagatccgggtgtcggagaccgggtggccgtcgcggggcgacgacgacgaggccggggcgacgccggagaacgcggcgaggtacaacggcaacctgatgcggctggtggcgcaggggaaggggacgccggcggcgcccggcgaggcgctgcaggtgtacgtgttcgcgctgttcaacgaggacatgaagcccggcccagcgtcggagcggcattacggcctgttcaagcccgacggcacgccggcgtacgacgtcggcgtgaaggctccgacgattggcggcagctggaaggggagagccaatggcactagcggcggcggcgccggcgggctggtcgtggcggaagggcccggaggggcagacggtgcagggcagggcactggattctacaccgtgtcagcagcagcacacaaggtaattgattgattgattaattaattaattataattacattttgcaaccgcataattacttcattgtttggttacttttttttttgttattagtgtggttcttgattgaatgaattgtgattgagtttggtacaaggaaagtatagtttaagtatgcagtgttgtgtcggttcagacgttcagttgatgctgcgctagctagttgctttgcagtgcttctgttgctaatcaattaaatcatcaatatagtctaattagtatgtgtaacaagtttggtatgcacgtacaaaaccaagttttaaaattgcaaagaggggaaaatgctgctgtgctagctcccagatcatactcctactttgctattccatacccaaaaaaaaaaaagatttgctcatcaagtgagtaatcatgcttggcactagctagtaatcaatcaaaaggttagctacctgctgtgacagtattggagattatactagccctcctttacaagtaatgctttgtgtcacacactttatcttcatgttccttttttcataggtgaagaggtggcggtgctgggaaagcttgttcgcaaccgttgttctagtcatgtcgtccggcctgtgttggtcatgacctgaagagttgaagatgttcatgaagaattgaagatgcagtagaggaggagatcgatctgcagcatttgcagacaaaggagaaatgagcttgaacaaaaacgccattgattcaattgattcttgtgttttcgctgtcctccgattggtgttggttgatgtgtagtttgtgtactgtaaggaagagagatgtaagggacattacatgatacactggattattaattagttcagattcagatttctgaaaggattagaacatttacgcccagtagatggccagacttttaaatcatggatttggatttttttccccaagcaatttttgttagaaattttgaaccaagtgaaatgtgagtgccagtttattggtgggcttgacagcccatctgagagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16938 - DNA, 647 bp, Oryza sativa
  unsure (1)..(647): unsure at all n locations
gaggtcgagcacctaggaatgccatggatgcccttggcgaacacggtgtagtgcccgttgaggtagagagctgcatggggtaggtgatgaagaactggctcccgttggatgttgggcccgctgttcgccatcgacatcaccccgcgggcgttgtgcttgagcgactccctgaactcgtcggcgaacttcttcccccagatcgaggtgccccccttccccgtgcccgtcgggtnnnnnnnnnnnnnnnnnnnnnnnnnnnnnnnnnnnnnnnnnnnnnnnccgtcgtagtagccgctcgcgcacagcgccaggaagttctccgccgtccgcggcgcctggtcgcagaacacctcgcacttgatgtccccgagattcgtgtgcagcgtcaccgactgcggcggagatcaatcggtcctccggtcagccacagggaagagattttccggtgagggagagtgagattcgagcggcgagggcttaccatggcggcggcggcgaggcgacgggttgcttcgtttcggcggcgaggagaagcgtagagaagtctcgagtctttggggaagacggtttggtgggttgggctgggccgccatttttatggatcgagaattcgcactgacaaatactacctccgttttttaatagat

SEQ ID NO: 16939 - DNA, 415 bp, Oryza sativa
tttccgcctgtgattctgtatgtcaggcgtttattacctgcaagattcgtacaaacgatgatcaaaagcttgcatgctgtacaatacggcatatgctatgatatgttctattataaaaaaaaatatagcttagtgcaatacacatgactatattcattcctgaaataaaagctaaaatgaccgagtaacattaccatatatggctcggttaaaaaaaaacacatttccatataaataattaacttaagagaacagtatatttatataaagttagttagcatgtccatatgagttaaactcataagcaagttactagtaactatggaaagtatatatagttgagcctatgagatcttacagtgtttgagcctgattcacagggggacttcctcactacagccatgaaggatctctt

SEQ ID NO: 16940 - DNA, 721 bp, Oryza sativa
gtgggatgcatgcatgtgtacaattgagcaaaccctactccagggacatctggtctaccgagaccaccacctaccacgattcatacgattgattggtttagctagccagaaattaattggcaatcaaacagtacaaaaacatccatccatgttagtatcatctgctacactcctcattgccttcattatctttctctcttcatctcttgatcagctcttgacgatggtttagacgacaggccgtacggtgcacggctggtcatggccatcactcatcagtcatcaccaacggcgccacacattccgtcttgtactacaagattaattaattgaaaataaaattgtactacacgagatggccccggtgggcccacctggcagccgctcacagagttacggccgcagaggatcccgagccccccccctaaaattaaccaaccaaaccaaatcgcgtttaatttttcgcgcgcctcctctaaacccgcctagcttaaaccccctcgtccaccgatacactgacatgtgggcccacacccactgacatgtgatcgcccaagccgacccgggcccacatgtcatcgactcatcaagcagccagccaaccgtggtagagagattttttgaaaaaaactggaagccacgggcccctacgcctacacgtacccccctacccaccgggtccactcactgacgaggtgggccccactttgtcagccttcct

SEQ ID NO: 16941 - DNA, 5260 bp, Oryza sativa
  unsure (1)..(5260): unsure at all n locations
cagatatgaataagtgcgctcattatgcaaagttataacagaactctcaactctgaatattaaccaagctaaggcaggtaaaataatcacaacaaaggccttcaaaattttactcatgtaatcatatggagttctccaaaaaaataaaaagatcaacacatggtggttcccatcttggatcctgtgatctggtgagttgatcaatgaaaggattaattccaagcctgcaattgcatctgctcactctgaaccattggcatatatacacaaactggggcacacctagctagatatatgtagtaagtacatatatacacacggcctatgtgtgtgtgcatgatgcagaggcggcattatttgctggatagccttgtgtgcatctcgatcgatcatgtagcaagtgtgacaatgcacacactgcatatatatgcatatacatatatgcagcagcagcagcagcagttatactatatactagtatagtagttagctgtaggcttgatgaagtgaagaaggccatagcagaaagatgcaggaacacatactatgtgtaattacattgcatgcagtagatgctgcacaagagagggggtcagagctacatgtttgtgtaaggtgttaatgtccttaattggtatttctctttcgtacgtacgcatgcatacgtggctgcctgcctgcctgcacaactgcatatgcatgcatacttggcagttggcaacttggcatgcagagaacagttgaaattctggaggctgagaggaagctaattagctaaatcaagctaataactaagggttcatttcgaaaacataagaatagagggcacaggatcagtggcggagtgtcaagtccggatgactaatagtgttttctagtgatcgattaatttttataggtgtcgatggccatcgatagtagagacagcaacagcgaatcctgggcagttacccgacctgcccgagaggtggctctgccactacatagaattacaatgtcttatattaagaattcctatgggaattagaaatgtaggaatactctaatatagtcatttagacgatatgcagaaaaaacagagaaattatagacacaataagagagaactgtgatgtacaacctcatgttttgttttcttccaaaatttctatgaactagctcattccatgggttttccagaggaattttcggacatatatatcctttgttttgaatgagttcatcataggaagtttatcctaagaatttaaatcctctaaaaatccttcacattttccctttgttccaaagaaagcccaagtgttttttttccccttttcagggtaggttgggtgggcaattttaaatatttttacctttttcggttttatgtacacgagattcagaggtcatctctataaatgaatgctgatggatgatcatgttaactataggaatggattaaatattatatgaaaatttgaaaaacacccacaatagccgagttaatttgcatgtataggttgtgtttagttccctcaaacttccgaaaaccaattgcacagtttgcatgtaaatcgcgagactaatcttttgagcctaattacgccatgatttgacaatattgtgctacagtaaatatttgctaatggtggattaattaagcttaatagatttatctcacagtttaccaacggaatatgtaatttattttgttattagtctacgtttaatattttaaatgtgtgtccgtatacgtaaaaaaaattaaaaaggaactaaacacagccatagtattttagtttacccatatttatatctcacctccatcttcacgaattaataggaataatctcaaaggtgcatatgtcaatcagctagctcatgtgggatgcatgcatgtgtacaattgagcaaaccctactccagggacatctggtctaccgagaccaccacctaccaccgatgtcattacggatctgggattgggcttctcagccgtaaggncncagcgacacactctacactctgcggccaagtgcagagaacgagctcacgagatagaaatcaaaccacaaaaacatccatccatgttagtatcatctgctacactcctcattgccttcattatctttctctcttcatctcttgatcagctcttgacgatggtttagacgacaggccgtacggtgcacggctggtcatggccatcactcatcagtcatcaccaacggcgccacacattccgtcttgtactacaagattaattaattgaaaataaaattgtactacacgagatggccccggtgggcccacctggcagccgctcacagagttacggccgcagaggatcccgagccccccccctaaaattaaccaaccaaaccaaatcgcgtttaatttttcgcgcgcctcctctaaacccgcctagcttaaaccccctcgtccaccgatacactgacatgtgggcccacacccactgacatgtgatcgcccaagccgacccgggcccacatgtcatcgactcatcaagcagccagccaaccgtggtagagagattttttgaaaaaaactggaagccacgggcccctacgcctacacgtacccccctacccaccgggtccactcactgacgaggtgggccccactttgtcagccttcctcctcctcctcctctttctctctcctgccaccaccaccatggcaccagctcagctcagctcagacacccacacagtgagcccctctctctctcttctctctcctctttctctctcttggttgctgctgcgtgctgcggtgcagtgcagtgcagcggctgcctcccgaaagcaacaacagtcacgtcgctatcggcaccacccccacaaaacaccattgctcccccccatcgatcgatcagagctcagagaaagagagagagagccatggtggtcgtggtggtggtggtaactcggccagggtcgatgcactagtgacacaacgagtgcgagtgccctgaaaggggggaggaggagcggcttgagagggaataagctaggtggtggtggttcttggatcaatggcggcggcgagggcgccgtggctgtggtggtgggtggtggtggttgttggtgtggcggtggcggaggcggcctccggaggaggaggagggggagatggggaggggaaggcgctgatgggcgtgaaggccggtttcgggaacgcggccaacgcgctcgtcgactgggacggcggcgccgaccactgcgcgtggcgcggcgtcacctgcgacaacgcctccttcgccgtcctcgccctgtacgtcctcctccctgcgaagctcggtgttctttcctgggcagacatggcgcgcggcggcgcgggtggttgcgttcttgttcttgcaatcttctcttgtggtggctgttggttttttcttttcttttctttttccagcgtgcactctgtgcttcatgtgatttttctctcttgccgtgctcgctctggcattctgatcaggaggagcaaatagttcaactgttctgttctattcttgcctcccttttttttctgaataaaaaccttttcttggttggtctatttgtgcctagattgctgtgaatgtttcttcttgataatcttgttgttatcgtatatatctaatggaaaagaaacgggtttttcttgttatcttgcgtaggtctttggatattagtgaggctatcttgtttgttatgctaaaaaggatttttgtgatgagagtgtttccctgtgtgaaaaacaggaacttgtcaaatctaaacctaggaggtgagatctcgccggccatcggagagctcaagaatctacagttcgtgtgagtacggatatgagtagagagtactatttccccttgctttgcatctacctgagtttttgtgcatttgactagcctgtattttctttttataatcctgcacacttcacctgatttgacccctcatgccatgatgtgacacagttctttactattttactttaagcctgtggatttgctcgctgattagtttatttgtgctctaatgatttgcctctctgcagtgatctcaaggggaacaagctcactggccaaatcccagatgagattggggactgcatctccttaaaatatttgtacttcacctaatctaagtcttcttttattctgttactttttgtaacagggtgttctagctaattttttaattgggctcttttgattcttgccatgcagggatttgtctggcaacttgctgtatggagacatccccttctccatctccaagctcaagcagcttgaggagctgtaagctctactttttttaaatcttttcctaccttttctttagcaagagctatggcctatagctgttgagatatgggcacttcctctcccttctttggaaagttcaggctaatactgagacatcagagactaattgatttacattaagttttggaacatcttgttctagaatccagattatgatactgaacatcttgttggagtagtagtagtttttttcatggttttgcgatgcttgggttgtagtggtaacattttttctctctcatttattgatgcaggattttgaagaacaaccagctcacgggacccatcccttccacattgtcccaaattccaaatctcaagacattgtgagcctcttagtaccttactctatccgtgactatttacttctttggggttcttggacaaactgggtgatctgacttctacttgtttaactgtttttgtgttataatgtgcgtgccacgggaaacatggcttgctgtgtcattttttgcatcttaagtactactagttcttacttactgataaaatccttccttaattatcttggaatagggacctggcacagaaccagcttacaggcgatatcccaaggctcatatactggaatgaagttctgcaatacctgtaagaatcctataaaagaaaattgtctaactgttttagctggtagtataagaaggtatttttcaggcattaacactttgcttctcttaatcttcagaggtttgaggggtaactcactgactggaactttgtcacctgacatgtgccaactgactggcctgtggtacttgtaagtcatctcctctccctttggagatgttgctgcatattgtgcaacttggccttgttgacagtggttactgttcttaatctacagtgatgtaaggggaaacaatctcacagggaccattccagagagcatagggaactgcaccagctttgagattctgtatgttcttg

SEQ ID NO: 16942 - DNA, 808 bp, Oryza sativa
ataatgaattcttatattcattttttttattctcagagacctgagtgagaacgagctggtagggcccattccttctatactgggcaatctatcctatactggaaaactgttagtatcatcagtcagactttctttttcactgagattgctttcttctcttctctaacacctactgtcaccttttccttcagatatttacatgggaacaaacttactggagtcataccgccggagcttgggaacatgagtaaacttagctacctgtaagtgattatatggtatgcagatattgttgtgctccagttggtgtggaacactataagatgttcagaaatttttccatgcagacaactgaatgataatgaattggtgggcacaattccagcagagcttggcaaacttgaagagctttttgaactgtaagaaattttatcatgtctatgagttacgtagtatgctttattttattctgtgcaattgttgaccaaattttgcatgcagaaatcttgccaacaacaatcttcaaggtcctattcctgcaaacatcagttcttgcactgctctaaacaaattgtaagttagccggtactaagtcaacttataagttaacagggcattttttactccacatgattaaacatgttttttttttgcctctcagcaatgtttatggcaataagctaaatggttctattcctgctggtttccagaagttggagagtctgacttacttgtgagtaattgtatctgttgcattatgcttacagtaatcatttaattcactcggcgaaattattgtatttcacct

SEQ ID NO: 16943 - DNA, 756 bp, Oryza sativa
acagatatggtcactaaagaaaggacctatacaacttgcatgcaggccgctttaagaaaatagctaatttgtaactgcacttccactaatacttatggtcttatgcacttaacttaatcgaccactcactatgaaactcttagtgaggtatttttcttgagcaagaatgaagttctattactcctttgatcctttcaataattcgtccattttacttatatatgtagagtcctagttcttttgcaaggtttcctaggactttgaagttgtcagtgaactggttccctgtgaaacttttagtcttaattagacatccacaacttcacattgatgctatattcttacaaaaaggaaaattattactaaagctttactagacctatcgctttccatgtcctacggtgagctagttgatgcaatgttcttgcatccagtatatgtcagtgcacaaccgcgtgggtccttattccccaaagtggtcctcatgtctttccttgtaaccacagacagcgacaacttttttgtttttagactctacattgttttgcttgatatgtagcaggagtagactatgctaaaatgtttttatcttgttctctccaattttcagcgacgccgaggaatttctagatcacatgatacctgatgctgagattcgcatgcatgagagacacttacaccacctcatgtcctgcacggtgaaatagtggaaatctgcttgaggataaacagctttggttttatcgtcaccttgga

SEQ ID NO: 16944 - DNA, 28599 bp, Oryza sativa
  unsure (1)..(28599): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagtgtttcttatgtgggccaactgatgggccatatgactatctgggctacgccaaatattattcgggctagaattctacatggggtttcctggattaatatttcatggatgacaatttaagcctgcatcacaattgacaaacaacaatatgcagatttccccaggatatttaactatttgctacttttaagatgtggcaactaagaatttgtcactcgcagtctataatatgtgagtccaataaaatatccttaattgtcacttgcaatagtggtaaatagttaaaatatccttaactgtcacttgcaatagtggtaaatagttaaatatctcgatttttttctctatctatatctatatggacctttcttaggttctatttaggggagcttctaactgctgtagcttcttcgagaatcagaagctcccccaaataatctatcttttgctacaaatcctaagaagctataggaaaataaattagaagccagaagctgggaaactcagcttttctaaatgttgactaccaattagctgcttctcggaattttaagctcctccaaacatgctattagttgacctctttctttcatatcctagttgaaggaatatgcggttttaatctaagcttcagtatactccctctaacttaaaatggagtaatctggtatgaaatatgatatattttaatactacgaatcctaatattattaggttgctatattttaagatgaaatgacgagggagtatctgctagcattaacatcatgatcagtagccagttatccacaacagagcgagataagatatccatgaaggaagctcctgctcatatgcatagcttttattagcacccacaccttaattaattgcacttaggcatatcatctcacaattttcactgcatataacacagtgaacacacacatgcatgcaagaacacagaagagacaacactggtagtattctctctgggataaaaagggcatgtcattgatgccatattgctgcaaatctagttcgattttgtgagagtatattcagatttagccctggcctttgcagcctcgagggagtgcttcctggacagctccaccaccttcttctccccggcgatgaagtaggccatgccagcagctgcatcattaaccaaatcaaccatgaattaatttcccagagctcttaattatcagttgctgatctttttcaagcactattatctgttgtagtaattagctagcatcaaacatttttaccgtaggtgatgatgactgtcttggcgactgggttgcccagattggcctttgcccacttggacatacgaacactggcaaactgcaagggatcatatcaaaagttgcattggttcagaataattcagatgttgttcgcatccatgataaatgtgcattgctctgacaagaacgagcacattgtgttttttgtcacaagagtagttaattatgatcctgctaattaaattaattaattaatctgcttgcactcacggtggggatcgcggtgcagacagcagtgacggccgctgctttcagcccggcaatggccgcctctgaagtcaaaacaaaaaccatccatatacaacatcaaacaacatcacattgttagaatctaacatgcaacgatcaaacatacaatcttagcaataataatcagatatcgtgttaatagctagctaagctaggcagcaggagaagaaatcaccatgggagctctgcttggccatggcgaacttctgctcgatgagctgggaagaatccgtagccttgttcgacatctcgatcaaaacacaccagatcgacacacactatcacactaaccaactagctaattcaagctaatgaatgcgagatcgatcgatggatggatgatttgtgtgtaaagcagccatcaaatcctccaatttataggcttttcagacagcagcagaagcaggaggaggaggagtgcaccacctgacgacacatttcgtcaggcaaagaaagaacagcgaacccccggttttgccatggcggccgcgacgaagccgcgggctcctggagcccggacacgccggtttcgcaggatcacgccggcggcggaggcgcaaaccacgtcctcgggcgccgggtgcaacaagaactcggtgtgtttgcttgctgaacttttggctgcgtgcagtggcgtttcttgcccttttggttgtgtgcacacttctgttgatctctttgagtgtgagaatgggatggattaatatccattactaatgagacatatttggaactgaattctttggataaagattttggaaatgatggctttgtaattttggattaacagcttttttctggtagctatttatgccggccaagaaacctacattgtcctgtgggcttaattaaggggttcacatatttatgtatagtaaggagaacaatgtgctactggtaagtataaacaaaaatgaaatgtggagatttttttttaatttacctcacacaatttaatcgcgccaatactgcacttgttatttgtccactcgtttaaaaggaaaatagcaccagccaggaggatttacatgctcaaaatgtacttagattacttgcttgcagaagcacaaatatctatatgtgtcatcaccagcctaattaattggtagcaaaattgtgacgaatctggaaaaaataattactagtgtcccatatggtgctaccaatagtccaatacatgtgtgacgaactaacgctacaagtatcaactagaaacattgagattgcaaattttgcatgctattcctgggtaccccccccccccaaaaaaacaaaaaaaaaacagcatcccccgccataccctgccctccaaaaaaaatcaaaaggaaaaactcacctctaatagtagtatcaaaggcaaatgaaagaaagaagatgtagctagaggggaaacaaattgatcatgcaagtgatttgaacttcaattgagtaatcatgttaccggatatagatcgcctcaaccttagagtccaacaaatcagtatgggcgatgccgcaatatttggtggcacccgctggagatggatttgattctatggcctaatggatggggcaaaatacaactagaaaaccaaggcaacgaaaaattgaagtcaggaacattgatggtggataagtggagaagacgaggtaccatggaggaaagacgaggtagcaagctggaggagaaagataagggtaaaggaggatcaccgacaaggacgaaggaggctaggaaagcatgctcggggctagtcttgtatagcgtgtacacgtgcagacgtatgtatgcacatgcggcacgaggggcgtgaggtgcacccgtgttggcggtctcaaataaagcggttgtgggaacaaaaataatcccaatagcaattattactaggtgtggaagaaaatcaatattacagccagatttaggtaaaaaaaaagatgccaacattcataaatagtttatctctaagaaaaaaatttaagaaacatgatgaaagcaacatggtttgctgtcctactgattttatttttcaaacacgtgtgtctttcttttttgtttgaaaaatatagaagcaaaaataaagaatacatcagtatttttatatacaatttacatctatgaatgtctatgttgtaactacaaaataaaattgaactactttttattcaactagtgttaatacatgttagtagaaaaaataatgtagcaccacatcatacatgcgtattattttggctttacaaccgttgttcaatttacttatagtttatttataagtaccaaacaaactatcatgtaagttaaagcgaccaacaaaactattaacttgaagaaaaattaggtaatttaatttttaacaacaaggctatatggatatcagctgcctaattatttttttctcttatattttttttctttgggacataggaaggttgggagagaaggttcatttactgttttattacaaattacaatttacaaggtgagttccaccctcatgacccgttagaacactgaaccggttacgttggcgccttttccgtcgcggcttgctgagcccaagctaaccagccataagtgggcctacaaccgattttttttattttaaattttatttattaaaatatttacagaaataattttcgatttaaaaattttacaaatagtcgcccatcgtcatctgggagggtccaaagggcattttttccgacgtggcagacggctgtttgctctgtcataacggccgccaccgagggcgctgaaattttgtaggcgatttttaggacatagcaaaggcgatttttggctctagggggccacctgcaaaagggctgggagggctgcctggtagccccctttagtcctctaggagtgctattttctactgatgcgaggggtagcatttttataggcagccccctgcacagtaaaaaatacaagggtattaggatgtccagattcattatccagtactatattgaattttttttagtaaatttcataaaactacatatactttgcataatctatcacaaaactatatattcaatgtattcatttatcacaaaactacaggtattttgaatagtatatcacaaaactacagatgtaagaacttgtttcacaaaactataggtttaatatcttcatttatcacaaaactacagatttagtgtctccattctcacaaaattagacaataaatatgtagttttgtgataaatgaagacactaaatgtgtagcattgtgattcgttatacactaaatctatatttttgttaaacaagttcttaaatctataattttgtgatagattgtacaaagtacatatagttttgtgataaacgaagacactaaatctgtagttttgtgaaacaagcttttaaatctatagttttatgataatttaatataaaatacctatagttttgtgaaatttactctcttttttttaaggagggactacctagtagttcatcgtaatattaatctttgaattcctctatatatatatactgcacgtacgtatacatacgcgagaagtagggcgcaacttcttgcgtgcgtgcatgcacagttggagttaaggacacatcagttgctttcatgcatgattggtggaatgagtattaaacaaaaacatatgcacagtattcaattgttcggctcttttgaagcaagcaacttagcaacagagtataaataaatctcctctgtcaaaaccgtcagcaaatgcagactaaaccgccacctttttttcatcacgttaatttcttcagtttgagactttgggaccggtccatctaacagagtaaacaattactgatatgttctcaccttatatatatatatatatatatatatatatatatatatatatatatatatatatatatatactctatatatactgtttatatcctacttccctatcctaaaatatagcagcaacttagaatcgaattttacaaatctgaagaatttctatcaaatttaaagtgtccaatccaatacttagtttgctatattttaggaggaagagtacttaaataaaaatggcacacagtgctcttaatgctaatcttataatccttaattatacatgacccattttatctcttaccatttgtccattgcagtaatttgattatttcgcacgaattttctgtttatacgagcaaacaatacactgaacaggaagagtacaataacaatactagttgtgttgtgatttctgaacattattactgcagcagtgttacatgaagttattagtacaagataggagtacatgcatgtattcatattcaggtgtggctagataatgcctaatggcaagaggccaggatgagcagctagctgttgtaaacggttcgatctctgcaggggcgtagtacttgtattgtattactactactactactactacatgatacagatactactctgatcatatgcagctagctagccaggtagctagaagtatatataatatagcatatgttgtgttcttgtaattattgatcagggcctgaagaaggcagggtgggggcggccggtgccctggaaggaggtgttcttgaggtgttcaggtgcgttctcgaaggagtgcctcctggccagcgagaggatcttcttgtcggcggcgacgaagtatgccatcccggccgccgtgcagatgatcagcgcctgtcccgtcgggttgatgttggccttcgcccatggcaccatcctcacgctcgccagctgaaataaacagcacacacaagcatatgcagctaagttagaaaacctactcttctgataaagaattaattgacacaagaaagaagaagcatttgagaaagaagagagactactgacggttggaacggcagaggcgatggtcgcgacagcagccgccttaacccctgcaaggttcgcctctgcagatcgacgaagcatacatcagtttgtatatattcagttattagcgccatggaatgcaagaagatttgacgcaaaaagaacatgaatgttattacagtagtactagctagttttcttttgtaaaacacacgtaataacgtacgtacccctggagcagcgcttggcgagggcaagcctctggtccaggtgtgcacgagtcaccgtcgttgccatcctaattcaatccctaactatgatccaaatcaaatttcagttaaccgctctgcacgcgatgagcagcagtgaatgtgtgagcagatagatgatggagtgatggatgggttttggaggtagctaggcctgcgaatttataggcgagacgaagcggaatgaaatcggtggacgatcgaactaggtagatagcaccggagaagcggcgggacgtggtttttgggcgaaaccatgtgtgcacgtgtggccgttgcctgcctcgatgatctgctgaatggattccattccatatgcctcgctcgatgtattcctatccgtccacgcgtccagggatggtttttagggctccgcaaaaagaaaattttttgaatgttatatcggatgttaatttgacctgttgtcggaagagcctttcggacacgaatgaaaaaactaatttcagaactcgcctggaaaccgcgagatggatcttttgagcctaattaacccctcattagcacatatgggttactttagcacttatggctaatcatggattaattaaactcaaaagattcgtcttgcgattttctccataactgtgcaatttttttcatttatctatatttgatgtttcatgtatgtatccaaatattcaatgtgatgtttttgggaaaaaattttatgaactaaacagggccttactaatgcaactacaggtcggtgcatggggctaagttaaattaatctatctattgctgctactcaaaacacaacattgatagatggaatccatagcatctcgatcgataactactactaccagctagcgaaagagtagatatgaaatttcaaaatcgatgtaaatttttgagctatcttgggcttaaccatgcatatgcatccatgcacgcatgtaggttcctggcaaatgcagtagtaggggtggtgaggaaagtgctactacctcaatttctaataaatgacgatgttgtttgatcattcgtattattaaaaaaatatatataattaatatttgttttgtggtgagttattttataatcactaatagtattttaaacacaatttatatttcatgtatttgtataaaatttctttaataaaatgaatgttaaacgtgtgtctaagagtcaaagtcaacagcggacatctatttaaaaaaagaaagtagttaattaggagtaagcaccacattagtagttaatctactgctccgtttactggatggtcaattgctaatcatgtgggcggtcaggttcaacgtttcctgtggtaagatgctgctaccaaatagccacagagacacatgtcaacaaaatcaagcctagctactctcagtactcactgtgttgcggcatctttcaatttattatttttattttttttaaggagcctcactgttgcagcagcaatgcatgtgcaacagacacacaagtcatgcatcttcttcaactctaattaaacatttgcaaatgactattgtaaataaatactggagtactatcatttttctgcttgctagtgttaatcacttaattaataatttagcaattaacccatgtggagatgaagggcaattagcaattgctagtaggttttttttttcttttctgaaactgacggtgcatgggctagattggtgcctttgccgtcagttttgggcatttttcggccggcggaaaactgtgtggcgctcccagttttcggctggggtgtttagagcaagtttaatagtataccccactactatcttcaattcatatattgtcaatctaatagtcaattcatacaatagttgcttaccatactattaatatctggtcccacctgtcatacacatattacgtcttggaatccgtgctgcagctggctacagatctgtagcccgctgctcttctctctcatcctttatcttattaaaaatatatttacagctggctaatagctagctgctcttaggcgttggccgacgtcattcaggccagcttcgctctctgtggcccgggctaccaccctcttgtctgcatgcctgccgcagcccattgctctagggatcgcctatccccatttctgatgctatctatttccgtcccaatatataatattttagaatcatattagattcattttagatttgtagtttcaggataggtctaatctcattctaaattgctacatattaagattaaaattaagattaaaattaagattaagtaaagtcgtataaagcaagaaagttattagtacataattaattgagttttaattattataaacttaaaaaatagatttattcgatagtttagaacaacttttgtaaagaaaattttcgcataaaatatattatttttagtagtttgaaaaacgtgctaaaaatcagtatcttaattagaaaagaacgagcccaggatacaaccaactttgctttactgataatttactgaaaactcctctttttttgtgtgttcttaattaataacaaccaacggggttcacaaaaccgatcagttttcgtgaaactgctatatcttgatttgtgaaaaccgatctgcattagctagtttccataagtcgttgatagaaagtcatcggttttttatatctgttttcgataaatcggtgtggagcggttttcacctcgaaaacaaataagtaggagaaaactgtacagtagttgtcgatccagttcggttagtagggattagcaaagggtagcaagaaactagctacatgattagatcaatcaatcactggctgcccatggtatagatcaccatcctcctccctgtttttcactctatccatggctgctgctgctatacagtcgatgcattgactctttcctctatctgtcactcagcatcgatgtacatagacggatgaaacgctggctaaaattaagctatagatgtctcatgagaaaccaaaccagcagcagttagcagcttgatttgggaaaacagaacttccattcgtacatcaatgatcaatcaatttgttctcttttggccgtattgagctgcgatgataaggcaataagctgtaccgtcgaggtgatgtgacgcgtatcatattgttataccgtttttctgtacgtagatactactaccagcactacattttctgaaggttcacatcacctttgctctgcattagtgcacaattgcacataatgcataagtatgtgctgtatttacaaatctttatagctttggccttcaaagttcacaccaactagctaggggatgcatcatgcatgcatacagtcattagtaatttgtaatgcgctaacacatgttgtcagcgttcatacatagcattatgctgtttttatctttttcacttttttccctttgtcccggcaagaaaatgttctgaataaagggcagacaagacagcaaggaaatttcagaggaagttcagaacggagtgaaaaaaaaaacaaggtactagttctcactgatttcatcatcatcatcttcatcatcaaaactaattaattacattacaacttatagaaccattacacagcaagcacagccatattgtagtagtagcggtttatccaggcttccatcagtcactgtgaagttcagtgttcctcatggcctgaagaaggcagggtgagggtggccggtgccctggaaggaggtgttcttgaggtgttcaggtgcgttctcgaaggagtgcctcctcgccagcgagaggatcttcttgtcggcggcgacgaagtatgccatcccggccgccgtgcagatgatcagcgcctgtcccgtcgggttgatgttggccttcgcccacggcagcatcctcacgctcgccagctgatcgatgaaacaacacacagttcatcgcaagatcagtttggtgagatgcaatgtcaggcgaaactgcgaatgtttcgttgtcggtttaattagctcaccgtcgggacggcggatgccaccgtcgccaccgccgccgccttggctccggcgagcgtcgcctctgcaacaatttcaaccaccaatgtatgagaaccaagatacactatacattgatcaaactgacagttaattagcatacttagctcgcaacaaggagcaggaattctcacctctggagcagcgttttgcgagggcgagcttctggtcgaggtaggcacgagtcaccgtcgacatcagcttcttcttctacaacaacaacgacaagcagagagaggatctagctaccaacacttgcagtagcagtctagcagaaacaccagtctgaatctgtatctgttcttgagagtgggttcagttggcttgcatcgccgagagagcaagaagccgtgtatgattttataggcgtacgaggagaggagtggatgagatgaacctggtggcgcacggccacggttttgggcagaaacccacgagacgggtaggttcaatggacctcttcttccggagttttgggtgtgtttaattcataccaaaatttaaagtttggttgaaattggaacgatgtgatgaaaaagttaaaagtttatgtttaagaaagttttgatgtgatagaaaaagtaaaagtttgaagaaaaatttttgaatctaaactcgacctttacttcttttggaagttggtggccaacctgcgcccgcttcacactccactcattcagatggtagcactggagtacgcttttacgggaccaacgggtttgagagcctgaaactgtggtgccacccactgacccatatgccatgtcctgtttggctaatgggatatgaaaatgatctccaacccaccaaaagacatctttaaattctaatcattcattcttcctctctcatttaatcttaatctttcatttatttctcaatcataatcccatccctcatttcccattatccaaacacacccacacaggatttggggattcgatttaactgaatattttggttggttccttttctacccaaatcccatcttctttatcaggatgggagatctggttaggtagaataagtctatttaactgatcatccactataatgtactgaaagaaaaatgctactagttagtactaaatttttcgttgttacgtagcaacagtattatgagagggatgaataactaatactcggtcatatggttgccggcagtagtaactaattcttttctcgtaggaagaagacacggtagttgaggattggtgagtaattttttagtggccccacgttataccctactctttctatttcatattataaatcgtttgatttttcttttacttaaactttattatgtttattatgtttgattaagtttataggaaaggaaaaagtatgaattacccgataccatcgatgcccgcatgactacttgcaaaaaaaaccttacctgctacttcctccgtttcaaaatataagtcattctagcattttccatattcatattgatgttaatgaatctagacatatatatctatttagatttattaacatcactatgaatgtgagaaatactaaaatgacttatattatgaaacggagaaagtaatagctagtttcttctggtgtggagtttaactgtttatagagtgtcctcgacgtattctgatagctccacctgtcggcttgaaatttcttgaggaaactagcttaggtgtcacctgttgctgcttcctgctaacatgaagtctctagaccaaaagaaaaaacaaggaaaaagagtggagtactatactagtcaatttgctctatcaattctactagttacgtgatcacgtaggctctccacataaactagcacggtgatccgtataattacgcggctagtactgaactaaagttatattacgatatagaattatctacatttattcaatttgaaatcttttttaagaaacagaataatcgacccgctagattttacaacttttacagggtggcccgcgcaattgcacggctagcattgaaataaaattatattacgatgtagaattatctatatttgtttaacttgaaatcttttttaagaaacagaataattgatctgctagattttatagctttcttcactttgttacaaactcttttgtgcgcgcgagtgtgttttggctgtgtgcatcctagttatgcagaggacgggagcattattttatagctttcttcactttgttacaaactcttttgcgtacgtgtgtgtgttttagctgtgtacatcgtagttatgtagcagccaggagtattcttagtatggttgtatcaatttgatgtaattgtctgagattaataaaagctttctttatttaaagaattgcacatatataggcatatctatatgagagagatattatattgctttaaccatatactctctaagggaactaattaataaagtgacaataacaattttcctgcttcaagttcaaaatatgattgagcatctccgatgtactccctatcacgcgccattaaattatatttttataaaaaaaatgttccttcatttttatagtttttagaccataccaattttccctctttgacttcaaaatattatcatgtatctccgataaactccctatactacaccattaaatctatgatttataaacaaatgtttctctgctaccatccctctgctcgtctacattatgtcccttcttttcatttctattgcttgttgctcttcatattgtcttttagcacccgctgccacttcgctactccgttgttgtccctccaatcgactctttgccactacttttcttaatcaggcacaatacaaaattgaacctcaccattttttatagtttttaattagaagctgtcaccaccaacttactcctccgcagcttctcaaattgctccccttggcaagtgatgcctccatactcctttacgcccctccgcacctctttacattaagcaccttacaaatcacgctgaggttctgtttttatagtttgtagaagtcaccgccgacgccaccctcttcatttaccaccctctcagcttgctctccatggcaaccgccatctcgttgcttattttgccgcacactcacttgtatgcctattctgtcatctttcatctttgttatcatcgatactttgtaaaatcgaacatcattatcattagggtttatttttagaagccgtcacttccactttactaatttattgcctcttggctcgctcttcattggcaaccaccatctccctgctcttttgtcgcctatccactcattagcccacgtagtctcgcttccgttttgtcatcaatgcctagcgaaatcgaaatttattcgccgcgattatgttataagtttttattatatttgtgattgtaattttaatgatttcatctttatctggaattcatatgtaaatccagttttgaacttattttatttttatttcaaaagttagttaatcctgtgttgtgtactatatggactgttctttgatatttcttattttaatcgcaaattttagtaatttcaaaattattttcctactttattcagaattttcatgatcttttaaagtttatttggaattagtgttgaaaagcaatttcagaaatattttttttctgagtttcaattactcttacttttgtatatttatagaatgtgctttgctaggttgttcaacttttattattattttgaattttaatgacctttttatggaattcgtattaaaaattcaattttaaaatttattttatcttttacccaaattttaaacaaaatccggcggcttggctctgttattttgtgattgccagcccttgtgtgcagtagtacgttgattgcaagtggcttgatttattgtttgattgcccgtgctattggtttgcttggtatttatttggatgtactgaatcgtgaccagcataggaatcggtgaaagcctaagtggatagggctataggagcatgcaaaagcttctacactagaaaagctatagaaatctaaaggcatctctctacccccatccccatgggctattccttgcctaaccgacacataaaggcatgaacgaatggtggcgacaggtgatggtggcggcaacggtacctctcgccaccacctcgtccccatcccccgccactgccaccttcctaccaacaccttcaaccaccgccaccgccattactgtccctgttggctgcttggctctgtcgatctaaaaaagggaaggggtgaggtgaggagaaggaacggcagcatggtggagatgaagagtacgacgccggccagcgtcctcatagatggtggtgcggccaatggcaatgacggctagggaaggacgaagaggtggtggcagcacatgaagagcagcaccaaaggcgaaggcggaagaggatagagcagtggaagatacgaggctcggggatctctccgacgaaggaatccactccaccggcagccgcgccgatgaaatcgccatccgaccaaatcgcctcctctctcgtgcatcagtggaaatcacatgtatgaccgaggagcgcgcgcaacctgagcctagcgccgggatagccggaacgatgaccacagacagatggagctcgtcgccggcgagctcctccttcacgcgcagcgcgctggtgaacgccacaatcaagagggtggtcgtcgtggtgccgtacaacatctctgtgctccagatcagcaactttgtcgtgccatcgggcgtccttacgaggccacaaccgctgctcccgaccgccgtcgctgccgctccccaaccgccaccgccgccaccgttcccctccgcctcgtccccaccgccaccgccaccgttcctgagagagagagataagggagagagggggaggaagaagggagagggaggatgacatgtgggtcccacaatactttttttatgaatgacatatgggtcccacatatttgttttatttttgtttttatcctaatgccatgtatctacatcagagattagcctagacaaacccaatccggtacctacggaggccggcaagagagatctagtgctatctctgatctcatcgagttcatattcgaggagaaaggctacctcgtcgtcgagtacgagttagtgttcatgccgccaagtcgacgatggctagataggttatcccaatcgtctcaattgttgtattctgtgattttctatatcaattccatataaacaggatgtagggttattgcctgtcagataaggggcctgaacctatataaaagtccttgtcttcatatcttttacctcaatcttgcatatacccttgtcggtaatatgggcccgggggtacccacactaagagagaagggtcctttcctctagccacgtggccgcgtagcttgtcccccccatcgggggggggggggggggggtcgggcgcacgggtaatgagcagccaagaggcgcccatagctgcataggggcctcggggtatcctgtcgcgcccctcgggcctgaggggctgcgtcgccccgaggccctcactcggctgccacgttgctgctgagtgggcagagaaagaggcgctgccaggcgcattgatgggcgacgccccaaccaccaccgccgcatttaatgtggcatggctagtcgtgcgacgttcgattgattgatgtgcgtcaatcgcccttgaccaggctgagactagtcgcaggcggatgagacgggtggcagcgcacccatgctagggctatcaacgagccgagctcgagcgagctcgtctgcctaggctcgagctcgatataagctcgagccgagcctataaaatgttcgagctttttgacaggctcggctcaagctcgatccagctcgagcttgatttttaagtaacacaatatatatttcaaagataatcttataattaatttctagttcatcgtattaatagaagaggaaaaaagaacaaaataaatatatgatgtcaatataagacatacaaataacatatttgatctcctaatttattaaataacaacaaaaatcatatattactagactcgttagaagctcgagctcggctcgacaaagctcgcgagcttagggataggctcgggctcggctcgtctggagctcgagccgaactcgaatcgagcctaggacgagccgagctcgagtagttcgcgagcctcaagcttttttgacaaccctaacccatgccccaccctgtgtcaggtggcgtgggggcaggtatgccccgtctcatcgacgcccggagaccgatgtccgaccggtgcatcccctatgcatgaacccacaaagtctctaagaatttatgagggaatgacaggggatgtccccccgtgtcagacaaaagactgcgctggggatcacctgaggacgggtggccaccttacttccgatctaaggcatgggtggcggctcgaccagagttgatgtgggcccccctccaatgacaagatgtgtagaggcggtgcatgtggtaaccccttaaactataaaaggaggaccttgcctaccgagtaagggggattcggaagatcttgaactctgggggaacgcttgcagattgcactcccggattcaagatcccttgtaacaacctaaacataaacccacacacaggagtagggtattacgcttccaagcggcccgaacctagataatctctggtctcactccccgttcaccatccacctcgctagccgagtccacggcgatgacacactcttgatcatcgcgccctatcccctagccgaactcacaaagggggggggggggtctcacgtcctcccgctagagaggtttacacttcgataaccctggtaccgacgatacccatacaatctaaatatcctagttgtgactatcaaacgtcgacacttcttctctccacagaatcaccatgtttgcatcgaccatcgttgaaggatcgacgcctcagagtagaattccaagtggttctttatagcattgtcggttctcccatccaaaagctttgcaatacatgcccgcttgttcccatggatagcatgagcggcgattataatccggtcctcctcttctgcaccaaagatcacatgtttaacacgcaatgtaaaatattcttgctagactgacacgttggtcccacttgccaatcttctctccctcatgcataatctctccgtccctaaatatttgacaccgttaattttttgacacacgtttaaccgttcgtctattcaaaagcttttttgaaatatgtaaaactctacgaatgcataaaagtatatttaacaatgaatcaaatgatagaaaaataattaacataaattttttttaataggtcaaacatgtgtaaaaaaaaatcaatagtacggagggacgcggccgcaaataagcacgtgtatgggctatttctttggtaagccgtacctgtctcgtgggcttcaaaatcgatggggggcgatttggcccgcgtagccgatttccacgcgggcttcctgcacagatcctgtccgtccatccagtactgatccggtggccgtgatttgctcatagcatggtaggattcctgccctgcatcaccctcccccatcccttcccggagtccctctcgtggcatgccttgtaaagattcttgcggtactggtgtttttttttttttttaatctcttcccatcgccatcgttgttccagtccgtccgaggcagcggagcggctaccctccggtgcgggctccggcgagcacgctcctcctccctcggtaacaggttagctcttttctccaccgccaccgtgccggcgccgaaaggcgtcaacgtgccggcgcggccccaccccgccggcctcctccccctcccctttgccccgctttgcccccgccaccatcaccggcccaccgcccgccctcccagcgccaccttcccccaccccacccggcaaccctaaccctaaccctagttgtcgtgacgcggtcggaaaacgcgcgtgacttcttttgctagcgcgtgcccgctaattagtattcctggttttttcttggtccgattacatgcgtcatcttattggaactttacttcagcgggtcgacttctttcaacgagatcgcttgattgggtggtacaatattgctgttatatatatatatataattcaaaagatcaatatcttcaagcatacagtgtttctttagaaacccccttaatgaatctagtaccagagtaacagcagcacatggaattctgaaaaaaaatatcaccaacttatcttacatggaatattgtgcagtttcagattagttccataatgttcctttttttaattatgaagagcttgactgcttctttggtgctttttgtatgcccggtcttcactaagtggtagaagagaacatgttacatactccctccgtttcatattataagactttctagcattgcccacattcatacagacgttaatgaatttaaacacatatatatgtctagattcattaacatatatatgaatgtggataatgctagaaagtcttataatatgaaaccgaggaagtaccttccaattggaaggtgaagctaggtttgattagtgactaccttaacctgcaccccgaaaaaaatacggaggcttaagtgagctcttttctttctgttgtgtttgtgggaacagcctttgctccaagatgataccataaatgtatgtttggggaacatacttggcactcgaaatacagttggacacaacctaaggaataggcttgtacatcaggtgtgacgttgcactgtccttgtcacgtcagcactccatgctatagctgatagttgaactaacagtggcagaacttcatgtcacgcatggtttttgcaaactccgtaagacatgtacaataacaactagctaatatttacgaacaatcaatatatctacttgttggccatgcacaatttagatgcaagctctgcgactgccaagaaattatgctttttggctaccttcttggtgtttcaggcaaccaaggaaggatcagcaaccctgacataatttacatacttcgcattcctgattagttgctcggttatagttttatattgtcgcttcactgcttatgaccccacattttgcccctttgtttttatttctaaaagaaagttctgcttcagtcttgaaaaatatgtggaaagctaagaggggcggtggtgatctccctagaagctttcataagaatagtagagccttcaagaatgagtggatctcaggtctgctagatcttttcctcttttctgctacacccctggcgttttcacagtttatgtgattattcacagctgctttatgttttattttcttcaactaggtgacctccttcggaactctaagcaagatgtttggactggtctcagtgatgggcttaaatcatatttgtctaaaagtgtcgcttctattattttgttcaatggtgattatatacgcttagtcttctcagttttctaacaagtatatattgaaatgccaccagttataaatgattcaacttgcgatcttctgtaggagacaaaatcttattttcatgctcaggcatagctatagaacaccagttttttacaaagtttttgactactgcaactctggttagagctcttaatgctacgaccaaacaccatgatgacttaaaggttggtgctgacagtcatcctttactaatctgtttacttctgatcattgtgtgctcatttctcgctttttcattttttagattcaagtgcgccttgacggcaccagactgtatgatgggtatatggctgaatatgatttggataatgacttttctgttgtcgaagtctatagtgtccgtgatgttcaggttggacctttccaaagtgcacttgaaagtctgccccatggtgaggtattagctgtagggcatgacacctccggcgaaataatggtcgagactgtggagttgaatggcgattcaaaggtatccgaggatgatagagatcttcattgtaaaatctcaaaggtacacttgcatgatgatatgagcatttcatttttatttctgttaggcatggaggcaacagaaatatttgatttcttgtttgtatttaactcttgttctgtacaactttattttgttcaaatgtaacccgtgttgcttgttttatttcttagccttgggaaggtgggccgcttctttctgttgatggggatatggttggcatgaaccttttttttaccaatagaagagccatttttctaccatggggcacaactctcaatcattacttgacattcgtgcaaaagaagactggccttgtacaataaaaaaaaatgaaggttcacaggtatgtctatttaatcctcgcttctctgtcttgttccttgcctatgattctacccacatagtgtttggcaccatttttcgtataagtgcactggtttgatccattttactttttgattagtagtcaactagtcattttttatgatctgcaggcctgaagcatccataggtgagaaatctaacagccatccagaaggtgagcacacaggcactcctcacaagtgcttaacatcatattgttatgcaaattattgagttcgtaatggtacctatttaaaagctgtgcaagcgtttacatttgtacatcaatattccggccctttcagtagtactcttgtattgttggatcttattagttaacatatgtacaataggtatgttcatgcacgctgacttctaatgctaattgttgctcaggctgttataatgatataactcatgttacatgctatgtatgcgcagagtttatgtgaatttactttttgtgtatagtattagtatatgtcagtgctgatcacttcaccttgttgcaccagtacatggagattttctcaaccaggaacagttagatcttgactccatgggttatcctaagttaccatcctccatgttaggaggtgagtcagtgcttctaaaatttgctgatcttttacagctctcatgtaccactaacaacttattctacaatgtatttatccagctggcatgatcttggttaattcttttgaagacccttttggcgacatatatggtgaaggtgtctggagaaaattcagcagaagagcttctatcctaaatcgcaatgttgtcgcactggcttcattcaatggtgagtttacaacggtgtgacatttactatttcatctctgtttcgattacaactagctggtaaccagaatcatggcatgcaggagaaaaaaggttttttgcatgcacaggtttttttattgaatggagtggatctaagatgattttgacatcagcgagcttggttagagattctggtgatgagaacaagattgatgaaaacttgagggttggtgttcattgttttgtgtctgatgttcttctaaggtgctgtttaaatctgatcactgtattatttgcagattaaagtgtttcttaacaaccaatgcaaagaagggaagttagagcattgcaatctacattacaacattgctctagtcagtgtcaagtaccgtgctcttcgtccattaaatacgagctttgattgcaagtcttctagagtagtggctgtagggcgttgcttcaattctggcacgttaatggctactagtggtcgtctagttccttggacaggcacacttgactgccagttcctcgcatgttccacatgtaaaattactaaggtaataactctcttttttctattaggtgtaatttgactgtctaaaagagagctttgactgtaaattcctgtcattaatttgcttacagttaaaatatggtcatggtaaagtactttggaatatgaatcgaacggtatcttttgatgaaacctagataatattacaattgtgaaagcttgacattggacagactctgctttgtgtttctgacaaagtatatagttgcattggaatgaattagctagcaatgttttcaatagaaaacagtaaatcacaacttatttatgttaacttgctaggctgggattggaagccctcttgttaatcttgatggcaatgttattggcatgaacttctatgacacaagaattggaactcctttcttattatgggaagagatctgcaagattctagcatcgtttgagacaaaaaggtattagcattgttcatgtcagtattctagcattgttcttttttggagcattttaagaagcttgctgaagcataatctgacagtgaatctagtggtgatattggcaatgcctctggtgcgtgtttctggaaaatgccaagagatgtcaaaaataaggttaacaggttggtattccgatccatgttgctatttattaggttgaagttaagttttggatatataagttatttcgttgaaatgaacaggtggtctgtgcccaagccacgctggtgccgtcctgaagatgctgaatctgatgatgatgataagttagcttttgatgatactggccagcttcaatacagttatattttgggacggaaagtcaagctccttcgtctcacaatccccatatcggttccgattgttgaagctaaatccactgatggttagtaatttgtcttcatgaaccttttgccaacaatcctgttgactgttgtgctgactggtctctctccctgatacagtattgcagctctcatattcatctgcttttgttagtcgactccgtccagcaaattttccagcatttttcatatgcagtgctttacccccatttatttttttatatgcagtcatttcatagtttaggacctaaatctgacaaacattttcttactattaatgattctttttctagatgtgcatgtatcctaaacctggttggtcaacctgatatacccttttaatcgacaatttcatttgttacagagcctggagttgatcctttcgcacaaaggaagcaaaagaagaagcgggtagaaaagcaaggaaaaaacagactagagaacttaaagaaagctgcaaaagttggtgctttgccaaggttgtaatcctttactcacctactgcttacccctccctcctatgaattccttttcgtaccagtaaggaacattgagaattatgcagtatagtcatctaacagctctccaatatattttgtgtgcagtcatatacaacttgctgcaacgtccttgcccatcacaggaactaaagctgatcttccgaaaaaatctagaaaagaggatcttgagaatgttgctggcatgggatctgcaacagcaagtggtgggaagtttgatgagaagttgcctggcgagaaacctccaaagcatcctggcaaacataaaaaggtttttatatcttaatggctttgatttatgagtctgcctttgtaggctgaatttgtgaactatagctgaatcatgttgtttctgcagtttatcccagttgctgaaggggagggaatgggcaacctgggaaacagcagaatgacaaaattctgatgtctctacttgccagaaactctgaacagcttgatgtttgcaaggcaagttccaggattcaatggagtatattaaattgtgttttgcccaccatcattggcactgcttgttctgtttgaatgaactaaccgcatctgtaaacatttttgtaagcaggcaaacacaatgtacaaggtgaagaaggaaaagcgaagaaggaaagacagagagatgtcctcgagatctgataagctcaagccccagaagaaacctttcaagaaatcatctaagaaaaaagcttaggtcaacatctttcttgtgacttgtttttggaggtgaccatagttttgaatgctcaaggagacctgttgcatcttcctatgtttgaatctatgggagaattactgttgttcctttataactggttaagagttatgacataggcctgaatgatgatataacaagatcacaaatctctgttatgccctgctatgtgcgtattatattttcaaattttgtttgatgtggtttgcaagtcatctgtattgattcctgaaacccattccaaaggatgtcctgacaaactggtttgtgtgattggttatccagtgacaatctgatgcttggttctcaagtgccaatctgaatcattggataacctgatatccatgcatgtgtcatcgtttgcagttgtattgatatggtttgcttacccagcagcattagtgttgttgaattcgaatgccttggcaaatggcaaccatatatatcagcctctacgtgaactgtctgaagtggatcaatctatgatctctaattttggtagcctggcttggatctaaccgaccaggctaggccaatcttagcttatatggtgtgatgatgttgtcattgctccggtgcgctctttgtgtgtgatctctttggtcgccggcggtccagaaaaccgcatgccgtcgacgaccactgccggtgtagatgtggatgcctcggacgcgtcgcttgcaatgtcttctctttccttcctaaaaggaaaatctctcgtttaatttgcctctccatccccctaatttcagtgcgattctctcaccacagtggccatcgccggagagagatcccctgagacagataggagtcatccaccaccatctccatggggatgctgaatctgatgcgcctcatgtccgtcaagcgccgccgccgccaagtccaagttccccatggtaaaagaacaccatctccttccttattttttcgattatttgaatctgtatatatctatagtatgtacacaaacaaacagaaccaaaaaacaaaagattttactgttgttaagtggtaccaatttttttttaactacgttcatcccaaaaatataaaaaattagtaatggatgagacacatttttttttccagattaatacgtttttatattttgggacagatagaatagtacaaattttcatacctcagagtatcagatataccatcttattaaaaacttgagcatcataaaaagacatgtttttattgagtgcaaggtaggagatcaaaagaggtggtttatctatgatcacaatggctggtggcctccaccttcttgttccttttgctatttaactagattgacccgacgtacatgggtagagaccatactatttattatgctatgtaaaatatgaaaaaaaaaactatatacatgctgaacttcaggttttccccttaagttgataacaagttggtttcttttacaaaactgttagtattgttgcacaaaaggggacaacagaagaaaacaaagataacggattgccatgtgtgcgatggtgtgcttgcttgagttttctgttttattactcaaatgtatgtaaaccaatgttttcaaaatcgctaatgtggcataatcagatgcttatatggtataatcggccacttatatgacttgagtagtataaggttggcgcatccgttccttgtacacggccttgtaaagcttttttaaaacactgatgtaaaccatgcatcttgtgctgcagatggattgattgccttacgggctaaaagaaagtgttcaccctgccaacaagatggcgattctcagggcgctgctgacatagagataccagaccttccagaggtacaccataaataaaatgttgatgatgaaacatcttactagtagtagtgtagtgcaagtaaattatgacgattactgcttcaattgcacaaattggtccaccaacgctattaaagtttatgaacggagcactttgatgctgtaacctcctacagccctgctgcattggaatcttctttgttttgctgccattgaatagcaacatgctattagacaattaaacatcattccatccattctttctggcacaaatgcaaagaaacaaatatgtgctgagcacttaacacctcatttgggtaaagaccatatttgcctagaagaattcaactatacaattcatagtacaatagtacataatcaggcaggtagcattggaccggttaaggtgttactccataagttatcctttctttcttccatctaattcaaccatttgtcttcacaattagtacaatgtttaacttctctcccatatgcttgtgcaagcaggacatctggcgtcttatacattccttgatgccaatgcgagctgctgcccgagctgcctgtgtgtctcgttcctttctaagttcctggagatgccatcccaacctcaatttcagtagtgaagcatttgggttgaatagaaatgcatgtggaaaggaagaattggctggacttttctacagcaaagtcgaccacattctcaaaaggcactcaggcatcggcgtgaaaaaacttacgattaaggtatattcagattatagtgggaagggctcttcatatctcaacaattggcttcagattggtgttaaaccagggattgaagaactcataatttcactgacccagttccaggcaaagtacaatttcccatgctctcttctgtcgaatgggagtggagactcaatccaatatcttcacctttctaactgttccttccacccaacagtcacacttggtggcttaagaagtctgacgagattgtatctctgttgtgtgcgtattacggagaacgagttaagctgctttctttcccattctcttgcattggagcagttggaaatcaggtactgcgataggattgtttgcctgaaggtaccttgcctactgcagcggctcatctccctgaaggtgtttgggtgcgacaatctgaaactgatagaaaatgaagctcctaatgtctccatttttgcatttcaaggggacaaaacgcaactgaaacttggagaaactttgcaaatgaagagcctatgcatggttcgctctggttatgtttatcatgctcgtgctgaacttccatccatcatgccaaatcttgaatctcttgccatgaagtcattcaaagaggtatgagaaattttgcctgacacatgaatgagactagattctgtcttatgggttgtagcataattaatttgacctctttatgcagacggcctttgcaccgaagctgtgtagcaaattcctctgcctcaggcacttgagcattgcccttattggatatttcccagcctatgactatttgtccctggcttcttatattcatgctgcaccttctctggagactttctacctgactgtgagttgccattcatatattattactgctatgaatgaaaattagtagttgtgtggtggaaatgtcacttaaaatttctccctttcacatcctaggtaatgcagcggtacgtgcagaatgtttcaatttttgcacatcctgcagatctgagatcaatacgagaagagcagcatcacagccttaagagtgtgagggtcacatcattcatctctgtaaagagcttggttgagctgacatgccatatccttgagagtacaacttcccttgagtgcttgacattggatgcttctcagactggttttaggtgtgatactcctggcagcaaaattggcaaatgccccccactagatagggacattatcatggaaggtcacagaggggtcttggctatcagaagatacatccagcctagggtaccttccacagtgaagctgaatgttttggagccctgcagctgccattgtactgaactttagatgtcatgtaaaattacccttatcttaattattcgatgtttaatcgtgctgctgttgatgatgattcagctgaatgtttagatgggtcatggtttctatagtttgctattaatgagtaattgatatcat

SEQ ID NO: 16945 - DNA, 3221 bp, Oryza sativa
tatagtttgctattaatgagtaattgatatcatcaccaaatgcacacgatatccaccagtaactccagtttccacctagcagcagtggtgtatgcacattaaaaagttcttactagcaaatgttctcgaacgtctgatttacctagttcagggtggttataaaaagctaaacaactagagtttgtaacaaattttagtgtgtagactttaatttgaaaatttcacctatatatgcatggttttcttaatcttttaattcatctatgtacgtatacataacatcagggctaaacctttcggtttagctaccaaaatttacgaaaaagtttaaaatttttggccgaaataatatcgtatcggagggggtccgaaataaccgaaatttcgttccggaatttccaaccctgcataacatacgtacgcgaatggtagggcaactttttgcatgcatgaatgccacagttggaattaagaatgcccgtaatcgttttcatgcatgattgatggaataagaatcaaacaaaaacatacagtattcaattgttcatctgttgaagaaaaagcaacagacaatatacatataaaactatagcctgtcaaaaccgtcagcaagtgcagactaaaccgccaccttttttttaatcttgattgttcagtttgagacttttttagagacctgtccatataggaggatcgatatatttgaaccaagttaaaaaaaaatgacccatcatctgcagaaaggtggtacacagaacacagtgctcatgttgctgaactacaagcctcatatatataaacccattttatctccagttatttaaccactgcagtaatcaacttgattagtatttcgcacaaacctctctgtttaccgacaatcaatacatagtggtcggaatatatagtagtaccacttgtgatttctgaacattatgaggagtgcatgcactctgcagtagtgttacatgcagtgagccccagtgcaagatagcagtacatgtatttaattaggtggctaatggcagatacgacagagatgagtactaacaccactgctctacagaagcagctctaaatggttctgcaggggcgtacatcgattattatatgacacagggatcgatcgagagctagatactgtgatcaagtttcagattcatgcatgcatatgctgttctaattgttcagggcctgaagaaggcagggtgagggcggccggtgccctggaaggaggtgttcttgaggtgttcaggtgcgttctcgaaggagtgcctcctcgccagcgagaggatcttcttgtcggcggcgacgaagtatgccatcccggccgccgtgcagatgatcagcgcctgccccgtcgggttgatgttggccttcgcccatggcagcatcctcacgctcgccagctgaaataaaccacacacatatgcagataataagttagtacatgtacctgatgagctctgctgatgaatgaagactgaagaaatcacacaaaagctagcagcaagaactgaagaagacgcatttgtgtgtgtgtgtgagagagagatatatatatataaagagagtttactcacggtgggaactgcagaagcgatggtcgcaacggcagccgccttaacccctgcaatgtttgcctctgcagattcacaaagcacgcacgtatatatgcatcagtcgatatatattcagttaataagtgccatggaattcaattaacgcaaagacgaagaacattgtagttcatgactactacacgtaccacgcgagcagcgcttggcgagggcgagcctctgctccaggtgtgcacgggtcaccgttgccatgtaaattagtttcagtcacttagtttttgctgaactgcactagagcagtttgagagagctaggcaagccaatcgactagcgagagagagagagagagatcagaggagtgtgtgagagagtagatcgagtgtagcggcaagcaagggagatggatggattggattggggagaggcatgggggcctgcgaatttataggcaggcaagccaagacccaagagatcgatgtagcggaatgaagaaggaatcagtggacgatggaggcagatagcggcgggcgggggacgtggttttggggcgaaaccatgtgtgcgcgtgtggccgttgccggcaaccgcctccggcctcgatctgcttcacgatgataccatatattccgccacgcacgtacactacctcgcctcgcctcgctcgatctgttcctatccgtccacgcgtccagccatggtttgctgatgcaactacaggtcggtgcctggggctctgccaaagctggattagttttttctttttcttttttgaagcccccaaagctggattacttaagagtatggaccctctgaattgtaggtttgcaaaaaaaaaaagaagataaatacgagaaaaacatgtttctgacatgaatacgagcgtaaaataatgattgcaaaacacatgaatggctgattgattatactgcatgaaaaaagcagaaattagagataggctttaaagaaaatttttcgataggttggagctcttactaagttcattccaaaatctacatgcaatgagtcattatatagaaatttcataggattcggaaacttcatccctttgaatcaaatgatcatagaaaaaattcctataggatttgaatcctatacgagctccttcgacttgtaggaaaataattaaattttgaaggatttcagttctatgagaaaatattttctaaagatttttaaaataaaatattgaataatatcctatcttttaaaattcctatggaatgataaatccagtagagattttgaagataatttagcaagagctctaaccgcctcttggaaaattttcctttgagtttatctttcttatttaattcctacgtttttcctacgatccaatcaaacgatcattcctgtgttttttttacgttttatagttctctgttttgcacttatattcttatcaaaattctacatgttttttttttcatttttctccgtttttccattcatgctatccaaagcggtcctaaaattcataaatgaatcatttgattcaaagggttcttaagttaatagtatagccaatttataaagctaatctaacattatattcataaaatagttacatgtaaatatatatatatatatatatatatatatatatatatatatatgtgt

SEQ ID NO: 16946 - DNA, 36142 bp, Oryza sativa
  unsure (1)..(36142): unsure at all n locations
catcatatttgccacattatatttttgtttatgtgacaatatatttaatgctatgtacactagatacatggagtgatggagggttggggatggccttattttaatccactgctactaatattcactattgattcatggaatccataacatctcactagatgtagacatgaaccaagatcgatgtaattttgagctctctttggggactaattaatcctataactactgcgtgcacatagattcccgactaatgcagttagtgggggcgtgtggtgagcagttaattaattaggagtgagcattttgttaatactacctctcctatctacgaactgccctgtttactggttagtcaaactggctgaacctaatcatgtgggcggtcaggttcaacgttcctgtggtagatgctgctaccaaatggccacagagacgcatgtcaacaagtcaagcctcactctgttgccgcttcttccagaatgcatgtgcaacggacacacaagtcatcttcttcaactcttaaacacttgcaaatgacatatagtaagtactgtaaatactagtgctgttaatgactagcatcaattaataatttagcagttaacccatgtggagatcgagggcaattagcaactagccttttttttttacttttttcctctgatgaaactgaaatgcaccgtgatctgtgatgatcgatccatggttggtggccggccatggcgaatctgccgtcagttttgggcattttttgtggggcggcggaaaactgtgtggcgctcccagttttcggctggtttttagcctcgccgacgtcactcatgctcatgcctgtcttgcactctcactctgtgggctaccacccggccttgtctgctcactagcaatgcattgctgccccactcaaagtacggatcgcttatccatttctgatgcgatctgctccatttcagtctctcccatctcaccttatcatctcctgctagatccaaccaactttgctttactgctattctactgaaaaatactccatccgctctatttataagtgcaattgttataacgcagttgtggttgtttgtgtctaatgttttaccgtttatcttatttttaaaaaatataaaaaataatcgcataaagtactatttattttttatgtaataacaataaaaatactaatcataaaacatttaaataagatggacaatcaaattttgagcacagaaacctacaactttaattaaatgtttagaatcgttatattagaatgtgtcatttaatttaatttggttttttttaacggaaagtgagtagtatgaagggttcggtactgtgcgttagttgtccatccagttgggtttgtggtgatcatcagcaggcaactggttgattagatcaatcaatcactgcccacggtatagatcagatcaccatcctcctccatgtttttcactgtatccgtggccgctgccgttaaactttttcgaacggtcgctgccgttaaacttgaacagttgatatgcatttactctctcctctctctctctctctctgcatatatttatagacggcaaaatgaaaggggactaaggccgtctttagttcttccaaaaaaattttatgtatacagacgcatatttaaaatattaaacatagattaataacaaaacaaattacagattccgcctgtaaatcgtaagacgaatttattaagtctaattaatccatcattagcaaatgtttactgtagctccacattatcatatcaaggcgtaattaggctcaagagatccgtctcgcaatttacatgcaaactgtgtaattgatttttttcgtccacatttaatgctccatgcatatgtgtcagggttatagataccacatatttaatagtagttgactaaatctcggcaggacccaccacatactatgtcttatatggaaatatccttcagatataagaggagttccgcgtaaggaaggaagaatagagttttatatggaaacgacaaaaactactcgaattgtatccatattggtttccctagttctacatgaaaaatggaacacctatggatataaatacaagacaccttaggaggagaggggagagggaacaacagatcaagatacatatcaacatacaagccaatatacgccaagacgtgccgccggatatcgacatcagagatatgcctggactgaccctatccggtacctacagaggccggttgtagagatctagcgatgcctctgatctcgccgagcacggattcgaggagaaaaactaccctgttgtcgatacttcaatccactatgtcgacaacagttagataagttaccccaaatattgtactggtgtgatcatagtgaataagagcaacgaccggcttcagccaacaggagtagggttattatctgataattcaggggcccgaaactgtataaaaatcctcctctccgtctcttttacctaagtctcgcatatatcctagtaccaacgatccccatactatgcaaataccggaatcgcgacatcaaacgttgacaatatgtccaaatattttatgtgacgaaatttttaaaagtttgaatggaactaaacacaaacacagcctaacttttaggaaatgcacttggtagcgttaattgtaagggatatgccaatttaatttcaactctaagatactattttcaattcctaaacaatttttttaagaaaagcatctggagaaacatttctttctacaaatctcttttttttcgaagttaagctataaaagaattcattctctataaaaccagcagcagtttagctggttgatttgggaaaacagaacttcgttcgtacatcaatcttggttactttggccatatattgagctggcgatatgctataccggcgaggtgacgtggcgtcgtcatgtatccgtaccagtctaccagatcactgtaccgttgctctgttactgtatatactagcagtactacattttctgaaggttcacatcacctttgctttgcattagtgcactctgaaaaacttgacactgcttatccaatatccactacattattcaatactagtataaaagtactcccttgtgaaaaagaaaagattcatgtatgaaagttgtctcttttttttttgactatcggagagtatgtgctatctgaaaatctttttaattatagcttttggcttcaaatttcacaccaactaactagctaggggataagtgttcatcaactgttttgaagaaggtgaagacatcaacgagttttcagatgaagttcagaacagggtaaaaaaacaaagtactagttctcattgatttcattttcatcatcaacaacaacaaaactaattacatcacaacttatagaaccattacgcatgaactcagcagcagtagcagtttatccaggcttccatcagtcactgtgaaagttcagtgttcctcatggcctgaagaaggctgggtgagggcggccggtgccctggaaggaggtgttcttgaggtgctccggtgcgccctcgaacgagtgcttcctcgccagcgagaggatcttcttgtcggcggcgacgaagtatgccatcccagccgccgtgcagatgatcagcgcctgacccgtcgggttgatgttggccttcgcccatggcagcatcctcacgctcgccaactgaatttttttacagcagcagatttcatcgcaagatcagtacacaaggaaaaaactctgaaaatctgaatgtttcgttgtcagtttagctcaccgttgggacggcggatgccaccgtcgccaccgccgcagccttggctccggcgagcgtcgcctctgcaacaattcaaccaccaatgtaagaaccaagctacagtgactgaccgtcaggtaaatcacttataagcagcataaatgttcacctctggagcagcgcttggcgagtgcgagcttctgatccaagtaggcacgagtcaccgtcgacatcttcttcttcttcttcttctacaacaacaaccaaccaagaacaacgagaagcagagaggaatcagctacaattgtttgaatctgttcttgagttcgttcagttggcttgcattgccaagagagcaagaagccgtatgattttataggcgtacgaggagatcgaggagtggatgggatgaacttggtggcgcgcggccacggttttgtgcagaaacccacgagccgggtaggttcaatggacctctgcttccggagttttactcgtttggaagttggtggccaacctgcacactgcatagtgcactccactcattcagaaagcagcagctagcactgtacatttgtacaacgctttacagggaccaacggatttgagcctgaaactgtggtgcacccacagggtttggggattcgatttaactaaatattttggttgcttggttccttttctacccaaaatcttgaatttttcttcaggatgatatggtctgagagatctggttaggtagaagaataactctagttaattagctactcctacttgtagtagtctaggtagaacgtagctagcatggatgcatgatattctggagagaaattataatgttctcaagctttgcctaatggagtgcaagaaacacaatttgcaggattcaaagcgctgaaaaaattattcgattgtgctgagatactagtgatggagtcaaaacggtgaccgaattgggagaatcgattcaacacgcgaatacggatgcattaggtttggagtttttgacaaaacgaatttttttgcttgtgtttactctatctggttcatagattctaaggagatttggagaaaccggcacgtttgttctctgaagaagaacaaggtaggtgaagccagccagccacagtaaacagctgaatatttttagcatttgaacccatccgtgaacaaccatgatttgcatacgaatgcgacgaccagagtgacgcgttgtgttgtgattttgccatcagttttgctctgaatccgtggatgtgttgccggcagtttttgctctgacggatgacgctcctagttttcgggcgaaaccggctcagtcagcagcagtagcaacgtctctctctctcaaagttgcaaaggcataattctgtgagctgaaacgcgtgtgtgcataggctgtttggtaatgcttccaatgaacttctagactttttgcaggtttgctctgggcccacctgtcaggccggcaccgtacgtacgcaggaatactccatccactgtagtatacgtttttcgaaccgttaaatgatatttttaagaaaaaaagttatatgtgaaaattgttttattttaattcattttcttaaaaaaactaataattaattaattatgtgctaatgaattgttctgttttacatgcgcacaaaggattaatttccaacaaagacatccgaatatagcctatatgtagctctactagtgaaaattacagttagtcactgtagacttcaaaactgacggaaaattgatactagcactaaatctgcttgatcagaaaaaaattactgtaattctggagtcactaaacaacgaacatgagatttggcctctgcattttctgaaagagcaagatcgatcgccggccggtctgaaaaaccgtaggccgccggtcggctgaacgtcatcgatggccgctcctgttttgtgggcgtcgccatcggcacccaccagcagcaccccttcctgtccatttcttaccatgtctgcagatgatctccatctgtgtgggctctctctgcatctctgtcgttttctatagcacacaaaattaaagcaggataagaaaaagctgttcgctcttttgcgttgcctgatggggccgacgtcgcatgattgcagtatggcgccgtcgtgcgccgcaattcgattttctgatccgcagctgatattaatcggttgtttttctgcttcgatcgaccaagcgtcgtcatcttcatctgatagctttctgtacgttttgggactgaatgctactgctgctagctactccaggtgggtgagaattgtctgtaacttgctcgaatgtgctagctaatttactctcaagtgcagatatctgaaaggagattcagatcagtggatttgtctttcttcagtctagatactcgtgtgacattttctctgaagatctggagcttccatttcgctttcttgtgcagatacaaatgagagttctttttacttttagacgtcttatatacgagtgttctaggggacgtttacaaaatgtataggcagttcaaattcgttcgagttcaaggaacaagaaacatgtactacagtgcacatgaaccaccgcatccattcttgagttcatcaaattaagattgtttattaatacaagctggagcatacagtatattacatccaagtacacaacactagctactttctgcagcagattgcaagcagcactagcttgctgatcatggcctgaagaaggcagggtgagggcggccggtgccctggaaggaggtgttcttgaggtgttcaggtgcgttctcgaaggagtgcctcctggccagcgagaggatcttcttgtcggcggcgacgaagtatgccatcccggccgccgtgcagatgatcagcgcctgccccgtcgggttgatgttggccttcgcccatggcagcatcctcacgctcgccagctgatcgatgaaacaacacacatatgcagctaataagttagtacacctactctctgctgaagaatcaacacaaggaggaattagaagaagctagtagcatctgagcacactcacggttggaacggcagaggcgatggtcgcgacagcagccgccttaacccctgcaaggttcgcctctgcagatcgacgaagcatacatcagtttgtatatattcagttattagcgccatggaatgcaagacaaagcgagattaaacatggtggtttagtgtgcgtgcgtacgtaccccgggagcagcgcttggcgagggcgagcctctgctccaggtgagcacgggtcaccgtcgtcgacattgtcgagcaagatcgatggagctgagaagaaactagtcctgaagtgaagtagctgggaggtggagagaatcgcctactggttggatcagtagtgctgagcgagatgagatgagatgagattgaagaggagggggtctggatttataggcgagagaatgcgatcatcggatgatgcgaaggcagcaaggtgggggagcacgcacgcaccaaggagaggagacgaccatggttttgaggtgaaaaccacgagtggttgcatatgctggagtggtcggtggcactgtgctcgatctgccccctgttgaggatggattctaatctaatctctcgggtggacgttcacccgtttcttacatgtcacctaaataattatgaaaaaattctaaaaaaattcacaagataggttaatatgtaatatatctcttcacaaacatgcaagttcaaattcgacttctacaagttgtaacaaaaataacaaatcaaactctaactagtatacgtatattcacagtcaaatttgttatttttgttataatttttagaagtcttgttatttttgttataatttttagaagtcgaatttgaacttacatatttgtgaagtgatatattatatattaacctatcatgtcaattttttttaaaatttttcataactatttaaatgacatgcaagaaacggatgtacgttcacccaagtatttaaaagagtttcccgcaccctgttttctctgacgtacttctccactccacgtacgtatgtatgtgctccgtacatgccttcttttcagtagatcctgaacattttcagagttaaaaagaaaagagtattatcggttttactgccaaaagaaaaacttttcagagtcgaaatgaatctgagcggcacgtggcaggtgacattggccggtttgtcagcctgcctgattatctttaagagcaaatttaatggtatagctaacttattatttattagcttatactacttgagctaatatgtataataagttaaccatgtctaactaacttatttgacaatgcagtgctaaaataaatattaaattaaatatgtgttaattatagattaattaggattaatagatttatctcataaattagcctctatctgtgtaattagtctatatttaatactttaaattagtgtctaaacatccgatgtgatagagactaaagtttagtctttgtattcaaacaccccctcaagatgatgcatgcgtgtgcactatgctagcgtgccctcggttttgggtcgatcgatgagctgcattttccttaaaaaaaaaagctatcctataaatatatctaaaaaaattattattcttttcgtggcgctaacataattgacatcatgatccaacatgacggtggtcacggcgctaacaacattggcactatctcccttcacattagtgatttagatttcactgaggggctatggggatagcgtcaacgtcattaacgtcttcacgttggaccacggcgccaataacattggcgccacaaaaacaaccatttttaaaataagttttcttaggggtatatttgtagaataagttttctaaatggtaggaaggtttgataatcagctttcgagaatttacagaaattgggtttcccagcttctatttctagtttattttctgaattttttaactacagcttttgagaatatggatgaaaagctaactatatatatgagggagtttttgattttagcagaagctggactgtttgtgctgatatgctagtgataggaattggtgacggaattagtcaaatcgattcaacactcgcatacgcatgcattagggttcgagttggacaccgccgaatttttactcatgttttacttgatccgattcatagatttttcggagatatggagacccggccgtcatgtgtacgtactgaaccggcactttttgttctctgaagaagaacaaggtagggtgaagccagccagccacagtaaacagctgaattttgtatagtagcatttgaacggcacccgtgaacaaccatgcatgattcatgcacacgaatgcgacgaccatcgtgacgcgttgtgttgtgattttgccgtcagttttggtctgaatccgtggatgtgtgccgctcggttgccggcagttttcgctctgacgaacgcgacgcgaccgcgaaaacgctcctagttttcgggcgaaaccggttcagtcagcagcagcagcagcagcaacgtcgattctgtgagctgcgtgtatggccaccagcatattttataggctgtcaggttgccgtgggcccacctgtcaggccggcactgtatgtatatacgtacattgtgcaagtactatacgtagctctagtacacgtattgccagtagagaaaactacagttatactctcaccttgcctcaaaactgactgtaaaatttcttaacttttctcccccaaaaagataaccgtaaattaaatctgaagggcaactaaacatcttggcccttgtgttttctgaaacaggatagatcgatcagtcgatggcatgagcgccgccggtttgtgggcgatcggcaccatcacaccagcagctagcattaccgtcctgtccacttcttgtatcatgtctgaagataatctctccatctgtgtgggggctctctgcatctatctgtgtctttttttagcgcacaaaagtcgaaagcaggataagaaaagctgttcgctctctgcgttgcttgatggggccgacgtcgcatgattgcagtatggcgttgtgcgccgcaatctaaatttctccgcagctgatattaatcacctgtttgtgcttcgaccaagagtcatcttcatctaatagctttctgttcggtagatgggtgaagattgtctgtaattaacttgctcaaatgtgctggctagctaattactctgaaatgcccatgtagggctaattcctatgatattctctctgtaacaagtatctgcaacttccatatcatttttcttgtatagatacatatgagagttagtagtagttcttttttttttacacagttacttcttatacttgagagtagttcacaggctgacagacagtttctaatttgttggcgtcgttggaagagcaagaaacttgtagaatgcacatgaaccacaaaaccaccacatcaatgtaattcgttctcaagttcaaaagatttgtttattagtactacaaactggagatacagacatacagtatactacatcgatccaagtacacagcaaacactttctgaagcagcagctagcctagcaatgcaagcagcattttttttttctatagctagttgattaggagaaattcatggcctgaagaaggcagggtgagggcggccggcgccctggaaggaggtgttcttgaggtgctccggtgcgttctcgaaggagtgcctcctcgccagcgagaggatcttcttgtcggcggccacgaagtatgccatcccggccgccgtgcagatgatcagcgcctgccccgtcgggttgatgttcgccttcgcccatggcagcatcctcacgctcgccagctgatcgatgaaacaacacataaaatgtgctctaagttagtactcctactctgctaatgaagaactgacacgagaaaaagggctaattaatcctagcgtagcatgatctgagatagtagacacttacggttggaacggcggaggcgatggtcgcaacggcagccgccttaacccctgcaatgttcgcctctgcaggtattatgcatcagtttatattcagttaggtgccatggaattcaattaacgcaaagacgaagaacattgtaggagtagttgatgacttcgtatacgtaccacgcgagcagcgcttggccagggcgagcctctgctccaggtgagcacgggtcaccgttgccatcgcgatcaagacgatgatgggatgggagctgaagagaaagtctgaagcgaaggaggtgattaacccaaggagatcgaggagtactggctactagtttgatcgagagtgagttgagatggtgcttgaaggggagctctggatttataggcagcagcaagcaacgcaatgcaagggaggaggatgcgaaggcagcaaggcgggaagcatgaaggagaccatggttttgaggtgaaaccacgagtgggagtgggagggacgaatcgggaggcggttgcatgctggattggtcggtggcactatgctctctctgaaaccgggggcatttaactgttctctctctgaaaccgggggcttttaactgtttgccacttgaaataactatttgccatcaatgacatgtggcgcttattatactcccttcgttttaaaatgtttgacaccattcgtcttattaaaaaaatttatgaaatatgtaaaactatatgtgtatatgaaagtatatttaacaatgaatcaaataatatgaaaataataaataattacttaaatttgttgaataagataaatagtcaaatacgtactaaaaagtcaacggtgtcaaacattttgaaacggatggagcatgttgtacccgactcttttcagtacatctagtcaattttcagagttaaaaggtactgcgaaaaagaattttgagttttcagaggcgagatgaatctgaccgtccagaacagaacggcgacacgtgggaggtgacacgtactggccggtttgtcagtctgcctggctaatttttttttttacatctgattagtataagcaattaagcatacgcggaagtgagaaaaaacgagttataaacttgttctaccagctgtgctccaagatatgatgggccaaatataatgatgtagtgtatatttacatgaaaaatattttttatacgctagtaaattggctatggatgatatgacgatgttttaatttttagaactagcatatgcttacgctattaaatttgctctgatgactttaagtaatccatagtactctatccgtactcgcaaaggaagtcgtttaggatcaaacccttgggaatataaatcatgaataactcttaatttgttgagtttgaaaatataaaaattatatgaatagatttgttttaaaaatacttttataaaagtatacatatatcacttttcaataaatatttttatagaaacaataagtcaaagttgtgttttggagaccgtttcgctgtccaaaacatctttctttacgagtacgagaagagaatataatcgaatgcatgaatgagcagtggataagattgtctactactgcaatggacggaagctgcatggatagctggagaagatgaagcatatgtgtgtgcactgtgaagcgtgccctccagccctcggttttgggggcagccgtcgtctcgtctcgtctcccacgaaacaaggaaatccgccgcggtttcagcttggccgttgcagactggcggtttgccgacccaaccgaccatctgtgactgacacgtgggccccacatgtcagctgccgtactgctgaacagtcagataatactgtacgatggagaaactgtagtacggtttgttgggccaaaactacggccagtgttccttcccgtatatcgtggtgaacatacggcccaaacaaagttgggccgtaaagattccgaggtttaacgtgggccgtcgttgttggccaatttattgcgggcctaatggaagcccatatatcagttgggcctagaacggggatcgctgttaaacgtgtggcccatgctattactgtcagatgtctatttccttgagccgttcaaaggccgatagacagacagcgatagaagctactccgacaatcggccggctatcgggcaggctggcaaagatgccggccgtacttgagccttcagcttcagctccaactcgtggttgcaattcaaggcgtgtaaataatccgtggtaataattcgaccagtcagtcacaaatatctagattttacctcgttttcccgttaatacgttttttaaactaataaacggtgcgttccgtcgtctgtgcgaaaacattctatataaaagttgctttaaaatatcacatatatccatttgtcaagtttgtaataattataatttatttaatcatacatatgctaatagctttcttatttcacatactctaacttaatctttattttcatcagtttcagacaccacctacttagtgctctctctattctaaaataagtgcagcctttagtttaaatttgaatatctgtatttattttgaaaagaatgtacgactataaagcgatgtttttgttcagactaattattactccagttcgatacaaagacgatgacccgcactagtcaagtcttttctgatgcagaaactttcaggacgatattgttgttgcttggtgcaaacgaataaaaaggcagcttatcagcatgttcgatgtctctatgtataggaggtattcatcgtatggtcacaggagtatctgagggacagggaaagtacgtagcataatacatggcttgctctttactttcaggtcagaagctctcataccttactatacaggctcatagttaattcttgcatgctcaagtattttgtaaagttgagatgtttagaggttcaaatatataggaatgttacgtgcatatggtagaagaattaactcaaaaagtcttttttttggacgttgtatccgttcctttgacatgcaaatttactttgcgaggatagtatatactccctctgaccataaatatttgacgccgttgactttttaaaacatgtttgaccgttcatcttattcaaaaaatttaaataattattaattttttttctatcatttgattcattgttgaatatacttatatatatatatatatatatatatatagttttatatatttcacaaaagtttttgaataaaacgaacggtcaaacatgttttaaaaagtcaacgacgttaaatatttagggacggaggtagtatgtttttggtgtttaacgaagaacaaagagaatccataaaattgaaggtccggccctggtgtatgataatttgccgttattttggattggtgttgttttatcttgtctgtcaacgaaatgaggcaaatcttttgccttggaacgatttcaagcattatcgatagaatattggtaatgaagggttttccttaaagttctggtaggagtttatcgctacccggcgataaccacacggttaccaagaaaaacacgaggtttcagaaactaatattgacggagcgtggggctcctcaccgggagaccgcgcaggcccccctttaccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcaccatttctctcttttttgtggggacttaccccccccccctttttcataaatggacggagatttgtataattgccgtccgagtcaccttctgatgagacggcccacaactacctccactttcgccgggagcaggtgcgacgtggaatcgtggctgtctactgacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctgggaggtaacacgctagctccagctggggatgagcgcctagaagccctcgtcctgacgggatggggcgatgcgtgcgtcagatcgtctgtcgccacctaacccgcgatctgaccggtctgtgactggtcacagaccggataaacgagtgcactgcactgcgttacatgcggcgtgacacgctcagccaaaccgcaataaatgtggttaggtgagtcccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagtagccctcggcgttatgccagggcgatcgccctctttaagggaaacggtcgggcgtgacgccactcctaagacctggtgacaggtgggaccggtctccacaattgggcagaaacccaacggtcacaaaccacgcacatcggcaatggtaactcggctgtcaacaatgagcggtctcttcaagactgccacattacttgagtagcacacgaatctggacatggcgattcgtttcgtctgaagatatggtaacgtcgcttcggtcggcgagcgtaattaacgcgcacacgatatgatctacgcacgatatgatctatctcgactgccacaaccgcatacccacctcatgcgccgcaagcgggcgaatgggattagtggaagcgtgggcgcgagaaacgagggggcgaaatagtgggcgcgagaagcgaggagccgggcacagcgttggcaagagtataaaggcactgaggaagggatctgtttccttcctttcgccattattccccttgtcttcgccgcttgcgccctaactccttctttcatgtgccctaccttcgccacacacgctcgctcttaatcttctcttcctccggcgccatggcacggggttccgctctgctcgatggtagcgtgctgccgccttcccggatcgtgagcgagaggcaggctgggctgtcgcgccgcttcatgccggaatctgccaccggccgggagatagtcacgctgggcgagggacgcccggcgccagactacccggggcggtccgtcttctttctcccctatgcaatggcagggctggttccaccattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttcttcaccgtgcagtcggtgtcgccgccatcggtagtcggtggctgctacttccagccatgggggccggtgctgaaccgctacatcccctgcgccctccgcaagaagtgggacgactggaagagcgactggttctacactcccctcgccgacgaagcgcgcctccgacttccgagccagcccccggcgcaggcctccagctggcgggcgccggtagatctgggggatggctatgacgccgtcctcgaccgcctggcgggcctacgatcccaggggctcacaggggccatggtgtacggcgactacctccgttgtcggattgcgccgctccagcgaacgcgctcggggcgcttgggagtacaccgggtccgaagacttcacgaggacccaccagggagtgagatgggactgggctcctgaggacttcaagatattggtccaacgggtgctgaatctcaactccgtagaggcggccctcattccccaaggaatcctccccctctgcagcgatccagaccgtgcctccatcctgaccattatgatggcggtcggggcctcagaggagcgagctccaaagggccacgacggcgcaggcgggagccgcaggggggaacaatctaccccgagagggggtcgtgcttctgggtcccgcgacaggggcccggggagcagccgccctgccgacgcccgggggaagaggaagcagggaggaacacctcccccatctcctccccgagggggcggggcggcgcgtgccagtaacaggcgcccggagggggccgcgccaacatcgcagcccgagggggagcgcaagaagaagcggccccgtaagatgggggagacagaaccatctcggggaaacctcatttcccctccaaagtggtcgtttaaccgaccccctcgcaggttcgtctctcacccatcgtggctgtattcattctctcaacgcgagttttcactcacccatcttgttcgtcttctggttttttcttttgtttcagcgagatcccgtcgcgtccctcccgccattccaagtccggccagtctgaggccgaggatccggcggccgcagaggccctcaggcgggaatctgaccggcgagaggccgcggatcgcctacgggaagccgaggagaccgcccaggaggccgcccgggctcgccaggccgaggaaaccgctcgggaggaggccgcccgggcccgccaggccggggaagccgctcgggaggaggccggatttcgccaggacgaggcgatggcgacttccgaggcagctcgcgacgaggccgcgggcgcgtcgcttgggcccactccctcaggcgacactcaggcgacaacttccggggcagctggcgaagaggccgcgggcgcgtcgcttgggcctactccctcgggcgacgctcaggaccaaccgggtccgggggacatccccgagtccggcacttccatcggcggcccgagccgcgtggcatcctctccaaggcggctcttccccacgccttctatcgccctactgaacgcagagccccttctgcaggccttggccgccgcaaacaccacggtgttggatgggttaagtgcccaggtggaggtcctgcaggcagagcgggcggagctcgacgccgcgtgggcgcgtgtcgaagaggggcgacgctcggtggaggccatggtggaggtgggccgtaaggctcaccgccggcatgtctcggagcttgaaactcgtaagaaggtgctggcggagatcgccaaggaagtggaggaggagcggggggctgccctcattgccaccaccgtgatgaacgaggcgcaggacaccctccgccttcaatacgggagctgggaggcggagctagggaagaagctcgacgccacccagggggtgcttgacgctgccgctgcccgagaacagcgggcggcggagaccgaagcggcgtcccggcggcgcgaagaggcccttgaggcgcgcgccatggcgctggaagagcgcgcctgcgtcgtggagagggatctggcggaccgcaaggccgccgtcaccatccgggaagcaacgctggcggcgcacgaggctgcctgcgccgaagaagagttcacgctccgcctccgcgaggacgcgctcaccgaacgggagcgagctctcgagggggccgaggccgcggcgcaacagctggcggtcaacctgtccctccgcgaggcagcgcaggaggagcaggcgcgccgcaatctggaaggtgcccgcgccgagagggccgtactgaaccaacgggccgctgagctcgaggcgcgggcgaaggagctggacgcgagggcgcgcagcggcggggcggccacgggcgaaagcgacttagccgcccgcctcgcagctgccgaacgcaccatcgccgatctgcagggcgtgctggactcgtccgccggggaggtcgaaaccctccgcttggcaggcgaggtagggcccggcatgctttgggacgccgtctcccgcctagattgcgccggtcggcaagtgggcctctggagagggcggaccgtaaagtacgccgccaaccagggaggcctcgcccagcgcctctcgaagatggccggggctctccaacggctccccgaggagctcgagaagacaattaagtcatcctcgagggacctcgcccaaggagcggtggagctcgtcctggcgagttaccaggccagggaccccaatttctctccatggatggcgctggatgagttccctcctgggaccgaggaccgcgcgcgcgcgcaggtccgggatgccgccgaccatatcgtcgacagcttcgagggctcggcccctcggcttgcgttcgcccccaactccgacgaggagggcaatgccggtggtgcagacgacagtgacgtcgaggccggcgatccgggcgcatcggattgagtccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgccgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggttcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgacccccccctcaggggtagaagcgacgaaggtgttcgatgttccacgggttaggcagctcagtgccgtcgcccgtggctagccgtatggagcccggccgggggacgccgaccactcgatacggaccctcccacattggtgaaagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccccggttgctcggcttggtgtagttcggtttgcccagagcaccgctggcaactcctcgatccatgaatcgccgtgcttcttgagtatgttgaaggtcttggttttaaggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacagtcccaggatatcgagtccccagacagcaaatggccacgaaagtggtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgccaaaatggcgctccatacgccgtacttggcgcacgtaggcgtccatctgcgggtcagagcaccggtactccttacagacttggttaacgaccagctgagagtcgcctaacaccaggaggcggcggatccccagtccagctgccactcttagtccggcaaggagtccctcgtattctgccatattattggtcgctcgaaagtcgaggcggaccaagtatctgaggacgtctccgctcggagaggtcaacgtgacccccgcaccggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatacgcctggaaataatggcgcagtttcctcgaggccatcagaatagcgtaaagcatcttctgggcctgagggtatcgggttttggcgtcccggagggcctcactaacaaagtagacgggccgctgcacctttcggtggggccgatcctcttcgctaggggccgcatccctggggcactcttcgtccaagcagccttgcggggcgcacttatcttctgtgctgatgacctcagggtcggaggataacaggggcggccttcccacagtggcttcggggccgtcctgggggtcgggggctcctggcgtcgtcggaaaagcgggcaaagggccaactccggtcgtcaggggccttaggcctccgttcggctcgggggcctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccccgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattggttacccaaagaaattcgagtagtacgttgaaaagtaggacctgcattctttaacccgaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcacggatgaatccggcttccagaagtcgcgccacctcctcgcggatgaaggcttgacgtttcggggcctgccgccgcactttctgccggaccggccttgcgcccggccgcacggcgagacggtgctcaatcacctccctagggaccccgggcatatccgccggtctccatgcgaagacgtcagcgtttgcccgcaggaaggagacgagcgcgtcttcctatttgccatccagaagaccaccgatccgtgtggtcttggacgggccgtcgcccagggcaacctccttgaccgggacctcatcgcctgtgatcatccgttgcctcggggtggcgggggcggaagcgccaagcctctcgtcgccaccctcgggcttggatgcagcggcgaggtggtccgcgcgctgctccagacaagcgagcgtgactttgaggtcgccatggacagagatggggccaccggggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggtcacgtgtgccccggcgtcacaccgataattggctgggacggccggagcaccatccccggggccttgatggcgtcaaaggccgcaggggaaaggatgttgagggccgctcccccatcaatgaggacacgccccaacttcacgttgcaaacggtgggagaaaccaccatcgcaatctgccctccccgggcaacgcacggtgggtggtcggtctggtcgaaggtgagggcaacctccgaccaccgcgcccgacacgtcgcctcatgagtaggggccgcggccagaagctctcgcttcatggccttgaagctccggcgagaaacgtgagcacacgctcccccatcgacggtggcaatggtggccccaggctcttggaaacctaggtcatcatcgccgtcatcgatgtcctcggcggaggccttctgcttggcctcacttcgccgattaccggaaggaaccgccggggatttgccctctcggcgctcctgcctcctctcctcctcccacttcctcgtccgttcagccaaacttttgactgcacggcagtccgcgagatcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcatcggtatgggctgacctcttcttcctcctcctgtcacgccgccctatctgagcggcggatccgggggcggccgaagctgccacaccggaaccggaggggttctaagtccatgcctcctccttatgagccactcggtccgcgagctgaaaaagctccgcggtagtctggggctccttggaggcgatcttttcaagcatgcggttgtgccgcacaccccccctgaacgcgtaaatcaccgcgtgcgcagggatgcatggtatggtgttgcggacttgacagaaccgctgaatgtacgagcgaagtgactcatcatcccttcgctgtactgcgtgcaagtccgcttcctcacctgggcgcggatatgtgccttggaagttcatggtgaactgttggcacaaatcctcccaagagtggacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgccacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcctgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaagcttggcgcacacgaaagagtgcgagagctcaaaaaatccctcgcagagccccctacctggcgcgccagatgacggagcgtggggctcctcaccgggagaccgcgcaggcccccctttgccggttcggccggggactcagggagagattctaagctctctatatgtggaaggctcgcgagacaggaaacacacaagacacgggtgatgtatacaggttcgggccgctgagaagcgtaataccctactcctgtgttttgggagatctgtgtatgaaggagctacaaagtatcagccagcctctcccttgttctgggtttctaatctggaaaagtctagtcccccctctcagtggacaaggtcctccttttatatcttaaggggataccacatgcaccatttctctctttttttgtggggacttacccccccccctttttcataaatggacggagatttgtatagttgccgtccgagtcaccttctgatgagacggcccacaactacctccactttcgccgggagcaggtgcgacgtggaatcgtggctgtctactaacgacatgaccggtatcagaccagtcacgtcggtcattcttgtccaccacgtgtcagcttagcaatctacatgctcgcccttcttcacacaacatcttgcctgtaatggttaggatgaagcctggcatatatctgaccaggactaacgtgccatctctaggaggtaacacgctagctccagctggggacgagcgcctagaagccctcgtcctgacgggatggggcgaggcgtgcgtcagatcgcctgtcgccacctaacccgcgatctgaccggtctgtgactggtcacagaccggataaacgagtgcactgcactgcgttacatgcggcgtgacacgctcagccaaaccgcaataaatgtggttaggtgagtcccactgtgctcacctaacccatacacgcggagcaaaaacccacgaggggtcggggcgcctcggccctcggggccgaggggggtgcggcccgaccccctcggggggactaagaggagggcgaacgcatcaccctcgggcccgacgtccctcgggggtaccaggctacgtgtgcgattgtgtctgcctcaaacctctagtcatgatactcctgatcccatgtcaccgacaaatatggttacgacggtattgtaagagcaggcacaatagcatactataaaccaactataaacacacatcgagaagaacaaatttgtagccagctgcagcacaaatacaagacacaatgtttgtctgataagtgggaccaggtattactagtgtggtacatatttataaacaactattgtataaattgactgttaaattaactatagatgatttgaatctagtactattaaacttgctctaaacctctttgctcattacctgggtaagaagttaggtccccatcgtttggttttttatggaataaaaataaatttataggtaaaacttttatatagatgttcttggtggcttaaaaatcaatgttgaaaaagaaactatattgaaaatatcacaaaatcaaaaatttaaattttggctttttcttttactgattaggccatccgatgggagccttagtacttgtggcaaccagcctgatgctgctgatactacagcatagtggtgcatctgacggggctagggctgggtctggaagtatctggcagccccagcccgattgtccagctccagcgaagtgcggcaacgtcaacattccctacccgtttggcataagagaaggttgcttccgaccgaagggcggctttaatatctcatgcaagcaagaacaagcttatattgggtcagattttctgattaaaataaatattttatcttgatttctgttagcacgttctttcaaattgttaaacggtgaatttcatgcggaaactaaaaattactttaaaatatcagataaattcattttcaagtttaaaataattaactactcctgtactaacggttttcctgtactatacctttatcagaccggacattagggtcacgaattttgatgtagtccagagtgaggctcgcatcctgaccgatataccatcagggacggtagcatggaagtacaacaatgaatttgatccaattgcatggacgtccagaggaggattacgacttggtaatcaccatatggtttccagcgccaagaacagattcacagcaatcgggtgttcaactgttgcattcatctacggcagagacaaaaatggtagcaatggacagtttgatcagttcaccagcttatgtggatcgttctgcttcgacgagggtagcatcgaagacggcccagagtgctccggcatgggttgttgccaagtccccatttcaaccaaccttaggaggttcagtttaggattctataattataacacaaccaaaaaagttcttaattttagttcacgcagctatgcgttcgtggtcgagaaggatcaattcaagttcaagagttcctatgccaaagcagacaatttcatggaggagctcgctcgtgggattcctataattctccagtggattgctggtaatgaaacctgcaaggaagcagccctgaaggagtcgtatgcttgcgttgccaataacagcaaatgcatcgatgtgatagaggcgcccgggtacagatgcaactgcacccaaggttacgagggaaatccctacctcaaagacggctgccgaggtcagaattaattcatacgcatgtgttcaggttcatggttagaattgggtctttttatgagatggaggggataaatttgttcaaaaggactccaacaaataaatttgatcactctctctcaaacacacacagagcaagctaaattaattatatatgcaccctatatatgcgagttgctgttctccatggattcatatgaagttattattattgattcctcactttgttcagttgttaatattgcagacatcaatgagtgcaacgccacaagattcccgaattcttgcaagggcatctgcactaacaccgatgggagctacgactgtaagtgcccactaggaactcacagcgatgatccaaagaacaaggaatgcgtcccacaagtgaagctggtcattggtaatatgtttttcacgctacatttttcagctgccaaaactttttctctaactgttcatatttacagcgaattgagatgcaaaccatacagtttttttttcgactatatatgttgttttcttagcaaaaaataacaggttgttttgtttctgaaattttctacttatccgtttctattcaacctaaccaattccattccaacaaacggaaacaacaagtctgtcataatggggctagtcgagcttatgataggtaatcatccatttccaggtatttgcatcagcatcatcttcctcatcatctgtatctccactctgctgatcaagattcagagaatgaagctggaaaaagagaagcagaggttctacgatcagaacggtggccacatattataccagaaaattatctcagggcaagtcaatacagtggaaatattcacagaagaggtactaaagaatgcgaccaacaacttcgacagcggacaaaagcttggcgccggtggtcatggcattgtctacaagggcattctcagggacaacaatgtcgtcgccgtgaagcgctccaacttcctccacgtgacagacgccgaggaattcgtgcaggagatcatcatgctctcgcagatcaaccaccggaacgtggtcaggctcatcggctgctgcctggaagttgaagtgcccatactggtctacgagttcatctccaatggcactctctcctacctgatccatggcgatagcaggcggtatgcttcactgaaacttcgtcttaggattgctcaagaatcagctgaagcattggcatacctgcacctgtcgacgaaccggcctatcatccatggcgacgtggagtctctgaacattatgctcgatgatagctacacggtgaaggtgaccgacttcggggcatcacggtggctgtccaatgaagctgtcgagcaaattgcgatggtgcagggaacccgagggtacctggatccggagtacctgcaggagaggaagctgacggagaagagcgacgtgtacagcttcggcgtcgtgctgctggagctgatcactgggaagaaggcgatctaccgccacgatggcgatggcgacttcgagagcctcgcaggatcgttcctgcgggcgatggaggagagggtggagaacatcttggacacaagcttggctggtgccagcatggaggcgctgcccctgctccaggaggtcgccaaggtggggagtatgtgtctgagcgccaaggggaaggagaggccatccatggcggaggtgaccgacatgttgaaagctgtaagaattgcgtggagggatcttctggtttcatcggagtacaacgtgacggaggttttcgtcgacagttcagaagctcctccatctggcaacccatcttccgctgtgttctggacgccggacatgcagtctctagaagttgaaactttgaggtgatgtttacagtctagactgtttgcagatattcagagttgcattgtctgcagacgagttgcaaaggtgtttgttcttgttataaactattcctatgtggttttcgtgactgttctagctgtcaattctcaggtttgctatctcaaaatggctattacttagctttgccagcaatgattttagtagtctcaagtgtaacagtagagtaaagcatacattgatatctttcaaacaggtttcagatggcataaagtattcagaatatgatatagtaattaagttgcctgggggggtctatagtcttgttgtaaattattccgttttgacaactctaatttttttttctctgtaaattctcaattctaaactctattatcttctgtgtcgcccttcatcctagaacttgcgcgtcatatcatagatcgctgcagcggaatcgacatcgcgcacgccaaatttggaggccaaaatccttggggtctcgtggggggggggggatttggcggcccggcggcggcgtcgtgactcgtgtgagcaaagagtagagttcgaggagaggccggcggaggtggacgtacctggatgcggcggtggaggcggggccagatctggcggcgcagaggtcgtgggggcgcggagggaggcgcttcgccgccggtcgccgcccctcgcgcgcgccggcgccggcgccgcctaccctaattggctacggaatcagaagataatccaatcataagtacacccatcgagctccaggattcgatttcttgaccgcacgatctccatccgacggttcacatgaacctaaatggggttcgnggaatttttctcggaccccccacgcgaccaccattcgcatcgatcgccttcaaccactcctcgtacatctcgtccgcacgtgcttcatccaacggttcacgtgaaccaacaggggttcggactatttttcaaatttgggcggttcgaatttttttgcatttgccgctcgatcatatatagattatctccatctgtaaagaaattttctcctatagatctcacacaaatccttacggcatgttcagaactcaactcacaactgaaaacgtgctactccatttcagggtcaattcattcatagatggtttcatcagtaaaatactggcacacattacatatatccaaaaatcatatatctccattctgtttgcaatatagatcacacacttataagagcaaatccccacaaatggcgcggggccttaactcgtaatcagggttcacaaaagaaagagataaaaagagcggggtcttttccccagctcattagctttagtattattctgcttaactgaccagcaatggctttacatagcgttaaagttaaacagatactgtcctgtcctactgtacaaaatacattacaaattgacgaaggggcgacatcaccctgacggagcccgcccttgagaatatacagtatcatcatctgtctataaacggtcaggataaatataggggtcaccataatctggcaaacctcttctctacatttaccaagtcatcaaatgcatccagcataaaattgccagttctcatggctatcaatcatctcgttgccgttccatttgtattgaccggaaaatccgtgctgctgactctgaagcagttcgtgaattatgtggaacaaccttgataacattggtctggttgtcccggctgctatatgagggctgaggctggttgttctgagctgatactgtggggaaggcggatacaggaccacttccactgcattggaacctgtcaaaaggactgctagcgctgctggcctgtgcctcgctatctcttgagggcatgaaatctccaaatgccacttggatgtgacatgttacatgagatccacgactgctgctcaaagttcccataaggctgtggcatcgaaggatgtctcccttgttcgactacaggtgccggtgcagttgggttcatcactggtatgctgaaaggcgggaagtagttcataggcatggaaggagggccaggagcacccatatgttgtggctgatgaggcataggaacaccgtatgccgagttcatgaaatctccagctgttgatggaagactcaaaggagtacagttggcataaaacggggccaatatgctaccagctggagggcacggaccagaataaggcttatagacaaggccttccaaaggagacatgacagggacaagccattgattttgaggtggttgaagttgaacgccccagttattttgtttgttatcagaagcaacaggtgtagctcgacgattgcttttagagacgccatttgttgcagcttgatcacgttgaccactgccaagcccagtatcatgaggggagggtgggctgtcttcagtgttttcttttgatacctccggttgctgtagacttggctccacgtcatcgatggttgcgactaaaagaggttgtgctttcaggttttcttccaccagcttgttcttgctacccaacaaggcattgccaaggcaaggatcactttcaataagtacatgtggcgatgctgcaatcaacttctgcacctgattgtaagtcaaatacaagtgtgggttataaacagattatggacaaaatcctatccacgaattaacctgcttaagagtggctagaaggaagagaaatttgctagactcacttttaccaacttatgcagctcaaaaacctggacagcaaacaccctctgttgactgcatagagtttaaagaagattagagtgtaaaacaataaagggaatcatacagtagcttggtaaagcaatacctacaatatcactttaacagggacacttttacaatctttttaaatgagattatgccattcttcttgactaaaatgaaaataaaattgaaaccactatagattaaaattttcattgacatctccaaaagagaacatttcagtagtacaggtgtaggtggacaagaacaacagacaacaacaaaactgattgacctagttgaaaggaaaataaaacatgccggcattctgcagacaactaatccaattacaaatcagcaaatgttgaactagatatatattaattctgccaaagaaatttgtagacatgctgacttgtaagcccaaaatttggcataagtatgcacagtttccatgcatgaggtatttgaaatatcatctggagctgacatctattggcattcaaatatgaaataaaccaaaaacaaacgagatagtcatcatgtttttctgtctaagatgattaagatcaaccgcaaattaagagcaaataacagtaaagcaagggaaacaaaacaaattttattcatcaaagctacctatacgtaattagagctgcaaacaagtctagtttgagtgggccaaactaagctcaaaaggatagttttacttacttcataatagcacgtcttgctttccagaaatgctttgtaccaatggctccaacaattttatctggagaaatctcccaaccagttatacactccaccgaggaatcagacacatcatcaatgttctctgcatcgtgttgttctagcaaccttgacacatcatcacttttctctgcatcgtgttgttctagcaacctttttctctttgtacctgtttcctctatgcctccttgcggtaaattataatgcctatcagtattttcagaagatggattagaggaaatttcatttcttctcattggagggttctgaaatttcatggaacctccatttctgcttgtcgcttgatgcccactatttccaccatgtggctcatcagaatcatttataatgcccgtcttatccatcttaggatatactttagcatgcctgctttcaaacatatctttggaagcatgaaaggatgaacttttttcaacttccacgtttttggatgtctgtgctgcttccatctccttgtctttcaaaggggtccttgatttcacatcagaaacatggattctctccaatttcttgcaacagtgttataacactttgtggatgatttggacactgttgaagggcttttgtgtggatttgcagcaacaaggggtgttgattggtcttgaacccctgcattctcttgagtactatattgaggaaatctggaattgaagacagaaggaaccataaattcatcatcatcggccaatctctttcccgaagaactctttattgtattttctgctcttctttgtggtgcctcagcagttgatcttgaagcataaatatccatgcccttagtctgagaggataacatccccagttcttttcttgaaccactaatcttcttgttgatcttatctgaattgatcttttcagtagaatggccaggtcgattggaaggcacattgaacggctggaacagagaactgtcacgtccataaacctggaagaaaataaaatccatttcagtactactagatttagtgaaaaattgcgaggattccacgctaattggtaggaagcgtatttaaactatccaagaacttccatgttgaattagaaaaagtggtgggagattaagtatctcatggtaagatctcgattttttattttattttcgacccaaagaagggcaaaagagacataatactgcaaatggacttctttctttcttattttgttcacatttcttcatttggaaatctatgacttggacttttgccattcgcacttcatgtctataactatcccattatcaaaaggtagttggatgtgttgtgggaggctattgcagatttgttctaaagaatattttccactcctaaatccttgctgaaaacagtattagaaaaccgttgatatttatcacatacaggttgaacgtgtgcctgacaatcaaagcatatcaaccaccatttttatcattccctttcacgtggacctttttttttcggcaggcaaaaatgcaagacactaaggaggaacctagtgtcaatgatttaaggaaggtgagcacgtcagggagaatagaacacagtacgttgagcagcactacggctactctttgccacctgcgctacatgcagtttcacatgtggacctttttgtttgtatattacaaacaccagacctcagcaacacaatcatagcatatctggccatatacaatttgcaataagctataatatccgatattgtttgcaaggaacttatgccccgtctccaaaactttaccggaagagctgatgtaaactgcatataaaggttttgttctgctctttcgccttcaacacaagtgagttatcagcacggagaaagatcaataatgacactatgacaacgtgcaagcatgttactcctaccacaattgtatgactatatttgcaagtaattgaatcacatgtcgacggcatgatagattaatcagcaccaaaggaacatggcatttgtgcctcaaactgggcttctcggccttaattttatccaatttttccatgtgtttagctccgttgcactaaattcgcccatcatttcatttatcccaaccgagataactacaaagggtaaggggtgaaaccccccctctgaccta

SEQ ID NO: 16947 - DNA, 20662 bp, Oryza sativa
gcgggaacagcgggcccatcaccttcccttggcctccttccctcctcctcctccgcctcctcccctcgtcgccatcgcctcccgccgcagcagcttctcgggggcgtcaggccatggcggggtggaggaggtcgccggtttttgtggccatggaaatggaagctacgggattgttttgctttttttttttttctcttggatctggatgccatgctcatccatacgcccattggaggagtgaaaggtgggcccaccgtgagtgagacattgggaaaaaagaaccggtcactgagccggtttataggctttatgatcaccgattcagtagtgtgacaaccggtttaaaccgtgatcatgaagcacatttttctgactgagcatgtataatcagtggcaggtctagaaaatcaattcattggtgtcataacatatatatcggtgtcatagtatgctagttatgcttagatcatgatgttataatatatggataagcagttttgctatagcttttgtcaaaagtcgtcggtgtcgtctggcaccggcccatatactgtagatccgcccctgtgtataatagtatgctataaaccagctataactttataagaatatgtgaaaaaggtaagagaagagagtgaagaaaagtgagatttctagccagctatagcatggattttaagatgttgtctgtgtatgagagggtaggatcagtcattaatggtataatatatatttatagataactattgtatgaataaattattagattggatataaatgatttggagctagtagttagctatgctattaaacttgctcttaggcttcattagatttgtctcttttggattagctacttcttttatcgctctccatgagcatactattttgaattgttgaatggtatctttttttaaaatatatattatatggaaatttgtaccgcaccataatcaactgttcccgctatcgacacccaacccctattttaccggatcaaggagacagagtgcgacggtgatggaactgctcctggcggcaggaagagaaggtattggtctccttctactcatgcatccggttgatgggagagataggcgatgcccaagatgccaacaacatgatgagagagaggtctcgctcagatcctgatcctaccaaatcgcttccagcgacactattgtcccctgggatgggaggtgctcatgacgacggttggacgggcgtagatgaggtcaaagagaaggccatcatcttcattgtagaaagagcccaacgttgttgcccgtgccaaatcgaacaccatgaaaacctgttccacgcactcattgccgtggacgccagcctagagcggtaaaggaactgtggtggtggtcgacatggctgaaatgtgaccaggcttcaaatcagtcaaggggggagctgtcgtcgtcatcggtaagccgaaggggtttgtttcctcctttgttacacggagtctaagccccaccgtcagcgactgcgatgggttgagtaagtgaatctagggctgctactgttaccttcatcattttttaatccactcgaaaatataagacaattttgaaatgactaccttcacccaaaaatataaaagtttattttaggacgaaggtttttcaatagtcgcaggtctgacagaagagtacaaacatacagaggtttcaaagagatttcgaattacaaaaagaaaaaaaaatgaagttcagaatatgaaaacaatgtttagatgaggaagctgacaatgagctctgatcaaattaaatgcgaggaaatgagtactccctctgtcccacaatataagggattttgacattttacctacactgtttgaccactcatcttattaaaaaaattgtgcaaatatagaaaacgaaaagttatgcttaaagtactttggataataaaataagtcacagataaaataaataataattttaatttttttaataagacgaataatcaaacagtgcaataccttataattggggaagtagggagtataatttttccgggccttcaaccaagcatgctctctatcagagtatcagttcgatctatgcttggaccattgagggtgtgtttgaggagtaggagattagagagattggaaagatacgtaaaacgaggtgagccattagctcatgattaattgagtattaactattttaaattttaaaaatggattaatatgattttttaaagcaactttcctatagaatttttttacaaaaaatacatcgtttagtagtttgaaaagcgtgcgcgcgaaaaacgagactcaatctcccctgtctcgcgaacgaacatagcatgaatgaacaaattgaacaatgtcaccacaaagcaaaacaatccttaaacacacaaattgtgttttgcaaaaaaaaacaaataatccttcagtttgtacctctatttcgaaagaaataaactttgaatcagacgatcatcaaatcgccatcgatctaaaccctaattagctgtggaaccagaagataatcaatcaaatcccaagtatagtgttgctggactcacgtccgtttgattattgaccgcacgatctccatccgacggttcacgtgaacccaacacgggttcggagaatttttctccgaaccccacacgaccaccatctcgtccgcacgtgcttcatccaacggttcacgtgaacccaactggggctcggagaaacctcgtcgccggagtgacgtcactcctccggcgagccaccgtgcggaagcgtgaggtcatcgtcccgacaggtaggagagcgcgaacgagttgctgatccccgacgacgtcacctgcatcccgccgtcgctggccgccgccggcggcggcaggccgaacgggccggggccgcgcgccgccgggtcgagcgcgaggaggtcgacgacgatcatgtccgacggcggcggcgcctccacggcctccgcggcggcgccacgcccctcgagcatctccaccacgcgcgccatggtggggcgcgcccccgccttcttctgcgcgcaccacagcgccacgtggaccagcctccgcaccgccgcctcctccaccgcctcgccggactccaccacccgcctgtccagcacctccatcaccctcccttccctcgccatgtctccggcgatcttcgggaagtacgtccaccgcggcgacgccgacgacccgtcgtcgccattctccgcctgcatcaggttgcggggccgccgaccatctcgagcagaacgagaccgtagctgtacacgtcggacttctcggtgatgccgacgccgagcagccactccggcgcgaggtaccccgtcgtgccgcgcaccgtggtgacgacgcggctctgctccttccccaccagcttggacagcccgaagtcggagaggacgccgcggaagccgtcgtcgaggaggatgttctccggcttgacgtcgaggtggagcaccttgctgcggcagtcatggtgcaggtaggcgagcgccctcgccacgtcgacggcgacctggtaccgcgccgcccacggcaggtacctccggcggcggcgatcgccggagtgcggggagaagatccacctgtcaagggagccgtgctccatgtactcgtagacgaggaagcgcggcccgcgcgggacgaggcagaagccgacgaggcggacgaggtgggcgtgctgcgcgctggcgatcgccgacacctccgacttgaactccttatcggcgtggtcggcgccgccgtcgatccgcttcaccgccaccgccgtgccgtcgtcgaggatgcccttgtacaccgtccccgacgagccccgcccgacggcgtactggaacccgtccgtcgccgccgccagcgactcgagcgtgagcttgcgcggcagcccggcgaccttgcggaagtagctgtactccacgcggatccgctcgtcctccatcgacggcagccgcctcgccatgcgcgccgcccgcctccgctcgcccgccgcgtggtgcagcagcgccgcggcggccgccgacagcgcggcggagacgatgacggcggtggagaggaagaacggccgcgacagccggaagcggaggtagagagcgagctcgaggaccagcagcacggcggcggccgcgccggcgacgatcttggccgtcttgctctccatatctcggccacgtgacgtcacgccgtcaccggctcgccgtcgccggcgacgccgcccgccatggtcagttctttgctcactttggacgcgagttaatttcggattttgacatgatgggttagcaattaatacatgtgagaaaacacactgaaatcttaagagtgatagctacatttcaactaatgtttgtgcctagtgcatcactattggatttatctaattatcttgcagtagtaaggagctgacctgatcaaaaaaaaatgaagggaaaagatatgtaggtgtggagatcaggaatggttcaaatcaataaagtggattaaatgcagtgcaaattggaattctgtcacgccgaatccgtccaaaattttcggtattttgtgtggtaaagttaacactttggttgaatgcatcctcacgtgaatgacatcagtgagtggtgaagtgtgtggtgctggtttggccaaatccaagtttgaatgcatcactgtctcactcatcaaagcaacaaattgaccacgtaagcagtaggaaattaaggatcatataaagaaattacaaaagcaattgactgtttcatccaactgcttggttataatcaaagataactgaactggataggagggagaaggatcatcagaatgctgacttcatttgtttaaactgaattgaacaggaccaaggtttgtgaaatgttcagataacagatcatacaccaaaataaatggtccaggtggccattgaacatggaatcatccatcaagacaaacaaacaaacatacctattttgaattcgactaaggtgtgctgaaaaagagaattgcatatcattgtttactgaatcctgttatttgcatgaacaaatctctaaaaagacaaactttgtttttccaaaatccactgctgctccaagtcatctgaattgagagttgacatggatatggccatatccagtgtttttattgctagaggtgacttctgcaaccttaatgatggtggtgatcgtcgtcatcgtcatgcccatcaggatctcctccttctcctatcacctcaagctgtgaacataaagttgcaagttgatagctcagcgaacatcaggacaacataccaacatatgcgcgatttagtggctcatgcagaaattgctctcacaaggcaagcgattttgtcaacagaaagtaccaacataccgagaaatactgagtgcagacagggcattcatgtggcttgcctttctccaaccaaaaccacacgacatcatgctcgtcctctgaaaatatcaatcattgcaatttgcagtttaagttaattccattggtggttagtcgatgaatatttatagagaagatgcaggagaagatttcatcctagaagcttctttataggtcaaaaacaaggaaattagcatgcacaggtactatacctccttcaccaccgggacaaccaacaatccttttgttgtagtatgactgaataacagctggagcttcctatacaacatggaaaaaatattagtccagttcgatcacgcaggagtggaatgaactaaactgaacagtgacacaaaaggtacaaagggaccaaatcaaggttagatgcaacacgctaaagagtagtaccattcatcaacaggccaaaacagaatgaaaatgatgcccattaatgtgctgataaccttatcagatcacacctaatgcaagtctgaggggaaatgtcatgagaaaaacaatttgtaggaaaataggggtgataaaacaaaagaaaccactgaataaataaataaattgtataacatccgtacatgtatcgatcaccacaactagggggcaatctgccttagagactagagatatatgggaaagcgaagaattttcaaaacactgcacttattttatttcctggagatagacaacatagaaattgcaaattcaacttcatgatcaaatgtactattattgagcaaccaataactaaaaggtccaacattgctggttcaactagaaacctccatattagccggatccacatggacagaatcagagaataaactcacaagatatagtagcagggttttccaagtgaaaatatatttctatgagcatgtaaaggaaagtcttaacatgaaattgctaatcaacaattctctaaagaaaagcaaaatcaagatgcctccaagtactagatataagacaggcccccataattatgcatggaaattcagaatgttatagcctacaaaatccccaaaattattttaacatgctgaaaaaaaatgctctactaaagttataatgaaaacaaagacaaacaaaatcctctttgttaacacaacaggagtcaggcaacacagcccaaccttttttaagcaagcacatctgacaagtgaacaaaacagctatttatgcaagtttttcctatcaacaggactatacgaaaagtcaacacataagatgtacagaatagcaaaagatgtgaccatacgaaaagccaacacatagcaaataacataagctggaatgcacacaccatacagcaaggcaaaaacttcggttgccaatgaccagcccacaaaaatacaaatcacagatcagtgtaaacataaacagaattacctatgttgtaatgactttattaaacgtatgtgtgttgaacttttgcctaatgtttgtgcataaaaatctttcctatgtagggaaaagaactggtagctgaaccaatgctacaatctcacatattcatattcagtgaacaaaatccctgccgtgacccagctgctgcatctgcaacatcagaaactaacacctatctcttcgccgattccgttgagccaaagaagcttatcacctaatatcagaggggaacatgtcaagctattaagagagcgttgcatccatggccacaagtcttaagcactacacatcagcattaattcagtcagcaatcacacactccatctaaccaatcaattcaatagctctcaaatacacgggtcaaaacatccatggaattgatgtgaaatggaaagctctcagcctctcatctcaccttggtaccaaagggcccgacgggcgcgtccatatcaaacctcttcttcccctgaaatgaaaaaaaaattcagaccttccatctagtaaaaaaaaaaaaacttccactaataaatcaatatcaagaggagaggtggttgacctggagctcggcggcgatctcctcgcgctcgagcccggtggcgatcggcatcacgtcctccaccctcgtcctcgcctgcgccgcatctgcgcgggacagagacagacagacagacagaccgccccgtcaaatcgccgcctcaccacctgccgggatcgggccggagttcgggagggaatgttaccgagcgtggagaagaagagagcacggggaaggacgccgccgccgatcgccggggagcggcgggtgagggcggagcggtggtggaggaggacggaggtcgcgcgcttccacatggcgggcggcggcggcgacggcgagcggcgggagatggagaggccggagcggtggttaggaggaggaaaaaggaggcagctttcgggccaatttggggtggttttgtcggcccacggaaatcagaacaatccacttgggtgtaaaaatttaacaaattttgcaacgaaattcgtaaacaaagtgtgttagaacagtgagatgattgtttaaatgcaaccacggtttggttagtttgacttgtttattttaaagttattattaccaaatgatagtggtttcgatggatagatcgttattagtatggtttggtgaaccaaacaaaattgattgtgcatatatctcgtttttatttatttattttagataccacaatgattgggtcttaagattttctttaattattcgacgataggcatgtactattgatatgaaaaataattccagttacacgtgactaagtgacttatattcatatagtgatatagatatactagcttgtttctaaaagaaaaaaaataaaataagataattgcaaaagaaaaaaacaaaaaggatcgacaattacgtgtagagtaacttaaagttgaacaaattgtgttcatttgtttaacttttttttaagtatgattggttatttatgtatataaataacacttcttttacctaggatcttcactgcatatctacgtggcatccggctcgtaatatttcacgccatatcggcctctgttgtcccccggtgaagaacgcgaagccaaaataggacactcgttctcccgtggcgaaacgatggcgtgtgacatgcaggaagagaattgtgagggtgcattgtggaggtcatatccttatcacatcatgccttcacggtcgtggtcgcccccgctcctaaatcacatggctatgtgaaaactcatgtccttatagagttttaggcctagctagcaagtgagacccgagaagtgcgtgtcttgcattgctactgtcctttactatctcacataatttaaagaatacgtctctgtccaaatttaatatatataaagttatcgacaacaatctaaaatttacaaattttctcaggttttactgtctgcagtatctatcttcaaaagttcaaatggtaacaccaccaccatcaacttggagcacgaaattcaaagcacaatccaacggcggaaacacacgatagccaccctttaaaaatcccacccccataaaccctagcaacccaaccccgtcctcctcttccccaccaaaaacctcgtctttctcctcctctcctcccatggcgtccctccccaacggcgccgcctccgcctccgcctccgccgccggcggaggcccggcggtggtcgacaaggaggtggacttcgccaactacttctgcacctactcctacctctaccaccagaaggagatgctctgcgaccgcgtccggatggacgcctaccactccgccgtcttccgcaacgcccaccacttccgcggcaaggtcggttgggtttgatatcttcggtgcgattttggggctctgtgttgatggattttggtggatctgtctttgtcaggtggttcttgatgtgggtaccgggagtggcatcctcgccatctggagcgcgcaggctggcgccaggaaggtgtacgccgtggaggccaccaatatggcggagcacgcgcgcgagctcgcgcgggctaacgacgtcgccgacatcgtcgaggtgatacaggggtccatggaggacgttgtgttgccagagaaaggtgattctctctttttttttattcctcgattggttgttattagtctctgaaaataagggggaattgatgtggctggtggtaattatattcgatctcttgcgaacgaaacatagcttaagaatttgtttcctaaggagaggaaaagttataaagaatttaatggaaacaagaggttaccataatgtgtgttgagtattgattgctttgtttctgtatatctttggaacggcagttgatgtcattatatcggagtggatgggctactttctattgagggaatcgatgtttgattctgtcatttgtgcgcgtgatcgttggttgaagccagacggtgtaatgtaagtctatttatacttctattcatgctaatatagacagaatttttgaatgttgcacacactcttcattctctggaaagcaaaccgtggtagttagttagttagttatccaatatctttgattacattagcaaatacggtcttgtcatttttctggaagatggcaataacctctcaattctgttgttggttcaatgaaatatctgtttcactttcagccaatgtaaaatcaattttggttgcaggtatcccagtcatgctcggatgtggctagcaccaataaggagtgatctggctgaaaataagatggaagatcttgagattgctatgcatgactggaatctatttgttgaggataccgagtcttattatggggtcaacatgaatgttttgacaaaggcataccgtgcagaacatgaaaaatactatcttaaggtatgcctgaatctgtacaaagactggcatgtttgatttaatcttttgtattgcatgtgctgtctgcaagaaaaatgcaatttaaacaatcttataaatatacttgttaagcaagaatccattcatgataagataaataccaaggtgcttgcagcacatatttgattagtatagttcattacttattttattctgtatgtaatataggatccattagtatctctggattacttgttctggttgttcctaaggtctcagcaaaaatagtagtgaatgcacattttcctgcaagctcagtgtacatttggttgtattcttctgcagtctgccatatggaataatcttcatccaaaccaagttatagggcaagctgctgttattaaggaaattgattgcttgacagcaacggttgatgagattcgagaagttcgagcacaggttacaatgccaatcaagctggatatgacaagattagcagctcttgctggatggtttgatgttcattttcgagtatgtcaaactgaactggcacttaatttatctcatgattcagtgagatatgctcactattttctctttaactctttctagggtagtaagcaaaaccctgcaactcaagaagttgagttaagcacagctcctgatgtgaatggtggcactcactggggccagcaggttggtttcctggaattaagctattgtattttataactgcagaaatttgttaccagctagtccataatttgaaatgtatgtattgttctttttaatgtgtgagtgttgatatgtaaagaagaaatcatgtaaagagggaagctccagtctctcttttatttacaattaattgtaaggacaaacagatttcaaaacctttcatgcaaaactgatacttagataaagagcaatatctttatttgaatggcacatgtttatgtataagggcttttattcaaaacaataatttctttcaattgattgtcattatggaaatgcatatcatagaccatagttatctggcacaattcacacatatttactattgctctgattcttttcaaggtattcttgctgactccgcctctgaaagtaaacgaaggggacaatgttaaagtttctttcacaatggttcgctcaaaagagaatcatcggctcatggatatggagttcacatatgaattgcatgagtcatctggcaagcagcttcccgcaatcacaaccaagatttacttagaatagagcaaggtttggttcctaagactacaatgtgtttatgcatttttctttctttattttcaaagtcagataatatgccaacatataaactgtagtgggcactaatagtcatcttaatacccgccacgcaatgctttatttcagtgctttctgtaacaataagaattcaacctaacctggtccttttttttgttgctgtcattacagaacgctgactggatctgattcaattgatgaaaagattgtgtactggctaccatgtctgaaccttgcttgatagttggagccaagctgaactcctccctggtgtatttggtttttaatagagggcctaatggccacattgtgtaatactacccagaatatgtacaccgaggctgtgttgtgtgaggcatgataaaagtgccagagattttgttgtatcagtaattcatcgctcgattggttaattggcttcatgattgctgtcatatgcccatgtgtgctcagtctcaaagtcaaacacctttctcaacattttacaggagtagttgatgctcccagtttgagagggctcagtaatgataaatttgctgttttctgaagaagtcaacagcctgaaggatttgatttagccgttcattcacagttcacacccaatttcaacattttatgatctcattcagagaggattcactgcatccaaagttctgaagggttactcgattacaatttagacacagctctctcttcacttggagtcatacacacacacacacagcacatttattcctcgagtatttacatcagcaagatgattatccccttcctgttacaagcacttgatagggtttaacataatcatcatcaaaacagggtttatagtatgtacagcccccatgaacagattacagtaagcatctggagcacagataaaaacttgcaagctctttcagtggtgcacacaggctgtatctgccatggcaatctcagtttcctctgaaagactgaagaatatccatgaaacagcaatttggctgtcttctaccagctcaaacttgctgcacaacttttcattcttttctagctcatttttccttcttacttcatcaacaaaagtgcgtctcggtgtcgccctaaaagggtcagtgcggttgctgcgatgtgatgagcagtcaacccagccatgtcgagctgctctgtgagcgaagcgtgcccgatgtacctgtctggtagtacaatgggtcgccactgcaagttaacagaaagtcactgtttgaaattatcatttatacaaaacatgaatggagcacaaggcaagtggcatattgcaatacaaaagggtgaagctccattgcaacttgcaagaatattggatggatttatactagataacaggagttaaaatccgtgtaagagtttaaattcttacctttattttgccatcaagcaacccatcgagtgaaataaattgcgagacgtgtgagccaaaaccaccaaccgttccttcttccacggtgattaggaaatcgtgttgctggcacaacattcttatcagatcaatgtcaagtggcttgcaaaatctcgcattagcaacagttgcctggatgccaaagttgaacagaagagatcgagctatcaagcatctctggaccacatcaccataaccaagaaaagctatctctttcccctcagcaagaatctctcctttaccaatctgaaagagagtccccaaaactaataagaacagcatgcaaaatgtttaagcgcacaaaggtattgccagcttgtttttttcagttcaccaaagaacaccagcttttaggtgggcatgaatcccagcattagcgtaactgatagctttcaagctgtactattttccaagtgacttctgcttagaatcaaaaaaagaaattgaagtagagctacctcaagtggattcccatatgctaaagtgccactagtcccaacgatggcacccttgggataccggaagcaaatgggtctgtcctcaaccattgcagctgttgccaccatgtcaataagttcatcctcattagatggtgacatgacgatcatgtttggcaggcatgacatgaatgtaatatcaaatggtcctgagttagtcgggccttcagatcccaccagacctgcacttgtgattgcaaagcgaactggtatcttttgcatgtccacatcttcgactatctggcatatatgtgagctttatcaaatgcgaagtacttgcagtaaagcagccatacagattaagtggagctttagtctatagcccactattacagaaactatgcttgtttcaactattttattgtagtacatgaaaatttggaagatggcttacaaagcctactaatgattgtttcaaccatgtagcagagcaaatatggagtacagttagagaggaggaatacatggggagatgggagcaaagggcacctgatcatatgctcgctggagaaaggtggatggaattatgcagaaaggctttaagcctccgcatgccaaaccagcagaaaacgtaacagcatgttgctcggcgatacccaaatcgaaaaatctgtccggaaatctggactgaaataattggattgatcgatctattcccatgcctccatgaaccaccacaatatgcttgtcattctctgcttctgctattagtgattctacaaagcaatcattatatgtcctagaaagaccattttctaaaaactttagaatgtcttggcttgagtctggaggccctgttagcagagaaaaaagttaataaattatagattcattttagtatcctatatgatttgattgtgcaaagacatgtaggaaggatctcaaaggatagttgacttatacatgtaatatttaacataactgatatgtgaaaccttaaagttcctgaatgttgtgaattgtgaatgattctacaggtgagaaccgattcacatatttcatttgaaatttcagtagtgtgttctatcatttttcaaacaaatacaacattcacatgcatattgccactcaaacaaatccttatcgcgctgtttccttcctcaaattcatgctgtggtgcttcacttatctctctgtattaatatcaaagcaagacatccagaatgtaaaatgagaaaacagagaaagcagaatgtacgctatcatattcataggattgcagaaaatttcgttgacaatttgtaattgcacaccttcctcgtcgggagtaatctcactattaaattctccacctgagtctttttcattctcagtgattacatgcacaagtactgggccggtagaatctagagtagaaacctccttgagtacacaaatgagatcatcaatgttattcccatcaataggcccaatataatataatccaagttcttcaaaaagagttgctccatgaggacctatcataccacgggcatactcatcaattttggcagcaaattcatgcatccctttaccaaaccatttggaaagtccctagaaaggaaacaaaattcgtatcaaagcaggaaactcaaggcagtgcaagactgttgttattaagaaagtagaaagacaacccatgccaaaacttcctggaaatttttcatcataatatgtacagcagcaagtcaattagcaggcttttataacaataagttgaaagtaacaagtacatttgtcactaccagataaaaaagagaactgaaaagaaacaatcaactacaaactatatgtctatactataatcataatcaggaaataacaggacagttaaaaaaaactatgttttattagcaagttcaaatctagtacattatgtcatacagaagcataaagttttacctttgcagcctccctaaactttctaaatcctttgctggattgaaccttgctcagagcactagagagggcattaatagacatctttgattggctatctgctttaggaagcaaggtgtgccggctgtcatttaaaatcactaccatgttagaatcaaggaaaccggcatgacccattgcctcatacacctgaccagccatagttgtccagttacttataactgttactattcggtttttcctcccacctagatcccttgcgactgccatccctgacaagagatcattttcaagctataaacgaataaaaggaaatcatttgacataaaagaataaaacatcaggagattcatgattaaatgtagaaacatacttaggattctaatagactatgcaaacttctataatgattattaactccattagcaaaataagatagtttaagaatttcatatcatgactgctgataccacaccagaaggatatgaacttgaatacatcagaacttatattatatttcttgaattatattttgagtcgtacatcccggcactgtataccttggtttaaaaagcaagaagcactgtttttctctgtttcaggtagctgaactattgataaaatgcatggaagctaatcggagtcgaagatgaaaaaaactatggaatattgtacggattccaaacacaatgaaatcaatatcttaaggaaatccatttaaatagaaggagaggtctaacaacaaagcaagcagttcttgaagtgcaaggcatgaattaatgtattaacatttaacagaggcaacactatatataccaaggcctgcggagagactattgcatccatgtcctgcaccaaagggatcatattcgctctcgaaacgggatgtgaaacctgaaagcccctttctttgcttaatagtatgaaagagtgagcgccttcctgtgagaatcttgtgtgcatatgtctgcagatgagaaaaaatattgaacacaaaaggtaaaacatttccgattatatgaaatggtatatgatagcttactggaggcaaaatcttagcacaaaacaaaaagatagagggatcatacatgctgaccagcatcccataatatcttatccattggggcattgaagacataatgtatagcaatagcgagctccacaacagaatgtccagtgttacatggttggcatttcctcgacattatgaaagatatctccgatcgaacttcaccagctagttgctttaactcctgtctttcaatgggaattgtcaaaaattcctcacccataacatagttagagagtatgctactatgcttaaaatagtatgactgacaaccttactagatagatttttcaaatggatgggtgcatcgatcgtgtccaggattggagttggatccttctcccaaaagaaatcatcgacatctggcagcgcagccactcttctattgaagcgctgtacaaaaagagagaacattcaccatctgtgagtatgagactacaaagttcagagtccttctccggccacaaatgtatccctagtgaaatagttatcaaattctggcaggctgcgactaaagctcacacaatgtacttcattcttttattctttgtgggactaaatatctaccctgaagctaaaatgttagccttgtctgcacagtgtactgcagatatggagaaagaacatacccttgatggcatattgaacaccagtgttcgacatggcttcaaattcgatgttttgcatctcaaacacagacaagagtggagacagcaacttgttgagcgcacaaaagttgattcctcacagattaaattaacagcaggtggagaatgcagatatctcccacccatcctgcgcaaggagtgacgaccaaaagcctgaaatttacagtattctttagcctgtgagaaacttattttttttctaaaaataaacatggagagatcactggatcctaaattcatcataaacaattatccacatatgttttcagtgttctagatgaagatgagcacacaatcaagtatcagtccttggaatgacaccacaccaagaatcagctacaaacagcaaactcatctatccatccagggacagctaaaatggagaatcagacggccaaaatccgtaatccccaatttacaccacaggcaaccagcttccactagaaaccgaaatagccgcggggggcaaaagaaaaccaagaacccatctaccgttacctcctctcctccttcaaaccggccacccgccgccgccgcacgcgcaggatcggcggcgagggagccggaggcggctcagcgtgagggggcgctgctgctcgcgagtggcagcagcagcaaccctagctccggtttgggatttgggacgcggagtgctcctctgcgctcttgacatgacagattagttaggcattaatccgagcagaaaaggggacgatgattaatttgacagaggattagctactaaactaatcacgtctctcctaatcattcattattcggttaacttgttcgtccgtactcgcggggcccaactgccagtggcactggagtggtttgctcgggtaaatttacgagattgcccctgggatgagatagagacgaagtgaaaaagaaaaaagcttcgattttttcttttgcagaggtggtggatagatagcgcggcagaggaaagaggagaagaaaagatggcggctttcgcctccgctctccgcgttctcccctcgccgccggctgcggtgcctcgtcggcttcgctcggtgagctcctcgtcgcgaaacccatggataccttcttcttctttctgccccttgctcgtgcgctcgctggaagctttctcatttggcgagctgccttgttcttcgatttgtgacttgagatttgataaaagggataggaaggggaagggagacactggcatttcaaagagttagacgtttggaattcgagggcattgcaggttttttccttgcagattttaggatagtgcgaatttgaggactttaaatcgattaataattgattatgagtggcactataatcttttgtaccatattattatcggtctcaaacatgacaccgctaaagatcatgtgtgtctgtgatgttaccaatcaatatactatttgataagttagtgatcctttatggtggatattcagcttttgtgagtaatttttcaagccctagttttttaagaacaggtttgtataggtggtgggtctatgtagtgtcatataatctcattgtagttagacaagatcgtttctctatgttgttggtattcaccacggtaagtcagccacgtctcatttttcttccatcttccactgtgcatatgcagtgtaagatgtttaatgtttctttgtgttaaatttggtgaactgtgccagtttccatgataatccgtgtcatgcttgcgtagtgctcaagcaatgctaaagagagcttaggattgtgtgtatcacgctgacactgggcttagcaaccaatgttctattgtgaagttggaatgacattacaagctttgaagattgtacctcagcttttgtaattctacgggcccttgactatgatgtttagtgctggttgcaatctttacgccttctgtttgttgcagagagaacaaaggcagggctgtagatctcgaaggtattcaaaagtcgtggcttactacgctctcactactccgccgtataaacttgtatgttctcctcacctgttaatattgcctcgacagattacattctgccatttaaaaggaaaagattttaacttatagcttgtcctatggtgtccaggatgccctggaaccttatattagcaagaggacagttgaacttcactggggtaagcatcagcaagactatgtggatagcttgaataagcagcttgctaccagcatgttctatgggtacactctggaggaactaataaaagaagcatacaacaacggcaacccattaccagaatataataatgcagcacaggtaatgttgttattatttggcttttttcccccattagtcggatattttatttgtacccatcaaattttcatcctgatagcttcagtgtacatgtttaattgtgccccataattgaaggcttgaaaaaaggatgaccagtaggctaataatggtcctaatttcaattcttctgaaatacaggtatgaacccatcacttcttctggggaatcaatgcagccaaaagttggtgggtcaccagggcgaggtgtcctgcagcagatagagaaggattttggctcttttactaattttagggaagagtttatacgctcagcattatcacttttggggtctggctgggtttggcttgtctgtaagttttttattttcattttctttgaagttcagcctgtacaggcactgttggttcaatctgacttcctgaaatgttgtttctacaatctaaatttagtttttaaagtctgatttatacacgtctggtctatcttttgcttgtttcagtgaagagaaaagaacgaaaattttcggtagtccatacacaaaatgccatcagtccacttgcacttggtgatattgtatgttttctcatttccttttgaaatgtttagaataatagcatcccaagtataaacctttgtgatgacattccatgccctcttctcttgcagccactcatcaatctagacttgtgggaggtaaggaaatgacactgcgtttagatattacattatgctaaatattgacatatctacttttgtgtttcagcatgcttactacttggattacaaggtattttctagatcctctttttcttcttatacctaaaattgtaattcaccaagtactaagctatcataaatcactggtgatgcttccttttgatgcttcaggatgacaggcgaatgtatgttacaaactttatcgaccatcttgtctcttgggatactgtcactctacgcatgatgcgcgctgaggcttttgtgaaccttggtgaaccaaatatcccagttgcatgatatgagatgatatggatatgacctagagatatctatgcatgtattctcatcatgaggtaaaatccagcattttgcaacatcatatctggtacatatgcagcttaattatgtagttcatcattcagtatatatacaaaaagaaactagagaatcattcagtttttggtgatgacttattttcaactatgacgcatcttcagcattagcaatgccagaaatcatgctcctaggacattatcttataacacaaaaaagttttctcttgaaaaacagcacgtgaggcaatcaatcaaatatcgggattgagatttaaacacatgctgctgggagtatcagggagcatgtcgcttgatgctgttgcttcggctgggttaagaaacagaatcaagtgccctcaaagaaacagaaatcga

SEQ ID NO: 16948 - DNA, 5966 bp, Oryza sativa
tatgtggacacatatataaaattttgacccacaaattatcgtttttcttgttgataaaccgtactgcttataaccagcattaggcgaaccgatgacagcctaagaggatcgctgtttgttttaactctttcttgaaggttgtgatcatcggcttcttttgaaactacccagcagataagattatgggctagcattacatccatttaaccatgttggccttttcatttacaacacagttgcaatccataaagaagttagcatgaaactgccagaatgggcttaaatcagcactactcattccattcatctttctgttgtaacagaaatgcagcccgttctgcaacaccacatggctgcagtctgcagacatctttgtcttctactttgtaaactgcaaccaataacctgctcatgtgatgtctactgtcaatagtggatgtaccctgcaacaactccaattgaaaaaccatttgcatgttccatgctgattggtatggcaggttaacctgctcaacttgtcactggatcaatcaaaacagtaggaagaatctgtctgtacgactgtaccaaataccaaccctgcaagagataatttcacacgcatagaaagcacttcagataacagtattctgggtttcttacaatagtcctctttttcagaacacaaatgctcgattctgacaaagtttccatctactacatgtttattaattttacatgatgacaacgggctgataaattatgaaatctcaggggtaagagagatggaggcgatctccatcctcatcttgatcatgttcttgctatggcttgatatggcagcctagttgcagcagcagcagaggcagtcgaggcagcactcgcaggtctcgtagcagcagaagcagcacagtgcagtgaagatgctgcaatcagaatgagagaaatagttagcgagatcgatcaggattttgctaaaaaagattcacaaaagtttcatgatttgtaaacttaaaaactgacgatatcagaaacagagtgtagcagagttgaagtagtttcagcaggtgtattgacttctgaagatgtgtactgctggagttcggctctaattcaaactttcagcaactaagccaagcatgagaagcagggtgattttcttaagtaaaaaaaggaacactaataagtgtgttcatgatctgaagctatttgtaaggttgttcaaagctaaccagtgagacaaaagaagctgaagaaatttgcatgaaaagaaaaaaaattgcttacaaaagtccaagaaaaaaaagaatcttataaaatactccatcaaagaggggaaagagagaaagatatgtcagctgcaagaaaacaagtttaagatccttctaactaatcatcctgaccaatactcatccagccatcctcttcttgaattgtgtctccaaaacaggagaacaagaagaacatcataagaaaaaaaaacaaattgctctcaccatgcatagaggcaacccttctcctcatggcgcctctgcacatgttcatagtaggacatgtcctgtgccattggagcgttatacatcttgtctctctgcttctgatgaacaagcactcacctctctaaaaaggtttcagagaagaacacaactattcaagggccaaggttttcttctcctgtcctctcttgttgcttgcaggattggaagtagtggataccatttataggccaggaaaagaaaggccacatttttccatactccatacaggtgatgtactatcatctgaactggagggacccagatgtcagcaagtgatgtaatttttttttgtcaaattatgaaaaattagtgctttgtttctatgctcttcagaaaaattctctgttttttctgctcattggtcctagtatctgactggataatctacttggctttttctttggaacaagaggctcatgtttgagtggtcagttctgataggctggaataagcagagttctgcccaactgcacaaactaccaaccaactataaaagcaaacaaataattagtattaatcatctctgagttctattaaggagtggtccatggtttgtgcttgaggaacaagatcctctcttccaattaagtggcctgtccactgattaattgttcatgcaaggtcaccaaactcaccatctgcttgccatcattgctagtatcacatcatggttaagtagtattattaacatgaacaaaaggttctgtttgatggccccagattttcttgtcttgtccaaattaatctgaacgcaaggcaggtactgtatctattaacaccaaaagtgatatatgcaggtgctttgcttaactaattaactcatgatatggtgatcctttattgctaatcaaatcgatgagttgtttgcagttgaagtagaaatgagttaaaaataaataatatcagattgtgcaagggaggaagaggagattcgacagagattagccaacagttccgaatttattccaaaacaaaaaaatgcaacttgcaagaacacgtgagaactgagaacctagaatctgaattccctttcaaccaggtctcaagaacaaacgccttgaagtggcacgataaagttcatctcatagtgaaattcaaacaactagtaagtagtaaaaattaatgttgatattaatttagcaggttaattactgcaactgatcaggggaggaagaagagatgaactgaccatgcgtagaggcagcccttctcctcatgccgcttggtgcagtgatcgtagtaggacatgtcctgctgcgccggagggttgtacatcttggctagcttctcctcttcgatcgatcaggccaaccaagaatgatctctcttttgatacaaatctaagctcacttttctcttcaaccttgcacacagagtttgatgtgaaatggaagtatttatagagcagatttccaaggttttctgattccaagttgttgcctggtaaaacacccttgcatcatcatatggcggttttgtttccatacattaatatttttgcaaccatataagtatgaccttagtttccttcgagcctaagatttgtatatggtcatttatgtacttattatactccattaatttggattttggttctacacggtcgtcatttatgtttggcaaaggttcagagctgagaacagcaggcactacaggacacaaattaattcagtgtgcagtcaagaaacagatgcactcccttttacttacaccaactacttcggttcacctaatcttgtttgccgatgatgatgacatttggatatattgagataattaatcaagtcatcaatgctcactactgtgtttgatatatgtaagatgattcatgcgtcattgagttctttctgaagtttaaaatgggctgtgcagtacattatttactgtgtatgacctgtgagattaattgaaggtttactatgaaaagaagataggtgtgcttatcagattgcttggcttaactgttgggcacttaatatgcatggattgagcaaaagcaaatgtaagccaaagttactacaaggttttcacagcacctctgcagactgcagtattcttatagtaccatcctaactaaccacaggagcttaatacagatattagaaatgcattttagaggtatttttttagaaaaggaaaatacttcagaatttttgtagtatttgtatcatatacataacaccagacatacatattattagtttaatgctgacttgtataaaattatgggcgtcttatattttagaataaagaataaaggagtaattaattagttcgcatatgctcattgtgtcaaaaaaaagacttaattttttgccatttcatggaaatttagtagtgagaagaaataatcaaaatacccttgctaacaaaaaaaatagtattgctaactagtcagatatataagatatatcgaagggataacactctttagtgattgtcgatcgatttgtcaattgatagtagataagcaagagactataaattattttttaaaataaattttgaaggttggaaacctttttatttttttaaaaaaataaaagaacggatggagtactacatactcctatacacacatatatatttccttggtggctaagagtctactctacatacacaagtgtatgacaagtggatggaatatggctatgactattacgtctcattccgtgtctggatttgtcatttgctgactattaggagacgacgtttcgttctatgtctatgtatgcatcttaatttctttcttgggatttttctcagtcactgttgatatagacaagcaaactcattcttgaccaaacttacgcatgcaatgcaatgccatcagagtcaagaatattataatgtcgcacacgtacgtactccctccgtttcagatcaaacgaaatgcgacgtatcctaatataataaattttgatagatgtatgtttaaatttatagtattagaatgagttatatcccgtattagatttgtttattttgagactcagatcaaacgaaatgcgacgtatcctaatataataaattttgatagatgtatgtttaaatttatagtattagaatgagttatatcccgtattagatttgtttattttgagacagagcgagaacacactcatgtataatcagctagcgtataaatcacggcattgttttggttgttagtgacttaattagcatggaaatggaaatgcacactcttagtgtaattggcaggatacgcacggtggtcaagaagagagaaacatcgtagacttgtagtcgagtatataaaggcgtttggtgggttctaaactccaactttcaaatctaaactttaattttagtgagagctaactcctataagaactgagatgagtataaaaagtgtttagctagattactcagttccacgctaccacatccctcgtcgcatttcgtcgaacatcttgttggcgtcaccctgccgttgccgccgccgttcagcccgcgcgctgcgccgccgggcagcccacaagccgcagccgatcagcttgcgagctaggctgccacctgtcaacaccgctgcccgcacgccgccgccgatgccatctccttgctgccctcggcaccacatgccgccgcccgccgtcaccgcctgccaccgatgctgcgacccacccgccgctcgccgccactacatgccgccgccggccgtcggtaggaggatggggaggagagagaacgggaggagagagggtagcaagaggtagttcagtggcattttgtgtgaatacactaaaaaaattaaagggcagtggatcttttgaggtagagtggagctgtgaaacagaaaaaactcggctccatacaaatttatgaagcagctatactaactccgctccaaaataataaagaaactgtaccatttgcctaaaacctgaagcagagctggcaggccacagagaaaggcaaggtgcgtgcgtgggctggcccagaagagtggccagtgggcttaggcgctgtggcccatggttggcccgtaggttgggctgggatttctggcccaacaaaactaaactgaagttcccactcttctcttctcttctatgaaaatgaaaatattccatgaaaatacaaataaaggtaggacatataaaaaaatcattaacacatgaccaattaagttttaattattataattttaaaaatagatttgtttgatatttttaaaacaacttttatatacagaaagttttcacacgaaaacagtgttaaccaaagttgaaataaaattaatatgtatttaatcataaaaaataccatccatatataaatcaaagaagagagagagagacgggcagatggctgctatcggaggcttggagcagctagcctgggtgttcgtccaaaaaaaatagtttttgggatgaatcgaaacaagaacccatccacagattcattcttaaaaattgtttttttttt

SEQ ID NO: 16949 - DNA, 11924 bp, Oryza sativa
cccccaaaaaaatttgtctgatgcacagtcaatcacacaccctgacatgcaacacttcctctcttggaacttcactccagtttaccggcatcatactacaagtattataatgcagatggagtagtaagtatatgctctccctctggttccatattaattaacgtttagacaaggttaacgttaaacttttataatttttatttttaaaggaactaaaacaacgtatatagatttgtcttttaaagcattataataaaagtaagcatgcatttatttattatatattataatagaaaaataagttcaaaaatatatctcgtagaccgtatcattatttaaaatgtcaattaaaataaaaccagagggactatagcagatgcttccagcagctagccagccttcctgatcgacttcttttcacagcagcaaaactgacctgatattcaatcaattttgagtagacgacgatagatatatatattatatataccgtatgatgcatagttaggttttgattcgacctccatagccgtaaaaaactatgcgatcgatcgatcaattacgtgcttaagtacaaaatacagtactatactgactcatcagtatcattcgcactatatatgttaaattttcctgctaaagtacgaattgatcctcttcatttacatcgatcgatgcagagttctaagttctaactagaaaaaccgtgtggctttgccgcgcatggtaaagtgaacccagctcattcgactttagtgaagtaactaattagggcccctttacttgaaagaaaaatatagaaaaatataagaacttttattctatatagaaacaataaattttgctatagaaatttttttatatgattctttgaaccaaaggattattaaaaactattgagtcttatcaaatttctaaggaatgcccaaattcatacaagttttggagtatttttaatataaggtccaatatcacgcgaagtctcttatgagtttatctctctcatctaattcttgcatttttcgtacggtccaatcaaatgattattttatatattattttatgtgttttataattctttgttttgcgcttgattttttgtcagaattctatgtttttcctattcatccctcaatctttgtttcaaagtagcccttacaagacatatataggttgcatttgaccgagggagaaaagagaaggggacaattttgctagtacaattgtacccctactttgatgtcaaataccgattttatcctacattttagggttgttattttttgccctatttttttcaaacgaatgaggcgtttacccctgtttttgatggaagtgagtgggattggacttaatgcggtaaagaattagagaaagaaagagataacgattttttaaattatcgattgacccttttacccctagaaaatatccaagtaccgcttggtgtccctccaggcttgagcacttggcatcgactcttcccttcatgaacccaaatccccgttgtgaagcagtggcggcagtgtccctgggccggccggctaggcaatgggcacgacccgagcaagtgcaggccacccaacccagttgcagcgtgcatgaggaggctaggcattgcgcaaagaggccatggtagagaggaggacaatggtggctgctgtagctcagcgtagggaggaggtgcggctgctcgacgtgtcgaggaggcgatggggaggaggacaacaggtcaacggcggtggtggtggctcgatgagagaaggcgacaacggcagctagcgcggggaggtgatggtggcggctcgacgtggggaggaggcggcggcggctcagtgagaagaggaggcaacaacggtggcggcggtttgtgagaggaggcgacgatgacagcttggcacaggtaggcaatagatttgcttgacttgtctatttgtttttttcaagatatcaaattttgaagcaaatttttattgatgtttatgttaaaattatcatgttggtaaaagtttatcgaatttgcaaggttcatgtgctaaatgtgggcaaattcttaatcatgaacaaaaacaggggaagtttgcaacatgagtaagggtattgaatgccttctcgctaaagatttaatattgttaatctgcccatcaaaagtagaggcaaaatttatctttatttaaaaaaccatgggcaaaaacaaaaccctaaaatactgggcaacatcaatattgaacatcaaagtaggggtaagaatgaaattgccctaaagagaaaagattctatgatttccgtagaggaaaacacaggaaagaaataatataaatcacatgaatacggacacaaaataaggaaacacaggaactgcaaaaggatggatgtttgcagcgtaggaattttagtgggtgatttgattacatcctgttaatcctcttttagtctgatcaaagtatgtatcattatttctttagttctcaatatccggtggtaggaggaagcaatagcttcctgagctttgccagccgtacggcggcaacgcgagaaatcacatagactgctgtgcccccatggacctaattgctcgatcaatagaaacttctggacgaccttctggacaaccgctgcacgcacgcacacgagcgtttcacgctgcacgcgcacaagcaggatcgagccatcccgcgaaaccggtgttgccacgtggcacaattcttctttcaattttttgcatgaaattcgtattataagataagattaacatctcactaactccattttacgtcgtggtccgggcatatacgtagtacgatccgtcaaattatatgtgccagcaatatatgtttattacgcggccttgatgtgtccatggaaattaacgaccggtcgaggacactgcaaggcagctagtgagtgagactagttcgtaaagaacagtagtactgatgaacgaaattaacgacgaggaattaattcaaagctagcaaagcaaacatctccgtccgttgctgtaattaaattaaccgcgtgatcatactgcaccacagcacatccgtgagcagtactccctccgatacatttcatattataagttatttaatttttttaatcaaatttctttaaatttaactaagtttataacaaaatataataatattttcaaatattgtgtcaaaatatattcaatgttaaatttaacaaaactaatttggcatcatagatgctgctaattttctctataatagtcaaatctaaaaaagtttaactgtggaaatatcaaacaacttataatacgaaacatatagagtataactgattaaagtctctactaagcttaatgcttcctccgtagtaaaatattactcactctttttctaattaatcatcatattacataagtacactaagatgaacgaaaatcaattattctcacgtgctacttttactcagtataaatttaatatatgcactatccccactattttctaaccaataaccaatcaaaatattgtattgcaggttagttggttgtaaagagttaggtgtatgatgcatgtatttattaatattcatttactctgatacacggataacgaataaacttaaggatatatactaatatatattgatcatttataaataaccttaaaagttatatgatgattaatttgagaattgggagattacatagttttagcttaagaacttatcacacaaatactataattttagagtgggatttactatacctatttactagtactttttttccttcttgtttcagccgtcgaatcagtagtacaccatatccttctccttattttctctctattttctatatctgactagcattttagggatggagggattacgtactggcactgtaattaataaatcatgtataacgagttagttatgacttcaagtatatgtatgtccatatccaaccaaagtagctagcagctagtagacaggtgaacacaagaaagctacgtactagtagcaaataattcatcatatgatgatcgactagtaattaattaattaagcaataatgctcggttcttgactatatatatatatatatatatatatatatatatatatatatatatatatatatatatatatatatatatatatatatatattcaattttgatccatccatcgatcacctagtttgaccagagctgcttatactgcttacgccaatttggattaattattttaactttttaaattctttcagagatgatggccttcctagttggacttgatctaatgcaaactgtccattctgtacaccaaatcatctactagtcttaaattaattagctaatagcttagcttgttcttagcctcactgcaaggacctaattaaagaatagctagctttattgtccaggaagtcacgcctgcatatatatgtacctttcaacgtttttgatcaattcatagcaggaattgatgcgaacacgaacaattcaaactggcctgaccggaattcatttcgaattgtcaatgttggtacgtagccgaaatgaattgacttccgtagcaacaaagaaaatgagaagaaagtcttgtgttaggccaaagcaaaaatatttatttattttttgacctccgtttctgaccctaaaatggcagaaaaattaaagctctgcaaaattttatcttgcagcgagattgactgtcaagaccttggagctagtggatccgtctctctccgggtttaggcgtttagggctcttttgaattggaggagattcataggactttttcaaaaaaaaaaagagataaagagattcgtaggaattttaattgtaagaattcatttcaactgtcaatgttagtacgtggccgaaatgaattgacttgtgtagcaacaactacaatgagaagaaagtcttctgttaggccaaggcttgtggacctccatttctgaccccaaaaatgacagaaaaagctctgaaaattttcatcttgcgccgagcatgaccgtcaagaccatatggtgtctgtctccaggcttacaatttcggttctggatctccaaaatttcgtgtttaccggtggctccaagtaggaggttcttccgaccgaatttgtaaaatttttgaacttagcaaaaaaataaaaataaaatcaaatttaacaaagtttcttaaaaaaatgatactatttatttataattttaaaaactttcaaagttgtttggtgagcaactgtgcggtggggccaccggcacagaggcatgcacgtggccacggccggtgaagagaacaccctggcagaatggctgggtttctcgaagctacaccgtttcccaaactacccctctgcctcctcacccacgaatctgaaaccgtcagtgtcatcagcagcagctagcctaaagataatactgttgtgtggcaaaatggcgtcagttcttcctccatcacgtccagctgcctgcctcggaacagcaaacctgatttgcatagctcaatctgagggcaacagacaacagctagctggctattctctgaattttctttgagagagtacagtactcctactccatagaagtttcatcgaagggttattttattttgtaggaaaaggtatatgaattttagataattgtagttctatggaaaaaacatcgtatgaaagcttttgaaataaaggattaaatcatatcatttccttttaaaattcttatggaatagataattctacatagattttagaggaaaattagcaagaggtctaaccttttttttaaaaaaaatcatttgagtctatctctctcacctgattcatacgtttttcctgtggttcaattaaacgatcattcctatggatatttctgtatttttcaatcttctgttttacttttatattcctatttaaatcatgtgttttttctattcctccgtttttttacattcctgtgattcaaatgaggccttaaaattctgaatctttgtgaacttcaaattcttgagttactccctccgtcccagaaaaagataaaccctaaattttcgtgttcaactttgactgtccgtcttatatgaaatttttttataattcgtatttttattgttgttagatgataaaacatgattaatactttgtgcgtgacttgtctttttaattttttttataatttttttaaataagacggacggtcaaacgttgggcacggaaatcagggtttgtctttttttgggacggagggagtactccattcaagttccattatcagggtacagtacacatgtgaaatctatgctctctgaacattctggagatactcgattgaagtttcaattttcaaaatttctgaactttctgaaactatagctttcagaggttgggaagattcaggggcacacgtgaagatgtggcgtacatcgatgcaaatgtcgtttgataccggtaggtgtacagggcatctcaaatagagaacggtaggtgtacagaagccataccataccataccatgcagagtttgtacgtatacatgtattcaagagaggatagctagtgatgttggggtggcatgcgtccagaagtacaaggatggcaaatggccgaatgcgtgttttgcgtgcacaacatgtggcatcacacattaaacaatgcttatctgctaattgtgctatcattggtaaattgcatgcgatggatccggagagaagaaagggatggttggggtcatgagggaaaattttccttccttttcgaaagaactgttgaaaacactgaacttaacgatgcatacaagaagaaaaatgacataaaaataagcctattcaactgaatttctactgtagctaccatctttttcagtacttctagtttgttcgagcaaagtgaataaattgttgttaactattccaaccaaaatctattacatttagggacggagggagtactctattcattctaaaatataaacatttttagatctaaatttataccataatataaacatctttggtagcactatgcacgaaaatatgtacatttttcagtcactgagatgtttgaaaagagaattgaagcaattcaaatcttaacaattgaagtaactaaaatagaatatttttctccaccttagttttagtgaagaatataaaaataaaacagagggagtagtgcttaccaccttcagttaaatttattgtcgttttggacacttaattttttccttataatttatttgtccaaaacatcaattgattttgtctggaggaagtagtagtaattgatgcagtgagctgcctaactctattaaaaaacactcgctttctgaaccttacagaaatttcgctggccatgcacataatcttctctttgtcaaagagctggaatccaaaatgattgctcgaagatttcgtgaagatagatagaaccatcggctagcaaaggagaggaaataaaaaaacaaaaaaaaagtttttttgtgggctccaccttgcgctgcactgagctgaccaaattgaccataccgcacagagactgagggaggggcacttccgtcatttcgtataagcgtatacgaatacgtatctcatacgcgctctgtatatatagacggtaacggctccgcgtcgtgtgagttggcgagcccgaggagcggaggcggccacaagtctaatccgcgtcgtctgcgcgttcgtgggcgaggaggagaaagaagaggaggaagagagggaagggggcttgatttgatttgggcgcgtctcgtggagtatccggtgagttcttggcgatctggcgaggcgagtgatgagtgattcctgctgctgctgggggattttggcgtgattttcgttggttgcattttgtttctttttttttgtatcgatttgttggagctttattcggtagatctggtcgattccatggtgagttgtatcggcgccggagtgatagctgattctgtttttttgtgtgattttttttttgttttggaaatagggtttgtgtcgaattgagggcattttttttccttaggcaatgcaggatttcgttttgtatgtttttgcgtggaatggatatgaacagacctcgaacaaatggaagaatttgtattttgtatgatggattgcaatgcgatacttgttttggggcgtgattcgattgaaataaatgaaatattagagttattttgggattcctgtttgctgcgcctttttttttagcatttcttgatatgaacaagagaagaagggctgaatttttttcttagctttggaggcatttactgtcccagtattttctcctaccggaagcagaatattttgtttgattggagggttgcctccctttgccaaattgaatcaaatgttctcggatgttttaaaatttccgtggactctttttgccccaggggagaccgcttttagcagctggatcccgtgttttcatttcaagttcttgttttcctagtctccatatatttctgattgttaactcgtattctctacctcacatatgcaaaatcacacttgcgtcgttctgtaattagttagattctgcaagaaaaatccggaattttcaagcatgctagtagttttaaattgatgccatgttttttagacaatgttaattgatgccatatgactataggacacattatattgcgtttctgaatataccacctcatgaaactcataattttgttgattaattgttcaggttgccccttctagtgtgtaacttggagcaaatttggaccctgagacgcaaatcagtcatggctggttctcttgcggcgtctgcattcttccctgtcccagggtcttcccctgcagcttcggctagaagctctaagaacacaaccggtgaattgccagagaatttgagtgtccgcggaatcgtcgcgaagcctaatccgtctccaggggccatgcaagtcaaggcgcaggcgcaagcccttcctaaggttaatggaaccaaggttaacctgaagactacaagcccagacaaggaggatataataccgtacactgctccgaagacattctataaccaattgccagactggagcatgcttcttgcagctgtcacgaccattttcctggcagctgagaagcagtggactctgcttgactggaagccgaagaagcctgacatgctggctgacacattcggctttggtaggatcatccaagacgggctggtgtttaggcaaaacttcttgattcggtcctacgagattggtgctgatcgtacagcttctattgagacattaatgaatcatttacaggtgatacaatggagctatgctgctttagcttttcttccgtatttttcactattggtacattatgttcgtggcatactaactgtaatttgaagctttgcaggaaacagctctgaaccatgtgaaaactgctggtctcttaggtgatggttttggtgctacgccggagatgagcaaacggaacttaatatgggttgtcagcaaaattcagcttcttgttgagcgatacccatcatggtactttttctgcaatccactactctccacatcattttcttggatggcaaaacttctctttttactcttaattcataacatttctttcattcttaatggagtacttttgtccccggtgcatttagtgtcacaatttaatgtttacatggtacgggaaagatttatcactcaatatccacggtgtaatgtttttagctaaactcaatatccacggtgtaatgtttttagctaaacttgtcttcagtccttttttcctttttccctatgtttgtgtgctgtggcattcgatggatcatcgagactctgagtagacgtagattcttgcattccttatgcgacatgaggcacatgttcgagtgtttatcaccctacatgaaaacctttccctactaagttgctgcttctattgttctgcagatataagcaatatttttgcctatttttcctgtgctttgaacttctcgtaggttcatggcccacaacctttagcaggcatagtgccttgaaatggagtattacactcaaaagcataacaataacatgtattgccttgtatgataagatgagtgatagatcttttgaaatcatttactgaggaaaacgtttgtttatttgacaagacaatgtattgatgaactagaactgctctattaagtggtatctgccctgtgtctcctttcgtacaaattgttgcacccctgttcatgttacttctcacttttcaccatggcaggcatgtttagaaaatcatttgattttacagggcattaccatgtgaccccttaataactaacaaatatattttgggtccaccaaatctgtggtggatggaaagggaaattaataaacacaaatggaaaattcttcattgtgaaacgtgataaggacaaattttgtgaataaataaagtaacaaaaaatggctagtatttgcctacatatagagtacacctcaagagatcagaaaagttgcctttattgatggagtaattgaattagtagtaagcaataaattctgtggacctaggggacatccctgatctagatcgagttttgatctcatgctacatttaatcttccatgtcagcaactttcagtacctgctattaaatttcccctgttcttctgacgattgatgcaattttaagtttatgagaaggaaaacggtctgctgtttttgaattctgaatgtagtttacacaatttctcataggctgaaattttggttgcaaatttttaggggagatatggtccaagttgacacatgggtagctgctgctggcaaaaatggcatgcgtcgagattggcatgttcgggactacaactctggtcaaacaatcttgagggctacaaggtttgtgtttatcgtttgcatttgttgcatttcttttgtttcatgctgtttaccagcatgttttattccttttcgattgctaattgttcctctcttgtttgcagtgtttgggtgatgatgaataagaacactagaagactttcaaaaatgccagatgaagttagagctgaaataggcccgtatttcaatggccgttctgctatatcagaggagcagggtgaaaagttgcctaagccagggaccacatttgatggcgctgctaccaaacaattcacaagaaaagggcttactgtaagtcagttaatattgcttgttaccgtcattcattttgctggtggttctcatgcataaaatttctcatgagggatcctttgttcatgtcagccgaagtggagtgaccttgatgtcaaccagcatgtgaacaatgtgaagtatattggttggatacttgaggtaacttctttttccttttctctatccgaacatgctatctctagatcagaaaagagagtgtctgatcgtaattagtaacctagttcctagtcatatgccaagctgtaaaaacacttgcactgtatattcaaaagctattcaaatttctgagtacgttttgtttttttttcctcagagtgctccaatttcgatactggagaagcacgagcttgcaagcatgaccttggattacaggaaggagtgtggccgtgacagtgtgcttcagtcgcttaccgctgtttcaggtgaatgcgatgatggcaacacagaatcctccatccagtgtgaccatctgcttcagctggagtccggagcagacattgtgaaggctcacacagagtggcgaccgaagcgagctcagggcgaggggaacatgggctttttcccagctgagagtgcatgagcgcttctgtagtttatccggcaagtaacctctttgagaagtgcagattctaacttggctagcaacacaggacaaatgattgttggtgggaaatttggcatgccgagcctgggttttgtgatgcacacagcacacattcagatttgaagattgagagatgcttcttattggcagcttg

SEQ ID NO: 16950 - DNA, 1865 bp, Oryza sativa
ggtttgtgtgtggagatgcaatccattgtagtaacagcctaacttgtacattcttgccatctttttcttattaattgaatgaatgaatcgcagacctcctgcgttttcatcaataattgaaatgacttctgcttcatcaagaattgaatgaattgtctgtctgaaaaagttgccttcttaaaagattgctttctttcttattctgttgaatcgtcctggaaacaggctatttgttgttcagaggagattgctggaaacctcttaagagcctttcttggaagaacccttgatgatctgtcgttagcacgacagctctgagctttgctcttttgctgtattttgtggttgcatggaaggtgcaactgtaaagtgccttgccttacattacattacaactatggttggagaacgtagagcgacgtgcaaacaaacggcgattaatttgtctctcctctcttttttttaacctgaatattttcgtagaaaactaggtgttgcaaaataaataaatggctaatctgagtgtttaaataaaatttgaaacggagtcagtatacagatttggctgatctgttctaagttccaatagaagatctccaaataatttctggcaccaactgcatgctgcaagcaggagcatcactcgttcggtgacgaccaaatcatcaattcatcgtgagagaaattgcataacaaactgcaagtagcataacgaacaggagtaaacaaatcaaagacccatggcaggagctacataggcagcagaatcagattcagataatgtctctgaatgaatgaatgcaaaggcaatgcagagagagctagctggcgttaggtttgcgaccgtgttgtgcagctgccacctaaaacctaagtgagcggctggaaaccaagccagccagcctaccaaccaacccaaccgccggcatgaatttggtgcgagttgtagtgacacttgtccctgaaatataaaatggatataaaagcatatgggtccccatgacagcctgacacacaacccaacctccatgttacaaaacaggtcgctggaagaagaagaagaatggaatggacgagtgatacatagaaaattttgagcgtcacatcgaacgtttgaccagatgtcggaaggggttttcggacacgaatgaaaaaactaatttcataactcgcatggaaatcgcgagacgaatttattaagcataattaatctgtcattagcacgtatgggttacagtagcatttatggctaattatggactaattaggcttaaaaaattcgtctcgcgattttcatgaaaactgtgtaattagtttatcattttatctatatttaacgctctatgcatatgtccaaagattcaatgcgacgtttttgggaaaaaaaataggaactattatactcacccaattttatatgagctggggaaaagttttacccaatttcttattcgctcttgttatccttacccttatataccaataagacaatcatgcaaaacttttgatgaaaaataaagaattgtctctgaaaatcatagatactctttccatcttaaaacatctaaaattttcgtcgaaattttatcttaaaatgcagtgatttctcctgctaccttttcatctcaaccaatcacgattacaggcatgatcatcaaactgaacaattgactaaatcgagtacagtagtatctttctttcctcggtgtagctgttgcctaccggccagccgacgatggcggctagtagctagctggatgataatagctaccagtgtagatccggccatgttaatggcgatccggcgaagaggggtgcaggacatcaatcaattgcatgcctagctcttgcctggctgctgctgc

SEQ ID NO: 16951 - DNA, 22260 bp, Oryza sativa
  unsure (1)..(22260): unsure at all n locations
caatgtcgtttgaaatgtaaatctaagatttttttaaatatgttttatctttgtaacaaatatttggatatctaaaacatcttaaatgaaaaagttgttaataacaaagctgtagatctctttgagctctacaattttgatataaagttttatttcatctgactttatataatataattttaaattgtaaaatcatagagccaacaagttgtgctggaaaatttgcatttaggtcctgtgccgcactctggaaggacgatttttaaactcccaaaaaattattttggtaaattttttaataaaaaaatgtataaataaaaaaaattcctctctcactctctcgctctctctctgcttcgtagttcgaacctccgaatgctcgctgcaagcggcgaatggccgcgtcgcgctgcgcagcgcgacgggcactggcgctggcggcggcggcggcggaggcgttggagcgcgcgtgctgctcctcggacgccgccgcggtcgtctccgggaacaacaggctgatggcggagcacctgagagccggcaggctggaggccgcgcgggaggtgttcgacggaatgccgcggagggacgtcgtgtcctggaacaccatcatggccgtgcaggcgcgggcgggctcgcacgggagggccgtgggggcgttcttggagatgaggcgccaggggttccggccggaccatacctcattctccaccgcgttgtcggcctgcgcgcgcttggaggctctggagatggggaggtgcgtccatgggcttgtgttcaagtcctgctcctctggtaatgtgtttgtgggtgcttcgcttatcacgatgtatgccaactgtggggtggtcagctgcctggagcaagtgctggatggtgttgagagtccaaatgtggccttgtggaacgcgcttatatcaggccttgtgatgaaccatcgtgtaggctatgctcgcaaggcttttgatcggatgccagtgcgtaatgtggtgtcctggactgccatgataaaagggcactttacagcgcatgaggtcgacatggcgtttcagctgtttaaattgatgccggtgaagaactctgtgtcgtggtgcgtcatgattggaggttttgttacgcatgagaaattcagtgaagcagttgaattgtttaatagcttgatgatgaatggggaggaagtgacaaatgtgatcctagttaaaatagtgaatgcttttgctggcatgaaaagtattagaggaggcagatgcattcatggattggctgtgaagtctggttttgcttacgaccttgttcttgaggcttccttggttttgatgtactgcaaatcgttggacatcactgaagcacgactggagtttgataaaatggaaggaaatcatgttggttcatggaatgccatgttatgcggctatatttattcggataagatagatgaggcccggaaactttttgattccatgaataaccgagataaaatctcatggaactcaatgattaatggctatataaatgatggaaggattgctgatgctactgagttgtactcaaagatgactgaaaagagtttggaagcagctactgctttgatgtcatggtttatagataatggaatgcttgacaaagcacgggatatgttttataatatgccccaaatagatgttatgtcttgcacaactttgctgtttggatatgtgaaaggagggcatatggatgacgcgctggaccttttccacatgatgcaaaaaaggactgttgtcacctataatgtgatgatatccggtttgttccatcaaggtaaaattactgaagcatataagctctttaatgaatctccaacacgtgattcagtgacttggagctgtttagttgctgggctcgctacaaatggtttaatccatgaagcacttcagttctacaaaaagatgctactgtctaatatacgacctagcgagtcagttgtttctagcctcataagctgtttgtcaaattattctatgatggttcatggccagcagtttcatgctacaaccattaagattggactcgattcccacttgctaatccaaaattcactcattagcctgtattgcaaatgtggcgaaatgattatagctcaaagtatttttgacctgatggctaagagagataaagtaacatggaacacgatcattcatggatatgcactcaataatcttggtcaaaatgctgttgaaatgtttgagagtatgacaaaggcacaagttgatcctgatgacatcacatttcttggtgtactttccgcatgtaatcacatgagccttttggaggaagctaaatatttcttcaatgcgatgacatgtacttatggaattttacctaatattatgcactatgcttgcatggttgatctcttttgtagaaaatgcatgattaaggaggctgaaggattagtgaagtcgatgccatttgaacctgattcagcaatatggacttctctattgagcggttgcagattgactgcaatgataagttagcagagcatgcggcgagtcaattaattgccattgatccttgtactaaaatgccttatctgcatctcatcagtgtgcatggattaaccaataaatcgactgtgattgatagtttgagaagtcaaattaaaagcactgccactgaaaaggatgttggctatagctggatttagcatcccattttgatttgcagatgtgtactacagcaatgggatttgatcatttatgcagaaaacttccaacaagcaggtaaaaaatctcacaaagtagatggatccttggttgaggctttgataactttgatattgttctaatgagatgataaatttgtttacagtgtcattcagattgtttatgagctggttgacccaggtttatttatgagggatagaatagaacaagcatgaaagatgaatgaaatgcatctgtcgactacaacccaggttgcatattccaacttaggacttcgacagcagcaaaatggcatcaaacaaactgaggcatgtagttgtcatgcctgttccatggttgcctattctgcaacggagcttctaaaatctgaatacatctgctcacagtttgcaagtagactactctacaatcaaagttgactggtatgtatcaggtaagcatcaagctaaatcgtgtctctatcgattagagtttaaataaaagcataagaaacactattatagatgggtagatttgggatgaactggcaatctgatatctgttctcaaaagtttagcggtcaactgtgaatagtatggcagtgtccttataaattcaattttttttcactgttcaggaatgttaatggtgaactccgccatcaggttgtacttgtagggtttggtcagcatggagacgtgaaagttttcagtaaatggtgtgggcaaatcacgaatcaccttgaaaatgccaagacagtttccgatcatctggccgcttcattgcaggttttcaatccttcgtcctccctcccccctgtaaatgctctttttttattcttttttgtaaatatattacatagggacctcccctactgttcaccggtaaatgtataagatcatacacaccgaaatatgtttgcaaacaactataaacaagattcccacatattggatgtatccagttggaacttaggatgaatcaaggttcgattcaagcataccacataatcatttgtaaagcatttgagtacaccttccccaaataaagcatacgtgcaagtgtgcaacgaaggatagcatatgtcagaacacgggaaaagtatcatataacgcgaacagcataccaggtacagaacttggctatccaaattaatctctttatcctagtactagcaatttgcatagctgtttgcctgcttaacagattgtattgtgttgcgcacatgctacctaagatacattggcccaattgagtttcaacaaatgcattctgttgcgcacatgctacctaagatacaatggcccaatcgaattttaacaaatgaaagctcattccttcttctgagtgtccctgggaatgcagcactggggatagcaaatatctctggctgttatattgctgttaacaagaacaaataggggtggatgtctttcatgtgccctttggcattcacctccaccttgcacctcccaatctgattacctcttcagttccagaatccctgcgagctttatcatcacctgtatcatcctttgtgtttgtcgcgtcaccatataaatccttcaattttgccaagttggatggctctggtggtctaccaaatgggctagagcggtgattttcaccttcggttctgccacggtttggactcctgctcctgctcctgcgggcactcgaacgtccatgtcgatcagaatccctgtccctcctttcacggccttgtctgtcaacattcctacttgaatagcttgaacgacggtaatcacggtctctgtcctcacgggcatggcgatcatgctccctatccttgtgcctaccacggtcacgatccgaacgatcacgctcagaatcatgatcacgttcatggctccgacttcgtcgcctcctgggtgaagatcttgcacactcaccatcagaactcctttctctatcccttgctgaaggcaatgtcttccggacaggggatgagtcccttgtggatgcacggtgtggagcacgctgaccaaaggagaccgacagagaagcctttactgaaggaggccgtcgggcagtatcatctgaaccaaggcgactagagtcccctgttattcctgactgctttgttgggagcttcatcttctcaagatggccagtgacctgtctcaagatcggaagaggcactcgtggaagaagactgtcaaagtagtactgcaaaggaaaaacaggcatggacaccaagtttttaatatcatgtctcaatggtatttctcaactaaatctaccagaacaatagctcaaaaaagaaacactgaacaataacatcaaaatgatcaaccaaaatggaatgaagcaaatatagttgtgaggttaatatgctgtcttggcatgaagtagatagacgtggtgtggggctctcagtaacatgcggctctaagcctctaacatcagatgtgaagacaaactgcgatagtagaaaataaattggaatttaaaaaactgcattaaaaaactactcagttgttttgtgattgtctccggccaactgtaaacactgcttcaactcacccatgaaacattcatcacaatttgctatttgttctctgctaacttgcatggaaaatgaaatctacgaaataactacaatatcatagaagccctgactggcaataattatgaggccgaccagtaaaaggaaaaatcaaaaaagcactttcgtagttcactatttactaaaagttggggtattgctcacccgtttctgttcactatgaacctaaaaaaattataagtaactttcaattattacatgattattacacactgaacttcgttttcatttttgaaaggaaagttgattttctagattagctattccaaaatatcaagcatagacagaatatctcttgccaaagaagaaacaaatatgagacgtagtcctcaacaaatttaaacagaaaaaaacatctcaaaactaaaaaagatagcaccatagcatacatcattttcttttgttataaatccttaactagatgaaacataggaaactctagcagaaaaatggaaaataaacatttgagtaacacatcatgacaaaccttatacaaagtggttactggtggaagagatgatgtctcctcttaaagcaactccacaattgaaatttccgctcagtatgccaaaccaacaggtgagtgattcaacaaacactaattgcatttatgttcagaaaatactatgtcaatgatgtatgcccacggatgtgcttgggtaactaaaggacactgtaacaggaactttacaatactgttctatttaaaggcagaaatgaaatgaagttcacaagatatacctgcccaagtagaagatctcgcacataaacacccatagtagtcattttaccattagatccaggagaaaactcctgagcaagaagaaaggcacagttttcataggtacgttatgcagggattgaactttaataaaaacacagaacatatatttacaactgacaaaggcacacaaaaaagtaacaatttaacatattaaaaatagatccagatggctcagcgctcagttcacatttcatgcacataacatgtttatgctaagaagcaaccattattagtagtctagtgcaggaatagtgatgtatttcactttttcctttctttctggagtttacgctttcatgttttcaatattttttttctggtttgtacaagcattgtccttgacaaacagtaggcatcttatacaaatttagcataccacgtaccatttatagggagcagtactaaagtttgctgaatacttcaaagtacaaaataggatatacgaaggaaaactatagatttatccttttacagcttcaactaatcgtcaaaatgatgcaaaatacaaagaaagctaccaaaaaagataatacctcatcatctttaatgtagggttcataccaactccacaacgtctttggttccgcaacatatcgcaggtaaagaaatccaacctgaaatataaacgctaattactgtctgagagcgaaaactcaattgtttgacacagtaaaaaatcatgatgcttcatttactggtttaggtgcagatttatctcaagacacattaacataggtttctatatatccttcatttactggtggaaaatttacctaatagtagcaccaaggctcattttcaatcacactatcaacactcaacagacacacatagtgcagcgatttagcaaaatctacaatattcagtaaatcctctacattgcattctgcacgtaacaaaccatcctaacaaacagaaccataaattaacattgcgggaaccggaagagtagaaaacaacaggcttacagctctgatgtaaggcgagtcagggtgcttcagcaggccgtgcatctgcttaaccgtgagcttcatggtgaagaacttgtagaggaggcagaaggcgctggagggcccgcggcagttgccggtcatccatggctctacgtggtcaacctgattgtagatctcatcaatgacctcgtggtaagtcttcagcctgtagagctccttgaagtagtccgaggagaggatgttcactgacaaaaccttctccatgagcacatcgattggcctccctgatgactgtatctccatttcccctcctctgaaattaacatcacacgacatcattccatcaatcaatcaatcaatcaatccggggagggggtctcctaaacctagttttaatctctgcactaatttaccattgatcatctccaagaatcagtatttcacggttcttagaaaagatcaagattttctaacggggagaggatctcttgtagctcaagaacaagggagattaaagcaggaaaagatgcttctttttgtgcatcaaagatccaaactttcgccgtggaaccgaaagctttacctcttttcttctcaccgggatgcgaagcggcgggcggcgcacgggggaggccacggcgagcggcggcgcggacgagattggggattcgttttggattggggattagggcgacgagaagaggagagagagagagagagagagaggtaaccgatggaggagagatggagtcgtggccgtgcgaccgtggcaacgggcgaggttacatcttacatgtacactctaccgtctgaacagccgtatcgcagccgtccgtcccttgatctacggatggatggatggtatgcaggaatgcaaaatgaaatagttcatgcacaagcacgtattttttaaaagaaacacagtacaaacacagacattcgcaacacgcacacacttatccttataaacacacatcttatttctgtgagtctctctctataagaccgggttgatatatcttaagatcgacgtcttgtgtaccatcaaaacttaaattcaaaaggtacactcgctttgttttaaaatacacacataaaaaaaatatttattttcatacttctaaaagattatttataaatacttaaaaaataccatattgtttaagtgtataacgttgtagacgtacgtatgagactttcgttatttatagtctaattatttaagagtaattagtgatcacaagtaaaacaagttttgtatatttgaaagcagagggagtatcttgcaagcaagtttcaagtagacgggagttacgagattcaaaaatttaagctacatttgccatctatatattgcacatattaaatggtccatgaggtattttataatggtctctattggtaatagaatcaatataggccattcatatttttcaatctattgactcatactatctattaacttattaaaggaatataaaaaggagcatgtacgttcgctctcacggtctataaattctcagattaatcggagaaaaagaaaaacagagtccatatagaaatacaatttagaaatagttgaaattcggaattaaaaaataaggaatattggaagaggagacaagtccatatagaaatacaatttataaataactgaaattcggaattaaaaaataaagaatattggaagagaagactagagtccatatagaaatacaatttataaaaaactgaaaatcggaaataaaaaataaagaatattagaagaagagtatagagttcatatagatatacaattaagaaataatagaaattcggaattaataaataaggaatattagaagtagagtatagagtctatatagaaatacaattaagaaataatagaaattcggaattaaaaataaggaatattagaagtagagtatatagtccatataggaatttaaaactaactaaatttcagaatacacataataaaattaaaagaagagtttagagtccgtataaaaatataatttacgaataactaaaattcaaaattaaaaaaaacatgggaaaaagagtctaaagtcaatataggaatacaatttagaattaactgaaatttgaagttaaaaatttaaaaatattgaaagatgagtttagagtccacatacaaatagaattagaaaaaatagaaattcagaattaaaaataaataatattggaagaagagcctagagtctatatagaaataccatttacagataacgaaaattcggaattaaaaaaagaaatattgaaagacaagtctagagtctatataggaatataatttacaaataattaaaatttgatattaaaaataattaataactaacacgcatataaaataaaatatgaatattacacattaatagtttcgtaaagttagtacaaaatttaaaattatgttgtcattttaatatatttgaataatacattgagaaaacatatatgctattatatgagagaaaatataatgatactagccgcgcaatttgcgcggaccactatgctagtttatactatctcaacaattagtaaaattaattttctactactagtagaactcataaatcaatagatcatttctattagtcataatattggtagtagaacactgtcaatagaagtcactgtactgtatgtaaaggtactcattttagtagtacggttagcatagcgacagttatgagagaaaattaacatatattctatgaaactagagaatatttcttcaagggagaaagtatgacgattacgagagccttgtgacaacgaggctcgtcaaaagaacgatgatgaagggagattgggagatcacatatattcccttcttttaaaagtgcaagctgaaagcagcaatgatagctgctagacagccaagtcctttgtcatgccgttggcatggtatttactccctccataaaaaaataattaaatccttagctataaacctggatagtattttttttaaaaaaataaattctagctatgaatctgacaaatgctatccaggttcatagctaggatttgatttttttttttacgaaggggtatctaattaagcacattgtgtgaaagagatgttagccggcccatcagtacccactctgccctgtgcgactcgtgagaaacatttttttctgaagagataatgttctttcttttctttggatgaaaagtgatcttgttcttatcttctgagttctgatacaatataatgtaatccttttttcctcttgttctgcattattatgatattatccttgtgaaattctcttatctttctttcttttttaagcagatggaatgagctctacgccattcatttcagagaagaaaaaaggatgatagcttgtgaatatcatagggacaaaatttcagacaaggtgacatctgaacttctgtagttttggacacaacctaaataatcaattgagtgggcttagatcaaaacccgattccattaaggattactttgcaacaactaccaaatcacaagctacaccatacacgccacgcattctggttacatgcttcaaaaactcttccaactcgatcagaagagatcagcacccggagttatttcccatctgcactaccataatcccccctaattaaacacaacacgcgaacaaattaacagcccatagacttgttttttaccaccttcttcttcttcttcttcttcttcttcttcttcttcttcttcttcttcttcttgttctacgcttctatcttaagattcttaattttaattagcctcctccgagaagcaccttgttctactgtgcttctgctggtcagagagtacttctgcttctgctggatctactggtagcaaagcacatctctgctcttgtcagggctgtgttttgtgcggcgccgccgcgacggcctcggcgacgctgaagaacacgcggtctgagccgaacgtcttgccgaccaccgagttgtacagcctctcggtcaccgatccaaccgggttggccagcacaagctgcagaaatccgtcagaaattagctcatgttactattcactgtcactgacaaatctgaatattatctgatagtaaatcactgaaactgacaagaagaacattggtagatagatgtttcagaagttctattacctcgatgtttcttttttccagcaccttcttcagctctgcaagtgcatcgaggccactcgtgtcgatcgctgcaacagctgcaagttcatcgaattctctgtcagtttgtactgatcacaagatagtactattattctgagaatgttatactgaataattagctgctctttttactgaacagttagctcatcgatccatgtgagtttttactgaataattaacaactctttttactgagaatctttttactgatcaagattgtactacaatctttctgagaacgttgtactgaatgaataattagctcatcgatccatgtcagttttaatttactgaataattaaccactcttttcagcatttttttaactgagtatgaattctgtacaggagtagtagcatgcaagagcttattaccactcatgtcgaggatgatgcatctgacagggcactggttgcacttggcggcccgctcgtcttcctcccggagaaacctcatgatcctctcgccgaggtacatggagttggcgaagtagatggcggactcgacgccgacgacgaggaaggacggcacacgcatggcctccctgtactgcgccatgctccggtagctcgccgtgccggggacgacgcccttgaccaccatgtttgggcgggtgacctggaggaggatcttgaagagggagatgccgacggcgatggcgaggcccatctggacggagacgaggaggacgccgaggaaggcggccatgcaggcgaggaagtcgagcttgtcgaccttccacagcctggcggcgccccggacgtcgatgaggccgatcacggcggtgatgatgatcgccgagaggatcacgttgggggtgtagtggaacagcggcatcaggaacagcagcgtcaccagcaccgccgacgccatcacgatgttcgacaccgccgtcttgcaccccgcgctgtagttcaccgccgacctcgagaacgatcctgcgtccattcattcagagttttttttgccaatggtgagccattgcgatcctcatctagcttctatgaatattactcacatcattttatttctcattttgatttatttttatctttgtctttttttttgttgtgcatctcatgacagaagccggagatataatccatttccattatctaaatatgaatattactccctcattccgttcatattataagtcgttttgattttttttagtcaatctttttctataatattgaattaattagtttcattgaatgtaacgttgaatatattttgataacatatttattttatattaaaaatattgttaaaattttctgtaaacttaaacaaacttgaacaagttagagtacctccggtcaaaagatacttatcgtataagatttggtcaaacttttgaaattttgacagctaattttatgttagagtaaatttataaaatataaacattttataatactatgataattacttttcgaggcaaatctatatactatatcgtttgttttggttttgaactatgcatttaagaaattactgatggtcagaattttaaaggtttgatctaattttatctaaaacgacaagtacttaatacgttcagaagctatggtgcaactgacaaaccaacctgtggtgacatagcaggaggcacatgagccagccatgttcatgacaccaatggccatcatctccttgtttccatcaacctggtagttgttgatggatgcaaatgtcctgcctactgctatcccttcctgcaaattcagtcatttttcctttcatgttcagactaaacatcaccatactaaaatagttcaaatggtaaataaaatgtgttttttatgtaggtgccttacagtgagagatagtatgccagtcataattcctgtgtttaaggccagtcctacgtaggagccactgaaggtcagcatattcgctgaaggagggttcaatcccttggggagatcgccaatctgtccaaacaccacccaaaaaaagatgaattagtgtgactaatgacgtttctttcatgttctcgatgtgaagctgtccatgaaagattcagaaatggtttagagaagctactcacaacactgatgccatgagctttgctgacgaacgagatgatggtagagatgatcactgatgtcagtggagcagctgctgacacccagaaaagctttgggttcctggcgctctgcaaaaatacagtgaaaattgttaccggctgcatactcgcatcaaagtcagagaaaattgtatacagcgaactgaagaatcagaaggtaaaaaaattattggcaaccacaacagcggttcacataatgaattcagtacatatttttttttaatttttataaaaagagttcagtagatcttgaatcacaaatgaaaagaagttctggttaaaacctattaatttggcaggccccatctcctcacatcttctgaagaattgttctgagatggtcccatgaccgtggaattgtcgcattaattgacactttttaatcattccaggtgaggaacagcgtcattacaaagcagatgacttacttttctcagaggaaaaccattaacagtctaatggatgtgtttatcagatcattctgtttagactgaaaagacaccgaaattcagagagatgagcatgtgaacaaccagcttaacaggtgacacgtcagagtggccaaaccagatccattcttcccaaaagggaaaagagaaatgttccaattgaaaatggctttattagaatatattctaaagccacacacacgccttgctttaattgatgtatatggtctaatcgtattaagactaatgcaagatataaacattctttgtttttgtttagtttgtgagatcatccaaactagaactgctcatcatactagttagagtgcttcatgacatatgtttttgtacacatgatcgattaattaattactaaaagaattagtgcttttctgcaagtgtaaggggagtaaatattattataaactcctttcacaattatgcaattaacaaccttaaatacttctggtcacacgccaacactaactttttagacaccatgtgttagtccaacgttcagatatcttggaagattaggcataagacatgactttttcttggcatagcaactgtttattaagcaagtctaaagaagtttttagattaccctaaagtagtactatactagcttaaataagtttaaacagtttgaaaaaattgaggaacttttatgtgatcccctaattaagaaaaccacccaactactaaagtaagatattcgaatttcgcgacaatcaattatgtgaatggaattcctttaggaaaaatcaaaatatcccatcattatgagatccctataagctggaggtagcttaacttcaccttccattaactattggccattagtttaactgagtggagtcaaattccttgttagtggcaagcaccctttgggcccctccatgaagctcactttgtaatggttttaatcaccacctttcctttttgccatactatctttcctagctatagataagttacctgtctttaaccatggtcaaataattataaagaattttgccgactaattaactaacaataaccatttagtcctgctcataactgcccctagccgaaagtgttctgtactcttccattgtctcagaatttacaacggcaggtctcattacatttttacttatacaggcaaggcaggccagcttttacgatccttgagagataccaagaggtatcgattattttagtgtaaattttggtatctattagtatcgaagatatcaagatgtatcaaattttacattaaaaaatatggtatcttctaataccttcttaagaactataaaatcactttacttgtgaatcactaaatatctagattgttctattaggcgcaacatttaaataacctgtacgcaggttcatgggtcgacatgcttgcatccctgatccccacgcatttcatacgtgtggctattaattgtggttcccttactattttggcgcctagccatttctgcggaactttctataaatagtaatagcaattaaccccctgattaccttctaatcaccacgcgattagcgaagaacaggcaataattaactaatcaatcaagagagcatgcatcatctctgcaggtgatacgctactaggaaggtgtggtagctattagcttacgatgtggcgtgtggtgaggaggacggcgaggaaggcgacgcccatgaggatggtctgccacgcccactcgtcgtggtgcttgaagacggagtgcatcacctggacgaaccccatctgcgacgtgaaatggatgatcccgagcaatcccttgagctgctgcagcgacacgatgatcgccgcgccgcccatgaatcccgtcagcgtcgccttcgacaagaaatccacgatgaaccccagcctaaaaccaagaacacgatatactccatcagttagctaggcatgaggtgatcgatccatcgatccatcgtcaatggaacagtagatgatggatgtgaagtgatcgaataccggaggaagccgagggaggcttggaagacgccggcgaagaaggtggaggtgaaggcgagctggaggtagaggatgggctcctggtccggcgacaccgcctgccggagcatcgaccccatcaccagcgacgctatcgacaccggccctacagccagatcccgcgagctacccaacaacgagtagatcagcggcggcacgaagctcgaatctgcatacatcatatgtgttattcatcacatcgaattgacataatggccggtcattttggttcatcttttacttacatagtccaatgattggaggcaggttggcgagcttggcgtagctgattccctgcaaagaaatcggaattcgaattggaattgggaatggagaatttcaggaggcaaaacaatggcgtgtatgtgtgatcaggttgcgtgcgtgcctgcgggatggcgaggctggcaatggtgaggccggagacgacgtcggagcggaggaggcggaggctgtagtcggagccccaatggaagatggggaagaagtactgcagcgcgagcaccagccgccgcgcggacgactggttcttgaactggtggagcgggtcgtcggggaagaacacctccgccagccgctgcctcagcgccttcgccgtcgacctcctctccggcaccgacaccttgtgcagctccgccgccgccgtcgtcgtcatcgccggcgcctcgccccgcggcgtcggcggcgcggagaccaccgccggggtcgtcggcgcctgcgccggtggcgcctcgacgtcgtaggagaggctgtccaccttgttgttgacaaccatggcgatcgagtcgagagggaggaggcgatcgaggtaggattaggaagggaggcgccttggctgcttgaggggttgggcggaggaagaggaagggcgccatttatagggagatggcgggaacagaacgcgcgggagaggaagaacaaggcgcgggcgcggcgcgtgcangattaagaagcgagttggggggttaatttaggtaagcccccctattactgggctgcaaagattcgcaatttgggacacatgtgcctcttaagctgtgctactaccctaaataaagaactacccaaacaaacatttgggcgtgtcacattttcaaacttctttttttcccttcaaaaaatgtatattaggaattaaaattcaatagtatcttggaattaatgtatctatctatctactagtgcctccatcccccctccctagaaaaaaaacaattcaactatctatctctctatccatctatttatatgtttatatattactgccatgcgaaaaagaatataattctagctatgaacttggacatatctttgtccacgtgcattgctaaaattgcattcttttttaataaagatagtgtatctatctatctatatatctatctaacatatgctaagagttgtatatcagatccaatttaacttttaaaatctaccatataaattagaattacatttatgaaagttaagaattgtatatctgcacttgttttttttctttccgaatagggctatgtatgtgtccatttaaatattttagaaaactcttttttattggagtgaatactaattataagctggtttttaatgtatttcttttaccaaagtattagttggtttccgcatgttaaacaagaaaatagtatgagaagaaaattccaccaggaaaaggtcgatttaatgagattccagataaagccgagtacgtgttagtatgagttcaacatatagtaattcatgcaaaattgataagacaagtaaaactacaacgagattcgtaatgtctcccatgcgagaattatggtcgatggttgctctctatctcaaaccagaatctatatattcttaaatataaatatctacactccaaaatccccaaaaaatgccacgaccactggcttcttcaagaggaatcagttgaatgatccatgtaaattctgagaaaaaaattttgctcggtggaaggtgaatatgcattttttttttcacttggacgattgattccaaatagttttacgcaattggtgggataaattctctgaatcacttgtagttgtagttagtggggtggccaattttaaccgttgtgtatatccagcggctatggatgattatgagacctactttgatttttgtaagcacaagggagggagttgctgacgtggcatgctagctttgttccacgtgtgcacatgtgggtccacgtcagcggcaaggcaaaaggcatttggaacttggatgcgcaaaccctgcggccttaattaatttattataaaaaatataaatggtaatgttcctttttcctctttttttatggtaaaatagctatgtggagcactcaacatagtgacccaacaagcacattattcactccaaataatctgactaatctattagcaatgggaggtaaagtagttgaacatggaatcattgagattctatcaaagtaaaattgtagccacaaattaaagataaactcaattgcaatacactcatgaggaccacttataatgcacctcctctgttttaagaaatataatgtggtacattatgcaaccaacctatgatgaaaactttaactgataatataaaaaaaataataataacccttttcacataaaaacattcatgatttttcattagtgtggaggtttatattattcatgatttttcacataaaaacactacctgcaaataatgtttattcgttcataatagtttgaggtgattattaacatagatgatatatatttgacaccagtgaataaaatccactttctcaatcttgagagcaatttgtaacttcatttattgaggtattgcaacaaagttcttatacaaaaaatttctcaaaaatactagatttacatcagaacctgaactgaagataccacaattcatatcatgcaagggtgatacaaccgtgaccctacatcaaaggtgagtagtggtcgactgcaatcatatatgcaccggcctgcacattcctgacacatgttaatctagtagcttccgcgccatcagttgtgacaggagcaccaagacaccatgatcataacaacatatatttttcaatgataaggcaaatctaccacttacaaaatcaagtggaatttccaaccatccatggactccattccataacctggccaagcttgctttctcccaaaggtgacctaggatgcatagctatgcggtagtaggatgcccaaaattttcttgcaaatcttgataaatattttgaataatgcagagagagagtaagaacatgtacaagtggaatatcaccaactgaatgcatatataacaccaattgttggccctaattgtggtgaagatgtgatattagaggccattggcaactgttggccagcaatgcaccttcaaatagatataagtggagaaaccaaaactagcaaatgctaattcagtagtagcacaagctgatttatgtgtttcctatgtttaaatctgtgttttttttctctgactcttcacgtgtgttgtgttcttggccggctagctacctgtacatagttgtgttcttttgtaggaaaagggtagctgtcgagttatctattaataatcctagcaaaaaaaaggagttatctattaataaagaggttggtggcaattgacaaatactacccaacttaaccaaaacaaactgggaactaaagggtgaaacgcctgtttctttgctttaattcacatggccatgagagtctctgaacatgtggttgtctctcaagttagttaacacttggcatgtttacttaggcaataaattacagattaaaagatgaaataaactttagagattttttttgcaagaatttagtgttttgtttccttttattctgttcttgaaaaaaaatcaaaatgtcaaatctttttattccccatttcccctattttccagctagccatgaatcctttttgctgtcacattcctctcacacggtacaaggtacaagatcgaattaatgatcttctttcctgaaaccaacgaattagtgagctgggatgacttttcaaggcaataaaagcttctattgaattcattaaattacaaagagatgatacaattattttaagagaacacttctgacctctacgtaacacacatgcacacaaaacaactcacataatacataacggattataagagcaaggttaatagtatagcccactactagctccaattcatctatagcaaatctaatagcaattcatacaatagttgcttattatactattaatatatggtcccacatgtcatacacacactgtgtcttggagtccgtgttgtagctggctacagatctgtagcccgctgctcttctctctaatcttttatctcattaaaatatatttatagctggctaatagtctgctattgtatccgctctaaggagaattaatggccattaattcaacagaattgactaaatcgtcatctatgtgattctgggtaaaaatctttgaccacccactctgaccgcatgtgattgaagatcagttatattaatggtgaaaagaatgaaaagaaaaaggccggttatatcaggcgtgcatggagaaacatattaatcaactataggactgaacaaagatcgaactgcagatttgtaggactgaactggctgccgaagcatgcatggaaagaccaatatataactacagtacttaaagtgaaaagatgagagattatatgcttttagagatttaaagtggaatttttttgcggctaactgcatgtgtgtgtgtccggagtcaaaaggcacctcttgttagttgtgttaggatcagggcactcactctacagtttggcatgcagctactagatatacttaattaactgtaaaaaggaacataatgcaagttcagttcagttccctgtttcttctcttctttttttttcttttgagacaccagttctgttatgtttgatttaaattattatcttatattatcgatttgattaaatgaaaaataaatattttaagaaacaggattaacagatagcttaaaatgagtggtctaaacagttcactagaaaaatgtttttgagaaaacgtatttttcgaagggtataacaaataatctgtttcaataatccgacacataagctaaaaaaaggggcatcaattcatactacaagttttttttttccatggactatggttgcattagttcatggtaaactaacaaatagtagtgtttgggttggtgttaccaaattaattaaacaagacaggacaggacatttaagagatgaattgaaatggacatggaatgtataagctgatgttttcgggggcattttgactctcattcataaatgtacatcagaccatggatctgtttgactctgtttttttaatacatcatctctcttgtcaacccttgcatcttgaaaagtcaatgaattttcttcagatatgagagcgatggaaatcaaactcgatcgagagcaatgagccgggatcatcacacactgaatgtctctccatgcattttctgcatatgcatgcttcaggctttggtgcgttagtttgctgtctgatctgcacctgccactacggatgctgaatgatgaacaaacggagtcaacggtgtgagacacacatatgccctgctcctggagtcaacgacgatgtactttaagtctctttaacgcggtctagatctcgatgggccgatgcatgatctgatcatgtactacactcagctgaaatcattgtagccactaacaaattaagacacaaagtgatgatcgagtgacagtggccggtttagttaggtctactactcgatcgacactatgctctcccctcccggcggcagttcgctttaggacaggtggcaatcttctaggacctgcttatctgagcgtctggcttcgactccctggttctcctggtctcttggcagctatggaaggagcggaacttcagggtagttgaattggcactctcctcggtctctgtgcttattgagtctatctactcggaaggccgtctgtggtctactgtgggcattgccgcttttggagatttgctaggagtgtagtgtggcttcgcctccctctccctttatgttggagaagttttcttttcgcagtagttcctttcatttttcctttgtggttttttctatctctctcccccccccaagcataccccagcataggcctatttagccgaatgcgtcgtgtaacaaaatctctatttcttttaatatattgacgtgcaatccttttgcacgttaaaaaaaatcaacactatgcagcatgcatggcactgatgaagattcgaaaggtacaaatcatcaacatgcatatacatcacatatagtcatatactgagctaaaatcaatggtgcttgcaaagatgggatactacatactgacgaaaaaatgttccaagatagtagtaacaacacacatggattgaatcgggcttaaacctgaag

SEQ ID NO: 16952 - DNA, 3278 bp, Oryza sativa
aaaatttttggaaattccgagaaaattttcggaaagtttcccgaccgattccgagttccgacggaaactgcccttatcatttctgagaaaatatttccgaattcgtttccgtttccgaaaaattccgaccgacatattccgttttcgaaaataggtccagaatctggaaagtttccgtaccgttttcacccctaatcctagtaaatccatctagttcagattcttttttaggacggagggaatacttttacaagctagccacttcttctttcttgaaaaacgaataattaaatgtgatacatcattgtatctaggagttctctttctatcctaaataaattaaatctaatgtgatagtatattcatttcaaagtaaacgaacctagcgtgaaatctagctgctgcaaaatccaccggtagccgatcgagtgcgacgtacgtacgtgcgcgcacgcggagtcagtcgacggtccaacgctcgtcaaaccgcggcgtgacctacctacctacctaccggcacgtacgtacgtactagcgatttcacggcacgattgcatcgtcacggggtaataattaatttttaatctattaaaataattaaggtggtgcttttcctaataaaaattgaagatgacgttaataagtaaggtattaattagggcataataaattaagttttaattattgtaaactaaaaaattgatctatctgataattggaagaaaacctttgatggaaaaccgtaccaccgaaaattaagataaaatatagtatatcttaattagaaaaagaggccatatagctattactccctccatactcataaagaaagttgtttaggacagcgacacggtcttcaaaacataactttgacttcttgtttctatacttttatgagaccgtgttttaggacagttgtgttttggagaccgtgtcgctatactaaacgactttctttacgagtatggagatagtacatataatttttacatttttaaactcaacaacttgagagttatttataatttatattctcaaggtttgacttaaacattatcctaaacgacttacttataattacggagggagtactccgagctttgatgcttattatggtaattaattaaagatcgcacgcacagtgaatatacatattattaagcggccgctttgtgtgtggtctcaaacagtgacggagaaagcctaggcttgtatcctaaacatctactaaaatttatcaacacttagtgaaaattttgaaaacacaagatatataagcaagtttagcccttagcttgtttgtttttttttgtctccggacgtctctggtctcgctaactaaaactggccagacaaattgagcgacaaggtatttcgtcattgtcgagtgtcgattgaaagcgagcaggccagtagtagttatagcttactacccgtacgtctgtcttctcaacaaagcggagaattagagaacttaaaaaaagaactgacgcagcagaggcttctaacagaatggtagtagcatatgcttcacaatatctgttttgggtccgcatatattaatcgaacaccgacccaccgacatcgatcgatccatcgattaggtcttgtttagttgccatttttttttccaaaaacaccacatcaaatctttgtacatatacatgaagcattaaatatagataaaaagaagaactaattgcacagtttacatggaaatcgcaagatgaatcttttaagcctaatttgttcaggattagcgataagtgctacagtaacccacatatgcttatgacggattaattaggctcaataaattcatctcgcggtttccaggcaagttatgaaattagttttttcattcgtgtccgaaaactccttccgacatccggttaaacgtccgatgtaacaccaaaaattttcttttcgtgaactaaacaaacccttagtactcttgtattccaaacctgctactccctctgtcccaaaatgtttaatataaacatttttgaactttgatatattctttcagatgctattttgaccaacaatatttatatgagtaagatattttaaataaaaagaattatatattataatagtttatttaatgataaatctagtagcatcaattttacatgattgatttttttttatttttattcatagtcaaagttataaatatttgacttgatattattttaaaatgcttatattttaggatagagagagcacataatatacttgcaaaaggaccagtggtacgtaagatggaaaaatgaataggtggagtcgttgatatatatgcttttatttattagggatataactctgccacctatgaatattaggtgcacacatgagtatgtttttactaggattttagtattttagggatttactataggccgatctctattcatgtgtatgttagaggatgcatgtaggtgtagtagcagtgcgaaaaataagtatatatctcattagataatgtccaattaatgctagctgaaggtgctagctagctaatagagttttttttttctctctcgagtaaccatcctactgttttgtgtatgttattcaaaactatttacaaccaaattggaaatttttatccttttttcttgtttatatgtatttgtaagttgaatttgatatataagtttacacagtgatatctcacataacgattgaagaaattaaaggtttccaaaaattttttaagtaacatataaaaacgagggaatatttcctgatgaacaaatgcacttcccgagtaaaaatacatactcggccaagtgctgggtcaactggctctctctctctctggctcagtgatcccattccagtcacctcagggcttttgtccaagaacacaattaatcaaaaacatatgtgcttttgcttacggtttactaattggctggtttgattactgcattgcatggcattggccgtgcaagcggatattccagggtattatcccccacttttccgaccaccaatgcatcatcatcatcatcattgtccttgtcctttgactgaccacctcttctttaatttttctccttcctttcctccattgccgccctttttcccctacattccacgagccatccactcaagccaatggccgagagaattgtaggagtagtaacagatcagagagatggccaagtctaagctagctagctatatagcctcgcttcgcctctgcttcctttcttccaaaaggctaggcttttttttttcttttcaatttacgtctatctttg

SEQ ID NO: 16953 - DNA, 2620 bp, Oryza sativa
cgtttatttgagtaatataaaagtagtggtcaaatttactaaccaaaaccgaataaagtcaacaatatcatttatttaaatagagagatagtatgtaattttctatttgtaaatatagttggattttatatttaattgtatcaatcgatatattttgctaaaatccagacccaccatgttaattcaaatgggcccttttttttctctttttccccaaaattaacacaagaatttatatactctcatagtaaattgtagtgggcccttttattctttctttgaacaattataaagatagataacttgccatctagctaagcatgtgtaaagcatgcacttgcacagcccatcacaatattgctttctagagacatacacttagcacgtaatgcaggtcgttttttggaggcaaagactgttgctaatgcatattacacactggttgctggtgcactgtccacgtacctactgttgcatggctgcgacatttcacaggcatgtatatatctcagctagatctactaccaggccctatctctaaatggccaacgactgccatatatattgtttgttgcgtgtttttatcagctaaaactgcagatatttttgttgtgtggatgcatatgtgatgccattgatcagttgcatcattattaatttcgtctatagctgattataatcataatgtttattagtgacagataatttatggataagactgttatatatctgttattatcgatttaaaagctaatataaaaaatatgatatcaaaatcaattttaaaattgagatttaaaatttaaagagttaattttactttgggccaccttttattaccaatgtttcgctttgaaccacctttagccactaatgttttcactttggaccgggtatttttacctttatttcactttggaccactcttactcatttatccatctacatacaacttgtaatatgtcgaaaaaaataatcttacatatagctgtggcagttcattgacgagtaggagacgatgtaatcgagatcgttcatatgcttgagaagagagtcgggtggtccaaagtgaaacaaaagcaggtttacccagtccaaaatgaaaatattgcttaaagggtagttcaaagtgaaacatcggtaacaaaaggtggcccgaagtgaaatttacttaaatttaaattttcgacgtggctgatgataagatgatgagctagctaagctgaatgttgccagctttaatccggcccgttgccgtccttatgaacagagaatacaattctcatcatgtgggggtggcgtgtgtgtgtgaccagttcatgcatctttctgttgccggggggcttatcatgtatgggctagcagctggagaatatatgagagaaaagggcgaatgatagggagaagagagggggtcgcataatcgtctaagatcgataccatcaatgcttgcacaatcataaatcagtgagcgtttcctagttgttgctattaaagagtagaactctatacacatagatgaagtgccgacttaattgtgcagaaaatctatttcaaaagtgctctcgatttagctctataggatagggtctctcatagatgaagtgagacaaaccagttatcactagctgtacaatcacgtccttaattatgagtaggttttggttcactcgaattcaactaaataaactgaattttgctcgagttaactgacaacgcatgtatctataaaaattgtgcgcgcacactaccttacttacaacatcgtgtgcccttcagttacatactcttaaaatacagtcatcttgttgataaaacgtgaattttagaataatttaataacttctaactaactgcatgagctttaacaaaaaaaaaagttggtgagatttctctatgtataattctgtaaaaaaaaactcagctccaaatgggggcttaaagttacatgttaatttagttatatcatgcatcctttaatagaggagatcatgtttctgggccacagctcattttagcatgagatgagtgctgcttgaagtcagactactcaaccttttacacccaaataacacggcacttcctgcactataggggacacgctatatgcacattgcacaagcaggttgacttcctagctagttcctacaggtgcaagtgggaagttgcatgccgggttggagtattgactaccgttaaaaatccagtcaaaatttgtaaaaaatagtttgaccaggaaactgggcagtttgtgttctcgaacaagcccgagaagtcttattttcatgaaaaccgactgatttttgttggttttgtaaacactggttgcatgcctttcttttcttcataactacgtaaatacacgtacttggctatggataaaagaaaaaatgtcataacatttttctaaaataaataaaagcatagtttccatgaaatttgttgtctacatttttctatagggaagactaaccttaatttattttatatgtgactatccatttaaatttactagttgttatgtaatactaagaaattgaaagggtaatatgaaaaaaatagaatgatagtaggggggtgacatattcgttaccaccaccattaaaatcatcttaaaaat

SEQ ID NO: 16954 - DNA, 1470 bp, Oryza sativa
acccccctggtcctcaccctttttcccatttacaagaacggtctcttcaggctcatcagcatcaacttcgacagcttcatctgtgctctcctccactttgttctcttccaaaacctatgaggaatcctatgttattattttcagaacatgatgatgaatatagcactacagacatttaatcaaggagaaaggataaacggaacaatggttgagtgacacggtcatcaacactagaaaggaaagttgaaaaatttcataataagttgaacatggatagcaaaatgcacactccacacgcaatacctcttcatcgggctctccattttcatctagtgcatcttctgtttcctcatcttcaatgacctgcatccttttgaaagcttccacaagagtcatgtctgacttttcagcatggttcaagtactcatcagcaggaggataatggaccctgaagaaagagaccttatcattgtaccaggtttgtttatacaatagtttcttccaaaagaattggtagcgttacatggtaataataaaaaaagcagcttctctggtaatttttacctccgagaagcaacattcttttctacagtaagtgcaacctgccagtcttcaaataaatttggatactcagaaggatctgccagagactctgcagcttttggattaacctgtacagaaggaacatatgaatagataaaaccagaacaataacagaaaatgttttctggatggaagcacacttttcaatgcaaagataagagcagaagattaagaaattactttactgaggtcatttctccatattgctactatctcagaaactttgctgggaagataagaacgtgccattaacgcagcttcaggtatacgattgctgtataatacatagatgaggtttagctttgaaaaatgatttactacaatggggagttcataacagcaaacaggatgtacatgtacctgtctatcagcaattgtatgcaatcttccaatttaccaagcataaagagacagaggaaagcaacattgtttttgccatgctcctttgcttgagaagcaagcttctcgattccctcagcatctccaagagatgaatatagtagcaacaggccacttaagtccttcgcttgcacaaggcactcttccgccatatctagctgttgaagttgtgaaatgatttaaagtcagaaaacaaggtaacaaacagaatataaatgatttgcattaattgtcatcaaatgatgtcaatatgaactagtgtagtagtgtcaactattgccatttccatatttctatgcacagaaactagatcgtgaaaggataaaggacaagtctcagctgatttccaaaagcatgtctagtttggtttttcctctaagtctaaagaggacaaaacctcgaactcaataatgcactccaggtaatctagcaccttgacaacaagcacctagatactatggcactgtc

SEQ ID NO: 16955 - DNA, 1799 bp, Oryza sativa
atgtgctacataacagtcattcaataaggcacatcatgatagctattgaaatgtaattgtaatttagcatataaatgtattttcacgcttccatctatcattgttttgttacttttaaaaaaggaacaaaattattaagaaaccaaatcaacaggttcaaagagaaacaggtaccaaaataaaagaaactcattgttttggatcaaaagtcagcaactaacttattatattgcgcctttggtatggatggtaaaatatcatttgcacgttcaatatccccacgcatcacaagtgtcttgtactcaatcaaactaagaagtaatgtgtaccccatgacactgcaacaagaaaaatatgttagttcaagaattcaacaccagacaataagcaggcagtattatcaagaaaacacacttgaattccttgtcaataagataaactcggctttgattcgctagatatcccaacaagtacatagggcgatccaagtgatacatcgtggtgacctgtaaatgtacaacgggataaatttgtagtgcacaaaatactacaatagaaaatacattaacaaaataaaaattcttgcatggagcacacaatatatacctcgccaccaacacaatagttcaggcgccatgatgaattgttataaataaagcagtctccaacccagatccctgtccgcactcgctcattaacctcatgaagcagctcaaaagcatcttcaacgccttcctcatccacaggttttccagattctagataagacgcaacgacatctctctgtaggaacacaaattacaaacataacttcatgccatggtaaaaaaagaactttcacgcaataacacattcaagaggagaaaagaaataacataatgaacatttagataatacaataacttacgttgtacttcagtatgtagaatgatgtatcacttgctattgcaactaggtcaccgctatcagcccaataaaggttctaaaaatacagtgacaaaactagttatttcagtatgaaattcgttaaaagtatcaatctataaatatcaatagataatatttgactcactttgacattcacatcaatgcggcgtattagtctacagtcagcccagtcataaaagcaaatgaaatcactggaacacatcgccaataatattccaccaaaaatacgttcagctgaaaatgtagggcgaatagttttcttctcctgcatattggatcattcaaaccagaagatacaatattgataaatgccaacagaatatgatgtgcaattctttgccaaattcattaataaaaggtccttagaacatagtaactaattaaatcaacctacgcttaaattgtttctagatcaatgttatagctaaacataaatggagtattcatgtaggctgattggctgaatgacaacagattgtcaggaagtaagatatatagtgtaagaaaaagaaactgtcatctaggtgactaggtccaatgagatgcaaacctaaatcagtatgtaatttcctttcaccaaacatgatgattgatgaatcatgaacagacattaaaatgcacaacataaaacttttgattgaatgaacgctcgtgttaaccagaaacctttattgattaaataaaagttaactcaatagttagccaaacaatagtacattagacatctcaattgaatattgcaaggtgtaaattcacggttaaaggcaaagtgataaacaggtgaagatggtgcattctccagagtggtgattgaagaaatgaaacactacagttttactgatcaaattcat

SEQ ID NO: 16956 - DNA, 6072 bp, Oryza sativa
ttcattcagcaacttttttgttgggaactctcatctgaagtgcaagcaatctagaatgttcaacctgcatagcaacattgctgatccacagctccagccatatatatagctacaaaattttggattgatgttagggttgagaagcatcaggaaattagcgctcgcagcgcattgggggcttctacagttgggttattattgtgtagagaacctttcaaccaagcccgccagccagtgaaacggtgaagtgatccggatgagcctgttagaaaatgctgaaagatagttatccaccactgagtttcatgcgtctagagattgaataggtgaaatatgccatcctgatgaaaccaattactggccctcacttcttgccacactgtaaactctccttcacattcgtgaaacacacattgagaattttcgatagaaattagaagcatatgaaacttctagcagagaaagatagcagcactgctctagccatttgatacccaaattgggtctgagcagttaggactgagaatcaccgggaaattcatcctcacctcattttcatttccagtagggttgttgtctatgggtagtagatgttgtgcaatcatccgttagtgatgaatagaggatattagaaaccaataaatatttgttggtctcaagtagccacatctgattgtgagtagcctatgccctctttgtaaaaccttttgtgaagatactttgcattttttttttcactggtgaaagagcaaaggaagtctgggatctcctaggcttgaaacatataattgctgatgctgtggtagtggattgtgcgggttcagccatgtttgcacatttgctgctaatgatcagtggtggagcttgacccaaaatgcagagggggccaatattatgtgttactgaacacaaaacctctgttttttcgtgtttaatacgtaatacattagataattgttctttttattaaacaaaaaaaatattatgtgttacagagcacacaacctttgtttttcatgtttagtaatccctctgtctctaaatatttgacactgttgacttttttatacatatttgactattcgttttattcaaaaacttttatgaaatatataaaactatatatattcataaaagtatatttaacaatgaatcaaatgatagaaaaagaattgataattacttaattttttttgaataagacgaacggtcaaatatgtttaaaaaaaatcaacggcgtcaaatatttagggacggagggagtaatatattagtatatgatcgtcatggacaaaaatagttttgagcaaaagacacaacagtaataagaagatatttcccaatatatcggtggaagaacaaaagaaatatcttcataggatagaaaatatatcaacgcttggagttggacaaatattccattcaaaggctatgagaaaatgaaattgtctaaataataacagaaatattagttaattggcgttcgtgaaaaatattagttaacaccattaacacttggagaactgaaaaacacatgggcttgagaggtgtagagcagaaggcctcgggtctcactggtgtaggcttgcaggagcttatagcaacgtcagacagtactctcattttgccagtgtcatcttcaagttcactcgtaatcaaagagtatgtggtgttcctttctgtatttaaatcagcactgtcaggagccagattatgaaatgaaaatcagaacaatggacacaccatataaacagagaaagccattatatgtaaaccaatggccctcatttcttgtcacacagtgaactctccttcatcattcaggaaaacaaacattgagaattttcaatgggaatttgaagcacatgaaattcccagcagaagaagatagcagtgttgctctagccatttgcatttgatacacaaattgggtctgagcagagcagttaggactgagaatcatcaggaaatttatcctcacagaattttcatctccaggagggttgttgtctgtgggtaggagatgttctgtaaccatccgttagggatgcatcaaggatatatattagaaagaaatcagtggtggagccaccacctgggcaggtcgggctctgccgatgtcgtctccactacgaacagctgttgacacctattaaaattaatcgatcactgaaaaacgctattagttgtccagacttgatgacaatgctggctccgccactgaaagaagtttttgttggcctcaagccgccatctctgaactggctattccattccaccgagatcgaagtgatcttctgattgtgtttgtttgttgctaattgtcatagcgccttggcttatccctattgatgcgaggccatgtcttgaaagctaacaacatctgggatattatcttgtactcttcagtcttcaagatagcgatcacccactgatggaaggttaagcttgtggttgagccattaaaattatgcataaagtggtagcagccagattcaaaattacaattggtggagagattgcaaaaaaaaaaaagtaagagattttttaccatataacatgccgatgcggtaccaaatcgtcgccattgagtggataggatccaacggctgtcatcactgagtatcgtgaggcacccacttgttcttgtggtggcactgcattaggatgtggaggtggaagggtacttttgtactatcgcatggctgattcggtctcatccacttggattgtttcatttgacaccgcctctttcatctccatctccgcgtaccaactttgcagccccgatgtatagcgagcatggtgtctccgcggtggccgccgtcgcggagagaagagcgggcgcacaactgacggccccggacgagcacgtcgagaaccacaaagcatggctccgccaaggaggagctcatatttactgaaacactcaagtaggtcagagagtgagtagaaacatatctttatttttaggtgacatttatttttctaagttttgtggttgtatataagcatgtgaaccacaaaattataaactcatatttactgaagctacagcacacaggagggggcaatacaggtgccaaattttgaccttttttagtcatttcatattattagtcattttgacctttttctattcaattttttaaaaaattataacagcgttttcaacacaaaataaatatattaccaaaatatatttaatgaaataaaattggtattttggatgttgttctatttttctataaacttggtcaactaaattaaaattgactaagaaaaaatcaagacgacctataatataaaggtaaattttgcttcaggatactcaaaatttgtgttatttgtggacagacataaaaaacgtgtcattaatgaaagatatcctgaatatgataatttgctataggatatatttggctaaattggagagataaattcttaagaaagacgggaatgcccctagaaccacatgtttcaaacatgacgttagagtaaaaatttagatgtcatcaccccaagtacatcattagcgtacatcatattccatcttcactccagtctcaactcaaaagcttttgactctagggacattcttgtatttttttaaaaaattctctctccaattgagccgaaagtgtcctctagcaaattaccagtgttttagagtgtctttcagtcatgacatgtttttacaatgtctaacaacaaattatacaaattttgagtgtcatgtagcaaattttgcataatatgaagggtctgtttggcacaactctagctccttctccacctctcctagagttagagctcagccaaacagttttagctccatctaaaatgggagcggagctaggtgaggcacactcacaaaataaaataaggaggtggagctgagtttagattgctacacaactatactccagacccaacttctgaagctaaatttaggagttggtgcttcactgaacagacccgaaatggagggagcaacagacaatcacacttgtgaagtattcaagagatggaacacaagaaacaaaactttgaaatataagtatttaattcgaattatgtaaattacaagttagttcccaaattaatttctgaaatacattatgtttcctgatatttttcagatgcattaaattgacgatcttcttaactttggtcattattgcgtgccaagaatttgctgtatatattacaccgttgtcagtaacatgtccattgtttttttttccaagacttcacaaccacgaagagctcaaattcatcctcagtgtgagccaatgcagggattgggatgcgtcaggaatatggatgtgccatatctttgtcctatcatctcaggtatgcaaatgatagtgtgcttctgagaaatatcccagcttttgcaagaattgctcatttggttaattgctctgcggctgggatatatacccgtgcaggttcttagatgaacggagttccatagacctgttcgttccgagcactcgtccgcgtatgttcttaggtggatggagttcgggaggcctgcttgcttccgagcactcttgcgtgcaagtgctcagaaccggggaaaatggatgtgccatatctttgttcatcatctcagggatgcaaatgatggtgtgcttctgagaaatatcccagcatttgcaagaattactcatttggttcatcgctcagcggctgggctacaggaagcggattcacctgaccactgctctcaaccaaattgtagagctgtagtagagggtgtgctcttgatccaatcaaaagggattggagagcagttcatttcctcttcagattttaatggaaggaaaagacaatttgtttcagtaaattcagagatccaaaatgaagcttacatatatgagatcttaataagcaagtaagttaaatagatagaggttgttaaagggaatatgtgaatgtgacgtgagtattatagaattttctcatcacttgtacacgttatgcagtctttgagccaaagttaatacatactgatggaaaggttaagctggtgacgaccctttaaaattagagaaaattcactctatgccacgaagcttgcccgattcaacgatttgccattgaaacaaattaaatacacatagtaaaattgaaaaatggatttaaaaaaaatactctatgaaattaatatatagaaagttctataaaagaatagtgctgagctcacctgaaacatgcccttcaactgttgtatttgctaaaaaaacaatcctagtattacactatggaattaagcagggaccatctatataacgagtcatctttattcctcagtagtcgttcagtaatattgttggtgaaaatcatcatctgaacagaagcaatatagaatgtccagcctgcatagaagcattggtgcttcagtcataggtaccaaatattggatcttaggattgagaagtatcagtaaagccgtcatgacagtgttagggacttctacagttgagttattgtgtagatccaaattctagtctctacgcagattcgtgaactcatcctgaaagtcctcttgacatttatccaccacagcgatttatgcagctagacattgattaggcgaaatacgccatcgtgaagaaacaaattcctaatgtccatttacaatgtttttactacgattatatatatgtcagtctcacaaagatgggcatgcacgatggttaaatttagatggctgattaatctctaagatgtgttcctgttaatcttccaagctttggaataatcactaacggtttatgacttcaagctaaatctcagactctgaaatggttctgatagaaccttcagatgttataggggtcaagcattggctgttctgtagtagaagtgtgcaataattctgctatatattatcagatgtaaggaatgtatggaataaacagtatgaaatttgtttcaacaattcatgcatattacaaatggacaacagtttccgtggactaataatgaattctctagtaaaaaagttaatgttcaagttttacactatcaatcaaaatgcacacagtactcccattttgc

SEQ ID NO: 16957 - DNA, 11988 bp, Oryza sativa
tcctgcagcccttaactaagtttgtaggcaaatatattaatatttacaatactaaattaatttcattaaatatatttttataatatatttgtcttgtgatgaaaatataaattcttttttctataaatttgatcaaacttcaaagtcaaaacgacttataatctaaaatggagggagtacttgattatggtttttctttgtcaagatttcaaataaccgtttgacaggttgcacatttcactatagacttgtcaatctcaaatacatgatgttccagtctatattcgaggtgcttatagggatagattatgtgtttgggtgttccaaggggatgactgtgcgcgcatgtgtacgagcatctacatttgaatgagtttcttttcaaaaaagttgaagattattttattccgtgctaaatgttactacctctgtcccaaaataagtgcagccatggatatccgtgcccaacgtttgaccgtccgtcttatttgaaaattttgtgaaaaaattgaaaatatttagtcacacataaagtactattcatgttttatcatctaatagcaataaaaatactaatcataaaaaattttcaaataagatgaacggtcaaacgttgaacgtgaatagtgtaaaactacacttattttaggacggagggattacatgctgagtgatcacagtttggagcactagtaggattgatactatttttgcttctttttttataatcgtgatgtcacactgatgtgcagcagctagcttgcacgtgctcactgtatgcgctcgactattgatagagtgtgcagcccggcccagcaaccgtgggtcacccatgttacattgggcctgcttcaccacagacccatcggagctacaactttaggtcctagacttacacaaccaaaaatgttagtctgatgggtgagtaatgctcgacccatggaaattggcttccaaatcagagctctgatatcacttgttagagtgtgcaacccggctcagcaagtatgcaacccggcccagcaaccgtgggtcacccaggtcacattgagcatgctcaaccacaggcccaacgggaaccacaactttaggttctgggcctacacaacccaaaaaactagtctgatgagtgagaattgcccgaccttttaagtcgtgctgcccccatcatcaattatcgatatgtgactaaacccaacaactatagatatggatcaactatataaattgaagacccttacatcacatacatatatcaatgtttcctaaagaaacccataaataccagtgagtgtgtaggttcagttcacgttacatatgaaatatatataataaaatgggaatgcatgctatccttgaaagactggtaaggtcagataaaatttgcatgctatcctattcttgttgatgcttggccactatgactcgaagaaaaacaatagttgaataggcttgagaggaatctagaaagttaatatctctaacagcaacagttggggctcactgaagaatcctgctggtctgttttgttttgcagcagtagcttcttccaaccattgaggagggtgaacggtagattacgccagcagaactcaaataatcaaatcttgatagattaaaacatatcccaacttaaaaaaccaatggaacgcacgttcggcggtctattcgacctaccaaggttagtctgacagcagttcacttggcgatctgaccgtcaacctaaaaacagtatgacaaagcttctgtaaaaactcgatttcacttaaaccaaccattggatccacttgtaaactttacagaataaactaaacaaaccaagaaacaactccactggaggtatttgcaaactaataaacggtttaagagaaaacaccctcgaaagtcagctgcctcagaatttcagcaaatctgaacaaaacctaaaacttaagcaaattcaaataaaactttccagatctgatctatgaagtattagaaaggttttagatagtttaacttgaataaaatcgcattaaaatgaagaatatcaagttaatgccaaaactgaacaatatcgtaaaacttatgaaaccggaagagatcgtcgatgccttgatgattgaatataatatttattgctcaagtattatttacaaggtgcagacacaacagctcttgaggctagctaatcatacattgtttactgttaatatgcatctgaagcactccttgtgaaatatggtcgaaaggatcttaatatgtgccagaatggaatggtagtacccagaattgttgtcagtcggttaaagaattagttagctttcgttagtcctgacaggacactaattagtcactcctcttacatgtgcagtctttgaaccatttggtatattgaaatcaataatgcctagaagtaacgtgtgaaagcatttgtgctcccggttcgtaaccccatgtactcccggttttgcaagcgggattatgaatccgggactaaaggtgggtatctttagtatctaggactaaaatccatatttagtcccggttggtagatggatagggccacgtcacgattgttttttacttattattattatttttttgcttgtacctattccccacccaaacccacccaaaccattcacaaattatacacaataaaatcatccacaaatcatacacattcacaatccacaaatcatacacatccacaatccacaaatcaatcacaaaatcatccccaaatcaacaaaaaaaatctccaacaaaatatacaaatcattcagtacaaaatatacaaataaaaaaaattcactcgctgccgcccggccgtgcaccgccttgcgcccggctgccgccgccaaggagagttcccaaatgacttcataattaaggagccactcggtctacgatggcgtggtataatatatttctttccaaaccgaataatacaacatgttaaagactatacaatttcatattatatcataccaatctctaaagggtaacaataataatatggtgtatttataagaaaaagactatttacaccttagatgaaacacccaaaggttaaaataattaagaagctcacgagaggagaaataattatcatcaactacagttaggtggagccaggcaattaattgtataacatttaggatacatgatacctttggacccaacttctatctatctattatatactaaaagtacattaaacttcctataaacgctctcgagtcgccaagtggcgcttctacaaacactcctggaccgccatgtggaccgccatgtggcactatctaatctcaccgtcgattttcacttaaattgatggacccgttaatttagaacattagattagatctattattaaaaaggtgatagtttttcctaaaaaatatgcaactggtggctgggaaaaggaaataaaactaaatgtccgtacgtaagtataattgaaaaaaaaacaaataaagcttcccactgttaggcggaagaaaaaaaaacatctactaacgataaaagatgataaagcaaaaaaaaaaagatgactcatccatcctctcctcaccaattcaattatctcctcttcttttttttaactaacataatataactattgttttatttataattaaataaataaatcaagataacattagctatattttactataaaaagttaaaatacattatttgatggtagaccctatcgtttgaatggcaactaaataacaacgaaaaattaatcgaacataatatgtattatgcgatactaaatcactatacctaacaaaaatcaattaaaacgctctagagcgctcataaatcaccatataatatgtcctaaaattataagaaaaaaaagcaaaatttgatacaggacacccaaaaaatgtgtaattggctgggagacaccgtaaaaacgtgacatggctaatggaaactataaaaattatgtaattggctataggacaccggaggcaatattttatatttccgagtcaaaacaggtgagaaactttttgaaatggtgagattgcccctaacacagagcgtcgccgccgcctcgcccaccgtgagcggcggcggttgtggcctaccccaccgcaatccgccgcagcggcgccatccgctacttccgatgggtggatccggctgcagaaatgtcctgcgggttgacggagcgccctcggcgacggcgtgtcttgagccgctggagcttgtctctcctctccatcttcgtccgtcacctgccatctctcttcggacgacgagcttgtcgccggtcagatattacgtattgctttgtgatttgctcgattccgttggtttccagctttcactcctgtggatcatcccagctgattttattaagttcgattcagagtctgttggtttaatttttagctgattttgaatcaaactctttttttttcatataattgcgtgtgtgtggatagagggtaccgcttggtcggatagacggacaaaaaaatattgtgactattggaaagttactattttttataagtagttaagatatggataaatgtgaatttgtccatatttatatctaaattttttgacacagggagtaaccaacagcctttttcccacgaatagaaaaaaaaagaacataacgaacactgactacaaatcaccgagcgacacgtggctggacatacgaggtgctagattaaatttgatcaattaaattgacgtatccaatattttatctattagatctattttttaaaaataaaatcttaagttatcatgtctcacgtcctataaaaaacggataaatgaccttggaaattcttagaaaaaatgaaacaccctgtcatcggctctcacttaaatcatttagaaaaattagaaaaataaaatctccacctcctcctcactctcacatctacacaaccctgtcaccccctccctattgttttatttattaaattaaaagagaaacaaaaaatatgtttgatattattttagaaacaaagtacaaacacgagcgcttacaacgtgcgcgcactcacctatgtgaacacacacatgcacatacccccatgagtacttctgatagactaggatgacatattttgagatggacgaagtcactacgtacgtctcgctttcgacgggtacgtcacctactactgaaagaatttgtaattctaggacatgaacacgagtgggaaaattccatcacaaccaacgtttacttcgtagtaatgttggatattaaaacaaccataatttttaaactacatttctggaatactcctatgccctttaaaccggtggaatcattatttctaacagttagagctatcttatataagaaaaacaaatgtgtatacatggtacatcacatttaaaatattattgtgcaattatatttcgctttcacattagcttgcgtggtacttctgacccactctacattaaattatcatagatggatcggctctcaaatcacatcaatcatattaggctatataaacccatatatttagtggagcttcatgtcccacccaattaatcctcgaagaaaccatgataatatatatgcaattaaaaaaagaaaaataccttagttttactttgcacttactcttcgttgacatgttttctagggaaaataagtctaccttcttttcaaatgatgaagaagattataaataattgtttattgatattacttaaatatgatataatataaagctaataggttagaaaattataaaagaaattaatgttgatgaaaagaatttacggagaaatcgtggtagatgttcaccggttaatattttcatcttataagcgtctcaatcttagcatacgacccatgcccgcgctaagcgcgggctatcttcctagtttgataaaaaaggccttacatattttacaggaacatcgatccatccataggctagctaccaaagctgttgttaaaaagatttaggacagatacatatgtgtagtatgggactgggaggcattgtggaaatttcgcatgcctatcaagtgtggttttgcacgaaagatggtggtgtgtcaccgtgcccaggcattcgtcgcactgacagcccacatcatcctgccactcagcagcatttgcaggctatccaatatttgacagcactatgcaatatatgaaatgcatgtcgctagcctcgatggtagtgtttgcattagtaatatgagtgtagagagaaaaatcaagttgaattgattatccctatcatttttctcaattgttcttttcaagaagacacaattagtaagtgaactgtatgtgttcagcaatactaacgcggtaggctcagttcaacagactacgtacatatgcttctcatatatcacaatgaacaagctaatttttcaaatcaagatcacaatgaaaaagatttaaaaagtctaaagggaaaaaaaactatattgtacatatataatctgatataacccatctctaacggataaagatcatgcaacacaacatatgctaattgaaccttccttggactgggatgcgtcaggattatgcatatgtcttatgttttcgcatcatttcagagataactgacaattgtgtttcccacgataagggtgttgcttgtctggttcatcaatgtaacattggtcaaggaagtttgtttctacttcagatttgaatcaaggtcgcgtgcaattcatgccagcaaattcagatattcaaaacggagcctacatatacgtgatcaaaataacaatgtaattgaaatagatatgattgagatcacaccatacgtaaaaacatgaaaatcaagggatgatttgtgatatatatgtgtttcagatgagctgtctaacaatagcaagtacactatagctgtccaacatgaagctcaagctaccaagaacaggattttaaatttttcagagctgaagtgaccaagcttgagaattttggtccaaagttattttaaaccctgcaagaacaatgtcaacgagatatcgtgaagcataaaagttggctagtcatgtcagttacaatgcaatgatcaactttcatatacaattaacgtttcaaagtacttaatcaaggttcttagtagcaagcttaatagtgatacaggacaaaccatctgcggatctgccagattgcagactgcatccttttattctgtcatatatagatatcaattaacccacttgtgtgagtcatcgcaatttgattgattgaaaattacaatcactctgcaaagtagattgatgtctaacacagaatatataagtcattaattgccacaaattgcactgagagtttgtaacttaattgcaagggttgatataatctttgcattagtttttatatcttcatgtgatatacagcagttcttcaacttgcacatgttcactgaatccgctatcgagatcaactatctgaactgaagaccctatatatcatcaccatatatatcaacgagttttgtaggttcaattcacttcacatatgaaatatgtaactaaatggttaggctagataatgtacaagcacctcatgtatgcatgctgcctattcttgctggcttttggcgactctatgagtctcaaagaaaacaggagccatatacgcttgggaggaatctgggaaaagtcgatgtcactggtaggagtgatcaggaatacgaacggatgatcagttgaatttggtatttctctcgtttcttataggcatgatcttacaaccactaaattgtttcttgtgtgtttgctgggaggctagcttaaacagtagatgcatttgaacttctgaagcttgccatgcccaatttgttgacaagtagcttaatatatatgcagaattggatcgcaaggcctctaccgtaatctatttgctctatacaaccttcttaaggtggccactctcttacatgtgtccattctctgaaatctatggtatattggtacaataatggctagtgctagcttatgaaaaagaggttttatcagaactaaaaaccagttaacattgataatacttgcagaaaatatctccaagtttttttttctaatttccaaatagtctagctttgtctagcatgaggctttggaactctctcctagggtgtgttacactacaaaggttggtacagctgcattttaaagagaggtcgcattcagtaaagatcagaatatcgaagagcatgacacggcgggagcatgtacagtattgttggaaatatggtgtatattttaatccaaaatgttaagacaataattatggcatgaacaatgtggggtgatctagtgacaacatttagcataaccagaagcatgcttacagtaccataagcatcatgaacataccaagaacgcaatgcgaccaacagaacaaacagaggtatgaacgacagtaggagagagacataccccgagaatggccctccgctggattgtaaggcagaactgcctctgtcgatgttgaagttcgcaaaagctctggctcccagagctccatctccagagacggcggcagcggcggctccggctccaggtgcagacatggtggacgacgagacaacgacgaacagagcagtcgtgtagagcagtcgtgcgggaagcactccccaataacttggtcacccgcctacccggtgcagatctcaggcgaaggtgtggttccggaggccctgctccttccgatctctcgtgcgcacaagcgattgcgatcagaaacgaggaagcgaaatagaggcagcacagggactagcggcctccttatataggaggagagatatctgccagtttagcggcctccttatataggaggagagatatccgcgaatcgttctgatcggactagcggcctccttatataggagggcggaggactagccgcctccttatatagtaggagagatatctgccagtttagcggcctccttatataggaggagagatatctgcgaatcgttccgatcggactagcggcctccttatatagcaggagagatatctgccagtttagcggcctccttatataggaggagagatatctgcgaatcgttctgatcggactagcggcttccttatataggaggagagatatccgccagttgccgcacgcgcgtcgtgggatcgtgcatgcgccgttacggaggcaatcgtggtagcaaaaggacagagactgacgtgacgcacgccccgccccggcccggccaggcacacgcgcgtggctttccgattcccacctcaaccggtcaacagagagcctccaataactccctatttaagttgaggtactcctcgcttaattcctgaggtgatattgttatccttaacacttattatgggcatttgagatttaatagaataaattgggcctagcccaatctatctatctattatatactaaaagtccattaaacttccttcaaacgctctcaagccgccacatggcctcctacaaacactcctatgtcgccacgtggcattttataatctcaccgtcgattttcttttaaattggtggagccgttaattttaagcgttagatctcccttagagaaaaatcatccccactatttttgagaaaaattaccgtatttgctttaactaatagatagaaaaaaaaaggagaataccataataggacaagaggccagccagtgaggatcgggcagggtacatacgttcttttattttctggtgtcatacgttctatttttttttcctggtggcatacatacgttactacgttagttttttttagcctttttttttagcaaacaatattttttgctttacacattcggcaaacagtactattactacgcatacgatacgtacacgtacgggagtttagggggaagtgttaatagatataaaatcacatgttaccgatttaagtgaaaaccgatggtttgatttttttttctcataatttttaatatttattttaatttagagatatgacatgtagtgacctatgagcatttatacgagcgccacgtggcggcttaaaagcgttcatggaaagttcaatggatttatatatactaaaagccaattaaactttctatagacgctctcaggttgccacatggcctcatataaacactcctacatcgtcacgtggcattctataataacaccgtcaattttcttttaaattggtggacccgttcattttaaccattagatctccatctcaaaggaaataaatctggtatccccacaactaacaccttacatacatgaggtaaaaaaaagcagtacgtactctttccaccctccgaatctcccctcctctcctattttctagctaacttatcctattttataattaacactcaatatataaaaaaataattcaaacatctaaataaccctcaagttacaattttattctcattttttgttaattgttctgttatttataattaaatataaaattcaaaatccatattgctcatattttgttatctaaatattagatcatgcaaccattctaactacaaatgtctaggcctaatggtacgcccataaacacttctaagtcatttgccacatgacactctattaaattaaaaaaaaatctataagtgtgacaaatgaaaacaaaacatctaaccattagtttccacttgaatcaatggatccactatcttatatggttagatctatctttaaaaggaaatcccaaaagtcccaaccgtttgtcccgttcctctctccctaccattcattatctgttctttttatctccatggcaactaaatccaaaattatctttacgagaaaaaaaacacccacaaatggactccgcctaacaagtctagccagcttttcctttgtcatgtgcttctcttctctttctcctcaagctagtacttataaaaacaacctaaattagactttaaaataatcgtaaatttttaaatcttatattcaatttatgacatttctaaactattgtaagtttcaattaaatcaataatttaatacattgtggacccgtctatccaacttgaagcctccaataaataaaataaaatactaaaatttctaattaaaaattaaaatatcccaccttaagtttttaatagcagtcaacccattatttataccatgctaaatagctaattgccttcctcccaactccttctgtttcagattataagtcattttaaattttgtctatgtcaaattacttgaattagtttataaaaacatagtaacattttcaacacaaaacaattatattataaaaaacatattcaattttgaattcaataaaaataatttggtgttgtaaatattgatatatttttcgtcaacaatagaagtagttaatttctcttaacatttaaataggggctatttacttatacttagatgcgcttttatgaataaatgatctttttagagataaatagacgttcctaagatcatcataacatctaaattatacatattatatctgatgtcactaatagattagagtaaaagcttttaattatatcttttttcttgtcataacatgtaccctgtctaggatctatttgtcatagacaatagattgaaaacaatcaatggatacttttatcccatgccaagttgtatggccttaacccacttatatttccataccaaattgcagagatcaaaacatttaagggatgcttgatggaatggaaatctagaaaaaaaatagaaaaataacatgataaaaataattgaagactgaacttttttttcttctaaatttaactttttttgaatttgaaacccattctaaatagcaatgttcaaatattttaggagtactgatacaatgaaaataactaaaattttaaataaaatataatagaaaattggactttttggcattatgttggaaacaaaatctaacataatttcagttcgaagtatacaaccctaaactacaacttgggagcaataaaagtctcatttttaatatattttctgatttagaaaaacttt

SEQ ID NO: 16958 - DNA, 1788 bp, Oryza sativa
ataaaaccaaatttgcacagttttaagtaattttagttaagaatttatacaccagcgatggttactagcattcagagaaacaccacacaaattattgaaaaattaaacatgtttacaatagagtaatcataaaaattcctaataaaatttctaacacagttaaataagatgcccgcgcatatgcgcgggctaccttcctagttattctaacaagtatatgtattatatataaccactgatgctagtttttctcagtagcatgcatatttatatttcgttggaaactctcatatagtcaactgtaagcaatcaagactgtcaaaaacctgcatacagcaaaattgcagcttcagtcatttgctcatatctaccataattggatgtcagcaggattgagatgcatcggcaaattagccctcgcgtcatcggtagaaagtgctacattggagcacttgtggatagcaccattgaaccaggcaatctatattctcttctctttatgcagttcatggaaactgctaagacgatgagtccgtgatcaactcctatttaggaataacccgtaccagtgacggttttattcagttaggcaggaatatatctgtgaaccagcagtgatatgatgagccggtttcaattggcttttgtgtgatagcataaactttgtccagaaaatgccgcaactaggttttgtatgcagctagagatttgatcaggtgtatgtttaggtgaattacaccattgtgaatttgggtgaataacaccattgtgaataaactaaatacagatatacttggtgatgtttttaatacaaatcgatcttattgccaatttcatgaacatgaacatgaacattcacactgcttcgttattaaaaaccttttgaaatcgattaatctttaatatagtctatgccaattaatggctagatatcagcacaaatcattcacggtttataattcactactacatagacgatttctctgtacgagcatccctatagtttgcaggcaaacaataactgatcgcgtctaaaaatcgacctgcattttcacatacaactctttaaagacctgcgtgcaaatatcaattttcgctggtgaacctcttaacacacccgtatgcaaaaaatgagtctattttgacatgcggatctcttaagtgaccacaagcaaaaatagatattcgcatgcatgccccacgctttttcccgcaccatttttttaactcccctctttctctccaccacaccttattctctctcttctcttcccactcctcctagctaactcctcctctccctctcccctcttccaatctcttcttcttccctccccccttctcttctccagtgggtgccagcggccagctagcggatctgccatccccgccctcaagagcaatgagtccgtcaaccctgccctcaggagcggcggcagcgggagcgggcagatcagtcgcccaagacctcgagagcggtggcggtgggagcgggtggatccgccaccccgccctcagcaggaatgatggcgcagatccgccgccgctgctttcgggaatgacggcggcgggcgcagcggcccgacgacgacggcaccggcggtgacgactacaacgacgatgaaggtagcgactagggtttcgagcgattttgtttctttgggatttttaatttttttcgctgaaactattttcacgtgcggtcgtcataggtgaaagaaagcgagaaatcctatttttgcatgtggttatgctaccgcatggaaaaaaatgacgattttgcacaca

SEQ ID NO: 16959 - DNA, 4361 bp, Oryza sativa
tcctgcagcccgtttgcaagtcttgaatggtttctcacagacctgttagagtcttagagattagttaattagacttgacacttggttgtccggtggaagtgtggactattttgcctatttactatcagaacatacaaaggattaaacaataatacgatgttgtttcaacagtgtatatttaagatggattagaattttcgcagactataaattggaatccttatgaattttcttggggaaatgggattgattaaccttgatttatatgtgtactagcaagaggagaacaagtacttctcctactatactccctccgtacatagtccgtacaaaatacttctagtatttgaaatttgttcacaaatataatgattttattgtactactttccaacacaactacctatcgtttaatgaatggcaccatattcttttcccttcatccttaatgtctcaatagaatttaaaagttattgtatttgtggacagaggagtacatgtctagctaggatcaaaaatttcgatgtaatcaatcaaaacacacacagtgtttcccattttgccaccgacatactcaaatttcatttgaaatccaagaccatgtggtgtaaggtattagttttgcaaatcatgagagttccaaaactagtttcccaaaactatatggtccttgattcatattcattaaattcaagattttcttagttgtggtcttttatatttgccatgaatctgttgtataaaatggacaggtgaaccctctatcctatatgtcaataaagagtgcgtctccggtgctttttacttagagtagaaatcaatctaaaccgctaattcgtttttatccaagggattagatttatttatactaccaccttattaagagtagtagaaacgtgggagggcaaattcgtccattgaaaaataaacattgatggataaatttgtaaatacgaattggaaactttgggatgagatcgatggtggtggcgctacaggagggggcagaggcggctaccgcggtcgctgctatcggcgacggcggctaatctgcgtgtggacactcatcgccaacatgtccatctaggcgagtgtttgtaattcttcatagacagaggagaatgaccagatgcaaggcccaacgattgtttgtcccgtatttcctctgacttcaattgtacagagaaaattttgaaggttgtaaaatttgtgttgatgtctttgtaatttaatcttcataatccgtaaagagatggatacttgaaaagaatatctacttaaagagaattcgatagatattggatggatggttactggcgaaggtcagttgccgaatcgagttggcaccgccgccggtgtaggtgcgtagagatacagcgagagaaaacgatataagcggcgacactaacaacagattcaactattaacggaaaaataaatatcaaaattacccctaattaactatacaggtagcaaaatactaatatacccttagaaatcaacggctcagatcattctacttgtagtagaatactaccagtagaaagcactggagcgtgactcgtcaataaaatgtccatttttcttccaacacttcttcacaaccgcgaagttctcaaatttgtcctcagtttgaagcaatcatatgcacgactgggatgcgtcaggaatttgcatctttcttttgctttccagtcatctcagggtgcaagcgattttgttctgctcaccagcatttcaacatttgagagaattgcacatccacctaacactacgcaggaaacgctcatctctgacagcaccgaagaactcgtcatggatgacctcacctttgaccggtccatccacagcctgtgagaggtgaagtctccagccgcgggccatcacaagttataatcactctatatcacagggcatggatttttcattttcctgttgatctcaacgaggtcacgcagtgctgtagtggaagctgcgctctagctctttcattcattttcaccaatggaaactcacccttttagattcgaattgaatgtccaatgtaattcgtcctcaagcgattaagagatccaagcagagtataaagcatcatatataatcttaataaccaagcaatccaaacagacagagatcgcactgtaggtaaaaacactaaaaattaagggagcatttgtaatatttgttgcagatttatatactacattaattctttctcacacttgcaagtatgctagctgtccaattcgaaattatcaagaacagagttttaaattttagagtgccaactctctctctctctcagcgcaaaagcatttcaggggcactgaaatttcagtattgaattgtgaactgtgcacgaacactgttaggccttattcggtttagagagggattgaaaagtattagaggggattaagaataattccccaccaaataggtgtggaataaatctcctctaatcccttcctcacaagggttaatcgaacatgacgttaaggctgatttgtggagagcctgaaactaggcatttacatgctcgtcgtttgcattagaaaaaaaagacaataatcagttgcaaacataatgaccgtatcaaagtagttgagtgtattcagggagcatgtgcagagctccaaagcgatgcaaacatatgaaaatacaataatacatttagagatcttcttcaatacttaaaattaattaggaccattgatctgcaataatctaacggacagaaagagaaggtgcctggaaaaaggtattaaaagggtgagtcaggtatggaaggtgggagggtaaaatggtaattgtttttcattaaattttttcggtaaagggcaaaagcgtatttttacaaattcagaacttttgagagaagcaacaaacgtttcagcatgaggaagaaaaaaaatgagaggaagaattagaacgctcgcgtgcgagaggaacctacataacctgctggtcgtcgctgccgtaaaaggctgccgcttgccgaggccgcacacgcccgccgctcgctgctgccgtacgcgcctacgaaagcagcagctggacaccgtcgccgccgacgcacgcgcccgtagcgcccgccggtcacagctgacgtacgcagcagaacatcgctgtcaccgccgctgcacgagcccgtcgcgccagccagtcgccgccgtcgcacgcgctggcttggttgattagggttaatcttgaatcaacggtgcgatggcttggttgattgggtgacgggtgggatttgagcaattactaagctacccttgttaataaaaaattgtgttcctaaattaccctttgaagattaatggtggataacaattcgttaaggaggtacctggggtaccttccaagcaccgtaaaagatctcatatatttaccatcacaaagtcaggtagaccctagcatagcatatgagcctcagtaaggtgctagtatttactagtagtaaaaattaatctgaaccgttgatctcatctcatatctattaatactattaccccaagtaagcggtagtagaaatatgaaggggcattattatagaaaaaggtgtgaaggggcataatcattatatagcagtaactaaacatttttttctccttttttttttgctttttcaatgaaatatgagcgatgccagctcaatggatattataggtcgatttagccaaggaaaaagaacataaatgatagttactcctaatcatggtattaatagattactaatttagccctaaaaataatggtagtataattaaactgttagagaacactggagcatcgtatcagtgagcaggttcactcctcttttctcataagaaacaaccaaaaggttaagactaggacactatacaagctcctcatctacgcaatctgccttttaaagcaaaggagtgtcaaataggattgggaggaatctaggaattcaatatctctccttctcaaatccacagtagctaattgcctatttggttacctgcgcactcgtcagcaacgaagctgggatccccatggcatgtgctgatcacattgccttacactgggaggcaagaaatgaaagagaggatagataataggatcatcgaagcatcataaaatagacgtggcattacttttgaacctcatctcttgaaagaaaagtaatcgaacactggaaagagtcatgtggtgagttatacatctcttgttgatgacttttcagttgaaatcatttagtattcgaaaatattgtttgaagttgtcatattttcaaattcaaattcaaactattcaaacaaagacatatagaaaaattaccaaaataaaagttatagatcttgataagttatacaactttgtttttgataa

SEQ ID NO: 16960 - DNA, 2703 bp, Oryza sativa
  unsure (1)..(2703): unsure at all n locations
ataagtcggatatccgatggaaaatccagataatatccgacggatatcacctagaccatatcgtttttatatccaaaaaaaaatatttgaactcgtttccgaattcgaaaattttcggatatatccgaccaaaactatccgaatccgaaaaatggtccggtcggatggaaattatccgaatcactttccaaccctactgctgagcgttccctgaattcccaaatttctgatcgatcgtgagcctgttgataggttatctacagttcgtttgcatctcttataaacaacttatttctgctgcttcttgctgttaattctacgatcattgagtttttggtagttttttcttaggatcgaatagcaagaactaagccaaccggggagggggggaatagttgtagtacctaaaacgtgaaacttttagcggaattaaaagttaccctcgaattcgatgtagatcggtgtgaccagagttgatccacctgtctgatcgacgttgatttccaggtcaaaccaccctgcgatcgtctctgcctcctgtcgccgctgccggtctgaccaccttgtccccaccggtttgaccgatgcgatgccatcggtctgaccaccaaacccgaacaaacacaaatagaagatcactcaatgtagattggaactttaatatttctctctgtgtttacaaagtgcaacaacagcatgaaattctcgactaaactcgaaaccctaacttttctctcaactcaactctctcaaaaacattaccgggaggacacaccctccctctctatatatacccgagataggcagcctaaagctacgaaccaaccttgtacaaaaatcctaatcccctaggaaaccttcccgtacaaaaaacaaactttacaaacttcaattgtactaaatttggactccttccaaattcgactccacatcccatacgtacacaatatctccatcgtatgccatttggaatcttcaccaagttatgacaccgcatgatatcctgatcgtcattgatctttagcctaagcataccgcatgatatcttgatcgttcagacatcatcttctcccatgttgactcccgatccatcaccggcaacactctcccgagacatcaagaccacctacacatgcatcaactaagaaaccatatccgagcacaagttctcaacaacttgacttattcttagcaaacaacaatattatatacgcatagtatccatctagaagtcataaacatgaataatccacagatatattgagaaacaacccaaaaccaaaaccaacacagagtcggacggtcaaatcgcaagctggccagtctgaccgcttgatacacgctggtctaaccggcaaccactgcccgatctgaccggttctacttagttagcaatccctgttcatcacctgcaaatcaattatctccaaaaccacttcgacaataatctccaaatatcaaaactaataatctcagatgccaattattcatcacagaataagaatcaaaccaactttattttacacttttacttggaagttcttgtgttactgctgctgctgattcaattcgatttactcagtttagaaatcaattacgtcataagtgctacccacctatataaatatagctcttggatttgttttagatatgtacagatttccctagaaaatcaagagtaaaaggattcattttcccaaatctattcagtttcttgattcgtatgaattaaaacagagatttctttgctttggtcttcaatatgtgccatgaatctgctctatatattggcccggtgaaccctctatcggagtaacatgtccattgttttaccaatacttcacaaccgcaaagaactcgaattcctcaatgtgaggtgatcatgcatggactgggatgcgtcgggattatgcatctgacttacttttgtaaatagtttcagggatgcaagtgttggaatgctgcacatgagcattccacatcttgcaacagctgctcgctttgatcatcgctcggtgattggccagagcaagatcgttcttcttccaactaatctcaaccagattgcaatttcttccatggaaggtgggctgtttgacaccttcccagctaattctgagatttagaaggtgccaaaaccatcatatatgtgatcttaataagaaagtaatttaaacagatagagatcacaacgtcaaaaacacgaaattcaagggagaactggtggtatctgttgctggtttatctgctccttttgttgtaacacttccaagttggctagttgtccaacatgaagctatcaagagcaggattttaaatttcagagcgccaaagtatttcagtccaaaattattgtgggccctgcaagaacacaatcaaggatgattaatgaagaacaaaacttggccagtctatgtaactacattgcaacataatgatcaattttcttatgtagttaacattcaaaagtatgtacttgatcaaggctcttattatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 16961 - DNA, 2872 bp, Oryza sativa
ttcctgcagcccagttccacatagttacacggtccagttcttttagacattgtacaagataaggagaatttataccaaattttcataaataataatgctactgatcatcatacattatttgatctgagctctctctatcctccttgatggttatctaaatttatatcagatatattgagttattgactaactgcaaaaagtatcttctagaagagacatggtctaatgaagttacctctttcataaacttttgtttatttaccatgcaccagttctgcatagttcccatgttgcagttctgctaatcattatctaagataaagagaggctgctacctggacgatttatatataatcgttccacagatcattacacactgtttgagcatctctctattcctcctttaattgttttctgaatttcatactataaggcatattgaaaactgaaaagtttatcttctactagaagagacatggcataaagcataattgatgttacctctttctcttctgtgaccggtgaatccaggccatgacaggagggaggatcccaaaaaggaagcagtttgcataaaccccagcaaaatccagtgccttggagaaggccgctgagaagaacgacgcaataacgataggaataatcagcacaatccatgtgagaatagccccatttcttccatggccaccgctagattcagagagctgcccaattcctcgcttcggagaaaacctctgcccaatcaactccactgtatcagccagctgcttcggaaagctcaccgcgtatcctatcaagctcgtcgccaatgcggcaaacgcaaagcctcgaacggcaggcaatgctgctggattcaccgagagcagcagcttaattggatcatcgaatctcgcaccgccactggaacttgccaacccgagaatgacggcattccaggacaacaccatggccaatgggacggcaccgccgatcagtattgcgcgccgcgcatcgtacactgaatcccccacaatcttgcagatgaacggcgtgatgacatggaacccaagcgtcaggacggtcaccggaattgcaggcaggatggtagcagggcgccagcaggcgtagccgagcgatctcagcatgctgctccggccgacggaaacgccggtgacaacaagcgcggtgatggaggcgagcatcaggccgcagagcgcgcggttggcgccgtcgacggccttgaaggggaagaacgcgatgagcgtcccggcgaagcacgggaagatggcgttggccaaggccggatccaccgccgggaagagctgggacaccagcgagccgatgccggcgacgcaggcgacgagcagggagaagctgagggcggcgtagacgacggccacgaccgccccgagcgtcgcccccaaggtgctcgacgcaagtcccgtgaagctgacctcgtcgacgccgccgtcctccatcgcggcgaagctgagctccgcgacgaggacgatggaggacaccacgtagacccacgagagcacgatcgccgccgtggacgggaccggcccggagcggatggtggcggacggcagccccagcatccccggccccaccgccgttccgacgatgaggctcaccgccgcccagaagctcttcttctcccctccaccggataccccgtcctcgacgagcggcgccggtgattcttcttcggcggcgtcggcgtcgccgtagtcgctccgccaccgccattgccgcctcggcgacagccaggacagcggcaacggctgcggctgcggcggcgcggggttcttggaagctagtggcggagggcgacgcgttcgtggctccgggaggccgaggcggcggcggcggcggagcggagaggggcaggttgccggcgaggagggcgtggcgaggtggaggcggctggagagtaacatggtcaacggtaaattttggtagggtcaaaggaggcgggtgaattctgggcctcttttaccattcgaggcccagtttttcaacatacgagtttctaaaacattttggattgggaatttgaagaatgaataataatacgtagtacaaactgagcggattcatgtaaaaaaatactgtaaaatttctgcgtcctaatggagcctcagcaaggccttggaagatttgggattagagaaattaatatggctgaatttacgtttccattgaaacggaagaattttagtgaattttcattatcattagtaagtagttcaagtgttcaacccatgcaagaatccttgaaaacaatcctacggttaacgcgctccacttgtgatggaggaattttgcaaaaatgaagtaataaagcctcgtagtgatcgattgaggctaccagtttggtgtgttaaggccattcgcactagtttgaggagctgagactaccacataggacgaagacacggaaaaaataatacttaccacaagtttcacagttctttgtgaaagtcattctctcctccatctccgaccgccgctcttccccccttctcccctcctctggtggctgccgctcccccttcctcctccaaccacgcctcctctttcttcttccggccgccggccaccgcgctaccccactgggtatgcgcctcacctcctccatctccggccgccgcggctcccccacttcctccgaccgtgctcctctggggtcgccgtcaccatccgcaccgcgcccggagacggagacgaaaggaaggacgacatggcggtcgcggaggaggaggtgacgtcgtcggcgaagatggtagagcatgtactcgccgtcgacgacttcactcgccaagaattgatctctggcgaaaggcagcgaatgggtgctaccaaaccttagggatggcagtgggtcggg

SEQ ID NO: 16962 - DNA, 7929 bp, Oryza sativa
cccgagacccacatgcccgtgcccgacccacgcccgccagctctatcgggcaaaactccatgcccgtgcccatgcccgacgggcacgggcatgcccaacgggtacccactggataccacaaagttaaaaacaaatttaatcacagcaaaaccacatgtacacaacacaaaatttcagatctggcattcacatacacaaaatcacaaatatacatacacaaatactaagatacacatacacaacatcaatttcagaaaatgcttgccgtcatctgtgcacagccaccgccgtcgtctctgcgtcaccgcgccgcccctcccgtgtgccgccgccgcccctcccgtgcgccgccgccgcctgctccctcccgtgcgccgccgcgccgtcgtgccacccctcccgtgtgccgtcgcgccgtcatctgtccgccgccgcgccgcccctccgcgccacccctcccgtgcgctgccgccgtgccaccccctcccgagcgccgccgccgtgccgccccccaagcaccgtcgcctctacctccgcctcccaacgccgccccctcctgagcgccgccccttcctgactcctgtgcatggtgcgccatgccgccgctagacagagacagagagacacgggagggagtgagaactgagaaactagggttagggttaataagttgtgaaatatataccatctgataatgggccaatggttgggcctaactcctgaggagggatgttaaactacaggcacattttcgggtcgggcatggattatccacgggcgaaatgtaaaacccggctgtgcccactaagttagctggtgtcgggtcaggcgtgcccacggacaaaataacgcgcccacgcccatgcccatcgggtcgggtatccgcggatacccgagcccgtgggcattactaccatccctaccaaagctgctactgttttggctccctggtaggccctccccctcgcctcgttctatctttctcgcactagctaacaaatctctgacgcattttgacaaggaacacgtgactaactttggatccacgttcctcatctgggcacgggagagaccgacgtggctgggaatattcgagttgaagggctgaggatgaatgccagcggtgctcactataaatgcccttagtgatctcgtccaattattaaaaaaaaaatcaaatactctattcctaagtacaacaaaatcaaatcgtaaacaaactactaataaaacatgggaactccaattcagtgactttgtgcatgttggccaattgatttctctactcttaagggtttgaatgaatttaggtaatatttttctcccattccatatagaaaatgaactaattcgtacaaaattcagttagaacactatacacttgatcatcaacattgtgatatctcattagccgtatatccatgaagatcgtcaccgactaagttgcagttagtggccaaaataatatctacattttggagagaactcgctcactgtttgctgcccagatgcatccatcagggccatttcactctgctatggaaagatttatgcatccacaacatgttgtaataatagcttaggcaaaatgatattcaaagcctaagatgagaaatcaggatttatgtcagcatacaagaaagcattatatccacccaaaaatttccaaagaaattagctttgtccatccatgtccagcacatcattaagcatgcgtgaccccagtactgccactctatttcacaataatacaaaagatcttgtttacaataacataaaagataacattaacagtgtagtctgcatatgacattctggacatgatacacaaccaaatagtgtactctgcatcacaacaagaatcctactggcaatgtgaaatcaagccaccaattcacccaaaacagaactaaccacaaacatcacatgcattgctgctacaccgcaaagatgatacataatgaacaaaaactgaaccatgcgaagtaagctgaaaaatagttaacaagcgcaatgaacaatccatagcaacacccaaaaggcaaaactgcatagtgcaaacatgaccatagctggaatgaactgatcaaaacttttcgcggcacaacagagtatatcgattggatgacagccaaaatttcagtggcgataatagtttgtaaactagcatacatcatcatgtatgtggcatgcctcactgtaaactaacagaccaaaaaagaattccgatacaagaaaagcacctgttcatctactggcaagtgcaagcatgggtgaaatcatcccttggatcccctgcaatgtgtgctgtatctgaatctcctctgcagccatcctcttaagatttctaacacaaccccttaggttctcatctgatcggatatcatccgcgcgcatctccagcaccttgtttgccacccccatcaagaacctggcataccttggcaaggttgcatttcggtgcaggaacagcaggagaagaacgagttcttccgtgtccaagttctcgatgcatctgaccagctttctccttgaaactagctcctccatcaccgccactatgctccttggattgtttcgagctaacgctgaaactagagcatccttgtgcctgaacttcctcagcaacttatcgtgttcagcaaccttcaccttcttaggcttctcaatcacaaggtcaccttccttagccttcgcattttgtccacggaggaagtacctatagttggacggtgccaaccgccgcttctccggcttggttggtgcccaatcaagctcaccaccaacacccttaccctcttcctcgtcctcccctgtcgacttctttttcctcctacccatataaattgtgccctttgaagatccagcaaccagcactgtcccacacggcgagcacgccaaggaaagcaattccttaggatatcgcatcgagtgcgtgagcttaagctcgccataatcaaagctcttgacataaccatcactccccgcgctaagcagccgcgtctcgccggtgttggtcatcttggcgagcgcgagggccatcaccgtcttgacatggctctccaccgagtggagaagccgcccgccaccaatgacatcccaaatcctgacgacgttcccgccggctgtcgccagcagcccgccggacggcaggaacagcacgctctccaccaattcgccatgggagaaggacagcgtcgacgtcttccccatgcgggcgtcccacaatttgacgatgcggtcgtacgagcccgtggcgaagatgttgtggtcggcgggggacgcggcgccggcgcggatgtagtcgcggtgggcggcgggggcggcgaacacgggcgtctcggatggcacgtcccagtaggcgaggagcgcgtcgtcgccggcggtgaagaggtggaccttgtcgccgccggcgacggggtagcggacgacgcgggtctcggcggtgtgggccgtgagcgtgcggagcgcgcccgacgactgcttcttgtcggcgcggaagacgcggacgacgcccttcttgtcgccgacggcgaggagggagccgtcggagcggaaggacggggagaaggcgacgtcctgggaggcggggatgcgggggagcggggagagcgggtcgccggagaagaggagcacggaggtggacaacgaggcggcgagggtgggggccgacgagggggagaaggcgaggtgggtgacgttgaactcgttggcgggggtgagctcggaggcgcggaaggagcgccagtaggaggcctccggggagaggcgggagggcttgcggccggaggggaggagggcggggttcggcgccgccgggaagaagggcttggaggtgtcggcggccatggcggcggcgggggcggcggcggcgagtgaaaccctagtttgtgggggagaagtgggggagagggggtttatgggttttggactttgttgcagatgggccgtggagtggaggaacgagttctataggagaaatggcgatggatggacaggggaattttacaatttggcacctgtttctccctcttacagtatgccaccgagaagtttgaaaatttttggaaactactcgcaggagatgaagttctttttctatattgataccagaaaatatacccgtgaattgcaatgagggaaggctattttaatcttattattgttatatgatttaattaaggtgaaatttgctgtgttaaattcgcttggatatattttttttatagaaaattatgagctgcaattaagagtatgatcgtctctaaattagcttatgagtttttttaaagagatttgttataagattcattctgtatttcaaaagcgaatgaacttttaaaaccgactcctatacggatgacgtatcaaagtaccggcaaaaacatctttaatttttataatagtagagataaatagtatggagaaaaagagaaaaaaagtttaaaatggaatagtcaaaagaaacaatcagatctatttctctctacttgtctatttttctttctgtttcatagtcttatacgcaatcatttgcgtatgaaaaaaacaatttggccatttggggcatgaaacatttgtggaatatgagaaaaaaagtgcaacatctggatataaaaatgaaactttttgagaactggcatataaaataaataaataagttaaaacaccattaaattcaaattataacatattggtctcacacacgctacgtatagttgcaacgttggaatcatcaatatatttatagagaataccttcttcctaaccaaacggtttgagcccaagatcgttttctttgaaaacagaggaaaaacaagaaaccacagtccgacataacacaacttggaccccaatgtcactatgtagggcgacatgggcaatgaccaaactcactctaccgccagccctcctcccgccatccccttcctcgtaaccgccagagcatggcagcagccgtatgtgcagctacaaggacggtgacggcgggcctctaatctatcgttttccattcctccccatcctcgagctccgtgaggccacgacccctatgatgacgatggtgattgtgatagggatagccagatctggagccacctcgaccggatacaacatctccctggatagatccggcctagatcccacatccctgattagattcgtgcgcagtggaggtatcgaaagaggcgagctcgacaagcaaatgtggtgacatcggtggttgggtggcatcggtggtcagatgtatggactatggtggtggcatgcctgagtgggagaggccagcgaggattggtcggaagaggcggtgacttctcacctagacttgttgtctccgtcgactagatccgatacgggacgacggtctagaacgaggaaggctggcgagggtgtgcttagtgggtaggcgggggcgaggttggcgattgggcggctcagacagtcatagtggagatggcggtgtgcttgagggggcggcatctgatatggaggcagcccatgaggaggttgctgagggcctataaaggggtgttgatgtggtgactatgtgctggtggtggtcgacttggtgcaaggtagctatgatgatggggggagaagcctctaggtgaaagcctagctcgtatttctatgagctggcaacgatgacgttttgggcatcacaatccctcgtgggggtgttgttgagatgtctctttccctccctagcaaagcactttggatgaaaaccttgcccaagttctcttgggtgggagacggcaatgctctcagtgtcaaagccttacaggaggtgtcatctttggaggcccaactctgcagttccttccttggggtatctgttcgcctaggacaacactcttcaaagttacatggcggtggacatgtgcgatggatgagcgaatctttcttctatgtcgccctctctctctacactcttaggctatggtgatgactgggagccttgttttgtatggggtgggcgatgggtagtgcttttgtggcccttgctctcctggcgacgagcggtcacgtatagcagtggtcagcttggtgctggatcccttccttgtggtcaggtgtgaggttgtatctggcacatggtatcgtttgtttcttttctttttcctagttatagcatcccagggctttatagtacaacattttatagcaaaagttgcattcaatgaaatcacaatatttaaaagcacatcatggaaccagggaatcatgcttactctgtcttcagcaacatttttgttgtgaactctcatctatagtgcaagcgatccagaatgtccaacctgcataacaacattgctgctcccagatctagccatatagccaccaaatattggatattaggattgagaagcatgggaaaattagccctcgcaaggcggtagagaggatttctacaattgtgtttttgtgtagctaacaattcaaccaggcaatctctccactttaggcagatatgtgaaaatgtcgaatgatgcctgcgaaccactgaaatggtgaagtgctgctgaaaaaacaagtagaaaatgctgaaagataattatccacataggtttcatgcaactggacattgaacatctgaaatacaccaccgtaaagaaaccaattactggtgtctattcggcaatgtttttaatgcaaactctaatgatagtttcataaacatggacatgtacaatggttcgatcatatataactagataatctctaacatgtgttcttgttaatcatataagtttagcaattattgttataaaaaccggtaccttaaactacatcggagaccaaacgcggaagaatgccataaaagatccaaacttgatgacaattctgaggtacgatatttgttaacatagttaagtggaaaccttgatctaccgtcgacagccatcccctattgcatatgttaaatcgtcatgtggttacaacatgcatgcctctctatttaagagagagcataggtcagaatccgactctactactagcctaatacttagcataactccaaaccctaaactgtaacgactttgtgcacatattggataaaaactctaaccattatcacaaacaatttatgatgtcaagctaaatcttagactctgaaatggttgtcaaccttcagagattaagggcttagcattggcggcttagcattggctctttttcaataccattggaatactctaaaataaagtgttacaatgatatccgtgtgcttacaaatttatatgtgaacgtaacaaatcccaaaaggggtggagggccggctgggatttttatttatttttatttaagttggggttgagaagacctataagttatctctaacaacactcaaaattatgtccgttacatatgagagacaattatcggtaacgggcttagagccattacagataggctcatcaataacagcttcttcttttttttagataatgaatcaataactgcttcctaactgagccattgcagatagggtggataatgtctgtaacgactcctcatcaactgtccattacagatgagtgttaatcctaatggttcagatgccacccgttacagatatgtgatttgtaacagatcgttatagatgtgagctagggtcgtctatgctagtgcacgtagatagagaagatccattatatttgtaccaatggccacacagtgaactctccttcacattcaggaaaacacacattgggagtttccaatggaaatggcaagcatatggaacttccagaagagaaagatagcagtgttgctctatcagttagtgatacccaaattgggtctgagcagttagggctgagaatcaccgggaaattcaccctcaccgaattattatttccagtatagttgttgtccataggtaggagatgaaccgtaaccgtccgttagggatgaatcgag

SEQ ID NO: 16963 - DNA, 555 bp, Oryza sativa
tgttgctcggtttgatgcgattggattaggttgacctggccaggaaggatcgatatgttttaatttgctgctgctccgcgtggcacagatcccgtgctatggtcgtgcatctttttagatgttcaggattatctgaagcaatcaagcaactgtaattaaaaaccacatgattcacatcgctggaggggccttgatttaaggcggccgatgtgatcaattcccatgttctgatgacagaaatcagtccaaaaaacagcaccgcgtagcaatcaaaagcaaaagtcgtcattccaatcagtgaacccagtcctgatgataagcatatcctccctggcctcatcgtgccagcgaagtgattgtgccctcgatcgcatcaatacaatcattcccagcccttaaaattccggctgatacaaatacagaatactctctccgtcctaaaatataaatatttttagctatatgtatccagattcatagctaaaaatacttacattttaagacggagtgagtagtacatatccaaactcatccgcaatagtagtaactgctact

SEQ ID NO: 16964 - DNA, 545 bp, Oryza sativa
ataagcaccgatagaccgaacattgcatgcgctgttgcttcattttctttcgataatcatgagctcggtgttactctcagcttctcatggtggtgataatataggtcaagggaagaggcgcagcggtttagatcgccaaagcggactcattgccattgcgcttgcgttgctatggtcaccggtgaggaggacttgtttgtttctggtaccagtatcgaagggaaaaagaagctgcagctgttggatgatgatggacggataggattggagctaattccaccctctgcattagcttctccaatgcagaggatctggatccctacgagaacacctctgatcgatacggattggtacaaagtagtagtgtgcagcctgggcttgatcaccaagccaagtggtaattcggtggacagcactgcatgcacacttacgtctggagccagttcgtccaaatcaccggtcgtgctacccggtatagctcattttggtgccagcaatgcaggctttgacattgagctgaccataagagacttggggctgcagga

SEQ ID NO: 16965 - DNA, 715 bp, Oryza sativa
ttcctgcagcccgctcgattgaacgatcagcggcttggatatcgccaccaattgactgatcgaaagcgtccgcttcatggcttggacagcagccgccgccgacaagcaccacttcagcagctggcaccgtcgccgcgctggacactttgcttggcgcgctacgcgccacatcaatcgattccctggccgcttccgaatcgcaagcctcgcactgctcgccgagcagatcgatccagccttcgtcggagtcccaatccggcaaggccgaaacagggcacgccaatgacttgatcctatcgcagaggctctctgttatctcgtcgacctcctcctcgtcgtcggtctccgactcccagaatgcggcgtccagtgtgctcttcggagagacccacctgggcttcggctgcgcggccttgacttcgtggcaggcgaatgccacgaacggatgctccaagagctgtgccgcggtgctccggtcgccggcgtttctcgcaaaacacatggccaagaagtccttcgcctctgcggacagccaaaccggcacctccggcacggcgtccgtgtacccaatccggtggacggcggcgaggacgtcgtccatgtcgctccacggcgcgcgcccggtggccatctcgatgaccgtgcagccaagagcccaaacgtctgccgctggcccctgctcctccccgcgggcaacctccggcgccatgaacgc

SEQ ID NO: 16966 - DNA, 1126 bp, Oryza sativa
acagttagaacttagacgccacagcttacctagttacctgctgtggcttgcttgttcatccggattgctcttgggattaatcggtggggggaactggcaacactctcttgtctccgaccaataaaggaatcggacctcgcagtttcgtgcaggtggatgcctgcatattttttgggagaggtcggcggccaaatgggccagagggccagaccgacctggcatgcagcaacgcgctgcgctgcgctgcactgccctgcactgcagtgcactagcagttggggtatgcgtcagatcggatgcatcatccccttccattccgcttccattccgcacagcgagcacgagatgcctggccgcaatgccgccttgtccgctcgcttttgcatcgtacgttcacggttcattccctcttgcggtctcgtgcccccccaacatacaaggtggtggtggcctggtgggcctcctcgtcgtcggagagcgcagcacgccgcgcccgcgcgcgcgtgcgtcccagcgccgctcgaactggcaaaaactcgtcacgcatcccgcctcgccgccaaaccggcgggcggcacgcgcgcctgctcggtatgattgatgcgcggtcgcgaacgcacaggagccagacgagagacaacaacagaagctaaaagctcgccgacgaacgcgaacccggtcgagccggacgccgggtttgattcggcgagcgcgcgactgcatgagccgatctcgggttggccccaaaccacacccgtcggtgcggcacaacgtcgtagatcctgcctgcctgcacgttgcaaacgcgttgaagggaggcagggagctgcgtttttcaaggcggcttgtgcaatgtgcacatgaaccgaactaccgaacgtctggagatctgcgagagagagagagagagagacagaggggctcgatcgctttgctgcgacgccgaactcgacgttcgattcaatggtccacggcccaagtcaacacataccagcaatgcgagcaagtcaaatgtttggtacggactacacttgaggtactactagtaattgagtagcctcaccaccctatgattacattaactgggcatgattacaataacccgttcttccagagctccgattcg

SEQ ID NO: 16967 - DNA, 1008 bp, Oryza sativa
tcctgcagcccggtctgaagttctgactcgtagtcgacaacagggtagtcttcctcctcgaatccgtgcacggcgagatcagagatagcgctttcgtctctcctgacagtatccggagacaccgtaggggactagccatgctaatccctgaagttgatatccggtatcttgtcttagcgtatgttggcttgtatgttgtggcttctgttgttccgtagactgtggtgtgtgttgattgaggtggtcgtgtcccctctcctcgtaaggggccttgtatttatacccataagtgtccccttatccaagtagaactagggaaaccaatatggatacaatccgagtagtccttgtcgtttccatgtagaactctggttgtctttccttatccgaaactccctccatatccgatgtcagtttccgtataagacatggtatgtggtgggtcctgccgagatgtagtcgactactattaggtatgtggtatccataaccctgacagtctcattgtcatgactatatgaacacctctcttttcccatgatgaatacaagttcaaatttggagttcttaaattatttgctaagaagcatgataaaaaaataaagcatggcaaaaacaatcctagaagagatggagtacaagaaaagataagagaaaatcaatcctataagaaatgaagtacaagaaaagaaaagataagtgcagaacaaccctagtagaagaaaagatatagaagagctgaaaaatagcagaagtaaaagaaaagatgtataagagctgaaaaatagaaataagtgcagaacaaccctagtagaagaaaagatatacaagagctgaaaaatataaacggagtgaaaattatgtcagaagtgggatttgaacccacgccctcgttagaggaccagaacttgagtctggcgccttaaaccactcggccatcctgacttgatgtaattacttgaaataatttcatacaaatttcgtatattttacgtgattcgattctgc

SEQ ID NO: 16968 - DNA, 2452 bp, Oryza sativa
attgtatttatctgaagactttcgattgttctaacacaatcattgctgctactctattattttttatttattttcactattttttttaattttctagaaacgcatgatgctaacgtgaagtgacgactttccctcgttccgactctgtagtggattaattgtaatcctattgttttagggccggtttggattggattcaagccaaaacgtgccctaccaagattttgggtaacataaatagtaaatgtgctagtttggattgaagctaaatagttggtagtgctcatgctcaatttagctatattctaaaatcttcttcacaaccctactaaaatttgattttatattggtatcaaaccaaatatagattagctaattttgccctacctaaaaattggtagtgccaaaatctactaattaattggtagggtagagaagcaagaaggcccttattcttttttttcctttctataatggctctgtacgtgctaccttcagtacttcacgttgccttttttttttccagcgaacggcttatcgcgggggaagctgatgggccactgaccgcgcgcagccttatcccctatatactatatactagtagtatattgtactcctcctcatactactatacaatgtatttgtatttgtacacagatatatatacttttaatatatacataccaagtcattttttatgtatgaaaaatatatacacgtatacaaactttatatgcatacatatgcaaactttgtatatgcacgtatgcaaattttgtatacgtatgtacgtatgcaaaatttgtatacatcgtatacaaaatttgtatacatgtataatatacaaagtttgtatatgtatgtatacatgtacaaactttgtatacgatatatacaatgtttgtatacgacgtatgcaaagtttgtgtatatatgtagaaactttgtatatgatgtatataaactttgtacacgtatatatagatttaaaaaccggaaaaacgtatatatattaaaaaaactggaagaaaacccaaagaaaaaaaagagaaaaaatggaaaaccgcaaggaaaaaacccaaaaaaaccgcatgaaaagaaaaaaaaaaccgaaaaaagggtatgtggtgtgctctcccaccgccctcctctctccgtgcacgccacgtggctgcgccgcggggggtggggggggagggcgcgcgactaaccgctagttagcggtttcggcttatcgttgtgtgaggaggagcccatgcgcatgtacatattgcggaaaggccgtgggacaccagggcgaggcccaaggtcgcacgccctagctagatgcaggcccaccccgcatgtttctatttttctccgatctctcatgatgcggatacttcacccatcactttaacacgtggcagtttctcagagaattcaaaccaaattcgttgggtgccacgtggcccaatagaaaaccagatcacagaccctaaattcggtcttagagatttcttgccatgatacagaaatcattcgcccaaccttgacgcagacacatgctatgctaggatagcccgtcatcgccgatgctggaccacggatcgcctagagaagagaggattgccaaagtagagtcttgtcttttgtttgcaaatcaaaagcagattcaatgcagcttggacaaaattgttgatttctctagtacccctctgcttcatattataaatcgctttaacttttttttcttaatcaaacttataaagtttgactaagtttattaaaaactagcaatatctataatactaaagtagtttcattaaatctagatttgaatatgttttgataatatattattctttaggtaagtttaccattctttaaaagatactaggaggtaccatattttctgatgtgtaactttggtaccttcatgtactataggtataggataccaaaattttaagtataaaatttaggtaccttgatatacttttctcaatgactgtaatatttattttgtcttgtgcattggaaatgtttctacgtttttctataagcatggtcaaaattaaagatgtttaaggtcctataatatgatatggagggagtagcaaggatgatctttttgtttgttcagttgtaaaggaacttccctttctcacttatgtggaaattaaaccagcaagaaaagaatgctatcacttgtcacagctctaatgatgatgctgtaacattgtaatccaatccttcaatcagcctccatactagttatacaactagcttactaccactgctacactatataactgaccaaagtttcttctctgaattctgatcaagacactgaagtctgaactacatacagtgtacagtcacctaacatgaattctgaacaacttgatcccttgtaagccgcttcttctagggacatataagccatgtcgacggattcagggctgcagga

SEQ ID NO: 16969 - DNA, 8460 bp, Oryza sativa
cagggaaataaatggagggaaacaacagggtatacaacaattccagggtgacctggatggagccttgttgaggaatctttgctctctgttgtcatgttgtttttttatgattctttttgtttgtgaagttgtaacctaaactttgcgccttttccttcttaatgcaatatcgcacaactcccttcaagttttctgtttataaaatttgcagcatcattcttgtcccacagattcagtccaactcactggttacttaaaccatttcactgaatctgtttataaaagaacttttctttctcacatctatggagtgaacacggtcagtcagaacatacaaacaacaagcaaacatggtaaattaaccagcaagaaaaaaatgttatcacttgtcacagctctaatgatgatgctgttacattgtaatccaatcatttaatccgcctccatactagttataccactagcctactaccactgctacactacattcctgaccaagtttcttctctgaattcagaacaagacactctgaagtctgaagtacatacagtgtacagtcacctaaacatagagagctctgaattctgaacaatttgatcccctgtaacttgcttcttcaagggacatataaacctgaccacattatgtacacagcaatcactcttaggcctgaatgtctgatgatagatgctgcctggcaatgctgccatttggccttccatgcgtcaaggtttgtttaagccattaaatctgcaattgttaagcagctaaaagtttttctttgcaaaattcgttgaggacaataccttataatagaaaataaaatataataactattttactagtgcctgaaacttttcagatgaacaaaaaaactcctttcgtatgacataacgtatgtaattcaggtgttttcacgttatgtttgccgcgtacaatgttatttctcataccagatagtttcgaagtccaacgaaagttttcttcaaggtatccctcgtcctacctatctgatggtgacaaggtggtcaaaacaaactgtccaaatcaccaaattcagctcattgactgaagaacaatatcacttctagtctcatattctcatgctattcactcttaagtcatgttgtaatcggcaatattcgagcagccaaattcatctgtaaagagacttgagtcacttgacagacactgaccttggagaaaaaacatagagaaaatataggacttttacggtacattctactgcaagtatatacttgcagtatataaaagggtatgtttggtatttgttaaaaatctgaaaatggctgtttagtcatttgaagttaggatttatttttatcgggagtaattttccaccggtagtagagattttttggtcgcacttgcatctgaaaatatttatcagcactgttaagttttggcatgcatagccatgatccatcaatttgatagatggtgactagttagtccatacttttttgccagacatatcaagttctcagtatctactatgttgatttctcagtttatgatgggatgatttgccagttttatcaatccccgcacggaggcggcaccaggagacagtcatgcaaaatgaaaacgactatggctatcagtacaatttctcaatggggctggggctggcgaccgggcgaacgagaggctgggacgcgtcgtcgccgacggcaccgagtttggctctggcgcttggagagttttggttgtcgacggcggcgatagcgcatggaacgaaggaaagctaacctctcgagcggatttatctcaagccggatctgacaaaaaaacgcgaaaatacaaaaataccctttttaatttatactgcaaactaatttagagagagatcagatgaatctgtaccgttggatcgtttatactgcaagtatatacttgcagtatagagtaccgtaatcagtttgtgagctctgattctgaggtatccatgttttcctatgaaacattaggcttggactacatattaagtttatcaatattgaaagttgttaagagcattatagtcttctcccatctcttttacatatcatatatacctatttggcctaactcaatattgcaacaagttcgatcctcaatttctctcttctttcagtatttgacaaaagtgaaacaagtgttccctatatccatgttcatgatgagttatctattcgaagacgtgccggaaatcctaattaatttggaaatgagaggcttcgggtcgttacagtgccagatcaacctacagtgccctcctccttggccatctccagctttctgttcttgccatgacagagaaatccttggccccaatttgttgcaaatactcgcaagacttgcagtgggtgtcgctgttactggactgcatcatgccttgagaaaagagaactatcaccccagggaactgcatatgtgtgatcaagttacacagagaaacattgatcacatttgatgaaattatcagggaactgcgttttgttctgtatgattgtgcttttggttagctattttgtttgttcagttgtggccagactctgcacttcttcttgatggaatgaatgcgcacacacatctttcgcacattccctaaaacatatgtgtgcacttcttgttttctgttataatatttacaggttacagcaccagttgttgtcccacaaatgtgctcagctcaagccctatgtccaagtcattgattagaccatcccaatgaattgaatctcttgtactaaatgaagttctctttctcacctgtggagtggtcagtcaatcagaaagaacaagaaactagggctgtgtttagttcccttcaaacttctaactttttcgtgtaggatcaaatcacagtaactaagccaaccagagggggagtgaatggttggtatacccaaaaactgaaaacttttagcggaaataaaagctaccctcaaattcgacggatcgcggtctgaccgaaggtgttgcgctggtctgaccgcctgataaacgtcggtctgaccgatgtagattgatcggttgaaccaccgagatcgcctactagctcctgccttcgctgccggtctgaccgcctcgtacccgccggtctgaccgccgcaatgttgccggtctgaccgccggtgcgttgccggttagaccgccgaaacccggagaacacaaatcgaagaactcttaaagtggatgacgactttattgattctctctgtgtttacaaagtgcaccaacagcactccttacaaaaatttcgactaaactcgaaaccataattcaaaactcaactcaattgctctcaaaagcgatatcgggaagcctcacgctccccctctatttatacccgaggtaggcagcctaaagccacgaaccaaactcatactaggagtcctaaacaccttaggaaaccctttaacacaagaaccaaactttacataaccaattataccaaatttggactcctttcaaattcgacttcgcatcccatatgcacacaataactccatcgtatgccatatggaatcttcaccaaccacgtgcatcaactctagcctaagtatcccgcatgatttctgaccaccacggacgtcgtcttatccccaagccgactcccggtccatcaccgcaaatactctccccgaggcatcgagtcacctacacatgaaataaacaaagaaatcatattccgagaccaagctatctccaacttgactcattagtagcaaacaacagtattacatacgtatagtatccatctagaagccataatcatgaaataatcacggatatccaaacaaacaacccgaaaccgaaaccgacacagagtcggccggttagaccacgggctaggccagtctgaccgcgcgatacacgccggtctgaccggcaacacttgcccggtctgaccggtcacatgaaataacagcagtatcctgtagattcaccagtgaaatccaatcatctccataaccacttcgtgaataaattccaaatatcaaaaccaataatctccgatgccaattgttcattacaaaataataatcaaaaacacttttgattttacatttcgtcacatcaaatgtttagacacatgcatgaagcattaaatgtagaggaaaaaaatcaattgcacagtttccatgtaaattgcgagacaaatcttttgagcctaattacgccatgatttgacaatgtggtgctaaagtaaacatttgctaatgagggattaattaggcttaatagattcgtctcgctgtttacagacggaatctgtaatttgtaattgttttgttattagtctacgtttaatacttcaaatgtgtgtccgtatacgtcaaatttttttttgccagaataactaaacacggcctaggtaaacttgaaagaaaatactgttctcacaggtctaatgatgatgattccattggaatccaatcctcccgattcttttctgattaagatatatattttatctcggtttccgttaccacacttttcaaaccactaaacggtacattttgcacgaaaactttctatataggaattgctttaaaatatcagataaatctattttcaagtttagaataattaaaacttaattaatcatacgctattggttttcttgttttattatgtgaactcaaatagggtaaagtactaacagaagtttttttttccctttttctgaacaaggctgaccaaattatgtagcccgcaatctattgctcgatactccctccttactcataaaagaagttgtttagggcaatgtttaagtcaaaccttcggaatataaatcatgaataactctcaagttgttgagtttaaaaatataaaaattatatgaatatatttgtcttgaaaaatactttcataaaaatatacatttatcacttttcaataaatatttttatagaaaaaaaaatcaaagttgtgttttggagaccgtgtcgcttttcaaaatgactttctttactagtaccgagggagtacatgctttggcttccctgaaaggcgaagggctgctcttgacctcaattctgcatcaatttttaccatatatcaaggtttgtttaacccatcaaatctgctctcattaagcagacatcttggcttagcacattaatatttatataacatactgtatataataaccagttactagtttctgaatcctttttttagatgagcacagaatctatgttcgtcaggcagcgtttgtcatgttccttcatggatgaaagctgtgtaacgtcatctttgtcgcgtacaattttatttctcaaattgtcatgccagatactttcaaagtccaatagaaaatttctacagggtatcgatcgtcctgcccgtctgatggtgacaaggtggtcaaaagaaactgcccaaatcacaagatttcactgctagtctcatgctctcatggtatgatcactcgtcttctttaaatgcacaacaatccgtgtcaaatcatcaaaagcaaggaactcaagcaatggcaaattaaggagggatgtgtttagcactcagttaatcgtctgacatacaattcttaccgcatggtaaaccagaaaaaagaaacaaagaattttgtgaattgacacagcttgtacttcagttcagatactatggcctgcttggactttgttcacaaaattctttgtttcttttttttccggattgtcacagttcagatactatattcacaaatgtatctaacttaagtactcatgttctctgatgaacattggactttgttcctgagaaagagtgaggttgtgagtttatgagctatattatgttcatcaagggtgaaacatatgcttgctccatgttttctgtttataaaatttgcagcatcattcttgccccacagatgagctcaactcaattcctatatccaagtcatggattaaaccatctcactgaacctctctttctcacttcaacagagaagaacacatggtaagccagaaatgtataaagagggtaatcacttgtcactcctctaatgatatgactgcatcgtaatctaatcctttaatcagccaacatactagttataccactgctacactacactttgtaactaactaaaggtttcttctcggaattctgcacaagacactctggattctgattgtctgaacaacatacagtgtacattcccctaaacacagagagctctgaaatcttaaccacttgatcccctacaaactttcttcttcaaaggacaaatgaacctgaccaaaaagtctgtttaagccattaaatctgcaaatcttaaagcagccaatatttttctttagcaaaattggttgaggacaaaaccataaataaataaatacagtataaccaatttaggctgtgtttagttcaagccaaagtttggattttggttgaaattgaagatgatgtgactgaaaagttgtgtgtgtatgacagattgatgtgatgggaaaaataggaagtttggatgaaaagtttggatctaaacacacccttactagcgtctgaagctcggatgaacatttgactttgttcgtcacacatagcatcgtcatggatgaagtctgtgttcacgtcatctttggcgcgtagaatttaatatcacaaatcatcatacctgatattttcagagactaataaaaaatttcttcagagtatcgccttgacctacctatctgatggtgacaaggtggtcaaaagaagtggcccaaagcaccaaattcagctcattgactgaagaaggacatcactgctagtctcaacttgtatcaaatccttgttaaatcatcgaatgaaaagaacataagcaatgccaattcaaggatggatgtgcatttatccacaaatcttgagcacaacatggtgaacttgatccaggaaataaaaaaaaaaagaattgtcacttgacacagctctgatgaatctgtgatgatgagtaacactcagtatactacattaattagaatcaaatcattaatcaaatctccaatctggagtaacactgctaaactagaaactaacctgcatatcatactgctcataagccactaatccttaaccatctctgaattctgaacttgcctgagaactctgaatactgaacatgtctgaaaactctgaatttatatacagtggtgcagtcacagagagagagagagagagagagagagagagagctcagaagaatggcgcgccgagcggctccgtcttcgccgccggcggcggcgcgagcatggagaggtcgtcggcctgcagcagcgagccgaggccctggaggtcgtcgaggctcatccccatgagccagtcgtcgtcgcgcgcctcctccttgggcagcagggcgtcgtcgaacgacgccgccggcagcgagtagtccatctccgggaacgcgtcgctgtcgacgacctccgactccggcgtccgcgtctccccccacgactgcgccgccgccatggcctcctcctcctccttcctgctctgcatcttctcccactcgttcttcttgttgtacagccggcacagcacccagtcatccagcctgagcgcgcccgcgcccgcggcggcggcggcgccgcccttcttggcgaggcggtactcgtgcatgatccactccgtcttgacgccgcgggggggcttgccgtggtagaacacgagcgccttcttgatcccggccgtcctgccgttgtgcagcacgggcttgtcggcgccggtggccttccagtagcccgaggcggcggcgcggttggggcgggagccgttggggtacttgcggtcgcgcggggtgaagaagtaccactcgcggcggccgaagagggcgcggtgggggaggtcccatgggtcgtggcggtagaggtcgagctcggcgatgatggggaccggggcggcgcggcccgcggcgcgcgggcagaggtagtgcgccaccagctcctcgtcggtggggtggaagcggaagcccggcgggaggttcaggtccgcctccgcgtcgcgcactcgccgcttcgccgccgccatggacacgaggtgttcgatcttgggacttgagggaatgagggtggtgggttgttggatgtgagtggcggcgggggtgggagggagatatatatagagggaggtgggaatggagaagattcgtgggaaggagagggggggtcgaggtggatatggggagggtggaggaggaggaagaagcactgcagcggcatattcggtcgtctgtctgtcctctgtcggttactcggttgatgttcatctgctttttttttacctttaattttaaaagttaaccgttctaaaatttgttttaaaaatctaaacctttttacaatgttagcctgcttacgcgtggcaaaataataccgtcacactcacaaagcccgcaatggttgtgatagttttgtcatgtcacggtgacatagcaggacaatattgtcacgccagctaggg

SEQ ID NO: 16970 - DNA, 1830 bp, Oryza sativa
tgtaggttgcgtcaagggctacaattttgatataaagtttgtcttcattagagttcacatgaaaaagttatgaattattttttatataaagtttttagaccgtcatgtttagggaccggggtgacacaattgaataagttggaggacctaaacgagtgatctgcaagtttagagaccgggatgacacagtcgaacaagtttgaggacctgaacggtcgatttgcgagtttagggaccaggatgacacaatagtataagtttagggaccggtgatggactttactcttttaaattttattttttctaatttctttctgcatcgtattaatgtagatactgaatactttaaatgataaatattgtcaataaccggcctatcgagcatcgtttccgaagtgatgctatcgattccgaccgtttccgatcgttttcacccctaacgccaaccataccgacatggccaaatagcattgtcacactatttagacgagcgtggtaatggtgttttaccacactaacccgcctggcatgatcaataaaattaaagattttttaggttataactgttgtatcaaaatatgaggattcctacaatgactcacatgattccaatcacttcaataattctaaatccaaccacatgcttgcaaaggaaatctaggcaactaaaaattcaaacattgacaactgtagtgactaaaagaaaatcatttgatttaaccatggtacgtgctaaatgaccttacaattcttattttatctaacaaagggaataagtagtagtaccagctaataattaatactccctccgtccctaaatgtttgacgctgttgactttatttaaatatgtttgaccgttcgttttattcaaaaacttttacaaaatatgtaaaactatatgtataaataaaagtatgtttaacaataaatcaaatgataggaaaagaattaataattacttaaatcttttgaataagacgaacggtcaaacatgtttaaaaagtcaacaatgtcaaacatttagggatggagggagtatattacttcctctgtagcagagtactattcttcgtctaaatagtatatccctttagtttaaatttgaactagagaagtacactcattttaggacgaagagagtaccaaattaagcacatccgctatctagttttttaaatttattttggaaccgatggggtacgtgggagtaacgaacaccacagcgaaagcgacggtaaacatacatgatgcgaaaccgctaattcgcatcacgtattatatatatagagagagagagagagagaaaaaacgagggaacaaaacctaccgcgcgtacgttaacgccgatcggccgatcgatgtctgggtcgttttcaactgtatagtagagtgagtggtctctggcgtggcggcacgtgcggccatcgcctaatttcatcacaaaaaggaaagaagaaagaaaggcgaccgatggagacgtggacggggggtcgcgcgcgaacgtacgtgtggattcatcgaacctgactgacccgacccgatcgacccgagcttctggacgcttttgttatctaggccgacggcgacgtatacaggcctcgtgtagtttgcgaaaaaataaattttaggttatacttcctccttcgtattttaatatatgaaaaagtacgaattacctttcgaactattacggtcatctgaattaccctcttgaaccacaaaaccggatatttttcaccccgaactatgtaaaccggacgaattacccccctcgatccaaaccgcggtggttttggtctacgtggcggtccagtcagcaatttatttat

SEQ ID NO: 16971 - DNA, 5101 bp, Oryza sativa
ctgcagccctgctcgtctcctccgccgcatgccgccgccgctcgcctcctccgccgcccccgccgccgctcgccgcctcatcccccgccgctcgcctccaccgccgccgccgctccctgtcgcccgcctacctccgcggcacgcgtgagtgagagagaatgagaggagagagagaggaatagttggataggagtatgacaggtgggtccacatttttttaataaataaaatgctgactggactgccacgcgtacgccacgtagagcaaatccaccacggtttgggtcgaggggggtaattcgtccggtttacatagttcggggtgaagaatgtccggttttgtggttcggggggtaattcagacgaccgcgatagttcggggggtaattcatactttttcctttaatatatgacgccgttgattttttaataaacgtttgacctttcgtcttattcaaaaaatttatgtaattatcatttattttactgtgacttgatttatcatctaatgttctttgagcatgatataagtatttttgtatttgcataaaaaatttgaataagacgaatggtcaaacgttagttaaaaagtcaacggcgtcatacattaaaatacagatggagtatcggatattagaatggattttttacacgaataaaaatactaattttataactcgtctggaatcttttcagtctaattaatccgtaattagcacttaggctcaaaagatttgtctcatgatttcttccctaactgtgcaattagttttttttaaatctatatttaatgcttcacgtatgtgtctaacaatttgatgggatgtttttaggaaaatttttttgataactaaagcaggccatataattaatactattggcagcgatgacgtcagtgccgacttcatccactcttgcacgtataattaattatattattacttctagattactactgcccggacgggaggtgatgccataggctacagcaatgtgtgtaggtacgtggttcttctgcagccatggaagtgtgtggtccgtttgtgtgcatattctttacctgctttgccggttgaatgtcgatgcaaaagttttcaattacggatagttgttcatgtgtactcctctgtcccttaaaaacataaatctaaaattagatgtgacacattctaatacaaagaatttagacagagacatatctagatttataatactataatgtattatattcagtactaggttaatttttttatgggacgaagggagtgagtgatcttgagaagcatatattgtttacggtatgtggcacttacatcaggtgccatatggcagaggatatcaatatatgaagcactccctagattaatatatatttggggggggggtaaaattgatttttttaatgtatttacaatgaaagttgaccgtgatagcgaagaaaggaaagcacactagcgcggtagcattttgtttaactcatgtttatccatgataaaatgtgtagtagtagtagtatacttgaactttttgtttcattctcatgaatccgtgcggcatcaaatactctctccattccatattaattaatcatcatataaacatatagaaatttcaaattgatcatcatataaacctggtccctttatttgacatgcagtattattattgcatctatgcatgtaaattgagtatccatgcatacatttagggataggtaagcatttgtttcttgtgcatacgaggagttatagcctacatgtttcttgattctttccctccacatacttagattatataaaatgcataatagttttttcttcttagtggaaagacttatatgataactaatatgaaatggttggggtactagctacgggcctatacatcgcacatgatctagatccaccaatcggtactacaagtgtaactgtacacacttgcgtacgtcctactagtagctagtaggtagtaattctatgtcctatagaaactaacatttaaagttttcactaatatcctgcaaaacatgtcattcaacaatataatcaaagaagttccctaaaaaaagaattaatcaataaagaagtgggaccatatacttcaaaaattttaaatatgctaaagattattttgccatgtgtcgtaatttctgtgaccatatagctcctgcgttcgaaatacaacatggcaatgagttgtggaaaggatcgactaattaattaattacacgcggagagattattcgtgctcctgtcaaccacattgcacgcacttgaccataaaatgacagctgagtcttagtaacctggtcatttctagtaggaaaactaatttgcctctaaaaccttcttacaaccgtcgagttttgtgggacgaaagaagtaggtgaagtagtagagtggagcagaagatcctgagcctcgagggatcaatgcgtgcatgcgacagtgctgacctttccctgtcgccctgtcggttccctgttggatgatgattccaggtgatgagagagtggcgcgcaagtagccgccgcctccttccatagcatatccacgaaccacgatggccgtccgtcaaggggagcgaggggccgcggtttattggctccgtagtacgtactacctccgttttaaaataaatacagccgtaaatattcctccctaacatttgatcatccattttatttaaaaattttataaaaaattcaaaaatatttagttacacgtaaagtactattcatattttatcatctaataacaataaaaatactaatcataaaaaaatttcaaataagacgagcggttgaacgttgaacgtgaatagtgcagaactacacttattttgggacggagggagtacgagctaggcagccgcgtgcaattttggctgtgtttagttacacactaaaaatgaaagtttaattaagttttttaaaaaaattggaagtttatgtatgcagaaatgttttaatgtgatgaaaaagttagaagtttgaagaaaaaattgggaactgaactcagcctttacattctctttcaatgaacgaacgctcgatcgcaggttgtgacggacgcatgcatttccacgtgctgaataaaaatcatactccagcaatgagcctgctgcctacttcgatgcgtcgcatatggatatgggccatatgcaatgcagtgcaccccacatcgttccatatacgcacggcgcacaccctgctaattaatttggtcaagcctgacctttactgctcgtgctaatactaatattcaggcccacttctattcttcagcttcaagcacacttaatttccaactattagatgatactttttttttaaaaaaaaaaatctttatagaagttgttcaaaaaatttaaataaaaccatttttcaagtttataattattaatacttaattaattatatgctaatgagatttctcgtttcgtgtgtggtacaaatcttgctcatccacctgtaatagaacgaatcataagaatgtgttctgttggttgatttatcaattccatgccccaaaaaattaaaaataaaagataaagttctattttatatttttggtgcaaaataaattcgcatataacatggcattaaccccagctcaccaccatccctgtaaaaggaagagtaggaggggggacgccccaactctctcaattctaaaaccctagaacctaagtcgtccgatcaactgatgcgggaagagattagtgaggtgatctatataattttcttttgttttattgacagaaaagccaacgccctatacttctcctacagtgagaagaattacgagaagatgagaaaagaaagaacaagaagtaaatcaaagtgaccggcttcaatggcttcatcctcaagttagcagataaataaattctgcattgagtaaaagtgatcatgtttaaactaaatcattgagattatgtaaattagactcaacacgttcaaaactccattttagtttggctacttcctcaatttttgttagcacacatttaaaattgctaaacgttacgtttcttctaaaaacttcctatataacgagttgctttaaaaaaataaaaaatatatgtttttcaagattttaataactaatacccaattaatcatatacttatcacgcttctcgttttacacatggctaatcatccgttcaaaagcactttagaatgcaccctaataatagcatcttctaactaaaaaaattatctcaaaacatatcaatttctagctacttcaatcacaatcatctctcaattaatttctctatttttactttctcatgtcttaacttatcacaaacttttttcatttaatttcacattttcccttaatttccgtaaaaaaatacttatatatttttagatggagggcgtagtccactgtgatgctacaatttgtgattttagattttcgggctttcttcattgttttttgttactcaacttttatattgttatgaagaaaagtaaaagaagatgacctaaaattattattaaaaagagttaaaatccaaaattagcttgaaaaaagctgtaccaaatttaaaagctacctttgcaaacataggtagagggaggaatagcttcaaattaacatattgtttttcaacgagcatgccaacttcgctgtgttataaggtgagggtggggaaacttccctttcagcatgagaatcgaaacgatggattagtgcacgattaataaagtattataaaaaaactctaaaaataggttaataaacttttttaaaacaacttttctatatttattatttttatttatcttaaaaaaaggcatatcttttagtagttcggtaaacgtgcgcgtgaaaaagggagcgagttgcgaaagagaagaaaaaacacacccaccactatatgtcttcaccgttgacagcacggcatgtacgccaagctgcatcttacatatgcctcctcaatatatattcggattccttatacttttaataaaaatcagcgcataaaaatctcttatactactgcagattcttcaacttttttacacctaaaagtctgaaaaacctttttgtccaatgtaaaaacatggaagaaagggctgcagg

SEQ ID NO: 16972 - DNA, 794 bp, Oryza sativa
cagccccatgttatttcggtaaaatggaggtcgtgggaacaaattctttcacatatgtgtgtgctatgatttgttttcttcctcaccaaaacaaatcgtgtaatagatttaacgattcaaaattatgtgaaacttacatataagttacactgtagttatatgcaagttacagtgtaattacatataagttacagtgtaattatactacgattgtactataattacatctatcaaatttttggagaaaaatttgtcgacaaatgtataggtagtcccaattccaataatcgaagtgatgcactagcatttacataaacacatgggcacacaggagaaatatcgcttgtgcatccacgtttatcgctagcatccatgttttatccttacgtatatgtttatgccggcctcttccatgtattcttaaacttagttatgtccctaatgtcaatggcaatagtcatagaaaccatttactgcacttcctttgtttctacctacatatacaaagtcatcgtgactttgcttatcttcacacatattgcttacatatagtcatctatttgttttttgtaagttatatggatgttccatccacgtggcacggttgattcctaggtgcataaagcctagcaagtaggtttaggaggcaatggtaacttagaaatctctttgtgaagggaatgaagtactgcgatactttatggtttagcgtgacacgactccgatgagaacgctagggcaagcaacgatggtaaaatatgtaggagaaaggtgcaaatgtgcaattggcactg

SEQ ID NO: 16973 - DNA, 5236 bp, Oryza sativa
ttcctgcagcccaaacctttcatacacacgtaacttttctatcacatcatataatttcaaccaaatttttaaatttcagtgtgaactaaacacagcataagtactagtgtagtgctacttcatggcctgaacccgcaggttttatgacttttaggtaggattggatgtgaaaaagcattgaaccggtagtgttgccctatcactgttaaagtgttaattcacactgaaccagcagtggtagcccgttccgtggtagtatcacaagtctattatataggttacatgaaatatctatttgtggcatgcatttttttttatttttgctcgatgtatgtctcccttgtaatcgaataaatgggttgtgacaccatatgtatccagctttgaggactatatatataatataagtcgcttgtttgccagtaccatttctggtccagaggactcctccgaatgaaacatatattctcctgttgctcactcaaatgtgaatttacacctcgtcatgtatatgaccttttgggtgtgcatcatgcagtaggtttaggaggcatccggatgtacatcagtaacttaaatggctgaaaaatgcagtagtgaagaacaaatcgcgacggcagcagcgatttgggtgatggcggctagggcttgtagcagctgctgggctatcgatctcttccccttttcttttttttttgttttttttcagttggtttaatagatatcctgatgaagatcgaatggcccatattaattcgatcaccgattactataaacttattgtctattttgcactactcggcgagctctacgcatccgcggttcctgatcgcctattcaaacaacggtttaaaaatttaacttttgtgcgtttgttctaatattccacgaaatatttcctgatcgcctattcaaacaacggtttaaaaattgaacttttgtgcgtttattctaatattccacgaaacatattaattggaaactcggggcattacattcttccccctttaattaaattcgccctcgaattcgtccaaccattctctagaacacagggtattacacgatgatctacaggctttccccaagctaggcgtaatctgaagaagtttgcagccttgtcccagtgtgctaacccattcaaacctctcagtcttaggctccatagttccataaacttcaatacatatatacactgcagtaaaaccttgaaatcagattctccctgcgtcccaaattagaaggcctatattttttctatacggtcttcaataacatacttgatcattaatttatttcatattatgtttcggacaaatataaaattagcatcacattaaagtactctaaaatataaatcttgcggtataacatgcataatactttgtgtctgtgtgtaaattgaagatgtttttgccgagattttggtacattatccgtgtttgaatcagattttaagttcgtttacttttagaaatacaaaagaagtcgtataagaaatctctttaaaaaaactcacttactaatttcagatgaaagtcagactcctaattatagctcatgattttctcaaagaaaaatatatccaagcgaattctcacagtcaagttcaccctagctaaatgtcacgccccgaactagtcccgactggaactaaaccgtgacgctccaaattaacctgttaatcgataccagtcctagaaaacagtgctggtatcacaggaagatagaatatcacagcaacagaggtctctttattatagagtaggagtacagtcatgttgggctgcggacagatcccgagctcacaactgcattacaaaagggaaacggaagccaggactcaggctaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccacacgacattactaacccggatcacccagcccgtggggatcagccacgttgggagacctccaagctttcatgacaaggcatttctaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaaacggtccttaagtgcaagagcggaaaaccgtacacccggtacgttccccggtccgcggttttggaaattcatttagttcgcaagcaccgacccaggtgtcgggttttccaagtcttttgtaaaacccaagttttacccaagttgtttttcagattttaagtttgaaggcgtccgctgatactcgcactaggtgcgcgaatatcgagacgcaactagatggttgcaaagggacatggtatcacaattaacaaagaaaggatcaaatgcaacaaattaggtaggtctaccaatctgccttgcagacgggacaacagattaagtgcgatcctatcaatgcataatatttttcaagcaacataattaaatttcaaatataggctcaagatgttcaaaggtggcttgccttgctcgagatctggagcttgatcctcgaaatcctcgcactgcgggtcttcgggctccgaaactacacgcgaaacgggacaactcaacaaacggcgaaaataaagccctattaatgacctcgaagcgtgccattagatagatctcgagatttgaggaattttggaagttgaacggagtcaaacggacttatggttgggaagatattgaatttctaagattattggatttttggtctaaaggaaaaggatttaattaaatcctttttggaaaaaaaaagaaaagaaaagaaaagagggagggaatatagacttttctcgggtggctagggcgcggcacgagagaaagggcggctcggccgggcttaacgggccggccggcccaagaaggcggcccagagcggcccaagacgcgcgcgcgtgggagggaggagagagagagagccggtggaccgggcttaccacgcgcggtcccgggtgggacccgcttgtcagcggctcggctcaccgtgcggagggagcacgcggcgcggcgctagggtgggggaaggacgcggtgcacgtgcgcggttcgcggtggacgcggatgcagcgggcccacgcgcagcctcacggctcgcggtggaacgcgcgcacggggaggggctaactggggtcggctcgacccggtcttggctgagctggtgccgacgtggcgcctacgtggctgccacgcgggccggcgggaggtagacgacgacgccggccggaacggacggtggacgacggcggcgagcggcggagcgaaccacggcgatacaggcaaaagcgagcacaccgggtggttgcacgtgacgaggggagacgagccaacggctcggattcgccggaggaagcttgacggcggcaaatcgcggcggcggcaaccggcagcgggagaaggggaaaacggcgacgaggtcacgaggggccaattcccggcggcgagagcatctacgcggctacgggaatccgatgctagcgtcggactgggcggaactacgccgagcgaggccggcgacgagcgggtgctacggagctcgagcggcgacggcggcgagcacacggcgagcgacggcaacggtgggggtgacgccggctagctacggggaggctactcgtgctactaccgaaaactaagggggagagatggagcgaggaggaagaacggagggaggcactaccgagatgaggaggggcgctgggacgagaggccgacggcgcgggagtaatctctccagcctcgggccgaggaagaggaagaagagggcgcgcccggagtccccttccgcgtcctagtgtgcaccgaatcctccggcacacatgcgacgacgaacggcgacggcgaacaggggcgacagtggcggcaagagacgaaaacgagggagattggagggggaggggcttgggtttaaatgggcggcaatgtcaggttgggagaggggaaccggcattggacagtcaagccggcgagctggcgctccggctagcggccaaaacggcgacaggaggtgacgccggcgagagggaaaaagggaaaaagagggagagaaaaggggagctcgccccttgcctctttgggaaaaaggaggaggggagcgggagcgtcgcggcagagggaggagggctctgcctccgtcccttggcggcttgcgcgcggggaggcggggccgacggcggcgatgacggcggggcggtttggagcggcgcgacgacacgagcgacaggcgctgacgacggcgacgaccaggcggtcggccaccacggcacgcgcgcgcgggaaacaacgggcggcgcggcggatttgagcggcgtggcttgggcacgcacgctggcatgcggggccgggcggctgcgcggctgcaggcgcggcagggcagcggggccgggcggcgcggacggcgcagacggcgcggctctcgcgcacgcgcgcgtggcgcgcgggcggagctgagggggaggcgctgggcgcagctctcgcgcacgcgcgcgcggcgcgcgggcggagcggagggggagggggagagagagagagagagcgccggggagggagggggaga

SEQ ID NO: 16974 - DNA, 7389 bp, Oryza sativa
cgaccccgggggaggcaaattagacttttgcggaggaatttgatttggagggatttggatttggaattgaactcgacgatagatcggggattgagatcttgagatggcacggacactagacaacaagcgaagaaacaaatttcgcaattagggtttttaagagataattttcccgctaggcgccacgacggaacgggcgctacagaccaacccccctaacaagaatctcgaccccgagattcagcacctaagggagcagctccgggaactcggcgcggagaagatcttctcgctcccaggttgttttcactggcacgaaatgagccaatttcgtgagtcgatccacgattacccaaatggagtcgtacccgctaggggttcttggcaaaccggtgatgaaatccattccgatttcttcccatttccactcgggaattggtaggggctgtagcagaccagctggcctctggtgctctgccttgactctttggcaaatgtcacacaaggctacgtattctgcgacatctcgcttcattccagcccaccagaagtatgccttgatatcttggtacatcttcgtacttcctggatgaatggagtaggcggactcatgagcttcctttaggatgagatctcttaattccttcttggccggtacacagatacgtggaccgcaccaaactgtgccttgatcgtctatggagaaattggtgtctttcttctcctgtattctttttattaactcttttatcccttcgtcgtctttctgagcttcccggatttgcgactctagggtaggctgtactgtcaagctggcagggacacctgactgtaccacggtcagcctcaacttctccaattctctgcacaggcgatcttggtcaggccgtatttgagctacattgcaataggccttgcgacttagcgcatcagcgaccacgttggctttaccggggtggtaatgaattccaagatcgtaatccttgattagttccaaccatcttctctgcctcatatttaactccgtctgtgtgaagatgtacttaagacttttgtgatcggtgtatacttcacatctgttcccgattaaatagtgcctccagatcttaagagcatgaaccacggctgccaattcgagatcatgggtgggataattgacttcatgaggcctgagctgcctggatgcataggccacaacctttcgttcttgcattaggacacatcctaagccttgtcttgatgcatcacagaagatctcgaaatcttttcggatatctggcaaggtgagaactggggcagtggtcaaccttttcttcatttcttgaaagctgtcttcacaggctgcagaccattgaaatttcttttccttctttaacagctcggtcataggtctggctagcttagagaattcttcaatgaatcttcgataatatccaactaagccaaggaagctgcgaatctctgacacattcttgggcgggttccaagcaagtacagcttcaaccttgctgggatctacctcgacaccgttggaggagatcacgtgtccaaggaatgctactcggtctaaccagaattcgcatttcgagaatttagcgaatagttgatgatccctgagcttttccattattagcctcaggtgttcagcatgttcttcctcattcttggagtatatcaggatgtcatcgatgaacaccacgacaaactggtccaggtattccataaagattttgttcattaagttcatgaagaacgctggagcattggtgagtccgaaggacatttctgtgaactcatatagaccataacgcgttgagaaagcggtcttcgggatatcttcagatctgattttcaattggtggtaacctgatctcaagtcaatttttgagaaaactcttgctcctttaagttgatcgaacaaatcgtcaatccgtggcaacgggtacttgttctttatagttacttcatttagggctctatagtcgattaccattctctcagagccatcctttttcttaaccagaagcactggggctccccaaggggatgagctaggtcgcacataacctttactctccaattcttcgatttgtcttttaacttctactaactcattagctgccattcggtagggtctttttgcaattggtgcggtgcctggtgccagttctatggcgaactcaatctcccggtctggtggcatactcgttaattcttctggaaatacgtcgggatattcacagactatgggcaccgactccaaggaggtgacttgtaaacaggttaagatagaccgacttgcggtaggagtgttaggggtaaagcggacttgctttcctccaggtccttgcaaggtgatggacttttcggcacaatctatctgtcctttgtgctttgccaaccaatccatccctaggatgatgtccaagctttgcgagtctaggactatcggtttggctaggaagtcaacttcctcaattctaaggttaacttccaggcatatttgagttgcccttatatccctcccaggggaatgtactatcattggtacacgtaaattttgggttttccaaccatttcttttcacaaaagcttgtgatatgaaagagtgggaagctcctgaatcaaacagaactattgcgggtatggagttgacagagaacatacccatcacaacgtctggagcatcctgagcggtctcggcttgaatgtgattcacccggcctcgaccaaggttgttggacacacgagaaccttgtccacttgcctgagagctaggacgagactgagctgccgctggagtaggagttctggcagtgctgccattagcatgccctgagctggtgttggtaggattctgagggcactgtctggcatagtggcccatctggttgcaccggaaacactgaactgctgacggtccctgtggtgacttgaaagaggtaacactgttgggcgcagtattgccactaggggcacgctgctgtggctgaggtgccggacagttcatctgaggacgaggggcgtagcctggctggcggttagcctgagtgaccgactggtggtattgcatgggttgaccgtagtgagggcgaggtgcgcctcgggaagaatttccctgatggttagagttgcgtttcttgtattcttcggtagcctcttttctggcatcttcaagtagaagcgccttgttgatcatatgctgaaaagtggggaagtcatgagcaagcaactggagtctcattccaactgcgattcctttcacgaatttcctgatcttcttcttatctgtgtccacttcctcaggggcgtatcgagccaagttgttgaacatacttaggtactcattgacactgctgttgccttgcttaagtctgttgaattccactttcttcatgtcaatggtgctttcaggcacatgagctgcacggaaagacgtagcaaactcatcccaagcaatgttagtgggttcagggtgtgcattgcagtaattttcccaccaatctgcagcaggtcctcttagctggtgagaggcatagagcgtcttctcaaccggagtacactgcaccaagttgagttttctatccacatctttcagccaatcgtcagcctcgacgggctcgacggtctgagagaactctggcggacgagacctcagaaagtctgtcagcttggatctattgttgctcatgtgacggtggccatttccatgcgcagtatgctgaaaaccggctacggctgcggctaatccttgcaagatttgtgtctaaactgccattaagtgctgcatgttgttttccacatgaggtggggaagggaggcgttcttctccagaattgtgactggcagtgcggtgagagcggtgagactgttccatctctacatcacaggaagccgtgcgatgcgagcggttgctgcggcggggttgctcaacttctgcattgcgggaagcagtacggtgcgaacggttgctgtggtgagactgctcatgatttgcttctggctcggctctaccatcttcaaaaccaaagcgggctggtgcacgagctgcacggcgggggcggctagccatctaaactcccagaagagggcggggtaagaatcaaataagcacttaggagggcaaggagcaacgtaaatagcaactcagatagcacacactaggcataaactggatttttcaaatcataaaaacacctgatacaacgggtgtggacaagtcacagagctacgccgagcttgactgtgcgcacaccacctaggagaaccagactaccgaacaacacccacaacaaacacacgcacgcactaccttgccacgactccgaaagagttggcggcggaacaaaagggcctaacacacgggcggctgctgtagactgcctcctctactcctcgtcggcctggctgcctcctgtagtcggctcctcagtcgaagaaatgtcgatcggctgacgcgaagggaccggcggaacctgtcgagggccgacagcagcacgggccgctggcggtgggggagctgggtagtggaaacggaacacggtggaagaaccaacaacacgcttccgcgcggtgcggataaagcgtgggccacggcgggaggaagcaactggggtgtgtccgggggtgtaggaggggctaactgggtgtgggtagggggagtacactggtgagtacggcgcacgcgagctgggggagcgcgggccactgggagtgcgggcagagccgcgggagctgtgggaggacaggtggctgccgtgacagaggcggcggcgtagcggcgggcaagggagcggtaagcctcaaggagtaggtcgtgctgagtggcctgagcctccgaaagctcaaccatgcgagtcagcactggctgagactcgctgtacggacaagggtacctggcgtctgagtggccagaaggaaggcgtggtagctgccggaaggcgaagcccccgagatggtggctgtagtcgtgggccaggtgacgaagcgcagtccaggagaggtcctggtacgcgatctggagagtgggcctggccacggtgaagtggtgtgggcgaaggccagctccgtgtatacctccacgagggtaaaggtacacagagagctcacagtgagggggaacacggtccacggagtaccccgtgtactcgggacacgagaagccaaggaaacgagcgaggtcacgaagctgagcgacgtggtgaccctcaccaaaaccgtgggagctgaagctggcgttcactgccatctacaattttgaaggagggagaaaagatcagtaaccattttagaaacaaactattgaaaataaggaaaccaaagaagccttagcttttcgcaagtagttttgaacttagtatccttagggtcgtcctaaacgtcgggtttcgccctagggccaagcctgtgctctgataccatttgtaacgtcccgcctcccccaggccgggcccacttacatctgatagctttcataggtcatagactgccctcacagaccaacacatgtcttttctgcacactttgtcctcactcgtgtgcacccgggaagaatttcccaatcggtcacccatcccaaattgctccaggccaagcacgcttaaccctggagttctttggagattggcttccgaaaaagaagttgcaacttgttgatatgagtattctattaatcctattaagccctaggccgggatgttacaccctcacccccttaagagagatcgacgcccccgtcgatcaacctaggccaggaacgtcatctcttggccacgtccatgtgtccagtgccagcgcatgtgccatgctgtgtaaccactcccggtctacatcagccatgcgcaccatgcctgcgcaactacgacacacgcgcccgtgaaaccgcgagagtcggctctgataccatctcttgtcacgccccgaactagtcccgactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaagggaaacggaagccaggactcgggccaaacaacacaggcgcgacttgggaactaggccgaaaccctaaaactcattgtagccggcttgctcctggaagaactcctcatcagcaggatccgcttcatcttcttcagcatctgggggggattatttatatagagcaagggtgagtacgagagtactcagcaagccaggggaaataagtgtttaatgcaggcttcaaggagaggcgggtgtttttgcaattgattttatttgaactcttttctgaaacaactaagtgagtgcttcttaaacgacacggatgagacagtgcgtctcgtccggtcggagtatgtgcaatgtattagtctttagattttgaaacaaggttggcacccggccaacagcttttcaaacggccacccgggccaacaacttccaaacggccacccgggcgtagctgatcccatcagctgcagattttccaaacatcgaacccctttccacaacagcaatttcacaagcagtagtcaaataaaactacgctaggaatcacctcacatccgcccatgaccgtgggcacggcttatcgaacagtttgttaacctctgcagagggggtacactttacccacacgacattactaacccggatcacccagcccgtggggatcagccacgttgggagacctccaagctttcattacaaggcatttctaaagccgacacaggtttaccatatgccgacgagaggggtcccagaccaacaacaggttaggtcccagaccatactgtgccaggaagcccaggggtcctccccaacaccaccccggcgaatccacatgtctctcggcatcaaggctcccctgataagctagttactcagccaggggtgtcccattccacccatgtggtcgtacttgtcttatgtttggatgaaattccaaggaaacggtctttaagtgcaagagcggaaaaccgtacacccggtacgttccccggtccgcggttttggaaattcatttaattcgcaagcaccgacccaggtgtcgggttttccaagtcttttgtaaaatccaagttttacccaagttgcttttcagattttaagtttgaaggcgtccgccgatactcgcactaggtgcgcgaatatcgagacgcaactagatggttgcaaggggacatggtatcacaattaacaaaggaaggatcaaaaaccaccaaattaggtaggtctaccaatctgccttgcagacgggacaacagattaagtgtgatcctatcaagggctgcagga

SEQ ID NO: 16975 - DNA, 5907 bp, Oryza sativa
  unsure (1)..(5907): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgaatcaacaacttcaggatagatttcggttgcatttatcacagcatgcctagctatgatgaatttctggttatgaaagacatggttaatgaattatatttgtcccaagataatgaccaatgtagttatatacgcggaggcatgaaatacacttctcagaaattctatgccctcaatttcagaacagtacgcggaggcatgaaatacacttctcataaattctatgccctcaatttcagaacagtcaaccaccacaacaccttatatggataaggaagagtaagtgtaacttaaaattgaaggtttttttatgactccttttgatggatagactgaaccccagcccatgtcatgttggatcataagaactttgctccaccagattgtgatttggcatgtgttttctgtagtcatcaagctctagagacactaatttttggttgttcttccaataccctttttcagttgcttgctggaatattgtggaaataataacttaggacacatccttaagtatggagaaattattgttggttgcgtggaacatttggaagctaaggccctgtttggttctatgggctaattattagccctcaccttttagccctgaattagccctcaaggatccaaacaggagggctaatttgaggttaaagtgaattagccctcctcaaaacattaacccctctatggggtgctaatggggataattttgtgtagggaccatcaaaaagcagctctttctcttcctctctcctctctttctactctctctccaccttttagccttgaattagccaatggatccaaacataccaccctagactaatatttagcctaacaatttatgactaaacattaattagtctcaaaattagccctgggctaatctttcaaacagtgcctaagtaatggttcgatcttcaatcataattcacctacgttgctttcttggacacaccttttcaagtgagacctcttgctgcttcttttcagacttaatgagagagattagaatgtagtacagagactgaattatactggcggtaattgttttttgtttttttcttattaacaagagttcttaacagcaagggagcccttgctgttttctgatcggctgttgatcaagaaatttcaactttgaactccaaatgtcaatgccaactacttttagagccagtgaatatactagatataaaactgtgcgataatctaattcggctcattgcaagtatgactaacacatactagaagaagcatttcaaattattcaggccggtatataaaaaccatccatctcttcccccatgagcccatcgggcaaacacttttcctgctaggccatagctcacatattcttccagtgtgattgtctatatctaccttgactttgacgagacgacaacgaacaccaatttgcagtaccatcctcttatcatttctctcttcaccatattacacaacactctggtctctgagtgtgtgtgagaatatcaattctagcacgcatcgtcagacagtactgtaccctcttcagaatcactagaacaactatatagcaatttgatacttgaatgtggtcatgctatgaagcctgtattcccattgcctcctaagcctactgcacttcatgcatgcacccagggaacaacttgggcaggaggactgcacaaaaattctaataggcttagagcaagaccaattagatgtgtagatgactgtgtgagcaatggcacatgccttatatgtagggcaaagcagaggaagaaaataaatggtttcaatagatgcaattgacacctctgtctattccatacacctagcgccgttttccactccgttccctagtgccaggatttattgccgccgtcactgcctgctaaactgtggcatcatgtagtgacaaattaatccactgccctacaatgggtgaattccttgttcctgttgcatcctaaacctactaggatttgcactagctagttaaccaactaaggcagaggtagatgaaatggaacaatagagaattaagagcaggatcgagagataagataagataagatgactgtacctaagcaatgtgagcagatgagcaaggtcatgatgattttatcattgccgaaacaaaaggaaggaaataaatagtttctatcattgccattaacaatgtcttttttgggggattacatgatttacgcttcggtatacaaatattagagcatacatagtgcatggatgcacagtagaggtaattatgtgaatctcatgaaaatcatgttgaaaattaaatctaccccgtgcaagaacacatggaacactccatgtgctacccatcaatataatggttgtgaggcgcagaagtaggagctccgggaggccgtcgaacactccatgccgctgccgctgactgacagggtagaggccatggcggcaaggctataggcttgtctgtgcaccgcgtcgccggatctggctccccttcgctagatacggcaaacccccctaatggatcaggcttcttaggcgagggacgccgactcccctgcaatggctccctgtgacagggaggcggtggcatgcggtgaaggggcaggcggtggaggtgccccacggcgatggtgtcacacgcgtgtggatgagagttgacgagttggctagtgaggcccgtcttgatggtagcgagtggtgccggaggcagcgagaagaaggatgcgtggaggtggccgatgatgccatgggtgggctgaggctgactgacgaggggcatccggcggggaacgaagggaggctagcacgacgcaggtggcgtcagtggttcaggaaggctgatgctggttgctccaggaggttggttcgggcgatggcagggaggccgccccggtcgatggcgcggagggccgacgaaagagaggtcggtgaggctatctggtggagggcgtcagtacagtggtgaccatgtaccgatagaggatggtaggtggtggagctttggagctttttcttcaggtcttcatggaccgagcgacatagtaaagcccagcttggtcttgccaggtcgacaacaatggtgttttaggcattgttttccatctttggggcattgtcgagccacccctcttcctcaggtgggctaccaggagaaaacctattgtcttggttctccttgagatctcgacggatggcgatgtcggtgttcatcatcgtttttctcactggagatgtcgtcaaggaagcctcactgcgaaaacctctctcgggggctaggccaaaccctttgcccccgcgtcactcccagggtaggggcgacacgggaggcgacccagccgccaccaccgcaccacccccaccgccctccttccacctcgccgctgcccgagcgggccgccggaaaccacgcggccgcaaggacggcggcggtggggccttctccccccccaaggtcacagtgttcggagcccacgaccccgacctagctctggggcagcgacttcggcggctgcgacgtcgagctcgacggttgcgcatggcgtcggcgaggtggcggtgccgacgacggttgaagaggtgggcggccgggccgacgacgacgaggcggcggtgttggctcctatgctctcctgcgtggatctagtgcggggggatggatcctgagttgccggcggcggtgatgagcgtggaggcggcggggtggccggatccggccccctcttgtctggatccggcacgggaggccgagctccgaccccaggcagcgaggcgaagggggcgcgcagcgctgggcggcagtggctgaaggcggcggggacggagctggccgagggcgctgaggcggcggcggttgtcccgtggctgtgacggcgcggtgcctggcggcggcgttggcggtgctccacagatccgcgcctctcgaccggatcttgagggtggcggcagttggtgacagcggtggtggtgtggcgacggtggtggcggcagttggccggcagcagttggcaccggcggtctcggccggatctggacgccggcagcagttggcgatgacagccgtggtgtggtgatggcggcagcggcgacagttggcaacggcggcggcggtcctggctgtggtggctgccgtgtcaactggcggcggtggcgaaagacatggcgtcgggcagctagctgctcggtggtgaaggacgacggcgcagcggcagtttgcggaggcagcggcgacggcggcagcggcgacggcggctgcgactctgaggtggtggctacgtcggcggcagggaaggagtcgggtgcgaggtgaggatgacgacggcgaggtggttgggtgttaggcagcggcggctgtggtggtggtgaccatgtttgcggtcaccggaggcatggcggcctcggttgactagccgaggacgtgggagacagctgcatctggccggcgcggcatcgttcggtggaggggtcggagaccagcttggcgcagagaagcgcagccgatggcagcagaggccggctcggcgcgagaggcgcgggcggtagagatggaggccggcttggcacgagaggcgcggccgatggagggaggccggattggcgcgagaggcgcgtccggtgaaggaggccggcttggtgcagagaggcgcggccggcggtggaggaggcgatctaggtgtgaggaggtgctgtcggtgagtgtggcgcggtcttcggcgcactaaggctgttcggcgggggacgtcggtgcaggggtctcacatgtcggcaaagcttgtgtggtggtggagcatcggtgcatcagccgtggtttcgggatctcatctgtgcccctttgttggcctattagcggtcggtcacgcttagcggcggccgagccggtgctagccttctcctgggcgtgtgtgttggcgatgtcggcatgtgggtggtggtatattttttcctttttctagttacgactctctaaggttgtaatcttataatttttttcccgctctatcaatagaacttcgcaccgtctagtgcgagtcgttcaaaaaaaacctctctcagaaacctagtgtgtgctctctgctggcatatgtcctcttgtgatggcgacatagtcaaatgcaagctggccatgttggtgagccttgtaggggagagtggttccatcttctctctcatcttctcccctaaaacctcaagggcgtggatagagttgagcacagtgcccattgttagggtttggctttggtgcccgggtgttgtttctttgttggcctagcagcgactggtcatgcttagcggtggctggtccgatgctagccttcccctagatcctgtataggtgatgtcgatgcgtagtgtgtggtggtggtggttcttttcctttccttgctaccgccttccagggtgctagccttgtaattttttcctgttctattcaatgaatcatcgcaccgtctggtgttgttagttctaaaaaacattatttctgatgacttgtagctagagtagctgtaagggaatgaatgagacatatttgaagcgcttctgaattaacaaaattctgaaatgcctctacagggaggtcattggtttcaggttttgtccccaatttcagagttttgtctacctctttagcttcttggaaaaatggttgcagcacgttctgcctggagtttgtcgcag

SEQ ID NO: 16976 - DNA, 739 bp, Oryza sativa
cactcgaaggagtactcctaactttggtttgctctagcatgtatccaagaatgctaatatctatatatagtcggcagtagttgaagaaaagaagcgaaatatatacatgcatggttgttgcatagtaaagttttgatatggaaatagtcagcaaatcatgggcatttccaaaattttgataaagttgtgtttggttttgtcgccgaatttaaactgaatttcttgtagggttgctaggcctattgttttgtttgaagcaaaccacagtatcaagcattgtgcagtaccaaagttttagcattagatggggacacgttaattaactttataaagataatacgtacatatccacgtatattgccctcaaacatgtacaaacatgagagaaaatttctattgtgttctttcttttttttttccatttgcttccgccaccatttgaatagtttctttacaataactaattttctcatgatggttgttgcagtctgtatgcagtgaagtttatggaattatggaggctaagagttagaggtttgaatgggttatcaaatggggacgagtcgggaagttcatctgaggggtattcctagcttggggacagcccgggcgtcatccttgtcagagtgtgtctatatgggcctgtgtgtatatggagctggagctcagccaaacagtttcagctccaccaaaactgggagtggagctgggtggagctctctcacaaagggctgcagga

SEQ ID NO: 16977 - DNA, 800 bp, Oryza sativa
aggacatgctttgcaaaagaaccggtttatgttgtgtactttcttctcactattaatttgtcgatgctctgggcacaaattattctatctctatcgcttgtgttagtcatgcatggttacgcttgcattgcgcggatttattttagagaaacaaatatgaggtcatactccactggatgcatggacattgacttttgcaccacattctctggtaattcaacactcacactgccacatcgatcgcctcctaatggtccattattcgcatgaggataatgcttacttcatcctatcaatggcctatcatatttgcaccataatcatattatgtcgatggagaagataaacttatcgctacattcttgatgcctcctaagcctagctacagtgttgagaacatctaagaaaaatattttgtagtttcagctgccggcagagagtggtgctcagcttgtggacttgtggctgatggcaaggttgaatttcagtgcgagctacagggaaagcttttgattcactcatgatggtttgttggctgatttcgaaggagcgtaaagcccgtatctttgagcagtgatcgcgcacagcaggttagctatttgagacatcagagaggttatcatagtatggaaggaggctagaacttttaggcaatgtgattagctgttagtctttttttttctttggggctgcagccaattgaattgttgcctgactcgacggcctaatgtcgaactcgtaaaccttgtaaccctctcttcttcttaataaaatttggttggccgaccaggggctgcagg

SEQ ID NO: 16978 - DNA, 724 bp, Oryza sativa
tcggtgcacactaggacgcggaaggggactccgggcgcgccctcttcttcctcttcctcggcccgaggctggagagattactcccgcgccgtcggcctctcgtcccagcgcccctcctcatctcggtagtgcctccctccgttcttcctcctcgctccatctctcccccttagttttcggtagtagcacgagtagcctccccgtagctagccggcgccgccccgaccgttgtcgtcactcgccgtgtgctcgccgccgtcgccgctcgagctccgtagcacccgctcgtccccggcctcgctcggcgtagttccgcccaatccgacgctagcatcggattcccgtagccgcgtagatgctctcgccgccgggaattggcccctcgtgacctcgtcgccgttttccccttctcccgccgccggttgccgccgccgcgattcgccgccgtcaagcttcctccggcgaatccgagccgttggctcgtctcccctcgtcacgtgcaaccacccggtgtgctcgcttttgcctgtatcgccgtggttcgctccgccgctcgccgccgtcgtccaccgtccgttccggccggcgtcgtcgtctacctcccgccggcccgcgtggcagctacgtaggcgccacgtcggcgccagctcagccaagaccgggtcgagccgaccccggtcagcccctccccgtgcgcgcgttccaccgcgagccgtgaggctgc

SEQ ID NO: 16979 - DNA, 483 bp, Oryza sativa
tactgtgctagtgtgttatccaaattgacgattagaagttaggaaacggtcaagatgttaatttctgcagagtcgtataggtcgtgcgtagagctagcattagttaagagccaaaatagcagtactccgtgccgtatcacggtatgaaacacgagcttagctatcaaaatttggcgttcgggtgtgcggtgctcgctaatctaatcgcctttgcagcacgggccaagattgtgcgatcccgtttttagttcatcggttgtgcccaattaatcagcggtgccgcggcaccagtcaagattggacgtacaacggctttgccgaacaacctcttcccccgtcgtcggtcgtacacggtgagagagagagagagcgcagcgaaagcaaagtctagcgggccaagtgtttggtgattcggctgacattggaaggcactatagctcaacgcaatataaacatgccaggtcccggggggggggggggggg

SEQ ID NO: 16980 - DNA, 1204 bp, Oryza sativa
tgataattttggaatttcttgatcaatagaccatcataaattttcttacccaccatgtgcttattaattcatccctatctataaggcccgtgcaagtcgatccgttgatccctatttataaactcttttgctagtctcttttctcctttcaaaatttgcaacaccatttggacttttgagcatatatatgtgccttgtgtttctacgacagctagtgcaatgggcataggaggtgccaggattgcaacagcgagttcaaggctccgccgatggagcagatccatgcatgtgtacactgcaaaattgatgggtagacttcatcatgaaatcccaatgcaaatactgtgtgctgatgggatcaaccgaagcccatgaactgcacgcacgcgacgtcgacacattgcagtgcacgcctctctttccatggagacaaatgctgcagcaagaagaacacacaattccagtttttgccgctcgacttgttgcggttgtcttcttggggtttgttcatctattttggtgttaataagctcctcaatgaccggccggtaactaaattaaaccagccgaccctaactacctatgtaatctttaatttcatcatccattaccgaagattttcctatagataattgtgatgggctactcgccgagatgttctgttggatttatttgtgtttggcacatttattttcaattaaatctataatattcaaggcacacgttaaatgctgatgaattaccggacatgatgtgtaaaaggtttctgttcaagaattgataattcaattgacacggaggattgatggctcaattagagaacactataaatgctgactattagtgttgattgatggtgttaatttggcaaattaacaacgtccattaccagtaactgatgttgtccaatgggagtaatcggtttcaacatcatctcctttacctctgtacgcatataatcagagaaggagctagctcctggatgtatggaacaaaaacacatcactccaccctctgttgctgctgcactactgaattctcatcgctagtttctgcacgtacagaaccagcgagagcaggcctccgaaaccatgccccgctgcgacgtttgcacggacgggcgagcgatcaggattttagggagcgcaaggcgtgactgctcactgttcgtttgcttcatcttcttcttggtaccgtcagtgag

SEQ ID NO: 16981 - DNA, 292 bp, Oryza sativa
gtatcgattttggctatttttaaattgagtaaaagtcatcaccggtccctaaacttgtactgctgtgtcatcccagtccctaaactcgcaaatcgaccgttcaggtcctcaaacttgttctactgtgtcatcccggtccctaaacttgcagatcactcgtttaggttctccaacttgttcagttgtgtcaccccggtctctaaacttggatttgaatatcatctgggtcaaatacgacggtctaaagactttatataaaaaaataattcataacttgttcatatgaactcta

SEQ ID NO: 16982 - DNA, 628 bp, Oryza sativa
tcctgcagccccgcgcgcgaggaggaggccgatgggccgcgggggagaggagagagagggagggaggtgggccgagccggcccaaaaggggatgggggaaaaagacttttagggtttttctttttataaaaccactttaactttgtttatttcttcttatttattatttgtgctctgaaaattccactaaatttatttacgcattttaggcttttaggaaatatacaaaaatcctccaagccttatttgacttttaaatttgcacattttaattgttggaggctttcacatggattttacttattctttgcataatttcgaggatgtattttagagtcgttttgggacgtgacagttattgtaggaggactcggcataggggagactcttatcccaggtcttcccgaaatgtaggacacatgcgcgaagcatatcttctaggatctgatttagacgctcggtctgtccatctgtctgcgggtgatacgcggtgctgaaatttaatgggatacccagctcatcttggagcttcttccaaaagtgagaggtgaattggcttcccctatcagatgcaattttcttaggaacgccatggagactcacgatcctagcgaagtagagctcggct

SEQ ID NO: 16983 - DNA, 1161 bp, Oryza sativa
tcctgcagccctccgtaggaaggttggcgtggatgtgtgtgttattttgggtttatttgttgtaaggcctttgtgggggatctttctctccacctttttttttactctcttaatggaatgatatgtagatctcctgtgtattcgagaaaaaaaagttctcttagataggctgcagtactgtctaataggtttaggaggtatcaggttcttgcaatttctcactcagcacagtagaatcactccacgagaagacattgtctagatgatgaaagttcaaggggtatctgcctgtttcctaagttgcactaccacggcggttggagctctgacgtggccagaaagttaccagagctcctattcttggtactcggtaaattacagtgtttttcaatttttgtacgaccagagtcactacttccagatatgattttgatatattatgttcagagtcatctcctagtcatcagacacaaagtgagaaaaataaaggatcaatcatttaagtttcaacaaaattattcatcaacgacaacaaaatgttcacatgtgacgtaaatatcatttaattttctgcctggaagatgtcacttaaagcagtgctaagtctttaggctctgatcgtttgcctgggttggaaacctatccctccgacacgaaaaacgaagcagtccattagtacgttattaattagttatttgctattttttttttcaaaaatggatcaatatgatttttaagtaactttcatatataaactttttgcaaaagaacgcaccgtttagcagtttaaaaagcgtgggcgcggaaaacatggtaggggagttgggacataagaacagagccttaattaggctatgttcatttgtgcatgttgggaaacttcctcgcacataaaacgaagctatggattaatgcataattaattaatacttagtaaaaaacttaaaaattagattaatatgacttaaaataactatattgttttaaatatgcaccaaaagttttttatttttaggaaacttgcatgcggaaaatgagatggtagaagatatagaaagcttactactgaacaaaaccttgggcttagatgatcatttttaggtttaccatgaataatagttttttatcactatgtgagtacgtgatgcaaatgcaatctca

SEQ ID NO: 16984 - DNA, 915 bp, Oryza sativa
tatttatctacaaatgagccatgcattgaggtatagctgattagctatatagtcagtggcggaggacggaaaaaattttaggtgtggcctacgaattaccatggaagttagcacagaacgaaaaatctcaatgcacgttattatatgatgcaatattatcttaacaagtctacattaagcatggtaaacaagaactaattacaagttgatgattcatcatctatttgcaaacaagtatagatagaagagtaggtactcaaaaaaatacctcaacttcctaagattcacgctttcaacaatacatcacaaataggaagtacagtactgagtatcgacagatatattaccaaagattgattaatgttcacatatgttgaacctgttgatggagtgatggatgcatggctagttggcttgccgcttgcttgctgtcgccgcttggtgctgcacgcttgcactgctgttgtgccattcgtcccaccctgcctttgtctctgctcttcctgcgctgcgcgcctgcccatttgggccctggcggctggtcgcgccgccgccttgccggagcggatgccgcagccgcagctctggaagcctggtggccacgccctcctcacctcaccctgccttcccgcgcgcggcgcgcaccgcagcagccgccgtccgccgatggggattggcggaggttggaggagatggtcagatgactcagatgggggaaatttgggtctcgtttacactaaacaagcctaatgggcttactagctatcagcgtgaggaccagcactggcatgcgcggacgcgtccacgccgcgtctcggccgtcgctcgtctttctcacgatgcggcgtcggcactctctctgacccggctattgcagtgcgcggaggagtacgcgcggggggggggggggggggg

SEQ ID NO: 16985 - DNA, 4758 bp, Oryza sativa
caaaagaaaaaaatagttgaaattaaggtggtttgatctcagccgtagagaacagtacatgacagagatttgggtaaatctacccgctgaagttggagttaactctagcggatctggacccctccaggcatatggtcaatgggaaaaaaatgactcttccaacaatatatggacaaaaatccaactgacgttcaaccgaacttttcttagacaacattaggcacaagtcccggaggctcggtcagggttttttttttggataatctgatgtaattttacatttcaatcatcgttcatgaggtaaagtgagctacaactgagtttaaaatttggatcaactagaagtgaagttccaggcaaataagaatcatcattcatttattttctctactacacagcacacctaccaaaaagatatattgattaattaggtttggaattcacttcagtgttcatttctgccattacttttctgcatagctatatattgttgtcacacatattggatgacactaccaactgtctaatttgacatgctctagccatatgtacaaaatgagttgagttggtattaccaggcctagatattttaagtacttttatgtctgtactatatatgtcaagcatttgcataaacaatttagtagtcttaggagacgtcaggaatataaggtgaacttgtatgtacaaactcataggttggttgaatgttttgatcttctgcatatagatgcacagccacaccttaggttgagattcccgactcactcgagcctataggcagattcatatcgagaatgcaggatcagcacgagtgactcatactgatgatgacccaaggctctcttttgtcaagatgcgttgacctgtttctattttcagtcatctaatttgattactagctgtgaatatcggcatattgtgggagatgtagggcttatttggaagaacttaaaattctgaaaacagttggtagctagcttttaagattttataactacagcttctcagaatctggatgaaaagctgacctatttgggggagcttcttctaagagaagctgcaactcctagaaactccctaaacaggtccataatattcatggcccaacatttttttttgttaaaatgtgttgatgtgatatttctatctagtgtcagtcattcaacaaatgagatatcttgcatatgaggtctgttttttattttcttttttttttaatttgaatgaggtctggtttgagagaatagttaagtggcatggtcattttgtgggatatataaactgctggcatgaacttagaaaggaggtgcagaagtgggattagaacctaggtgggcaggtgggattataacccaggtgggccgtatgccttgctaatcgatcaagtgcttattcacttggaataaccagaaaatgtatctgttttaatccacttcagttgactcactagtcaccacatagatcaatatggaagaaaatgctctggcattagtccaacctacaacaataacataactgacctgccacacatacacatcagcatacgtgtttgctcacaggatatatatatttctatttgaatttttatggttcagtgcatcgcattttctgatcttactatacacctactctaggacagtaaagaaattgatctcatatttagttaatccgaggcacgcatggttttaaatagcattatcgatcatgtcaggactccttcaggtgagatctgtctcttgccagtaggtatatatcatcaatctcagtggtgaattccccctatttcaacatatatatttgtgcaactttgatatgtagtttgctggccactggtgtttacggtttacattcattggtgcattttaatcttttcatttacatggatgtgtacatgggtctttgagaaggcttacgcttaggaggtatcaggattgcacaattcagagttgagtcatttgacctcctccacgtcgtgcctccatgcttccggggatcgcgcacagttgctgctgggttagcgaacaactcctaggttggtgacatacgtggcgccctcactgtcccggtcatctctcagttcctgttagtctaggacgcggtggttcctacccagctctcgccgggtgttgaggatcacctcgtctggcgttggacgggtgaccagtgctactcagcgcgatcggcgtatcaggcgttcttccttggccagcactcttttgcctgtgccgacttactctggcacgcgaagggccctgctaaatgcaagttcttcctttggtttgcatttcagcagcgctgctggactgccgatcttctccaaaagcgtggtattgatagccactctgcttgccccttttgcgctcaggagcttgagacagcgaaccacatcctcatcgattgcgtgttcgctcggcaggtctggctccgtgtgttgtcccctcctggctgggctgccctctctccccctcgtggcagctggctccaggattggtggtcatcctccagggtatgtttacctgagcaccttcgcagcggcttcgacttcttggtactcctagtctcttggcagctgtggaaggaacgaaactccagggttttcgactctgtgctcgcttcggtcacagtggttctagagtccttccgctcggagggccagctgtggtctttagccggtgttacttgttttggggatttcttgggagtgtagcgtggctctgccccctcccgctgtttggagttgcgtttttaaccgtcgtagtagttcctagcttcatgtccccccctttaggcataagccagtctaactgattgctttgtgtaacaaaaactcttttcctgctaatatattgacgtgcaatccttttgcgcgttcgcaaaagaaaaaaagagttgagtcattgaacatattggtccaagatggcctcctaactctggttagtacaaaacagcgtgagaaggtagacatttgagagggtttatttgatcttctggaccacagaaatgttcatggcccatatatatatatgatgtataaagtccacaatagtttggctttcttattaacatttttgcagaaggacataggccatgaaattgtgtatgcatgtgttactatgctagctcctgttaactccgcaatgatttttattttcattttaagattcgtgaatacaatgtccaggttaaaacacacccgactgatgaatgtacatagataagcatatgggcgtcagtcgtcagtcgtcagttagagttatctatgtgtaaaatcaaggagttgatttagattttgtgatgaaaatattggtggtttgctaatgttaatttgaagattttataagacggttgattttgtgaagtgtgcagtttcggttgaccctggcagttagaccggtcgtgtgtagccagtcagaccgcaggtgttgcggtggtcagaccggccggcccaacggtttgaccggcaggttcctgatcgtattcggtttcgggttgttttgttggatttggatgtttcttttggggatttggcttctagatggtttctatgcgtatggatactgttgttatactaatgtgagttaaggtgggacgaacttaggctcggaatatggtttcttggttgttgcatgtgcaggtgttgcttgaggccacgggagagtgttgccagtgatagatcggagtcaacttggaaaaagttgatgtccagggatcaagagatcatgcggaatactaaaggctagaggacaatgcacgtggtgatgaagaaatctatatggtatacaagagggattgtttacatatggaaagaggagtcgaatttggaagggagtccgaattcgggaagattgattgagatcaggaaagagataagttggatacttgcaagagagagttacctacgtggattaggagtcctaagttgtattagattcgtgggctttgcacagcctacctcatgtataaatagagagggagggtgaggcctcccggtatcggttttagagagactagagttgagagaaagttagggtttcgaatttagttcgaaattttggtgaggagtgttgttggtgcactttgtaaacactagttgatacaataaagtcgaaaagtttcaatctacatctttgagtttgtcatttaccggtatttctggatcccgacggtctaaccgcaggtatgcgcacggtctgaccagtgggatagtggcggtctgaccgtaggtgtctaggcggtctggccgcggtaggagggtggtttgaccggcagcgataggacttcgtcatcaacttcattcgagggtaatctttaattctgcaaaagatttttgggtttttggttttccctaccattcacctccctctggtaggtttgtttggtcttgtgcgatccttcactacgtacagtcgtcagtcgttagttagataagcatatgcatactttcgactgatataaagtcgacatgacttcgtctactccaattgctagtaatactcttaagacaacgagcatggatgaatcttccatccaacgctgttagagttgttccttaggggaatgcataaagtctactaggattaggaggcagtgggaattcagcattgagaggatgaatcctttcgagttttgaattgtcatatactctctggaaatcattgatcaggtggagcagtgattggcaagacgtgtctgaagtgtcatctatcacactcacacatgcatatgaaggaagctgtcgaggatgaagggaaaaga

SEQ ID NO: 16986 - DNA, 2647 bp, Oryza sativa
tcaaacccaaggctacaaccaattttaagaagaaaggcaagagaaaggcaaagggcaactgctttgtgtgtggtaagcctgggcattaggccaaggattgtcctgagcgcaaggacaaaaagtctgcaaacatggtcattatcgagggcggaggaacatcggggtatggtaaatttttacctacagttctctctgtttttcattcacctgattggtgggttgatcctagtgctaatattcatgtgcgtgctgacgtttccttgttttcttcttatcaggtcgggagatgttcctccttgttgatgggaaacagatcgcttgtggctgttcatggtgttggtatggtcgatctgaagtttacttcgggaaggaccgtgcagctgaagaacgtgcagcatgtcccttcaataaagaagaatctaattagcggctctctattgtgtaaagatggttttagacttgtttttaaatctaataagtgtgttgtttctaaatatggaacttctattggaaaatgttatgacagcggaggcttgttccgtttttctttggatgatatgtgtaataaagttgtgaaccatgcaacaaatgatgatgagtccaatttgtggcattcgtgactttgtcatgtgaattttgagtgtatgacacgcttagctaacatgagtttaatcccaaaattcaatttagtcaaaggatctaagtgccatacttatgttcaatcgaaacaatctcgcaagcctcacaaggcacctgaggcgagaaatttggcacctctacaacttgttcattccgatctgtgcgaaatgaacggcgtgttgactaaagggggaaagaaatatttcattacattgatagatgattgcactagattttgctatgtgtacttattgaaaacaaaggatgaagcattgcattactttaagatctataaggttgaggcagaaaaccaactggaaaggaaaatcaaacggttgaggtctgatagggatgaagagtatttttccaatgaatttagttctttctacgaagagtttggaattattcatgagaggacgccttcctgttcaccccagtcaaacggggtggccgaaagaaagaaccgcactctaactgagatggtgaatgccatgttagacactgcgggactttccaaggaatggtggggtgaggcaattttgactgcatgtcatgtcctgaataaaattccaatcaagtataaggaagtaacaccattggaggaatgtgaaaagaagaaattaaatctcacatacctacgcacatggggctgtttggccaaggtaaatgtacctatagccaaaaagcacaaacttggaccaaaaactgtagattgtgttttccttggttacgctatccacagtgtgggatataggttcttaatagtaaattccagagtacctgacatgtgtattggtacaattactgagtccatagatgctacatttttttagaatgaatttcctatgaaaaaagcacctagcacttctagtcaagaacctatttcatcccctgagcactttacaccgatagaacacattgatcaaatgtttgagggaaatcttgaggaggaaaacattgtagatactcgaaagagtaaaagacaaaggactgcaaagtcctttggtgataactacattgtatacctcgtggatgacactccaagaaccatagaagaggcatattcatctcctgacgctgactattggaaggaagtggtatgcagtgagatggactcgattatatctaatggtacttgggaagtcgtcgagcgtccatatgggtgcaagcctataggatgaaaatgggttttcaagaaaaaacttaggcctgatgatacaattgaaaagtacaaggcaagacttgtggccaagggttatacccagaaggaaggcgaggattttttcgacacttattcaccggttgctcgcttaaccacgatttgagtactactcgctctggcagcctctcacggtcttctcgtccatcagatggatgttaagacagctttcctcaatggagagttggaggagaagatctatatggatcaaccagatgggtatgtactagaaggtcaagagggaatggtgtgtaggctgctgaagtccttgtatggccttaaacaagcacctaagcagtggcatgagaagtttgacaaaacacttacatctgttggctttgttgtgaacgaaactgacaaatgtgtgtactatcgctatggtgggggagagggagtgatcttgtgtttatatgtcgatgacatattaatctttgggactagcctcaatgtgattgaggaggtcaaggactttctgtccaaaagctttgaaatgaaggatttgggagtggctgatgttattattaacattaagctattgagaggagatgatggtgggattacacttgtgcagtctcactatgtagacaaggtcttgagtcgctttgattatagtgactgcaagccagctcctactccttatgatcccagtgtgctattaaggaaaaaccgaagaatagcaagggatctattaatatactcccaaacattggttcattgatgtacttaactagtgcaacgagacttgacatctcatttgctatgagtaagttgagctgatttgtttcaaat

SEQ ID NO: 16987 - DNA, 4239 bp, Oryza sativa
tcctgcagccccaaattggatatctgatgctgatgagataaaggccacaagtggatatgtattcacacttggaggtggcgctgtttcatggaagtcttgcaagcataccatcttaatgaggtcaacaatgcaagtagaactcatagctttagatactgccactgttgaggccgagtggctttgtgagctcctaatggatttgccagtttttgaaaaaccactactagctatcttgataaactgtgataatcaaacggtgattattaaggtgaacaattcgaaggacaacatgaagtcatctaggcatgtaaagagaagactgaaatcctgtcagaaagttgaaaaacttcggagtgatagcattggattatgtctagacggctaaaaatctggcagatcagtttactaagggcctatcgcataatgtgatagacagtgcatcgaatgaaatgggcttgagacccacttgaagttacacaatagtggtaacaagctattgggtggctgagaggagaggcccgtgaattaggatggtgaaacaagctattgggtggctgggaggagaggcccttagattggctcatttatctgatgtacttatctccttgtctctatggcaagttggtgcataccttaatatgatccgagtgacttttcttaaagtagagatgttggcctatataacatcttagaaggaacacacctatatgagtctgactgctagtcacagtcttatagatttgggtgatctctagaaactcatgaagaggcctagagtatgacttatatgctccaaaccgagtggatgctttagtagcctagtactagtaaagggctttggtgaagcttgttcacacaaaactgtcaattcaaggcatagtccattggtcagttgtggataagtgtagcctctgttcaaggtggatcttcaacttaacactctcctctagaaaatacgggtatatcaaaacagcagtggagctgagagcatttctcgtgcgccgtgaaatattggtggggattgttggatttatttgtgtttggcacatttattttcaattaaatctataatattcaaggcacgcgttaaatgctgaagaattaccggacatgatgtgtgaaaggtttttgttcaagaattgataattcaattgacacggaggattgatgactcaattagagaacaatataaatcctgactattactgttgattgatggtgttaatttggcaaattaacaacgtccattaccaataactgatgttgttcaatgggagtaatggtgtttcggtttcaacatcatctcctttacctctgtacgcatataatcagagaaggagctagctcctggatgtatggaacaaaaacacatcactccaccctgttgttgctgcactagtgcattctcatcgctagtttctgcgtgcacagaactagcgagagcaggcctccgaaaccacgccccgctgcgacgtttgcacggaggggcgggcgatcaggattttagggaacgcaaggcgtgactgctcactgttcgtttgcttcatcttcttctttgtgccgtcagcgagagcaaggactgcatccacgatagcaaccaatgacgagaaaggtggcaccgatggagcggagaacatcaatgccaacggaggcaacaacaacaataatgcctcatcctcagaagcattctctgggtatattactctaactaccttagtgttaaacatgttactagattatgctattattattagtagcatattcatgtttagcgctatcactggatcatttcagttttcacatgtcatgtttattatctcgtttttctggattaaaatatgctgaattatgaccatatttccaacatgttcatgttgatatgcttgagagatattagtgatggacttgcattcgtatgttttgctcactgaagttcaaatattgatttctgcaattgtagacatgcatgtccttttctgtatgaattttgcttttgtgcttcctttgtttcgcctagtgattaaaattttggttcgaaattttggaccccaccagcaagcaactatatatctcgctcgaaatttttgaacttctccaaatattttgtgcatgtggtcaagatttattcaaattcaatcaaaatttgttaagatttaaaataattctgagcaaagaagtactggaaacaccaaaattcgtataatttcagtgacaccaaaatttcggcccaaactaaaagtgcaaactttggtttgacctatataagttaaacatgcctttgcaggtctgctcccactgtgcacagcacaatcatctcaatgttctttttttctctaggctatatatgatcatgtctgttgcagctgtcatataagccttttctccataggttcatacaagcttacatagtaggcttaggtgtgttatatatatactagtttgtacctctttccaacttctactctctcgtttttcacgtgcacactttttgaaatgttaaatattgtgtttatttcaaaaatattctataataacaaaaggttatatttttaagttttttagctaataattagttagccatgccaactgctctattttacgtgaagggaaaatttttgaaccgctactatatattgaacacatccttaaaagacattgagaactttagattcacattatatgttacagttactattgtaattgtaatgttttttcttcaattaatgccccaacagctctagctagggcgctaggtggcggatcgtctgatattgcgcccaacagcaactcactagaatgctttagcttttgagaaggaaacaaataggtggaacactactcccagtggatgatcccgaagtattggcattagataatgtaacagctttgttgtgatctctagactatattcaatatgtagagtgtgatgctaccatcgggtaccggacaactagaataatcacatcatgtgagtaaagctgtataaactctacagagtctaaaactaatcgattagccatgctcacggttatgagcggcttggtgaaatgatacaagtatagtgttggtgatttactaaatgatttgtgaaatgggtatggtgggtaataatgatgattttgcccggtgcgggctgagaaaaaaagttcacttactgccatagaaggcacaagaatgatactatgatgatatttatgctactattattatggtttactctttgatttaaatattttgttgtaatatattattatttactattgcgaaacaaaattttctttatgctaaaaatgagccacaaatatagtcatctttaatctcagcttgcaatagtcctaggtttcccatggcttgggtaggacttgccaatatcttgtgtattggcccatccctcgttgtttcttttagtcttatttgtaggaagcgggtgcttccgtttatcggagtttctagggatggttcttttctagggtgattcttagtaggttgcatttgtgatttgatagatacgtataccggagaacttatgtatattttccgctgcgtttgaaactctttttgtttggccaattggtggaaccattttgtaggactgttgccacctctaagttataagagccactttatgtacttatgtgccatgtgcattatatggatttgataacaatgttgtagatgtttatatggctagttggcgggactagtacagggtacgtttctaggtatttgggaattaaatccccaggtgccgatagttttaaagtggatctgataccatggttgaggtaccaaatatgatttattctctaaataatatgaatgaattaaataatcaaacagtactggatttggtggaggtgttgatgggtggtttgaagccaaaccgagctatatatatataacaatcaaggatacacaaatattcaagaaaatgcacacaaatccaacataaaagactcaacttaaatagaaaaatattgagtgttgcacaacatgtaaaatattgttgtgcttcctctgctttggcctatgtaaatccagcaccactttggacatctgctactagagagaggctagagttcatacttatctcattgttttttttaacaagcctatacatgagcatgtcttttgcataaccatgataaatctgtttattattaggtgcattaatacaatctttagtagtcttaggaggcatcggtaagtttgtattcaccgggaaaattcaaacatgta

SEQ ID NO: 16988 - DNA, 2522 bp, Oryza sativa
agtaaccatgttagtggcaaccaaagaaatcatttatttccttcttccctcggttttgacgtagctatatagagagaatccattatatgcccctgagtttactctagttcaatgatttcccatcgactttgtcttcctctataatataccaccgactttatcaattttttctataatatgccatcaggatggataattttcaaaaaatacctaaaatgcccttcaagccatacaaggattgccgattgattggctctttataagttttgaaaaaaatatgaaagttttagtgtagccttcttatacgatataaagttttttttatatattttaagatttttttcaaaatatttttatgtggtatatgaaagatgaatcacatacacaaaacatagctacattagaaaaataattttgtgtagcatatgaaagattatttatataaacaaactcaacgttacagtattttattagcatatgaaacataaattatattttcaaaaaaattaataaatgcaaattgaaaatcttaaaatccacacacactttatattatgtgtggggactatgtaaaaaaatttatattcttacaatacttctggtaggtaaattaattgtcaaccctctatggcttgaagggcactttatgtattttttaaaaaatatccaccctaatggcatattgtagaaaaaattaacaaagttggtggcatattatagagggagataaagtcaatagcaaatcgttgaactggagtaaactcaggggcatagaatagatgctctcgttcctatcatgacttatatatgttgcttgtctgctcagtgcttacaatatagtcacggacagtcatctgatttggtcttgctctaattatacacgaacgtttgttcgtccatccatatcgccagtggtagttagctaggtgcaaagcgtagctaggcctaggaggcgatgggaaattcggattcagcttattcaggatactgggtaatgaattatcagattgttgcacacatcaatacatgaagcactcaatccagtggaatggtttattgttgagggatatccatcaggttaaaagtgacattattattttatcatgttatcaacatcttttccggctaacaaacctttttttgaaaacctttccagctaacaaacctaaagcctaactgaggttcgccatgtataacttcttatatgtacatatggataatgtttgggcatgtctccatgtattgcatacatgccttttaatctttggtatgcacaatatactccctccatattttaatgtatgacaccgttgactttttgtctaacgtttgaccattcgtcttattaaaaaaattatgtaattattatttattttattatgacttgattcgtcatcaaatattttttaagcatgacataaatattttcatatttgcaaaaaaaaagttgaataaaacaaatggtcaaacgttggtcgaaaagtcaacggcgtcatatattaaaatacggagggagtatatattaggcttaggaggcaaggagtgtaatgctgagtctaccctctccgtcaccattgagattatcctatatatagttgaaacttgaaacataaacttgatatgcatttacatcaattcagtgttcaagcatagcaagtgaaagaaactggagcatttacatacgtttacatcaatttcgcatgtactataaaccaaccaggcaaccacatatgttttacgtgtagttagggaaacaccttagctttacttcaatttcgcattcaactacagtccagttctacgtgtagtcagggaaacaccttagctttatcatggtggtgtagttgtggtcgtatgttttttgcacactagaactcaaattttgtattttgcagttgcacacatggaggtccttttttcagtatgaattttcgcttctgtgctctgttccggcctacataaattcagcatgaaactttgcacatctgcttcgattccactgctccatctcattgatctctgcctgacatctctgtttcataggttcctagttattactcctagctcagtaggcttatgacacattgagaactattgatccgtatgcccatctaatagaacacttctcgttttcaccttaagaacaggggagagatggacaactgcttactaactgcagaggagtcttttttatagttcgggggggggggggggaggtgcttctagtaactcccttcctattaaacatctacagtttattttaatgggtagcgtggagattatgggtacccctatagttggccataaggcccgaggcccgaaggcccagcccacggcacgcctttttggcccggcccaagcacggcacggcccgacttgggtcgggcccgtgccggcccggctcgaccgtcgggccgtgcctgggcctccccaccagcacgctgggctggcctggcacggtcgggccggcccggcacgatgggctggcaggccagacccggtacacaaagtatacggactaa

SEQ ID NO: 16989 - DNA, 2040 bp, Oryza sativa
cctgcctgggctgtgagtgcggcacgtgggctggcacggcacggcccggtgtgtcggtcgggccgtgccggcccgacaagcctcggcccaggcacggccgggcctgggccgtgctgtgccgggcggcccacatggccatctataggtaccccatacctacacggtatggttatccgactagttataggggatagcttgtatctatagaatatataacggatcatgacttgggtattacgttaccttgtatattatagaacggcctaaagtcctgatttgataatattgtaaagtaaatttaggataccgataccgtattggttatggtttctatgttgtaatcctacctccatcctatataaggtgggcaggagaccttctagggggatattgacacccctgatcgtcggatctacaatacacttggcggattcaaattctcaaatagtaatagggtattacctctcattgaaagagcctgaacctgtttaaatcctttgtctccgcatccatccacttttagatctcgtacgctacccctttatattgctgaaatattgtttcgacaggtagtttgaattgaaagtagtggctttctacgttgcttggtatgtataagaggcattgatcaaatagaatctagcgaactgtgattaaaggtactagtgagagggtacttaaagttgtggatcgggtacgaaagtggaaggttagaatagcaatcggcttcccattatgtcctccttagttttagggcaaattagttcatctgttacggtaattttcattgaatcattattttatcgtctggttgaatgaccatttgttcgatttgtgtggtttttggctgcaacaattgacgcggaacaaaaatgtgatgtaaattgactaatagatcgaatctgatcatctgaagagtgtgcatgagagatttaatttgtcgttgtcaaatggaactagaaggcatcatctactaagaagagtaattctgcatcatccccacaatcgtgtagcctctgtatggtaaaaacagcaagtcaaccagaaatactcgtgattgaccaaatgaacgacggcatggatgcaacatctgatggcataagcaagcgatgcagagtaaagaacactccaggatctctttgccatctctttggagttataacgcaaaactagttgatcataaaggtatctaacgaccaacgattttttctgtaaacaattactacctgtatttgtgtcattgtttgttaccaatctacccttcgagattcttctgtaatcaacggtggatactcatttctacaagaggtatgggagggacctttcaagcaccgtaaaagatctcgttaattcctatgtttcaacattaggtaacataaacagaaagtaacgggtaactttagccgtgatagccattccaatgtttcaacaactaatccaatataagtaacttgttctgtttaccggttgtctaaaattggactattgtgagagagcacgcatcatctttccgtggaagacaattacttggttgtagtataaatttaataaaaagataagttctctaaacatcatgagcccatctctgtctactgaaccattcagggcatcaaccatgcagctaatactactacggaaatgatttttctgtacaagaacccctataggttgtagatgaaccataactggttgtgtttgcaaaaatgaacccctattttcgcacacgtctacttatgatgcccttatgcaaaaaatcagcttataaatagccttattgttgcttgttatctagtcagatcatgagttatcaaagtgagagagcttctagacgcctagttgattgccgtgcactctctctctatttttgtaacctataatattgaagttggcatgtgtgatccgctactctgctctcaatactaacagttgtctcgatactctttatttaagcccatttcctagtgttattttgctaacaggaaatatgaaatttcgtgtatataactaggctattgtgtatgcattgtcaatttgtttgtg

SEQ ID NO: 16990 - DNA, 689 bp, Oryza sativa
cctacatacatgaaccattgctcaaaccaactacgaaaatgcctgcctttatcaattgtcaaacatatatatgaacatactccctccttccctaaatgtttaacgctgttgacttttttaaacatgtttgaccgttcgtcttattcaaaaacttttgtgaaatgtgtaaaactatatgtatatataaaagtatatttaacaataaatcaaatgataggaaaataattgtgacatccccgcccagagcttaataggattaatagaatactacaacttctttttcggaagccgatctcagaagaactctaaggttaagcgtgcttggcctggagcaatttcgggatgagtgaccgaccgggaaattcttagcgggtgcacgagtgaggacaaagtgtgcagaaaagatttgtgttggtctgcgagggctttctatgacctataaaagctgccagatataagcgggacgttacaataattaataattacttgaattatttgaataagacgaacgatctaatattttttaaaaaaagttaagggcgctaaatatttggggatggagggagtatatagcgagctctaactattggtgcatgctaaccggagtgtcctacggagtgccggcaccacacgaccggggtgtgcatcgctgatccataatttggatgtgatgtagagttcatctcgcg

SEQ ID NO: 16991 - DNA, 1531 bp, Oryza sativa
cgaggataccctggtgaatgggaagatgtacagagtaggtggtgcatgcatcatatgtgagctaatttcttcaagcaattcaagaacaaggagctcatgaacatgttcaagaggctatgcaatcagaaccaggagaaaaaaattcaatgagctttggaagagattagatgagttgacagccaaatgcagttatctgcatgcagcgggaccatcgaccgccgttattgaccatcctcaagctcttggacctctcccaacagatagtccaacattggttagaagaactggagtagagatccggaaattttctcagtggattttgcatgaaccaaaagagaaatgggccaaggcttatgacacaggtggttctagatatgggataatgacaacaaattttgcagaagtttacaactgggtgatgcgcggtgtccgtggactcccactagttggcatagtagagttcattttacatgggacatgtaggtattttagggaccggttccagacagttcttccctctatgccgaacaacgacattttattcggaactttcatgcagaaaaagctagaggagtgatgtaaaaaggccatgaaacatcgagctctagtgcaaggtacccaacagcataggtttaagatactatgtcaagataaggcacgcaggggtatctaccgcaagagagtgaagcagggatgtgttctcaaagccgacggcacatgtcattgctcatgtgcaaagcctaagctgctccacgggccatgcacccatgtcattgctgccgcatcggagtgtggcataccagatgcagtatatgtgtcacagtacttcagtaagcaaacaatatatcatacatggagtggcgagatttatgggttcggcatagctggggagttcacagagactaatgatgaagtaatcaatattcctgacccatcgaagctccaaggcaaggctggaaggaagaagactcgtcacatccacaacgatatagacgagtcggaggcgggcagggtgaagcgctgtagcaaatgcgatgaacgtgggcacacctacaagcattgtcctaaagacaaggaaaaaccaagtgcagcggaggcaggactatcaggatcagtagcagatggagctcgccctacgggtgaaggcactacctcaactcgatcccgtcctagacgtcgtcgtaccacgtctgactacgtggtgaagctcttgtgttctatgttgcaaggcgcttttgctagtaatgtggtacaacatcacagatgtgtttatgtttcatcgtgtaatgtcagacttccgcatgtaatgtctttaggtctcgtaatgtaatgtcagactttggcacctactgtctttaggtatcttgatgtaatgtcagacttcggcatgtaatgtctgtaggtttcgtgatgtaatgtctgtatgttttagactgctcacctgtcgtacagacgacgttgcttaggcagacgtagcaccacagcggcctccctgaataactagtcctcatctagttgcgcacgttcctaa

SEQ ID NO: 16992 - DNA, 1597 bp, Oryza sativa
cggcatgtaatgtctgtaggtttcgtgatgtaatgtctgtatgttttcgactgctcacctgtcgtgcagacgacgttgcttaggcagacgtagcaccacagcggccaccctgactaactagtcctcatctagttgcgcacgttcctaagccgactccccctccgcacggaggtaagtatatttaaggattttttgtacatgcctcgcacatctatgtgagccgattgatccaattgcttcaggatttcatgcaccgttcagcaccccgccttccacgggtaggccatctgttgtgcccctcacagctatttaaaaaaacaatagtacttcgacaatcaatttacatgcattttatgtcttagtttacaagggtcccgttgtcgatgtctaggtttcgcccagtttgctccgacgcaggtcgcccacttctcctaggctgcagggtcagcgtctcaggcagctgcgtcgacctcgcactcagcgcagttctggcagtacaccgggacttcgtcacaggcagtcggcacgtcgagtcagggtccaccactggacaatgctaggacctcgtcggactacggggtggcttccaccttgctcttctccatgagcgacttcgacttcgcttcagtctcgacagaggacgtcatcggcccctcacagctgggaggcgcaccgccggtgcagacgcaggaccagtcgccatccactccagcgccagacactcatgctacccgtgctgtgccaccgaatcgtttcacgtactcccaggaccacgtgcgagcacaggctcggaggaccaagcgtggtcgcggcgcggggcagggccagtagagcagacttatctttgtttatttactttacatgctagtactgtatgcttgtgtaatgaatacgttgttgttattcgggtttctcatccctgaacttcgctgttaatttttacgaaagcacgatatctttcggcacatgcatgacatatttctgccgcaccgatgcagcctcctttattcgcgtgcgatacgactgcggaatggctgacccaccagtgcccacatacaactttcggcgccaatcaggcgtacccaccatggcccgcgacgttgacatgtcagggatatcactgcgatttttggtgcctatataagtcgccttaacgagcgaggcctctgaagcatctaggcccccgttgttaattttggtaattaatgacaagcgctaagtgtggactaaccattgctattaagatatattttaagttaggtccacgtcatgtgtgcgcatggatgattatcgatggattaaaatttgatggagcgaagcgaagaaaagaaaacggtaaaactagtgctttagttttaaaattgatcgaggtgaagggcgatcaaatttgctagtttatttttagtttcgccgtactatcaaggggggtaatgacctaaaaatgagatgattttaattgccacattaggtcattatgcatttagacttgtgctcacatttcatctcacacacacaattattcatctttcactgggatcgtcctgaccaggggcggtcagaccggccatagagtgacggtttgaccggagtgccccgg

SEQ ID NO: 16993 - DNA, 6647 bp, Oryza sativa
  unsure (1)..(6647): unsure at all n locations
atgattttaattgccacattaggtcattatgcatttagacttgtgctcacatttcatctcacacacacaattattcatctttcactgggatcgtcctgaccaggggcggtcagaccggccatagagtgacggtttgaccggagtgccccggccggtctgactggccccaagcgggcggtctgaccggcgcataaggccggtctgatcggaggcacatgcgcggtcagactggccccctggaggccaggatggtgttgctcggggtggccgatacagagccgacggagccgtatttggtcagaccgagctgatggcagtctgaccgagccaaggccggtctgaccggccactcactatcggtctgaccggccaggccgatggggccctctaacagcgctacaacggctcgttttctagccgttgcagagtagcacggtctgactggccacatacctccggttagaccgccagagcattgagttggggaatttcgcccccaacggctagttttggttggtgggagtataaatactccccctccagcagcaaggggctctcttggcacccaattcaattgcatacaccccttgcacctctctcacacccacttgagctttgtgttcatccatctagtgtgttagagggttaattagccaagagtcaagtgcatttgcttccattgtagagcttgtgtggcacttgattgatcatctccacgccggatcattgcttgttactcttggaggttgccgcctcctagacggcttgtggaggagttgcctggtgacctctccgagaagattgtggaggaggcccggcgtcggttgtgagtggtttggagttcaccatcttcggagtgaaggaagaactaccctagtgatcgaggcttgggtagtcctctccgtgggccggctcccgccttgcccaccccttgacaaagggggcgtgcggtggcttcgtggttgagcggtgtagttgggctcgcctcaacggggagtaggaaaccgacgagtttccgaacctcggtgaaaaatcttttgtctccttgtctcatttacttgttgcatttacatttgtgcaatttacatttctagatatatactagagaccatttcaccttaggattgctaaacattaacataggaatgtgatttactttcctagagatataattgagccattatcacgctaggtttgcaaaacataacttagttacttagttagagttgaccctcaccaagcctagcaacttaggttagttttgattaggtgtcatttagtttaaatcgcctattcacccccctctagtcgacatctcgatcctacagcctcacaatctttaataactcagtcacattcggtactctcttccccacttgcttcattacaaatcctaccagctttcgtcaatgggtagacgcctgggcattgaggatccgaattggcatagtgatccttgtgtatacctactaccaccttggtgccagcgtcctctctgcctatgcggtgactgatgccaactaatggcttcgaggaatcctgatattcgaggaaggcccttttttaggtgccctaactatgaccgtgaggtattttattatttgcatatgcttattcattccgtatgggcaattattttattcttcgtaatactactctattcgtcaggcccgcactacggcttgcgtatatatcgagtgggtcgatacagaaaatcccgttctcgacctaaccacttgtttacaagaaggatgctggtatttcgcattcgaaagtactgagcaatacttgcagagaaaagcggcttacgaacgataatgtcgtgaacaacagtgcaactagcgggtgctaactacggcactccctccatgggaagcccgtccaagatgcacaagcggtgatcgttgtcaggttcttcgttccataaagcctacgagattgggtcgaaggttctttgtttgtccaaatattcttgacgacaatttcatggtaagaatattttgattatcatgattccttattttctcacaacatttactaactttgttcgcttcacatctattctttcccccccggaaccaccaaggagatgtcaatagagagaacggatagacaccagaagggttctaactccacctagccgtgctgtgcagcttgaactaccagagcaatacagggatactaaagcgtggttttagagaggagagggatcctcacgtagggattagctattatcagacaacttggcatattgaaatttgtactttcatgcttccttgtcccattatcacatcgtcgttgtgttcaactcttgcactgcctccctcctagttcgaatataatatcatctatgtaaccgcaatggaaatagatgtatcatgttcaaattctactactatttcttcatgttacataattctccttgtttaagtctatataatgtttctacgaccgagattgcgataggcctatatcaatttcgtacactaatacgttgaataagttacaaaataatatcttacttaacatatgaaattgcgaaaacaaccaacttcaatatatttttaaaacattattaataagttttaccaataaataattctttaattattattaacataatagagaaaaatcatttggcttgtacttagtacgagccaaatgctctttagggctgcaaaaattgcatttagccccttgccgccctctagaggtggcaagggtgtaaatgcaaaatacgcatatggcaccgtccctcccccgtttgccacgtcagcttgccgccctccattggggcggcagggtctatttttgtaattttttgcgccgatagattatttctgtaaatattaaaaaaatttaaaaatgaaaaaaattcgtcctgtttcccattgtccatatcatacaatgtcttttctcaacgggccggatataacaaggtttttcaccccatcacatcgaatgtttggccacatgcatgaagtattaaatatagaaaaaaaactaattacacagattgtgtgtaaattgtgagacgaatcttttaagcctaactgctccatgatttgacaatgcggtgctacaataaacatttgttaaattaggcttaataaattcttctcatggtttataggcaggcactgtaatttgttttgttattagattacatttaatacttcaactgtgtatccgtatatccaatgtgacacggcaaaaattttcacccctggatctaaacacagccagtcatcatggcacgtttccttacaacgcctacgtttgaatcgaacaatgaaacgatggattatatggtactacctccatccccaaatacttgtcgtcttgagtttttgtttgtaaaatttgatcattcgtcttattcgaaagattatagaattattatttattttgtttgtggcttgttttattatgaaatgtactttaagtatgaattatccttttttatatttacactaatttttcaaataaaacgaatggtcaaacgttgcaaccaaaagtcaaagtgacatctattatgggacagaggtagtagtccatttacatgggtaagctatatttatatagtatttatgtggactggatgtttctatttctatgttgtttgaggagaaagagtcaaaacttacactataagtttcatatatttgcactataattttcagtattatgatgtaattggttattggtttaatttagtatataagtaaaaaaataaaaagtagaagggaaatattagggatggtctatgtgtcaaacaactttaaaaaataaattttataaaaccctatatgatggtccaagttttgcaaaattgcgtaaagtttggcacgtggcacatttctaggtattatggttataaagttttgcaaaaccacattactaatcattttgactttgatttaccacacttttaagatctacaatcatatctcaaatttatgagtgttatctatcatatagatgttacacccacgatttctattttgatataggagtatgtaaaaatggttaatggtgtagttctgtgaaattttcgaaccataatatctatggttctatgctacgcgctaaaatatatatggttttgtgtaatttggaccataatacctgtagttttgtacaattgatataacccaattagttaatgtgtgaaacaatagaactccttgtattattagttatcacagaacaaaatatattatagaattttttttatcacaaaatttcagataacatagaatgaccacatgttgatgagttgggaaaatggaaattaagaagtataattgtaatgtggaaccggagaagggagaacatcagaagcaaaagtacacgttatcttggactagtcaagaatatatatactgaccaagtatgcgaagttgatccaacaaaaattaacaccccaaatgtactgaggagagcttgataaatattttacgggggcttctaaactactccctccgtaaaaaaaaccaatcctaaatttgaatctacatatacactatgtacagatttaaactgaagatgatggcagcgagtcagcgacgcgtgtgagaacggggacgagttcagctgctgacgtgagtggaggaggggggcaggccaaaacatactcggaacaaaaacgggtcaaaaacccaaacctaactgcaagtcttggtacgatccaacggtcacaaatttggaaaaaaaatacaaatgaataaatcttttcattttcttcaactcttgctcccgattgaatctgtctccctcaaccataatactacatccgtcccaaaatatagctacatagtactaggaccagattcgtagtactaggtaatgccacatctagtactaggtagctacattttgaaacggaggaagtactgagtataacacctccccaactttcgaaaccagagcaaatcgagtctctttggatagaggtttcatccttcatgacgctcatgagactgtcggtgagaaaaattaaaataataacagcccccacctctccctaggccctagagcaaatcgagtctctttggatagagatttcatccttcatgacgctcatgagacctacatgttaatgagaaaaattaaaataataacagcccccgcctctcccaggccaggcccacttacatttggcaactttcatatgttgtagactgtcctcacagaccaacacaagtcttttctgcacactaggccaagcacgcttaacctcagagttctttagatatcggtttctggaaaataagttgcaacttgttgatgtaagtattctattaattctattaagccttgggccaagatgtcacaatccatgagccctgcgctgcatccgctggccttcgacccggttgccgaggtcgctagggtggtagacggcggccgacatcggcgagctcgcagggagtgcgggtaggaatagcgaggagctactatcctgaaattgttgtcgccgtccgacaaggcatcgttgccttgctcctctcctgacattcgatgggagtttcccggactaggatgccacatcagtcaaatcagctatccatattgtcttactacttcagggcctgtttagttcactaacgaaaatttttagcgtgtcacatcggcgatacggacacacatttaaagtattaaatatagactaataacaaaacaaattacagattccgcctaaaaattgcgagacgaatttattaagcctaattaatccatcattagtaaatgtttactgtagcaccacgttgtcaaatcatggcgtaattaggcttaaaagattcgtctcgcaatttacacgtaacctgtgtaattattatttttatttatatttaatactccatgcatatgccgaaacattcaatgtgacagggtgaaaaatttttgtttgggaactacacagggccttatttaacccggttttgaaagatggatgtttaataatttctgaagataaaggacctacagtgaacttattccatcccaaaacagtgtggtggtgtggcttggatgggccgggctgggcctcctacagtccggctcggtccaactatatatctctcccacctttatctattctattaacaaaaaagtgaaaaataaagaaaaattcattcttcttctccttctccttcttctcttcttggaggatatttcttccccctccgtctccggcgccgatctgcatccacccgccgagcagagaccagcgccgccgccgtcgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgagatggacgacgnnnnnnnnnnnnnnnnnnnnnnnnnnnnnnnnnnnnnnnnnnnnnnnnnnnnnnnnnnnnnn

SEQ ID NO: 16994 - DNA, 5011 bp, Oryza sativa
ccgatctgcatccacccgccgagcagagaccagcgccgccgccgtcgccgtccgttcctcctgtatcgcgtcctggtgagcatccgcccctcgttacgcacatttttttattcgaatttttttttcaagaatgaatttctgtgcgttaaccctagatagtacgtagcttccgttgtagatctggatctggaaagcttttctcttgatttgttcgtaatgtgatactaatagcagtttctttgcttgtttgtttgtttccctaaagaaatttcttttttctgggatgtccgacgttggagacgcccctgtgcagcgccgctcttgttcgaatccggccggtggtctgtaggattgggcggctgcggcggcggcgagatggacgacgacgccagcatgagcataagatgggggggattcttcgagtcgccggcgaggaacctcggcctgcagctcatgtcgtcggtgcctgctgagcgtgacaccaagcagctgctctctggtagccccttcctgcatcatcagcatcagcagcatgtcccgcaccaccaccatcagccccatcacccgcgtgactgcggcgccaatggcaatgccaatggtggtgctatgcctcctcctcctgccacggaggctcccccttcaatgccgatgaacttcgcgcgcagtgacatgtggatgcacccgcaacagcagcagcaacatcatcatccccgcgagcacaaggctcttcacaatctcactgttggccatggttcttcgcacattgcgcatcatgacccagtgggctatgggatgatccccggtacgcataccctgcagatgatgcagcagcaaacagagcctcaactgcaacccccaccaccgcctcagcagccaaaagaggaatgcatttcctcgccattgatcgaggaaaatgtacctgttattgatgagccaccacctcccaagaagcggcagcagggccgccaacccaaggtaccaagggctaagaagcccaagaagtctgctgctcctcgtgaggatggcgcaccacccaatgcaccagcaccacggagaaggggtcccaggaagaatatagggatggtaattaatggtattgatttggacctctcaaggataccaacgcccatttgttcttgcacgggcgcaccacagcagtgctatcggtggggtgcaggtggttggcaatctgcgtgctgcacaaccaccatctcaacgtacccactgccaatgagtacgaagcgccgtggtgcacgaatcgcaggcaggaagatgagccatggtgcgttcaagaaagtacttgagaagcttgctggtgaaggttataatcttaataatccgattgacctgaagaccttctgggcgaagcatggaacaaacaagtttgttaccataaggtaaaagacaatgaaattctaaaatttgttggctttgtaggttgctctgcagctgtttggtctgagtaattgtctgtatgtactctagattacaaactgcagaatccttttaggtgtaggttttaggcatgtcctgtccctttgcagtagtttacatgcctcatctgtgacctgggtgctgacctgtatggtggctatctgcatgtatctttgtcattatctttacaagtagcagtgtaatgcgacaatctctaatttaggtggcatgaaagttaatctgttcaacgtttctcattatgcttaagtcttctgttatacaatgctccattgcaatgcctggatgttttacagaatacaatatagttgctatctcatgaagtagaaacgttatctttttcatgctgtgttctgtatgcatgcaaagtttatatagcctatatatacatgtcttttcttttattgaactgatgtttgcatgcatgatgaatgtgggcaaaggttctgtacctaatctggattacttaaccaggtctaataatatctttactgtgagcaaggttcttgccaatttcatttgatgtgctcaaatctctgtcagactctattccgaagtcccttggtatcaaaaatttttagagtaaatgctgaggaatgtcttttgccacttgtctaatgtaacatgcctttagttctgccttatacgtagatggaactctgggaccattgatgtcatctttgctatttagtgattaccctttaagtccatgtgttattatttgcacttctttaggaggcaattattggctagtaatctaagtcctatgtttcaaactcagcactttgtttaatcaactttgtgcaaacagtaaacagcagtcaaaatattgcaattacattctattattttttgatttgatgatcttttttgggataaagaaaattacctgtatagtttgaacatattctgctctattatgctgcaagatatcaagctatctgcataaatcttgtcatcctgaaccttcaaaaaatacagtaatatttcacatgttatgcattcaaaatgttgatcctgtctactagggcaatttaactctgtcaaggctaattgcattataaggtatgcatgttctctattttttctatttgtagattacagagaaagtggtgccatttgtaataaatgatgttatgattcagcaattttcttttttataataaagtactataataattagaatgctgatatgagaatgaacgatgatgattaatgagcatcagaattatatgaaatgttagataattaattatcacaaaagctattttctttccaacttcatatatgctgaaatgtgggttgctgctagtttcgtgttgcctaaactgcagtgttacatgagaatattgaatgtttgcacatatgttttagaggccttgagtgccacaaacgatggacagcacctttttgtaaaatgtaaatacccagtaaaattattgtgcaaaatatttggtagtctatgaagccattaggaaaataatgtaattctgagcaaatagaagctaatactgccaatactagagctattgtgatagatatagttcactgatatgatatgtgtgaaacgttataacttgagctattgcgaattgcgatagcagagtgtgctatttatcagcatcatcatcgtacatctgggaatgttgtgttaggtgatctgtacatgtactctagttccatacatgctagctactgctgtttttcttgatctgttctgttggtgtgcatgcgccagaccgatgtatgtagatctattatctgcatttgttgatcgttgtacatgtttttttattttttgaaagaaaagtatgctatgtttagcttgctgagatgcaaatgcaatgcatcatcaggctgagatgtagctgcaaatagttcactgtgatgtttctcattgcttccacagttaccatggaagcagcagtattcccatcataattgccatggaattttgtgtatatgatgtgatatggttttcactactgttcatacttgatgtgttctaaacaatgagagtgtgacactacgtatcttgaagctacaaaatgaataattacccttttattccatctatatatgattgttcttccatttggtcatttcattgtctcgtgtggtcttcacatggcttcattgttacttatgctgagatatatcgaatcctggtcatcattcatccattctgatgcattttgcactagttagcctgcctccctgagcagtttacatcgaatgcgtattgttttgttgtacaaaagattattatttattagtattgtatagaagaaataaacaaaagcagctctaatcaggtgaactatagctgcggctaaaactgggcaagtttttgcattttaacttatggaaaatcttgtttgtgcaactctccaaggaccaaagggatctgtattggccatgtttcagcacacggcaatgaggttcagacttcagaagtccaaactgatttgtgtcttcccttcccaccatgtactatactgattgctatcttgcaacttgaaactcatcattgaccaacagtttcatcgatcagagcctattaacatgcagagatataatatctaatagcatttgtgttcaagttggctcacatcttaagctatacttatatttctagagcataaacagtaataaattcataagatgaagaatggattgtatttaatacgtatcaaatatcgcattgaagtaactcgttaggctctggtcctacacatctaaagccatactactccattaaaaaaaaggaaaaaaaagataaaacattacttttagggatgaatttgaacgaatttggacttctggggacttgtcaaatttaatttatccctcgaagttgattttttttttcttttggacagagggtgtactgtagaatctaggcagcattatgcagttgcacatctggagttgcaattgtaacttttcaagatccaaattatagtactttcagtaaaacggaatgaaaaacatgcgcatataatgattttttaggctcaaatcatgactatacttaccttaatatgcatcacatcattcaaccttattagtaataatgtggtgtcatgtggatctccattctccaacttctaaaaagaagctggaactggtaacaacttccagagatggccaaactaattagcatgttggttctttattaggcactttttttttggcagaggtaatagtaagtaggatatgattatcttgcaagttaataatattaaactcttagtaagatacacagtgatatagagctcagaagacagtgaaatgagctttctctttcgttgttaattgaactgaattatcccaagttactttcatcaatttaacgaattgacaggtgattactgatcatgacatccactgatagcctgctactcatgagaacaatttactactggattttaagtttttgcttataacgtttgaccactcgtcttattcaaaattttttgaaattattaattattttatttgtgacttactttattatctacaatactttaagcacaacttttcgttttttatattt

SEQ ID NO: 16995 - DNA, 14662 bp, Oryza sativa
tccccttttcgttttttatatttgcaaaaaaaaattgaataagacgagtggtcaaacgttacaagcaaaaactgaaaatcccttatactgtgggacggaggaagtatatatgttaggtcaaagaatgctgcttcgaggtgctgtaataaaggttaattttgttccttttgagatgccaattaagctagccaaaaagaggcgattgcaaactggtaggaacaaactatatgagaaaggttactttctaaaggaaattatgataatgttgtttgaccaaagctagcaaaggtaaagcaaatgcttccttttcgctttcggtaatagcagtaacatgtcgatcaatcaagagaccaaatattgtaattaattaacaaatggtaaacaaaagtgctcctcacaaatggcattttaccgaaactgattggattatgtattttaccgaaactgattggattaacaacttggatccatacaagtcaattgcctcacctgcagagctcaaatattcctaggtaatttgagtgatcatcttttacaattcagcttaatttttttcaggcatgcctcaaaatgagattcatgtggaaatcatgcacaaaattatggaagtttcattaaaattcatgtaaaatttctctcttccaaacttgaatgttccagagttcctagcagatgagaatatgtagtctcctacgcctatcagtctataaatcgagaaagcatggagactgagtagtagtaaaaggcaatgcgtgcacatggcaggatgaaatcaaaggtgctttgcaatcgcaaaggttataatagcagcagtaaactagtcatcaaagtaattaaagggaggcatcttagcttgtggatgtgatgcatcaagcatgcgggcagagacgccatcatgaatgtaattccctttgatctaatatttactattttttcctaaaaaattctcaacattttggtttcagtttcagattcaactctgaagatttttgttctgtgagaaacaacagattccatatatgaaggtataagatatatactggtattgcaaacaaataattaaccatattctctgcaggtaaaagattttaatttgtgtcaagaaatataaggtagtatttacccgcataatttggagatatatgcaacttcaatagcaacgcacaagttgtacatctaggattttggtacatatctccataacaattccactccagttaggaaattgtttttgcctcaacaaaaagaagaggaaattgttgcacactcctaaattatttttagttagtttctctcttttttatttctcattaaagtttttgagacttgccatcagttatgaacaacacctatcttctttttagttttttaattgaatatcacacatgcctgcatggatctcatcagaaacatagccacgtttgtagtgtactgtttagatgctccatactgatatgatgattagatatgtttcttccacaacatcaatcccgacatccaaatcgtcagaagttagcaatgttgcatttgttaattggatttgccaacactaatgcttgtgggggtaattatgattacacgtgcggcgccaaagcataaaagtgactttgagcactcaaaggggacatgaccacccttgttaatttacttgtattttaccaccattagtgggatgtatgacatgcataatatgacgtacacatgcaagttaatgttaattatttgagcaaattaagtatactatgtacataaacatcacattcaccatgtctaggtctagtatctattgatgcatcgtcggtacccaatgtgctcaatgatacatgtcacataggaccatgagatgtttaatgatgttgacctgccaagtttttgtacaattttttcccctaaatgctttccatatttctgtactgagaattctaaaattgatatatataggacgccagacctttttctctgaatagtgtgtgataatctggaaatttattttttttacggggaatctggaaatttatttaatatgcacgcgtaatggtgtgcgtgcattttctacaaaaataatagcaccttaattattagaattctagttattgagttcacaaccatgaaatcaaataattactttattgaagattaatagataaattatgcttaacaatcttaaataatagaattttgttaattggaatgccattggactacatgaatctaacctaattgacccaaagaaaaaaaaaagaagggaacacattgaagttaagaacatcattagtaaacgagattgggatgaggccgtgtgaaatgatctccataattaaaaccacttaaggatatatctttagcacggattattcatgatatccaacgtgcgaattatgtacttcatccaaccttgatctacaccctaccaattaagaattaataagaacaagaacaccaacttgatgcgggtagaatattggtgccatatgctgttatgcgcagcatcagtacactcctagagaagttaatttccagagtaaaaagaagaattaatttgataaaataccactcatttatagatgaatatatatataaggccttgcctaccatacatttcctttatatatagtttgctaattagttcatagaggattacataactctttacatatgaaactgaatatatactcgcataaatattatcatattcaattttgtttctccatcactaaaaaaacataacagacaaaaaaacatgatcttatcacatataaagtgcaataataatgaagatagaaattattaaatcacaagggccctaataggaagcagagtaaagaggggagcattatcatctctaatgccaataggaatttttttaaagaagttgatgtgatgtccctcccctggtagccctcctgtctgtgatggaccactgaattttctccccttaactttctgagtgcatgcagcacaattctgcctttcccatgcacacacatgatttcccattgatccctaagcaaagcaaccttgatatgcacacaaaaatatatatttgcaggaactttaaaaatccctttttctaacatcacatctggtgacaagtaatataatgcagatctccccactcaaccagagacacaatcactgatgttactcgttaaacattattctgcacaaatagatatgtgtctgaactctgttaaaggttttccatatcgtatcaacataaaaatgcttatgtgtcggttaaattttttttagagtatattaaatcaaatataatttttggctctgaaattgggactgtacattgatcgatgtaccgctcgcggtctgcttttggttctccaaggacgctttcaccctggttagggtgtggccgtgtgtttagttgtttgggcataaagttttcgaagtatacagacgcatatttgaagtattgaacgtagactaataataaaacaaattacatattccgtctgtaaactgcgagacgaatttattaagcctaattaatccgtcattagcaaatatttaatgtcgcatcacattgtcaaattatggtgtaattagcctcaaaagattcgtctcgcaatttatatgtaaattgtgcaattggttttttcccacatttaatgtcccatgtatatgtccaaacatttgatgtgacgtttttgaccaaatttttttatctaaacaatgccttaataaattgacattaagttcctccttactgtcccacacatgtttttttattttgtacatgagattttctcagctatttactcgatgatatgaatccagaggtttctcaaagaaaaagaaaatccgagtcagattttatgcatcctctgtgcacttgtctctgcttataggaaaaagtacgaattacccccctcccgaactatcacgatcgtccgaattatatttaataaacaatgaatgatctctaccaaccaaacaatatctcctaggctagtatgtgtttttcgcgttaccagtggcgcacacgtggtaatctagtcagcattttatttaataaaacaaatgtggggcccacctatcatactcttcttcctctctctttctattctctctcgctcttttctctctcacgcagcgcgcacggcaaggacgggcggtgggagtgggcggttggcgaggatggcacggggataggcggtcggcaaggatggcgtagacggtagcgcggacggtgcggacgtcggcgtggaggcggagacgacggaggagcgtggcggcaaagctagctaggtggaggactccgactccagtgactcgttgatgctattggtgaggtaaggacggcggcgagtagggggcggagccagttgtgggtggcggagggggcccgaggacgatggcggctggcgacggaggcggaggctgaccgggcacgcggggacgcgcggtgggcgatgggctcgtcctcctcgtcgtgggcgcgtggggacgcgcggtgggcggcggcctcctcctcagctgtggcgcacggggacacgcggtgggacaccgccgctactgcgggctcctcctcctcgtcgtgggcatgtggttgccgatggcgcgcagggactgcggtgggcggcgggctcctcctcctcgtcgtggacatgcggtgggacaccactgccaccgcggctcctctttggagccatcgagccgcgtctcgtcctacctccccgcgcctcgctccccgtccgtctcacgcctctcctcgtccgccggcgatgcgccggcgccggcgcagagaaccgggcccaagggcggaggaagagcgtgccgccacgctcgcctcacctcgctctgccgccatgctcctcccccgccgccgctgccccgtgatagagagagagaggaagaatgagacacagatagagaggaaaagtgagagagaggaagagtggaagagtatgacacgtgggtcccacatttttttaataaatagaatgttgactggactagcacgtgtacgccacgtagaccaaaatcaccgcggattgagtaggggggtaattcgtccggtttgcatagttggggtgaagaatgtccggttttatggtttagggggtaattcggatgaccgcgatagttcgggccgggggagggggtaattcgtacttttcccctgcttatatgatcattgtatgaaggcaaggaaacccctgatggctactttggcgcttaggaatttcactgaaaacaattcattttccacataaactgaataaaaaaactttttttcgaggaggcgagcaggagttctgccgtttcatattaggagaaaagacttaaaaaaaaacttttgtacaggagtagcaaatacagtaaagaagaaaaaaaggcaacttcaggctaaaattttggcaaactacatttgggccagctcttcttcctttgatttgaaaagtaatccaaaggaatgtttcctggaccaaaatcccctataaaacccacctacactgatagttgtccaaggcagtatcaatccaactcacaaacacaaaagtgtaccaaagcacccttaactggtgatgttttataaacaccacttcaaaaaaaaaaagaagagaaaaagccatctttatctctcaaaagcagaggattacacaccataagccataatctttctttgtaaaccactgatcatcatcaagagtgaccaacacaacacttgctctcactcaccctctgtcactcttttcttctccatccatccatcctcattgtcccaacattgcatccacatgccaaatggacattctcatcccacttctcctctcctcgatctacgtgtcgtcgtcggcggcggcggcggaaaccgatgcggcggcgctcctccgcttcaaggcgttcgtccacaaggatcctagaggagtcctctcgtcgtgggtggatcctggtccatgtcgctggcgtggcgtgacgtgcaacggcgacggcagggtgacggagctcgacctcgccgccggcggcctcgccgggcgcgccgagcttgccgccctctctggtctcgacacgttgtgcaggttgaacctctccggcaatggcgagctgcacgttgatgccggtgacctggttaagctcccgcgcgcgctgctgcagctcgacctctccgatggcggcctcgccggccggcttcccgacggctttctggcgtgttaccccaacctcaccgatgtcagcctcgcgaggaacaacctcaccggcgagcttcccgggatgctcctggcgagcaatatccggtcgttcgacgtgtccggcaacaacatgtccggcgacatctccggcgtgtcgctccccgcgacgctggccgtcctcgacctgtccggcaaccgcttcaccggcgccatcccgccgtcgctgtccggctgcgcgggcctcacgacgctcaacctgtcgtacaacggcctcgccggcgcgataccggagggaatcggcgccatcgccgggctcgaagtgctcgacgtgtcgtggaaccacctcaccggcgccatcccgcccggcctcgggaggaacgcgtgcgcgtcgctgcgtgtcctccgcgtctcgagtaacaacatctccggctccatcccggagtcgctgtcgtcgtgccacgcgctccggctgctcgacgtcgccaacaacaacgtctccggcgggatccctgccgccgtgctcggcaacctcacggcggtcgagagcctcctcctcagcaacaacttcatctccggctctctcccggataccatcgcccactgcaagaacctccgcgtcgccgacctgagcagcaacaagatctccggcgcgctcccggccgagctctgctcgcccggcgcggcgctggaggagctccggctgccggacaacctcgtcgccggcacgatcccgccgggcttgtccaactgctcgcggctgcgggtgatcgacttcagcatcaactacctgcgcggcccgatcccgccggagctcggccggctccgcgccctggagaagctggtgatgtggttcaatggcctcgacggccggattccggcggatctcgggcaatgccggaatctccggacgctgatcctgaacaacaacttcatcggcggcgacatccccgtcgagctcttcaactgcaccggcctcgagtgggtgtcgctgacgagcaaccagatcaccggcaccatccggccggagttcgggcggctgtcccgcctcgccgtgctgcagctggcgaacaacagcctcgccggcgagatccccagggagctcggcaactgcagcagcctcatgtggttggacctcaacagcaaccgcctcaccggcgagatccctcgccgcctcggccgccagctcggctccacgccgctcagcggcatcctgtccgggaacacgctggcgttcgtccgcaacgtcggcaactcgtgcaagggagttgggggattgctggagttcgccggaatccggccggagcggctgctgcaggtgcccaccctcaagagctgcgacttcacgcggctctactccggcgccgccgtgagcgggtggacgcggtaccagacgctggagtacctcgacctctcgtacaacagcctcgacggcgagatccccgaggagttgggcgacatggacgtgctccacgtgctcgacctggcgcggaacaaccttaccggcgagatcccggcgttgctcggccgtctgcgcaacctcggtgtgttcgacgtgtcgcgcaaccggctgcagggcggcatccgggactccttctccaacctctccttcctcgtccagatcgacatctccgacaacaacctctccggcgagatcccgcagcggggccagctcagcacgctgccggcgagccagtacgccggcaacccggggctgtgcggcatgccgctggagccctgcggcgaccgctcccgacggcgaccatgtccgggctcgccgccgcggcgtcgacggatccgcccccacggcgcgccgtggcgacgtgggccaacggcgtgatcctcgccgtgctggtgtcggccgggctggcgtgcgcggcggcgatatgggcggtggcggcgcgggcgcggcggcgtgaggtgcgctcggcgatgatgctgagcagcctccaggacgggacgcggacggcgacgacatggaagctcgggaaggcggagaaggaggcgctgagcatcaacgtggcgacgttccagcggcagctccggaagctgaccttcacgcagctgatcgaggccaccaatggcttctccaccgccagcctgatcggctccggcgggttcggcgaggtgttcaaggcgacgctcaaggacgggtcgtgcgtggcgatcaagaagctgatccacctgagctaccagggcgaccgcgagttcatggcggagatggagacgctgggcaagatcaagcacaagaacctcgtccccctcctcggctactgcaagatcggcgaggagcggctgctggtgtacgagttcatgagccacggcagcctggaggacacgctgcacggcgacggcggcagatcggcatcaccggcgatgtcgtgggagcagcggaagaaggtggcgcgcggcgcggcgaggggcctgtgcttcctccactacaactgcatcccccacatcatccaccgcgacatgaagtccagcaacgtgctcctcgacggcgacatggaggcgcgcgtcgccgacttcggcatggcccgcctcatcagcgcgctggacacgcacctgagcgtcagcacgctcgccgggacgccgggctacgtgccgccggagtactaccagagcttccggtgcacggtgaagggggacgtctactccttcggcgtcgtcctccttgagctgctcaccggccgccgccccacgacaaggacgacttcggggacaccaacctcgtgggctgggtcaaaatgaaggtccgggaccgcgccgggaagaaggtgctcgacccggagctcgtcgtcgagggcgccgactccgacgagatggcaagggtcatggacatggcgctgcagtgcgtcgacgacttcccctcaaagcgcccaaacatgctgcaggtggtcgccatgctcagggagctcgacgcgccgccgccggcaactgccatataaattcatttctgcagagagcttgtgattaatcgaccatctctgatgatcacaaacgaacacataaaaagacgcaaatgttgcatccagacatgcatgttccttgttgttggctgtttaatcttgatgcgatttattcatttgtgagctctagaatttccaagttatgactaaattttgaataaatttaggctggaaaaattcaaactggatttgaatacgtttaggaacaaaaaactggtagatttgcatttgaaaaaaatgagagtacattctagtctttcagctgttacacaatatatataagcaagacaactcagtggtatattggaccaataacacaattcattgctcttgagcagcccattaacaggtttttagttgtggcccagtaatctcgccatcccaaaactcatcagtggttttgtatgggccagattcgtggacatagaaatcacggtttcccctgaattccgggagggcgcttatctcctggcgatcagcatcggtgagctcccaatcaaaaatttcgaggttctctctcattcttctctcattgaagctcttgacgattatgcaatcgccttgctcatgcagccacctcaggcatacctgcaatttcggtgaaacttatatacatattggaattattcctaaaaactttgccatagatagcatggtgttcaataccacagatattgatgaattttttgtcgactataaattatctttacatcactgaaaatttagtttatcataactgatccaaaattaagacgtattgtagcattatatatgtacctgggcaaccgttttgcccttctgtacggcgatatgtttgagaacagggcagtccaagacggcattgctgccccatatagtgccacttgctcctaaaggagagtaggcacagagctggatttctttctccttacaaaactcccttagtttgttctgccggcaataggggtttatctcaacctgcatatatattgtagtcatgcatgcaatcccaacgacaattaataatacaatatatgttccaaaatatgtatgatgggacaaaatataggatgataatgtattgtacagtaatacctgatttgctgcaggagggatggttgcaaatgagagcagggtgttaagcttcttgcaggtgaaattgctgacaccaatggctttggtgagacctagcctctggcactcctccatgtccttccaaactccctccatgtccatcatcacaaagtcattgtcgtacaccggcgaaggcgtttcttgttccactctcagtcttattggccagtgaatcaggtataggtcgatgtaaaccatctgcaggttcctgcagtagtacatgaagactcacgcaaaacaaacaaaataatggtaattttatcatcttcaagaaagtaccaaaaatgctatattttctattttaaaaacatgacacaattatgtactagttaccttagatgtatcaatcattttagtgtaaaattgattaattttttgagaggaacctggacgagtctacgggtcgggctcccgatcggtttggagaaaaatcggggctgaagcgtccgatttacgtgcaaaactattttaaactaatttttctcttaaattacttatccaaattatgatccgattgcactattaaattcgttgcaattaaattttcaaaacaagaccacacatggatatattccgatgaaaaaagttagcttattattgaattatttttaaatgttgcacgatgttccatcaagtatatcggaattgtttcactaagtagatcgaaaatgtttcattcatttaaatcgggtgttgtttcaccttatataaaaacaatgtttcagcaaatagcgaaagaatgttttagttcggtgcaacatttgatccatacatagtgaaacattataagtacactaggtgaaacatttttcggtggaacaaaaaaataaaacgaattacgttaatagggggtttccaaaatatgtgggttttttcattgcaatggaatatttcacttcactgcaatattaaatctatagatagtgaaacatttttagtggaacaaaaaaataaaccaaattcttttaatagagggtttccaaaatatgtgggtgatttgttgcaggtggaggcagggattgtggtgggggcccaagtggcatgcatgcgcgcggggcagggggcgggggagcgcctgatttttttctccccccaccggtcgactgatctctatcattatcggagcaacgtagctaaaatttctcactaaattaataaacatacaagtgattgtttagaggttggtttgtgaatgatgctgacgtaccggagcgtcctcctgagcgccggcaagacacggccggggtgggtgtcggagatccagagcttagaggtgatgtagaggtcgtcccgggacgcgaccatgccggcgcgcacggcctccaacacggcctcccccaggggtgcctcggtgccgtacgccgccgccgtgtcgaagtggcggtagccggcgtcgatcgctcgcaggacggcgtccctgacggtggccggcagctggggcgcgtccaacgggaacgacgcggtgcccatgccgacgagcggcatcggcttgccggacctcagcgccgcctctggtatcgtcgccgccgccgccgccgatgctcccacaccaccaccagccatgaacgatagatggctagcttagctgtcgtacctgatcgagtgaggtaaaaagatcttagagaaagagagggagtggtgcatgtgtcagtttcatcttcgtcagttcagcgaatttagtagtagcatacatgcatcgcgacaggtatatgattgggagctggccggagacaagataacacaatgtgattgcggttgcgactgcgacacaaaactgtcactacttgtattttcacacacagaaacagacgtaatgtatgcatcacggaaatttatagcatcttggacaaattttccttcttcagcagtgaaatattaggttgtaagttgcgcgctgccggccggtaatctcgatcgccatcccaaaacttgtcagcggtaaaatgttctatagttaaacatgatatacatatgcatattgatatgttgttcactactacgctctctccggttttcaatgtttggcgccatggaattttaggcagacttttgattatttgtattattcaagttttgtttttaaatatgtaaaagtataaaccctacttttcatcaaagatatattcgagaagcttgaacgaagatagctgaactattgtttcaggggcgcgcgggacacgaccagaaggctgggttgagtggcgaacgtgtcccactgccagctgtgggcaagcgttcactaccataaatgaaacatgtttatgggggaaaaccccaaccagcctgaggtcaaaaagacgctaacgctgagtcattaggagcaacaggcgtctggatatgtgtcgcgcctgcccagtgacacccgacttatccaactgagaagaaaaatagccgtggcactatcttggataggttgaggatcgccaggcccaccatatgccgcgtggtgggcaggatggaaacccacctgggccagatcaatgcccagggagcccggggcaacttaatcatatacttttggttggtttctcgggaagattagaagggaaccaactgacagcgacaagacagctgagtgacaacacgaaggaagagcagaaaaatggcactgtgagcccctcggggacgtgctatataaaaagggatgcttgttccttagtttgaaaaaggtctagtttataatttccagatccagatagtgacaaaaaaaacaggagtaggggtattacacctttaggtggcctgaacctgtataactgcttgtgttcatttgtcttgtggggagctggaccctatcttggagatcttttccacgtcgtgcacaactaaccccctggacgagttttcactcaaggaaagatctgcacttcctcgctgctggagaatcgctcctccaacacttcccctttctagcgattagaaatttgttacctacttgagttcttgctaagtattactccctccatattttaatgtatgacgccgttgacttttcgaacaacgtttgaccattcgttttattcaaattttttgtgcaaatataaaaatatttatatcatacttaaaaaacatttgatgacaaatcaagtcacaataaaataaatgataattacataattttttgaataagacgaatggtcaaacgttagacaaaaagtcaacggcgtcatacattaaaatacggaggtagtattacttataaggtggtttaattgagtgttctaacatgtagcccttatagatataccatattatcaaattatacatgtttcaagtcgacgcgacttaaataatgttagataggtacttgagttgagagaaggtttagtcataaaaaaaagggtttgttggaaccatgccaccctaattttgcgaaatttgagatatgccacccgtatctcaatgacatgtaggaaccacatgagtcaatgacatatgggtcagggtggcatatcacaaattttgcaaaatttgtgtggcatggttcaaattttccctaaaaattatatgtgctgggattcccttattgccttctattgatggtatctctaatcaacaaaatacaaatatcggctatgggctcttttagtgaagcattggatgttgggcaacctcatgcaactcagcgctagtcatacttactacaaccctatgaaccatgcaacaggtcacacaaccacacctgacatctcaaatgattttctattagacaacgcttggatggatgtttttttattaaactaggtgaaaccccgcgcgttgctgcgggagtttatcatgagaacaataagtaaaaaaacgtgtaaaatagcttaaacaacataagcttatataaacataagttttcataaattgatgagatttaaattgaaatagtatgtagaataatgatttagatgtaaaagtaagatgatgtggctttatgaggcggttggacagaggcggcctgcacccctcggcggcgggagacgacgggaggtaggcggcaggagacgacgggaggtaggcagcccgcatccctcagttgcggcaggcagcgtgcggtggtgggaggtggtgcgacggaggcggcccgcgccggatcaggaggtgtggcgcggcgaaaacagcaggcatggaggtggggccgccagcaggaggtgcgacggcgtcgaacaacggccggcgatccatctttgcaaacgaacaaataacccccccccccagctcaatccgctgtggttttgatcctacatggtagtccagtcaacaattcattgttaaaaaaataggtgggccccacctatcagtttctctatctgtcttgtgtctctttcccaatctcttactctcttctccattggagctgcatcaagaagggcgacggcagaggcagtgacgaggcgtggggagcacggcggcggacgaggcgaggcgaggcgtcggcgtcag

SEQ ID NO: 16996 - DNA, 8657 bp, Oryza sativa
aatataagatgcaacttaagtatgaggaatcagtcaaaggataacgttgattacaactttaactaataatctgcaatcatatattttctcagcgatctaaagtggtaagtaaaaccatccttattttcattcgtcatttgatcagcctcaagtgatgtgcacttgaatatttagtatttagcagcataaattcagatatcattttagcccttggaaaagcatatatgtaaactgctgaaaccctgtctatgaacaaaactatttttactgtaatcataaatgaatacagtaattcactctccatggacaaattcagcatgatcataaatgaacatagtagcttagcttatttttatggaagaacatcaatcaattgttgcagaaaatagttgagcttcaactccttaaaatagtatagcatgtaggacacagcaacaaaatctagcatttaccgagagaagtgtaatcctaagttttcatgctgttggtggcatgttacggttagggaaatacacccaggatcatttgtgcaaacatcaattgatgctagcgacccaatccctccaaagatattgctgggatattttggtgtgcttgcttgtaatttatgaaattgatattcagaattaattgaaaattttatatacacttcaatgcatcatctattgtgagctgagaagttaatttgagcaacatatattggtcaattttaatttatctctagttaaagtctattagttacatccagcaaacagaaatttctaattaaattgaaagccattggctttaatcttatttggcttaaagggtaaccttccctggtttctgttcaagcaatttatcaagcacgaaacgtgcaaaaactatatatcaagatgggacaactaaccaaatgtttgcatactggctttggccatcttcacacaccgtactttaacactgactcgcaacgaattacctcagattctagcatgctattccagctggtacacaagctttactgggttctagcctccaatgctgcccatgtagcatcttgaagggcgatggccaaccacgcctcaagcccgtcgtcacacgcatgtcgccaagaaggagagcaagggcaacgcatgatgtggagggggaagccgatgcctttggcttggaggtgggggtcgacttcgatggctatctccgatctgccatcgtggatctgattttacagcaccaaactcgcctagaggcagcggcaatagctgggaggaggcatggctaaggcgctcgagctcactggtgaggtggtgcaggatccagtgcgcctattctgggacgcggtcgaaactggtgatccacttcatggtggcggtggggaggttggcgggctggcggcggcagtgtggccgtgtgcgatgaagagacaaggaggggaacattctctcctttttttttggttacctagggacgtggaaggatgtatttgaaaaagagctttctcgaaggatccagaagagattttgcaaatagagagatctgacggatgataatgtccggaggatatatcgaacggtccttgatttctcgatgatgtggcccaatcagattgcaagaaactttagttctttcaatactttagattggtgaagtgatactaccaagtatcaccggatattagtaaagtaatactactaataagtatcactatattagtaatcaactggtaccgatactactaagtatcatctgatactattgttccattttgatctaacctaaccgtttctctggagaggccaaagcagcaaagcagccatcaacggaagaacgaggtgttgctccacttcttgcttcgtcatcggcttcttcactcgttgcatgtttgcgccatcgattatcccgtgcggtccacagcccggcgctgggattgcctggtttcagatagagccacttatggcccgcctggaacctaaaggggcttgcgtctaggaaaatcacatgtgtagtagtgtcgttgccatcaactagtaggtcaacctcttacaggtcacggcggtggcagcaacggtggccgttggcaatggtaccatgcacttggactgtgaggagagcgagcagtgccaaaggttgatagtggtacaacacgtggtcagatcaggcttgcgttggttattagtcttatctgatggaaaataagaaaataacgttcctagatttaaaacgatctctatgatgtggacaagattggagattttgacgactagtatactttcattcacaaaaggacataacatgtgtgcatcatgaggaaaagtatgttggactctggtacacgaaatttgaattcttcttgagcagtccattcattggctgggctagcattgatcagggaccattagaaaaagtcttgtcaccagtaatctcgccgtcccaaaactcatcaactgttttatatggaccggttttgtggacgaagatgtcaagagttcccctccactctgggagggtgcttatcttgtgacgatcatcattggtgagctcccaatcaaagatgcctagattctctcttaacctgctcttgttgaagctcttgacgattacacaatctccttgctcatacacccacctcaagcatacctacacttccagtttgtactttcagttctaaatagtttcatatctagttaataaacatgatatgcacgataagattcactaaacaatgcaacataggtatatatagtattcaccagaacaattattaccataagtttcatgtatcatcttatcggccattaaacaaaccacttttgccttttgtttttcctgctacggtctctaaatataattgcatagctggaagcttaatttatcatagcacatataaaaaattgacatatattgcagtgttctgtttacctgggcaatagttttacccctctccatggcaatctgtttgagaagaggacaatccatgacagcattgttgctccatggtgtaccctttccacctaaaggagagtaggcacagagctgaattcctttctccttgcagaactccctcaatttattttgccgacagtaggggtgcacctcaacctgcaagtgttcatgtaatcccgtgaacaatattaataaattaatcaatgtacatgttgaaatgttttggacaaagagaatagagaaaaaaatgtatatgtacaactataatataaacagtaccaagtagtactaagaaaatgttgtctccatactcataactaaaataccatttttcctttttcctcgcaaaaaaaaaactaaaataccatttccctttttcttcttacaacccctcttaatcttttatgtccttgtctctctcatctgtgcatggccatgacgagtaactacttaaaaaaatactacctccatattttaatgtatgaagccgttgactttttatccaacgtttaactattcgttttattaaaaaaattatgtaattattatttattttattgtgacttgattcatcatcaaatgttctttaagcatgacataaatattttcatatttgcacaaaatttttgaataaaacgaatgatcaaacgttagtcaaaaagtcaacggcgtcatacattaaaatatggagggagtatttgttaagatgatccataagtgatttacgtgggcatttttccaacttgcctgcaaccaagctagggcctatagaaatcatggatttgtgtaggcaaattccaacccgtgcagaaatcaattttcacggtgtggctctctcaaggacccacccatgaaaataaaattccagtttaatttttatagacataaaaaacccacaaaaatgactaaacttcaaaatgttatagaaaaatcactttatgtccgattgaggtgaaccacggttctccatgatccttgtaatatttttcttcatatggttgggtccatatttacttaaaatatttattttaatatggttgctcactgccgtggtctttatatgagttgatatatatgttatgcatcttgacattaatgaatgatcagacacaaaaaagtattccatgaaagtattaatattgtcatattacagaaaacactaatagaatatcgtataactttggtttacctcaatcaggtttaaaataaatatctagaattgtttttaagtttggactttctaaccctcgtaaaaaggaaaaagttcatataaccccctaaacgttgaataaaaatccatataacaccctaaactttacagtcggacatcatccaccccgaactttgcaatacaattcatgttacccctaaattagtttcagacagtggttttgcatattttaaagtttaaacgagcgatttaaaaaaactcgtataacatacttacatacctcaatcatcggtcttaaattatagtatatagtaacatcatattagtattatattggtattcatttattcaagtggagatttaacatatatgtccaaggcatatgtcacatattcaaaatcatccatcgaatatgcaaattatgtagtaatcattttgtaaaaccaccatatgggttacatgaatagtattgtaaagtttaagggttggatatccggttttaaagttcaaggtgctagatggaatttcatctaaagtttagggggtatatggactttttccttgtaaaaatagatatcaaagcttgtaatgaatattaggcacctaaacgatctcatatataaaaactttcaactataaagttgtagatctcattgggatctacaatttcctggtagaacatttctccatccgaagtcatttgaaaactaaaacaaacaatttctaaaatatatctgagaatgaaaaatgaatatttgaacacacctcaacaatctgaaataaacgaactttcaactgcaaagttgttgatttcgtcaaggtctacaattctcatatagagtttgccatcatctaacttcatttgaaagagttacttttttttcatatttgaaattataaatgatctcaaataaaaagactatcaacacaaaagttgtacatctcattgagagatacaattttcatattaagtttgtcgtcatccgactttatatgtagttgcaatttttttttcatattttagtggtattcccatattttatgatggttttcttacttacaaccatccgctaaatatcgatttttaaagactgatttcacaggtatctgaatgtaaaaatagacttaccttcatagctagatggatttcttagatacccgtctgtaaaaagtaggttttcgtaggtgatttatgacctgagacagtgtcaattatttttgcaggtgtattttttcttggctgccggagaaaaaaaatgatatcttcctagaaacgtttcttagtactgagacatatatgcaacggaggtgagagggcgaggcttgattggacattatggctgagtttgacagttacgtgggctctagctgatcgtgaagcttgaccggaatcgccgatgtggacacttttttttttcattttttaatattgttatcccactaaataatgctaatgggtttttctctagttgatggtatatatatagatgcaattccaaaagagtcaagattattataatgtataggaatgtttggaacttttacttgatttgctgcaggagagatggttgcgaaggagagcaatgtctcgagcttcttgcaactgaagttgctaacaccaatagccttggtgagtcctagcctttggcactcctccatctccttccacactccctccatgtccatcatcacaaggtcatccttggaatatgtcattgactccggatcttcagccaacctcatgctcaccggaaagtgaatcaggtacagatcgagatactccatctgcatcttcctacaatattcgtacaaatcaaatcaaccacacaagccaaatgcttgatcatatatgcaccctctattttttttaatgttggttagttaaaaaagaaagacaacaatgatggtgatggttccgccatcctaccaccaccgccggttttgctaattggcgcagatgccgagatggtcaccggggcatgcacgcaagtgctgatttatcggtagctaattggcctaatccaattaggatggtgcgattagcgccagcctccaataatgataacggttagtatttcctttttccttttttgcgggactttccttttttaccggagatgtttactttggttagttgtagataataaccataattaattttttttatatttaatgatcttcttttactaatagattaaaaagaaaactatacgtaaagttaacttttgaaaactttttcaatccagatttaaaaacttaaaactttcaactctaatttaaattttttaagtcaaattttaaaaactttcaacttgtagtctcaaatttgaaaaattttcaactcaaatttgagacttttaacgcagatttgaaaactttcaacttaaaaattgaaactttcaacccagatttaaaaactttcaactcaagatttaaatttttttatattgaaaaatttttaagttaagatttgaaaacttttgaccaaaaaattttttggtaacacgtgtgctaccgattaaaaattcgaaaaaaaaacatgaaaaaaaagaaggaaaacacgtgaggggagaggaagcgaaaaaaagaaaaacgaaaaagatggaaaaaagaaaaacgaaaaaagatactagtgcccatgcaccagttagcatcctggccaccaccgccgctgtcatgtgaaaccactcacccatttccatgcctccctcccacaacctgctgctagtaggctagtttctagcctatttcatttttattttttactatttgtcttttcgtatttctaggcggctagctattagaatttcttgacgggtctcagattatactacatggatcaaatataatattctagctaggtatatagaaaatttatatcgactggttagagtagctacgcagctggacatgaagaatgacacgaataattaatgatcccggtgcaacgcatgagcatatatagctagtccaacaaaataagttgcagttatactcaccggagcgcacgcctaagagatggcaggacatggccggggtgcgcgtgggcaacccatagcttggacgtgatgtagagctcgtcccgcgacgcgacgaggccggcgcgcaccgcctccgccacggcgtcgccgaggatggcctccgtctggtacacggccgccgtgtcgaagtgccggtagccggcctcgatggcgcgcaggacgacatccttcaccgtcgacgggtcggtcgcgccgagcgggaacgaagccgtgcccatgccgacccgcggcatcggcttgccggagctcagagccgcctccggcatcatccccctcacatggtcatgggatcgaaccgatcgagagaaattgaagataaggctcgacagccaattaatctggccatatattggtacgcgaggcctcatatcagcgactcaccgtgtgacagctacagcccgaacgacccaagttcttcatatttttttttgggaaaaggaaaagagaatatttgggtgctttttgtcgacggcactcgctagttgcaacactatctccgttatttaatagataatacagttagtttatttttaaatttctaatatttattcatttaaagtaaaacgagtatcaaaagttctacacgaagcaaacataatatatttttctatttgcacaggacttttgagaaatgatgaatagtcaaacatattaataaaataactacatcatatctattatatactaaaagtccattaaacatcctataaacactattaagccgccacatagaactcccacaatcgctcgtacatcgccacgtggcatttaatcatctagccatcgattttcactaatatacggtgggcccattattttataccattagatttatttatctaaatagaaagggataaaaaaagtggccctcatatcctacccctcccgtccagtacatatgcttgtgtacgtgcgtatgtgcctcccccatatattttatttctcttctatcttcctcttttagttagatggaaaaaacattttatgatttatccaaatacaatgataaaaaaaaggggcccgtataccttccccgcctatccagtatgcacttgtcttttctctcctattttcctcttttagttatatggaaaaaaatatcacctcccccacatatttcttctctcctatttccttcttttagttacatggaaaaaatattttataataacaaattttaaacaattatattatctaaatcatataaataatttttatttgtgctcactattagattattttctgtaaaatttaaaattgaatatccaaattaactatattaattattaaagaaattcaatacttttagtcatatatattctacgaattatagctattgttcattgatccatacattttttaaaaaaatataatatattttaaacgttctgattaataatatgggtgggcaagtttgaccgcaagaaaactaaccagttgaactacgctcacttcataatgttggatataaagacaaccataatttttaagctacatttttaaaatactcctatgccttttaaacc

SEQ ID NO: 16997 - DNA, 6474 bp, Oryza sativa
atgccttttaaaccggtagaagcattatttctaaccgttagatctatcttatatagaaaaagtgtttattcatggtacatgacatttcaaaaatattactgtgcaatgataatacttcgtcgttatcgtgttatttctaggttgcgtggagtctctcatctactctacataaaatgttcatagatagatcgcttcttaaaataacccatgtatttagtggagcttcatttcccacccaacatcctttaacatattatgataatatattatacatcaaaagaaagaaaaacaccttacgttttattttacacttactttactttcgttgacatgttttctaagaaaataaatctacattcttttgaaatgattaagaagattataaataattgcttataaatattacttatatatgatataatataaaactgataggttaaaatattattaaacaattaattaacgctaacaaaaataatttatggagaaatcgtggcggatgttctccggttaatatattgcttttataaatacgtcaaaccactactggtgaaagggttttcactcacggttcgtaaccccatatagtcccgattatacaactaggaccacgaatctatctctagtcttgggtaaaataaccagaactaaaaattatctttagtcccggttcctattcaaaccgggactaatgtggtttttgcaccacctagcaaagatcacttctccagtagttaacatagcgtatgacgtacgcccgcgcgaatgcacgggctacctttctagttttataacatttaaaaggaggtatagtccaacacatatttttcatttgctgatatatacatcacatgtactgctagtgtgagagtactccatccggttagaataacatcacacgctgctacttctaatattacgcaatttataactgtgagcaggcagatcaagcaacgcatatattagattacttaaacccgtgggatctttggaaggttagggacgccacgtcatcggttttttcaaaaacaccactcacctctgattaatcacgttttgggttaatcacgttttggaaagtaagtgtgccacgtcattgtatttttttgcaaaaaaacgcctgcacttcctgttaattgtgcgttggttcctgccgctatggtccgttcgatcacgcgcgagggactagcgtgtcccagcgtggctgctcttccaccatcgtgagatcgttggatcagaaacggacggcctagatttggcaagaaccctagccacctcgcgctcgcctctcttctcgctcgtgctgccccaccctcctccctcgtgcgggtcgccgcctcgttatattataaaccaataggtatatagttaatttaggctgtgttcttcccccaattttcccaactcatctctcttgtttaccgcgcgcatgcttttcaaactgttaaacggtgtgttttttgaaaaaaaattctatacgaaggttgctttaaaaaatcatattaatctattttttcttttaaaaaatagctgatacttaattaatcatgcaataacacagctagttttatttttaaacttgtaatatttattcatttaaaataaaacgagtatcaaaagttctacgggaagcaaacataataggtttgtctatttgcacagaactttcgagcaaggacgaatagtcaaacgtactaaaaaataaccgcatcatattctaataacatttaaaaggcggtatagtacaacacatacttttcatttgctgatatatacatcagatgtacagctagtgtgagagttactccatccggttagaatgacatgacacgctgctacttctaatattatgcaattttataactgtgagcaggcaaccaacgagatcaagcaacacagattttatttgaaactagcaggtatagagttaatttacgctgtgttattccctagtttttccaactcatctctcccttttttcggcgcacgcttttcaaaccgctaatcggtgtgttttttgtaaaaaaaaattctatatgaaagttgttttaaaaaatcatattaatccttaatgaaacatgcaataatacatgcttcattttgcgtgccagggatgaagggttcccaacccctcctcctgaacgcatcctaaccttgcatcagaaataggtgtggaaaaaaaaaacctcgggctcgtgagctcagcttgggcttggctcgagctcggctcggctcgaatgaaaaacaagccaagcccaagcctcctttttagctatttgttgaaatgagtcaagcccgagttggctcgcgagccgcttgtttgggaatgatatatgtcaatgatttacccctgcttttcctaatgattactaattatatataaagagatgtttcaatgggaaggctcgcaagctagctcaatctggcttgagccaggaaacgagcagagtcgagctcatgttttagctcgtttccttatccaagctgagccaagcaagcctagtttgttgtgagccattacaatctgagacgagtcaggcttgactaggctcgtttccacccctaatcaaaatctatttatcttctattatataataaaaatccattaaatttccttaaaacgctctcaggttgacacatggcactctaaaaatgttctcaagctaccacgtggcgctagaaaatcctaaaattctagaaaaaaacaaaaatatccatccctgattttcacttaaatatatgggtccaatattatacaccgttagatttatcagaaaatactacgttactgtcctctccccgcaccgcaggcgctaaaattccattaaacttccttaaaacgctctcaggcggacacatggtactctaaaaacgtttccaagctgccacgtgacgccagaaaatcataaaattataagaaaaaaatatccatccctgattttcacttaattatatgggtccagtactatacaccgttagatttatcacgaaatacaacgttaccggccgtcctctccccgctggcgcgtgcgtacatgcgccatcctccctcctcttttttctcaacggtagttaattaagatcaaaagtattagtatcgtgttaactaattttaaatagtattggatttatatctccatagggcatagaccaccagggcacatagccgtatctcccagccgcaagtgtactaatagatgtacatgtatgtatatacgtgtatgtgtgatcatttacaagaaaagagcacgtggctctctcccattggctctatcatgtccgggcgtccggttaattcaaatgcaggtacatataataaaaacttactatctacaccttccatcccaaaaaccaaattcatagtgaggatttgacataaccaagctaaaaaagaatagtacaaatctaccaaacaaatcaactaaggatgcttatccaaaccaacatcaatttgggtcgggctgtttatacaagccagtctatacacaacaaacagggatcaaatacaccctaattaaatctacttcctccgtttcatattataagacttttaaaccgtttcatattataagactttcaaacattgacaacattcatatagatatatatttatagattcactaacatctatataaatatgggtaatgctagaaagtcttataatataaaacggatggagtacatagtatcactgttagtgatgtatgaatattggttcatgttacaaaccttcaacgatgtaccattgcctgttcttaacatgtaccagaggtgatcttctcaacacataattggttggaccagcataatattgatcaagaacaattaaggtttttagttgtcaccagtgatctcaccatccccttgactccggattcatggacgaaaaaatcaaggcatccccttgactccgggagggtgcttatcttgtggtggtcaacatcagtgagctcccaatcaaagatacctagattctctcgcaacctcctctcattgaagctcttcacgattatgcagtcaccttgctcatacactcatacacccatcttaggcatacctgcactacaattgcaaaatgtttcatatatatacatgttagaattcatttcaaaattacctacacacacatagtttcactttttcatacatataggaagtgataaactcctagcctctacatcgaccaaggttgtacaaagccaaaaaaagcatgacaaaaaaaggcatggtgttcactataatagatatattggcattatcattttgtcaaatacaaatataacaacaatttctatttgccatgggtctttttcttcttatgatatctaaatttaatcagttcatccaaagcttatcttgttgtagctgatccaaaactgagatgacatagtatagtattgtgtttacctgggcaactgttttgcccctttctaaagcaatctgtttaagtgggcagtccatgacattgctacaccatgaagtgccatttgcacctaatggagagtaggcgcacatttggattcctttccctttgcagaactccctcaacttattttgccggcaataaggatgcacctcaacctgtaaccgttcgctgatcacaataagtgattgtattaagtattaattaattatttcttctgagaaaaaagtcttgacaaggataacatgtaggtcagtatttataattttaactagttaacgatatatatatatatatatatatatatatatgtatgtatgtatgtatgtatatatatgcagtgtcacataaatggtgccattgaattggagatgtttaaaatattaaattctgtacaaggtaatgttatggagtgaatgaagttgattaaaaaatgaaattcaatcttggagaccatatcaaagagctaatatgccttacttttctcaatcaaaagattaatatgtacatatgtgtggaacaaaaattgatactgctggtgagcccacttttgttttaggaaaaataaaaatgaagaggggcagtgatgccgttttctatatttttttctctcctagttaactcgatatattattttaataggagaagtgtccattagcaaataaccaaagttttagagtatcttttagcatagccacatttttacggtatctcttggcaaataccataaattttggatgtttagtagcaaattttgccaagattatattgttttgtacaaattacctgatttgctgtaggagggatgattgcaaatgatagtaagggtatcaagcttcttgcaggtgaagttgggtaatttggaaccatgccattataattttacaaagtttgagatatgccatcggtatctcaatgacatgtaggacccacatgagtcaatgacatgtgggtcaggatggtatatctcaaattttacaaaattataatggcatggttccaattttccctagaataataaatgggctaggcccgatttattctattaaatctcaaaggcccataataaatgttaaggataataataccaccttgggaattaaatgaggagtatctcaacttaaatagggagttattggaggctccctattgactggttgaggtgaggatcggaaagccacacgcgcgcgcgcgagccgggcgggcgtgggggcgaggcgttcggtgcgcctacgcctgtctctatcctttttgcaatggaccatcccgagattgcctccgtaatgagattgccttcgtaacgggcaggcgagtcaattccaattgatcgcgtcgttactgcggcaaagggcggatatcgctcctacgctacaaggaaagatctaatccgatcagatgcggctactcactttccatctgttgttcttcctcctcctcctcgtgcacgcctgagctgctactgttctgcttccccgcttctgatcgcttgtgcgcacgagaaatcggaacaagcagggcctccggaaccataccttcgcctgagatctgcaccgggtaggcaggtgatcaggtttttggggagtgcttctgcacgattgctcctcttcatcgtcgtcatctgctaccatgtctggtgccgccgtcgccgctgttgctgctgccacacctggagatggaggcgcgcctgtcgacgggggatacccatagaccggatatagagggtattggggtacgctggtacgaggatctacgtagtacgatatcaagcaaacaggaaacagggattatactggttcaggccccttggtagttaatagccctaatccaattgatatgggattatatgatggaaaccacagattacaaaaggaatagtaaagctcgatgataccgacaggatcgtagtcgagttgatccgactagatctcccggcgacctggctttgataagctccggcttcgtaggctgtggtagatgtgttggctttaagatttaatgccttaggtcctcccggggggtcccttttatagggtaccgagctcgaattcgcc

SEQ ID NO: 16998 - DNA, 249 bp, Oryza sativa
tcctccattctctcttctcttttactttctttttctttctttcctctctttctcttttactttcttttctctctttctctctttttctctctgccggcctctcttttcctctccctctctctctcggctctctcccacccgagcggcggcagtggtggacgcgaggggggaaggagggcggctcaccggcggcagcagcggcgacgacggcggcagcgacgacggcggcggcgacggtggcgcacggcg

SEQ ID NO: 16999 - DNA, 5541 bp, Oryza sativa
  unsure (1)..(5541): unsure at all n locations
aaggggccgcctgcaaaatggcctgtccgggctggcttttttgcatcgggcgcaagggttttcgtgcaaaaaaccctccgccacccgtctgccgtcaccgcccgtccctcccccgtttgccacgtcagcttgccgcccgagtggagggcggcagggtctatttttttttaatttttttcgccgatagattatttctgtaaatattaaaaaaattaaaaatgtaaaaaattcgaaacgggacggcctaatgtatcgggctatgggcctaatagcatcacattgttagggacagattaatttaaattaaattgaacgcagtaaataaataaaaaatagtaattcaaggtttacgtcatttttcaccatcctaatatattagtccatactataggacacccccatcctaagataatactatgatactatgaatctgtatccttatttttgagacggagggttaggtggttgtacacttttactcaaacgtaccaaagccgtgttcgaagttccaaaagaaacagtccaaagtacaatggtctgagagaaaatggaaaatgaccttttaggattttgtatgacatgaaggggaaagaaaattgagagaagattgatgtttgttaacaagacattctaataatatacaacataatactatccatatggttatcatgcgtttatccaggttattacatgcgataaccttttcagtttttgaaaccacggtatacctcacagttaccgcagtgggtgtgttcggaagagatttttcgacagcagctgcggctgcagcagttcaaaacggctgccagctgcagcgattttcaactgtgcagcagaactggctgccaaacaaagccagtaaccgtcaaacgtagggttaccctcaaacggtttggtaaaccctgctacacattagtaagcgtgtacgtgctatgcatgccattaggcaatataaatgaactctaatacactgcaactgcaagaatatactcattgcagaatatcatcagaagcaggagcacacattttcctttttaaaaaataacttttcaagtcagtggaattaaccaaatatcttttaacagatatgccctctttacatataaagtttgctttacaataagtctaattcaactgacattcagctcaaatgtccaaagaaaaatacaaatatgggatcaaaggttcacaccataccaatccaaattcaattccatgctgacacacctattgttggacacataagaattgaataagatccaggcatacgttatgcataagaatcttccttgttttcctcttccaccaacaattgatcattatcaatttcataaaagtggtttgaattcatcatgttttaaagtgttataggtttcatcatcatagtttctacaaataataatactatcatttaagttattatacataaacaaacaaaaagatcggagcataccaaactggttcttaccggttcatttcgacacacaaaaacgctcatttcgacaaaagagagatgtttagaatgtattctggcaaatgcttgtatatttcaaggccggtgaacttatttaagaacaaatgttaatttagctcataaaagctgaaatgtaaagcattctggactattctgaagatgtaaagcccaatataaattaagcagggaccagtatatatcaatatatgcataccataccgaaatagcagggcagtaattacctcagagatatccctcaatgtgaacaagattagatgcatactatttttcatttggatgtatacagataaaactaatcacatagtgcaacttaggaaaactaaatttcagtttggatcacattgtttctaagctttctgaaatggaactgacatactgtaaaaaaaaatcacaagaatcaattcacactcagtttcagcaaaacaatacatgcaaaaataggcaacattcagatattgcacattcaatttttgtagaaggaaccatcaggaaatttgtacaggtcccaaaaattgatttgatcttgagtatgtactggactactgatcattgctaattagcaggaagatttatatgtcctggagcagcgaggtacaggcagtgtggggaggcagagcagtgcagcaccagccaggggagtggtaggcataatgaagcaaaatatgaacaaactgtacacaggtaattttctttatcccaaacaagatcagcaaatcaaaaatcactagtatgtaattgcaatattttactgctgtttatgttcgcacaaagcagattaaacaaagtactgagtttgaaacttcaggactttgattacttgcgagggaatgcctaccaaagaagtgcaaataataacacatgtacttaaagagtctccaaatgaacacttgaacagcaaggatttgacttcaatgatcccagtgttccatctaagtacaaggcggcaccaaaggcatgttacattagacaagtggcaaaagacattcgcagcactcgttccaaaaattcttgattccaagggactttggaatagaatctgacagagatttgagcacatcaaatgaaattggaaagaagcaatccaaagtatcatggtctgcgagaagatgccactttacgattttgtacgacatgaaggggagggaaaattgagagagaagattgatctgttaactagacattctaataactagatgacggggcacgccaattgttgatggtcgttatcgatcagtttcgaccgtcaatattaccaaaatagaggagaactagtgatgcttgcaaagcataaatatgttagaataataatattccactagtagtaggtatactaaccttttgcagagaatgacaataaaatggaggagaatcgacatcaactcagacgataaatcaatcggacgatgtcgagaaccagacttatgtatgaatgggccaagaactcagaattaacacgacacactgggccaaaattcacaagtctactgagaggaataccagaggaggccaccagcaaaaatgtgggctggttgggccggcccctggttcggccgaacctaccgtgaagccgctggatgcagggttttgggggaacggtggagattcactccctatggcggttggagggtattaccgacctttctaaccaccataaccgtcattacctgcctatttaaggagttcactctcttcacttcaacacacacctcaagcaatagctctctcatttctcttaagtttagtttagtagtatctagctggtggaatagggatagagtagaaatcaggagtccggaagccttcggaagagttcgggtatggctctagtagcttttctcttctcttttgtaagctttgtacttttattagaatactcttctaaatacatttatggtattgaaatactttcaagtatatgagtacctactttatattatgttcatgttatactgaatatacggctagcttatctaggagatgctttggtgcgggtataatgtttgcatatgcaattactctatgtcatgacgatgatattagagtagtatctggtagtttagacgtggtgtctagattacgggatatcattatttggggttatatattgaggatgagaggtgggccgctgatggtgacatctcagtacgggtattcctccgcgccggtatataatcctaagttaattccctagggagagtattcctccgtatttagccccagttgtatggtcatgacgggttgttgtaaggaactcggcagtcaggggtggcttctcaaagtaccaggagggcatccgatagagggtattagctagtatatcagttaactagaatgtatgtatactatgtatattagaagtatagaaatagattttctttctcttttctttccacttagcttagatgatatattatgagaatgagtgtttactgcttgtgtgtcactctacccttggattatcttaacccctgcttagaatatgattatcacaagtaatatataaattattagttgagttctctctacatgatcttcccacgggataaaatatatacgatacccatggaatactctcgggtgaaatgctacaatggtatatccatgcgcttgcagatggactatgtaaccataatatattagaagtatttctgcgccattgttaggaattatatttctagtaatgtcgttaagaaataccaacaccaatggcacgcctcctgcatattgtttagtttgattcctattttatgttgttgctagaagcttaaaatgttaataagaaaaaataaatgtcgacataacttagtggtagattttctgagtgctaaattgttggatcgctcaagcagtgtttagataccatgtttacaacaaaatttggtggtagagtgccatgttaaaccgtagacagcaagtaacacaattctgatggatgaaagggataatagtaattgatggatattttacacaatgtatatcgccacttccaagagcttcttgcgtacctaagtgttgctgttccagatgatcaaaggctcaaggtcatggccatcacttctcaagcaagggctactgcctacacagtgcagtttgagctgccaaacaatcttcaatctggtttctgctcttgtaatgagctactgtgctggtgtctggtggtcatctcacctgcctgtaggaaaaaactctctaaactgaagcaattaattttttttgactggaaatactgccaggactttgcctcatagtgtaattttataaatacaaattacaagagaacaaaagggaaacaaaaagatcaaaggattacactgtttgtaaccaataaaaaataatatgttttagtggatctttcattctgcacaaatgcagaagaacatcggcttagaataaagccctccaagagctgaacgagggaagctcattgcgaaagattttcccattcctttgcttccaaatgtgccaagcagcaatgaagaaaatttccaagaaacctctcttattgaactgaatgcgagccaaaaccaccatctggaaaaattctaggtcaggattccatgcaattcccaaatgctgccagcaatgttgactgaaagggcagaagaaaaagagatgctctcttgtctctctgatattattcaggcataattcacaagtgaggtctttgttttcctttgcacaatgtcatctatcaagcatatctcttatgttaagtctgtctctgaataaaagccaagcaaaaactttatcttcattacacattttgttttctagatccagacaaaaggccttggcacatgcacatttgagtatgtgagcttataaaacctcttagctgtgtatttatcacagttccggatgaaagaccattcatcacctttaccgttctgcaaagagagaggaccattcctcctctagaacagtgaattctccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcgaattcgcc

SEQ ID NO: 17000 - DNA, 551 bp, Oryza sativa
gattattgactttggttcatatgtcagattattgatgacatgcgcatacatctcagatgcaacaaatgcacatgtaatgttcctgtggtatttctgaaatgctcatgcttggtaatgactgacactgtccagtaatccttccattttcccttataagcgtgcactctccagggacacccatctttttccttaacacaccgaacttcatattgcgaccgattggacttggcaacccaaaactctctatgaagtgacactacaaaatgctttaccgcctccttcatttcttctgctctagtataaatcgctccctgaataacctcattttctttgtattcccatctcacactatcctcttcagagacgaccagaccagaaaaatcctcactagcccattcggctggattaatatccgtctcatcatctgacgaaccaccttcctctacacgctcgttgtcaaaatcctctctctccatttcatccacaatggtaccgacagtctccccctcgttggctactcaaccaggttgaatgcctactggagctactac

SEQ ID NO: 17001 - DNA, 628 bp, Oryza sativa
aaaaattcatcaatatctgtggtattgaacaccatgctatctatgccaaagtttttaggaataattccaatatgtatataagtttcaccgaaattgcaggtatgcctgaggtggctgcatgagcaaggcgattgcataatcgtcaagagcttcaatgagagaagaatgaaggaaaacctcgaaatttttgattgggagctcaccgatgctgatcgccaggagataagcgccctcccggaattcaggggaaaccgtgatttctatgtccacgaatctggcccatacaaaaccactgatgagttttgggatggcgagattactgggccacaactaaaaacctgttaatgggctgctcaagagcaatgaattgtgttattggtccaatataccactgagttgtcttgcttatatatattgtgtaacagctgaaagactagaatgtactctcatttttttcaaatgcaaatctaccagttttttgttcctaaacgtattcaaatccagtttgaatttttccagcctaaatttattcaaaatttagtcataacttggaaattctagagctcacaaatgaataaatcgcatcaagattaaacagccaacaacaaggaacatgcatgtctggatg

SEQ ID NO: 17002 - DNA, 602 bp, Oryza sativa
gtattttattatttgcatatgcttattcattccgtatgggcaattattttattcttcgtaatactactctattcgtcaggcccgcactacggcttgcgtatatatcgagtgggtcgatacagaaaatcccgttctcgacctaaccacttgtttacaagaaggatgctggtatttcgcattcgaaagtactgagcaatacttgcagagaaaagcggcttacgaacgataatgtcgtgaacaacagtgcaactagcgggtgctaactacggcactccctccatgggaagcccgtccaagatgcacaagcggtgatcgttgtcaggttcttcgttccataaagcctacgagattgggtcgaaggttctttgtttgtccaaatattcttgacgacaatttcatggtaagaatattttgattatcatgattccttattttctcacaacatttactaactttgttcgcttcacatctattctttcccccccggaaccaccaaggagatgtcaatagagagaacggatagacacccagagggttctaactccacctagccgtgctgtgcagcttggactaccagagcaatacagggatactaaagcgtg

SEQ ID NO: 17003 - DNA, 808 bp, Oryza sativa
  unsure (1)..(808): unsure at all n locations
tgcggttgaggactttattctctgtggttttcttcctccgccttctgaatttctccttttggtcttgaatttctatggtctttccttgctccatttgaaccccaattccatcgccttcctgagtatttttacgcatctttgtgaggcctacattggggtggagccgtttcttgacctcttccgcttttactatgagttacgctggatggaatccaaaaaggtgtccgggtgtgttggtttccgacttcaggatggcctgaagtcgcgatacatcccctttcagtgcctcacatctcgcagcaaatagcgggggaggtggttctatcttcagatagaggattcggatcctgtcttcgttgtacctaaggaacagccagacaagatttcatcttggaccaccaaacccgccttgaccccgtccctccaatctttcatcgatatcattgacgacctccgagaacgggggttgtcggggtatgaagttgctgccgacttcattggtaggcggatccagccgcttcaggctcgagcccatcctgcctttgattattctgggccagaggacgcgacccgggtttctcctcagggtatttcctttttagttaaattgactcccttatgttcatgtttttcccgtcttatcggattctgttctcaatctacaggcttgaatagcgcaaccgtggagcgccgcgtccgccaactgataatcagcggcccgacaacggcgagcaacgtccccgtcctcctttgnnnnnnnnnnnnnnnnnnnnnnnnnnnnnnnnnnnnnnnnnnnnnnnnnnnnnnn

SEQ ID NO: 17004 - DNA, 328 bp, Oryza sativa
  unsure (1)..(328): unsure at all n locations
nnnnnnnnnnnnnnnnnnnnnnnnnnnnnnnnnnnnnnaaaattagactttctttctttctagactgggccgaaaccctttccctcctccagcccaagccggcccagccaccacagccgagccgcccttccttcttctgcagacgcgcacacgcacacgccgtcgccgtttacttgccgtcgccgccaagtcgcgccgccaccgtcgccgtgccttacccttcaactccgtcgtctttccttcgccggtaagcaactgtcggcgacgtcagccgccacctcacgccgctgannnnnnnnnnnnnnnnnnnnnnnnnnnnnnnnnnnnn

SEQ ID NO: 17005 - DNA, 406 bp, Oryza sativa
ctctccctcttttcccctttttcctcccgccggcgtcatcctcctcccccctccctgtcgccgctttggccacgactgccgagcgctagccctctcctttgaccgccctaagtcggttcccaaaccgacattgctgctcctataaacccaagcttccccctttcctttcctctcccattcgcctccacgccattgccgccgcctcccgtgctctgttcgccgtcgctgttcgtcgttgcacgtgtcggaggagccggcacgagcaaggacgcggaaggggactccgggcgcgccctctccttcctcttccctgccccgaggccggagagattactcccgcgccgtcggcctctcgtcactgcgcccgcccgcacggtagtgcctccctccattcttcctcctcgct

SEQ ID NO: 17006 - DNA, 13533 bp, Oryza sativa
  unsure (1)..(13533): unsure at all n locations
tttcccccttccctcgccgccggttgccgccgccgcaatccgccgcggacgcactccctccggtgaatccgagccattggctggtctcccccggtcctgtgcgaccacccggtgtgctcgctttcgcctgtatcgccgtggttcgctccgccgctcgccgctgtcgtccgccgtccgttccggctggcgtcgtcgtctacctcccgccggcccgcgtggcagccacgtaggcgccacgtcggcgccaactcggccaagaccgggtcgagccgaccacggtcagcccctccctgtgcgcgcgttccaccgcgagccgtgaggctgcgcgtgggcccgctgcatccgtgtccacctcgaaccgcgcgcgtgcaccgcgtccctcccccgcccgcgcgcgtgcgccgcgtgctcgctccgcacggtgaaccgtgtcaccgacaagcgggtcccacccgggaccacgcgaggtgagcccggtccaccggctctctctctcctccctcccgcgcgcgcgttgggccgccttgggccggccggcccattaagctcggccgaaccgccctttctctcgggccgcgccctagccgcccgagggaagtctaatttccctccctcttttattttattttcttttctttttcaaaaaggatttaattaaatccttttcctttagaccaaaaatccaataatcgtagaaattcaatatctccccaaccgtaaatccgtttgactccgttcaacttccaaaattcctcaaatctcgagatctatctaatggcacacttagaggtcattaatagggctttatttttgccgtttgttgagttgtcccgttctgcgtgtactttcggagcccgaagacccgcagtgcgaggagttcgaggatcaagctccagatctcgagcaaggcaagccacctttgaacatcttgagcctatatttgaatttaattatgttgcttgaaaaatattatgcattgataggatcgcacttaatctgtttgtcccgtctgcaaggcagattggcgaacctacctagtttgttgcatttgatccttcctttgttaattgttatcccatgttcccttgtaaccacccagttgcgcctcggaaatcgtgcactctgcacgagtatcgacggccgccttcaaacttaaaatctgaaaaacatcttgggtaaaacttgggtcttacaaaaaacttggaaaacccgacacctgggtcggtgcttgcgaactaaatgaatttccaaaaccgcggaccggggaacataccgggtgtacggtttcccgctcttgcacttaaggaccgttttccttggaatttcatccgaacataagacaagtacgaccacatgggtggaatgggacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggccttggaaatgtcttgtcatgaaagcttggaggtctcccgatgtggctgatccccacgggctgggtgatccgggttagtaatgtcgtgcgggtaaagtgtaccccctctacagaggttaacaaactgttcgaacagccgtgcccacggtcatgggcggatgtgaggtgattcctagcgtagttttgtttgactactgccttgtgaaattgctgttgtgaaaaggggatcgttgtttggaaaatctgcagctgatgggatcagctaggcccgggtggccgtttgaaagatgttggcccgggtggccgtttgaaaattgttggccgggtgccaatcttgatcaattttaaagactgatacattgcacatactccgaccggacgagacgcactgtctcatctgtgtcgtttgagaagcactcacttagttgtttccagaaaagagttcaaataaaaatcaattgcaaaaacaacagccctttctttgaagcctgcattaaacacttatttcccatggcttgctgagtactcccgtactcacccttgctctatataaataatcccccccccagttgctgaagaagatgaagggggatcctgcagatgaggagttcttccaggagcaagccggctacgatgagttttagggtttcggcctagttcccaagtcgcgcctgtgttgtttgatccaagtcctagcttccgcttcccttttgtaatgcagttgtgagctcgggatctgtccgcagcccaacatgactgtacctctactctataataaagagacctctattgctgtgataatttgtcttcctgtgataccagtactgtttcctgggactggtatcgattaacaggttaatttggagcgtcacgggctagatccggtcggtactagttcagggcgtgacacaagcacaagtcaattctaccatactatatgtaaggcatatattcaaaggaaggcaatatgtagttcattttcagcataaagcaagttttgtttcgcaattcttttgtaaaggagttgatgcttcaattaacaaatcaaattttaagtttcaatattaaattcatcataattccatcataatcaatctcttgttgtcatcctttgacaacaagtcataatatatcacctcacacacacaactcaacacatctatcaatttcaaaccaatgtcacatgatcacatttttaaaacatagtctatactcatgacacatcaccaaagcgctcatgaccgtgagcacggctaatcgattagtttaaagaactctgcagagtttgtacagctttatccacatgatatgaactctctagtttgttttgagtttgcaagactccaccacactcttcattttgaattacactacttagagcctagccttgcaccagcacgatacgtgttcctccatcctaggcatacttgaaatatacctagaaccgttaagtggtgggcccacgccttaaacttaatgccgtggtggcggacacgacgggaacccaccgcacaataccgttgtattggaaacgcttagtcacctaaactaccacgtcagggtaaataggaagctcctctgaattatacgaactcatacacaccgacctaccagaatgcaaggctagtcctaaatagattactcagcttaggccatctcatactagcacatgtggatgtacgaataactttaaatgggtgacacaagttcggtccttatggacttgggcaaacactccccctatcggtatgcaactaacaccatatgcacaccacttgccgcccaagtataaaatcacattttacacattttagttcgcaaatacccatcatatttattttattccagcaaaggttcatgtatcaaaatcatattttaattatagatggaatgagcatttgcatagttgtaagcatggctaagcaagtagttgcaaatagagcatatataaacccatttgagcacaaagagtgtactctaaccatttctaggggttcaaacagcaagaggatcaattattcaaggtggggtatgcagcaaataggtcataactaccttaacccaatttcaaataccgatatagtctaagttcacatgcaactttgcaaacaaatattttcattcctcaaatcatgggattcaatgtgttcaaaggatgggaggagaaaacttgccttgatcagagaaatgttagcacctaatccactccttcaccgattatgcaattatctagataaaggacacgttatgcaattaaacaccgaaatagctaaaaaatctaaaatgctctaaaatgcatgatttatgcacagtgattaggtactgatctaaaatgaattttaggtgaaataatttttattttatcttattccattagggagttatgaattttagaagttttatcgatttatagtagtatagtcttaggtagtgttatgaaatacttttgtaaagtgatttttactagattagacttcacaggggtgtagagatgtgttttataagactaactcatttggtttcacaatttttggagttacaatgattttcttatagattttacaagttacaacgtgttttaggcatatagtgttttatatgtgcatgactctcaagttgtaggttcagaacatgctacttcctgtttaagttgaataaaaggaataatttggttaactaaaacatttttagttcacatgtttatggtctttactactatggttcatattttataaactagagatgctataaactaaactagcaatatattatattaacctagaaattgttatatgagctaagttcttctaagttttagtggatggggatggaactatggcctctctggtctaacaagttttattttggtttattcatagctagaatgcatttttttaactaccttacacatatattttgcttaaccattactaggtgattaactcctaggttatctatttaaagattagagctataatatgttcaaaaggtgcaatattttattttactatgttgaagctcactatttgctggttctatggaaatttggttcatttcatttggactaaagatgaattttctacaaattttacaaagtaaaggttgctctatcttggttattacttacataaatatttaaaggcttttattacatagtaggtgtataattttatttcatggaagtatacgttttgttgattctacagaacttgggtttactcaaaaaggatctaagatgaattatgaattttatgtgaatttctaaagttcagcttacctaaaactagtcattttaaagataatagtttcagaggcatttgatctaaagtatgtatacaatttcattttactttataggaaaacataagttggtggatctatagaaactgagtttgctataaaatgagttgagatgaattttatatgcattttataaatttgtgtatggtttatgtatgatttatcttagaccaattttagagacaaagtttgtacagtgaatgtctagttttatgcaataactctaaagttcttgatttggtgagttcacagaaatttgatttactctaaaatgagttgttttcaattttttatggattttataagtttacatgttttcctgttgaaaatataaagcttttagtattatctttttacattttcagattttaaactcatggggtccacctgtcagtatcaggccaatatgcaaaaagggccctaggattttcaggaaatcaacccgcagtcctaggtccatatgtcattgattgggaacattacgtaatgaaccttatagttatttaaattctcaaactgaagtccctgactcctttttcacacgcacagaggcagagcagccatggctgagctcgatcccgggttcaccggcggcgattggtggctcggttggagttggggttaaaagataaaatgaagagcatgttcttgcgattccattcctctagttttcttggtcagaggacatcggagtagcgccgatggcgagtgtgagcggcggtggttcttggggtgaaagctcatgtgtgcatggaaatcgattccgaacgatgcatgcatgtggtcttctagccttcaggatgctcaccgtgggtcgagctagggttttcgaggtcttggcggcagcggtgacttgtggaacggctcggcgacggtgctcctcctcgggtgaacgacgacggctcgaacgggacgatgagctgctacaagcaagcatgcacgaggtttgtgaggtcaaggagatggtgtatgcgcgaggaatcgaacaatggctcaccgaggcagcggtaatcgacgatgacggcggaggcgattctagatcggcgccggtgaagaaaagatgcgttctccgagtccttcaaatctccggctggggttcttgaggcgtattgaagaggagattgaggcgatgacgatggcacaacggcttgctccgaggtggtcaagaatggccggacgacgacgatggttgaagcggcggcgctccggtgcgtgctccagggcgtcgtcggcgtggtcgcgttccggtggctgtgatgcacaaaatgggacgtggtcaaaagagaaatggttcggcattgtgtggagagaagggaacgcgaaaaacctggagatgaactttacccaatcagcgatggcgatggtcgtcgtttccacggccggcggcaaggtttggggcgatggagaggcagagaacctcctccctcggtttcttcggctctgagtggtgaatggagaatggcaacgcgtctgggaggagtagagagtgagaaaagggaaaccgagatcgacgacacgttgcggccacgcgtcggctcgctcaatctctccctctctcggctggagcagtggaggaagtgatggacagagtcaaggcaagcttaagaggctgtcaggtgggtccaggtcgtggcaaactaggctagggtgagagggttgggtaagattctgggtaaacttgatttttagatcatttttcggaattattttctcctctaactttgtagcttcataacttaatgtgtggaccaaattatctagtgttgaatttactggaggtaaatgattacacctagattccattttctttggttgcactcaaaaataatgggtagattaatcacagaaattaaacaaagatgggctgttagaaagctagattgaatttttaggaggcctaaacagaggaggaaaattctagaaaaattatatttaggcatgataaataatctagtatttgaataaattattttccatcttcacttatgagcagttaaatgtacttttggatgaagtatgactttagccgattaaaatttaatttgattccttttagttttctgctttgactgattaatttgtggtattaaacttagttattaacttgtaccaatattatagtgaattgcttgtgctaaacattatctatctaatttttttccatgattttaacttgcacataatattttagagaattaggattactttactttgtatatgtgttcccacttcataattgcacctaatattgttacagggattacattaaacttcttttgggctgagaagatgatatttgagtttaatattaagtccacatgttatcacccaagattaacttttgtttagtaattttaacccttttagtttatgctcatgagacatattatgaaaagcaagaccaaaatccaaatgcacaagagactcgagcctaggcatgcattatgcacatgtatgctcatatacttggtgacatttctagtctaatgttgggaatgaaaaggttttattttgttctcaaattttaatcatgcaatgatttaagttggtcatcacctaaattaaaacggaaatttttgactctaaaaattggagaagttaacctctaactattttgacaagaaattttaagtcctgaaattttgggtatgttacaagtagcccccgacttctctctcctttccttggaattcgcaccggcggaggtgcgtctatttaagggagttttggggatcccatttgaggtctgcctgttgaaaaaactctccagcttccaagcgtccctcgtcttcttcgctcccgcaaaaaaccctagccaactcgtctcggtcctttctccggcgatcttcggtggccatggatctcgacaagtctacctccaccagtgcgtcactgaagaaactgcaagaggatggcgcccttcccggtcgcgggaccgcggagagggaagtaggaggtactgaaccccagcctgtcctgggtcgcatggttgcggttgaggactttattctctgtggttttcttcctccgccttctgaatttctccttttggtcttgaatttctatggtctttccttgctccatttgaaccccaattccatcgccttcctgagtatttttacgcatctttgtgaggcctacattggggtggagccgtttcttgacctcttccgcttttactatgagttacgctggatggaatccaaaaaggtgtccgggtgtgttggtttccgacttcaggatggcctgaagtcgcgatacatcccctttcagtgcctcacatctcgcagcaaatagcgggggaggtggttctatcttcagatagaggattcggatcctgtcttcgttgtacctaaggaacagccagacaagatttcatcttggaccaccaaacccgccttgaccccgtccctccaatctttcatcgatatcattgacgacctccgagaacgggggttgtcggggtatgaagttgctgccgacttcattggtaggcggatccagccgcttcaggctcgagcccatcctgcctttgattattctgggccagaggacgcgacccgggtttctcctcagggtatttcctttttagttaaattgactcccttatgttcatgtttttcccgtcttatcggattctgttctcaatctacaggcttgaatagcgcaaccgtggagcgccgcgtccgccaactgataatcagcggcccgacaacggcgagcaacgtccccgtcctcctttgcgagaaaggggtagccgagcgcgacgctgccatcaatataagtgtacttagctgtccttttgcatctttcttccgggatcacattatgacttcatgaaacgttggctctccctctgactgatatcatcgggtcgctcgtggaccatcaggtggcggcgtcgctgaaagagaaggtcgccaaggaggggtctgacgctgctgttgccactaccacgacgagtggcggcgacgttccgaaaaaggggaggaaattctcctctatagtcggacatcgtcggaagatacccactccctcagtaagttcacccgttatttgatcacgtagtcggaaaacttccacctcacatcatatcgattgtactccaggcctcggacgcgtctcccccgcctccgcgacgacagcggcttgtgacgctcagcgagaagtaagtgaataaatttgaggtttcgtgatttcgtcaaactctgtctcaatcgcagcctttcgcagggcggcgcgggcgaaggcggcgtaagatgggtctggagggacctccagcgcatctcctgccgtggcctcgacggatgtcgtggtcgtgcccaggagccatgaggcgacacctagcggcccagccagcgatctcgtggctggtcgtggttcgccggatgccgtcctcacctgggaggagctctaggttgagatggggcgcctcctcgaggctggtggtcacggtgttagccacgagatcgcggaggcgagggcggcggctgcgtcgtcggcgaatgagcgcgccaatcggctggcgcgtgatctagcggaggttcgcgaggacctccagaagatgagggaactggtggccggcaatgagcgacaacagcaggggctcgagcaccgcatttcggagcttgagaacaacttgtcggaaatccgtggctcgttgtgggtcacatatactggtctgcaccagctcgccggggagtgcggtatcaagtctaccatcccggcgaatcccgatgagttctcgctgatgtcttctcttgcggagctggtgacggcgatggaggagatcccctccaagtatccagccaggatcggagaggagacgtctaacgggatctacaccggggcgtgccacgtccttgcgtgtgtgaggctggcgcaccctgaactcgatctgcggaagatcttggatcagggggcagttagcgacgcgcgtaaggatgtgatggaggaggtcggcgatctggggagtccgtcctcccgctttttgaagagtagggtcttagctctcttgtactctttagtcatgccttgtaaaacttttattggttccaaccgccctagtgtgtgcggtcattgccttagctttgtttggcattttgatctcgagtactttgttgtcctttgtagagatgttgatgtcgaggatgtcctgcggcgcgggcaacctgagttgctagtggtcgttccgttacttgcgtccgaaccatatgtgccggaaggcgatgtagatcgaagttcgcctgtggaaacgagcatggcggcgactcccttaggttggttgtctttgttaccatttcctttgcccttccgtctggatcgacttgatttgttgtgttctcgggagagaagagcagcttgacttagtcgtttccatgctgagcagatctcgagagtgcgcttgttgaccaggaccgtcccatccagtattgtagaacgaagtttgaggttgcggaactcgagaggactatgctggaggtgagaaaggatcaggccgtagagacacttcggggtcgtgagctgtggttcaactcgtatctaaagagatgctgcacatccatgtcgagagtctgtagagagcatcgagtaccccgtggggatcccgaggaatcggcggccggatacatctcgtggctaaatggggcctgcgcccagctcgaaggcatcggtcaacgtatcgacgaggccttgaagcaggagtgtcgtcgctcaagccgatatgccggggggcacgtgctggcctgtatacgagatcatcgtccgcagctgcacctcgagttcctccgggaagggttttttcgttctcggagaactcctacggagatagatggcctggcgaagtcgatggcgccgctggcggagaaggttttccagtcgatggactggcgttggcctttctggtagtttccatgtcctgtgacaaatgtctttggaagaagtgtaatatagttttggattttgatggaattgtaagaaatacttgtggaatagaaaagaaatctatctaactaagctttcttactctggacgttgtgtgtatgagtgtcttctcacttcgcaactttgatcagtccgttgagttatacanctctcctaacccccagccttgtcatcggagaattcttctcgggagataaggttcttggacctttgacctgcctcggttgaacaagcactgatcgtagcctccagccatgaagttggaaagtttatttccgattacacggcttggttaatacgcacggcgagaactcttacacgactagatcttacatggtctttcgtctctacaggatataacaaggccttatcggctctggtcgtccccagccgaagttcccttaggttcctcggaggccttgtcaagacgacgtaaagggacatgaggataggtttcaacgctaggtgtcatctaggtaagggattatcgggaaggaacactttgattgtcgtctgtacctgaaaaataggctttattgaggctgtaagatgtcttacaagtatggatactattgacttatacatagaatttacgtaattgatcaatgttccaggaatttgccaactcgcggccatcgccgtctgcgattttgaatgcgcctggccacagaacttgtgtgatcgtgtacggtccttcccatttgcgtgagagcttgttgcgccctgcttggctttgaacccgtcggaggacgtagtcgctgatcgaaagcgtgcgtgctcggatgcgcttctcgtggtaacagcgaagggcttgttggtagctggctgctcgaacgacaactcgtttgcgatgtttctcgagtagattcacatcgtcgtatcactgctcctcctgatcctcattggagtacttctgtattcatgtactttgatgtcgtagctcggtggggagcatgccctctgagccgtacacgaggaagaagggtgtctccttgttggacgttgtcggtgtggtacgcacggcccatagtactgatggaagttcctcgacccacttcttgtcatgtgacatgagcctgtcgtagacgcgggtcttgattccttgtagtactatgccgtttgccctctcgacttgtccattgctctgagggtgagaaaccgaggcgaagcagatctttactcccaacctgatgcagcaatcctggaaatcgacactgatgaactgggagccgttgtctgttatgatacgatggggcaatccgaatctgcagaatatccctttgatgaatttgatggtgttgtcggccttgatttctcctgtgggtgtcgcttcaattcacttggtgaatttgtcgatcgctacgaataggaacctgtagccgccttgtcctcgtgggaatggcccgagtatatctatcccccagcacgagaacagccaagtgagagggatagtctggagtgcttgcgctggcagctttgtgtgtttactgtggaattgacaagcttcacaccactgaaccatgtcgcaggcatctttgagggcggttggctagaaaaacccttgtcggaaagcttttccgactaatgtccgaccggcggcatgtgacccacagatcccttcacgtatgtcgaggaggaggtgtctgccgtcgtcggacgagacgcattttaggagtaccccatttggtgccttcttgtatagatcgttgccgatcatacagtagacttttgctttacgggatattttctcggcttctgcgtcgtcctcgggcaactcttcgctgcttatgaatttaatgagtggggtgcgccagtcgtccgtggtctcgatatcggcaacggcgcgctctgcctctgtagcccccgaggtggtgtcgggggcgaccgggctatcttcgccgcttgcctctttcactgatggcctcgtcaggacgtccagaatcgagctcggtaccaagtggttctcgtctggacgcacatcatgctagatcatccggttcgatgttgtctttacggtacacatgtcggacctcgatcccatcgaaccttttttctagcttcatgacttctgtgagatacttggataactcggggttagagcacttgtaatctttatgcacctggttcgtgactagtttggaatcccctttcacgattagtcgcttgactctgagtgcagctgcagctcttatcccggcgagtagtccttcgtattcggctgtgttattggttgccctgaagttgaggtgaattgcatgcttgaattgatctcccgaaggtgatgtcaagatgaatcctgtccctgctccctggctgttgagtgcgccgtcgtacgccattgtccatgtttcattgtcgatttggttgtctgacctattatcaggcatggtccaatcgactacgaaatcggcgagtacctgtgacttgatgattgttcgtggcatgaagtagatatcaaattggcttagctcgactacccatttcgcaacgcggccgacaacgtctttgtttctcacaacttcaccgagagggaaggaggagacaactgtaaccctgtgggcttgaaagtagtggcgtagctttcttgatgtcatgattactgcgtagagcagttttggatctgtggatatcttgtctttgcgtcgtggagagcttcgctgacatagtagactagtcgttgcaccttctctctctnnnnnnnnnnnnnnnnnnnnnnnnnnnnnnnnnnnnnnnnnnnnnnnnnnnnnnn

SEQ ID NO: 17007 - DNA, 12626 bp, Oryza sativa
  unsure (1)..(12626): unsure at all n locations
gcacttgatacgcatagtgagatgcggccatgagcttcacgagtgcagttctcccaatgatggcattgtatgctgtatcgaatgcagcgacatcaaaggtgatctgttccgttcggaagttgtttgcttggctgaaagtcacaggcaacgtaattttgcccaatggtttggacgatgactgaggagtgattccatggaagggttgatcggtgggtgtcaactcgcttcgtgggatccccatcgcgtccaaggtgctggcgaagagaaggttgattgagctgccgccgtcgatcagtactcgggcgaccttgatattacgaatagtgggttcgaccatgatcggatattgccctgggatgatagcagtcttggggtggtcctcttctgagaattctatctactgctcggaccacttcatcttgggcgcggccccctgccacgtcgaacagacttcacgttccactttcttgtattctcgctttgaggagtatgccgtggaacctccgaagatgtgtgagacatggagatcgtaatctgggtatgctaagtctgattcctgagtaggcgccttagcgtccttctcaaccacgcgtactcgcttgcctttttccgatgccatgtgtttggcgagcgactttttgaagacgaggcaatcttctagagaatgtctgtccgtcttgtgtatagggcaccatgctttcttcgtgtcgctgccttgtgggtctgggcgcttggcagggtccgcgtattctgttgcgagaacttctgattgagctttccttttcccactcttgcgatttttctttttgcttgactcaggtgcgtccttggctggtttcttctctccttcggtctttggtttgtcgttcttgcatctcagtgcgtcatccgcatgagcgcatcggtcgacaatttcgaataatctccgagtagtcatgatgcgcctcgttaccaactcctgagtagtatagcgatctctgacaccggatttgaaagcgcgaattacagaagcatcggtgatctcggggattgtgtttctgcactcgttaaagcgccgaacataatccctcaaggattcgcccgggttctgtgtcaacgcatgtgggtcatcttcgatcgcgtggcgcttgtaagttccttggaagttggctacgaactgctgccacaagtctgcccacgaagagatcgagttggggggaagatgcatcagccatgaacgtgcaaagcctttaaatgcggttggcaagtaattcactaacgcgttgtcgtccgctccggcagcgcagagtaccgtggagtaaacctaaaggaactcttctgggtcggtgctcccatcgtatttctctattgctccaggtcagaatctttcgggccatcggacatcccgaagtgaacaaccgaaagctctacacccaacgctgggggcggtgggttgttggcgatcatgcgtccttcgtggatgtctatccgatgatgaagatgacgaggatgatgacgatgacgatgggtcgtctagttccggcgtacgattacggggacgtcggccgggttctcgagaatcctgtcgtcgtctcccgctgttatctcggtgccgatctccatcatcaccgtcattattgcgacgtcctcgaccagtatcgcccagtacccgccgttcgcgatcgttgtgatcgtggcggttgtggcggttatcatggtctcggtcttcgcttgaatgacctcctcgatcttcgttatcgtgacgccgtgaagagatatgacgccgggaacggttctcgttgtctcgtgtgcgtcgtgcctctcggcggccattcaggtgatcgcggagatcgccggtgccgcgaggtggaggggttgctcgatgaggtgattccgccgttcagggtcttcaccatttgcatcgcaagttggtggctgtttcgggtgcgctgcagcagcggcctcttcgaacgcgttgctgaggttggtcactaattgcgttgacggctctgatgtgttgggccggagtagtcacttgattctccgcttccgcattggtgcgtgctgacgtgccgacatcgtcgatagccaatacctcacgaggcgtactcgttgtcgatgatccatagtcttcgagtaggtgcaagactgatggttcatggggatcgatgtcgattaccccaacaaatcgatctgaaatcggcgtcgctccttgttccttgtcctcatccctgatggggatgcgtgactgctggaccttaagaggtggcgtcttcatggcgctgagaaagaccttgcagctcgagaggtcgtgattctttgtcttgtgaataggacaatagacatcacgagttggagaggtacactgaattccacgctcttcgcaggcacgaatttcagcatggacgttgagaaagacccagcaggcttgcagggtgtgtttcctggttttgtggataggacaccaggaccttgtcacctcggaagtaatcctcgtcggctcgtgattcctgtcggaaagacaaggcttggccgcactaggatccttctcgggtttggatgtcgttaacgttccgatctccgcttcggtgggaggatccttcgacatggagttgaaaacatgaaaagaaaaaaaaataaaaaaacatggatcttcgttaactttttatgattcttttttttcattaaaacatgttttaatccttcgacatggctgagatcggcattgtggtgtaaaccggaaagacgtttcgccgacttgagtccacaccagtgttgttgaagttggaactccttggttgaggttggtgttgacgctgttgtcgacgaatctggatgtcaaagtagtagaaccttgagcaccaagtccccctacctggcgcgccactatcgacgggggatacccgtagaccggatatagagggtattggggtacgctggtacgaggatgtacgtagtacgacatcaagcaaacaggaaacagggattatactggttcaggccccttggtaggtaatagccctaatccagttgatatgggattatatgatggaaaccacatattacaaagggaatagtaaagctcgacgataccgacaggatcgtagtcgagttgatccgactagatctcccggcgacttggcttcgataagctctggcttcgtaggctgtggtagatgtgttggctctaagatttaatgccttaggtcctcccagggggtcccttttataccgtaggtcaactggtctccatgtcggactcagagacatcggacccgacacgatataatgacggccgatttctatccgagtaggactctttccatctgtagactccatgatggacttccttaacctatgctgagaacgtccgtatacgcgcaaacatactatatcgatacgtgacgtatatcgaagggtagagggtataccttacccgtaaccctgatagcgccgggagccggagccgctgtgaacgacaatatcaacggaggcagtttgcctcacaatccagcggagagacattcacagggtataaccttcgcatactgttaattcaatttttgatacttctgttagtcgtaattctattgcgttcgttgtatggtcatgatgcttattatatcttaagcatgcttctggttatgttagattttatcactagatcaccccactttgttcatgccatgattattgtcttaatattttagattaaaatatgtcaatatatgactatatttccaacaactgacaccgatggctttggtaagacctagcatctggcactcctccatctccctccatactcgctccatgtccatcaccgcaaggtcctccttagcgaacacagccgatggtgggccttctggaactccaaggctcaccggaaagtgaaccaggtacaagtcgatgtactccacttgcaaattcctacatacatgaaccattgctcaaaccaactacgaaaatgcctgcctttatcaattgtcaaacatatatatgaacatactccctccttccctaaatgtttaacgctgttgacttttttaaacatgtttgaccgttcgtcttattcaaaaacttttgtgaaatgtgtaaaactatatgtatatataaaagtatatttaacaataaatcaaatgataggaaaataattgtgacatccccgcccagagcttaataggattaatagaatactacaacttctttttcggaagccgatctcagaagaactctaaggttaagcgtgcttggcctggagcaatttcgggatgagtgaccgaccgggaaattcttagcgggtgcacgagtgaggacaaagtgtgcagaaaagatttgtgttggtctgcgagggctttctatgacctataaaagctgccagatataagcgggacgttacaataattaataattacttgaattatttgaataagacgaacgatctaatattttttaaaaaaagttaagggcgctaaatatttggggatggagggagtatatagcgagctctaactattggtgcatgctaaccggagtgtcctacggagtgccggcaccacacgaccggggtgtgcatcgctgatccataatttggatgtgatgtagagttcatctcgcgatgaaaccaaagccaacgcgcaccgcttctgtcgtggcctcaccaagggcagcctctgtgccgtaattggccgccgtgtcgaagtgacggtacccgactttaatggtgcataggacggcctcggtcacggcgaccggatcggctatatgcctagcgggaacgttgccgtgcccatgcctacccacggcatcggcttgccggagcttagcgccacctccggcatccgttttccctctgcaccgtccgcagccatggggggatcgaaggggcaattgtgggagatacaggattgatgaagtatatattgtgtgtccatactactaactatatatatatatatatatatatatatatatatatatatatatatatatatatatatgtatgtctaaatacgtgttgtcgccgcagcctctaattaatgcatggagagctataatgctatatatattatagtatgaatgtttgcccatacgtgtcgggagtggctgcaagttggaagagccaaacgtgtctatgtcagcaatcaagcgtatgacagcatccacacacactgttattgtatttttggaaaataagaaaatttgttttcttaattacactagtttatctacaacaactgtacagttaacacaatgtgggtgtgacaccctgcatagttttcttactgtttggtgtttgcgctaatggagaacatgtcaacagtcaactgtgccacctatcggcatcggttaagaaaaactcacactaataatagagggagggtttcctgtccacccacctgacccgcactgacagtaaccctaaacccactctctaccacaccgtctgctcaactcctctccctctcatctacctttttcacttctttggtgagcagcacccacctctcctgcccttatgtggtgcatcagccaatggaaccagtcacctcgaaccagcccaatgcggtggagcaagcggtgtgagggttatttccacggtgacggcggcagatccacggtgagcggcagtggtaaaactacggtagatccacctgagcttgacagttacaagctaagtcattctatcctgctcctctctttagggttcaattttttaatttagttagttgcatcgggggtatcgatatggtcacaatttccaaaatttcggttattttaatccgaaataatttgaagttttaaacaaaatttgatcaaattcaaatatttttgtggaattcacgaatattgcaaaaatccaaaaattccaggtgaaataattttgtatgggatccaatagacccaaaattttgtaaatttcagtccaaacttttgttccctgcctctctctcagctttcaccacactctttctttttctctccctctctctcccatgcagagcggatctgaaacgcagctagcagctgttattcttttggggtgactacgaatcgggcacccgacgttatttctcaagatgtattcaaaaaatgtttcaatattgaaaatggtaaaacacaatcaatcaaatcatacaatgaaaaattttggtacaatatataaaacaacacatccaagtgcatcgaaaaaaatgaaacaccatggaaaaccccacaacaacatttcaatttaactaatgaaacatccaagtacatgaactgaaacatcaaatattcaaataaaaaaaaaaaactagatcaacccctccctctgctccggtggtttgccaccacatcgatgtcggggtgccgccatgggtgaggaggtggcaccggcgtgcacctatggagatgacgctgtggccgaagaaatgctcaagaatctctaccacctgctcctgtggccactctgcaacaccatcgcccgatgccacgccgagcagggccacatccgtgtggctgccgctgtgctaagcttggccacgtccttgccaccaccactaccatggctttgctcttttgccaacccatgagcgataagctcttcgtgaatgctagcccgttgcctcacaaatagagaagagaaaaggcgtggagagaagaagggagagagagagagaaagggatgatggaatggataagaaactatgcctcacatccgacagtgatgaaggggtatgtatatttctatgtgtcagttgtaagaaccggagctaatgcctgcttataaacggcactgaagacgtttcctgtggtagtgacgtagtgtttcactatttcggctggtaacattggcaatttatttttgaccggaaaatagtggggaaatcccccacggtaattttcattaaataaaggaactgtaaaaaaagattacaaattgtcaatccatgattgaaaagagggtctcaaaactactcgaagtctaggtaaatgtagggttggtttggtttgagtcctatattggccttaccaatatttggcaatttcaatagtgtttattgtctatttggtttggagccaaattttggcatgcctaagaaaataggccatttcaacagttaatttaggctattttggcttcaatccaaacacaatttttcctttgccaaaattagccatgccaaaagttgccaaaatttgacattgacaaaaattggtaaggccaatttagaccacaaaccaaaccagccctagctcctctttcaggcttgctttccatctactgagagagggagatactttgttgaatataagatcatttctctgcctccacaagagccaagcagccactaagaagatttccatgaagcaaaaaggagacaaaaccaaacctctgcacttgaatcatttgatgaaaatcaagagaagtatcccatgagaacccaatcatattccaacaggctgcagcaaaggggcattcaaaaaacaaatgatctcttgtctctcttgatcctaaggtacacatgacacaaaaggagggtacatttgggggcttgcaatgctttctctctaagagatcccgagatcccttgtatttgttctgtccaaaaacataagccaagcaaaaacttttgtcttcatatatgctttacacctccaaatacaaggcaaagtaactagggttgtagagaccaaaagcaaagcttgtagaacttctgagaggagtaaatttcatttccccatatatataactccatctaccaggctgtgaattgactgaaatctgtgaaagatcatccagataaattttgtactcatcataagcttgcactgacaagggcaaatggaagtgattatgaactggccggtcttgcaaatgctgggccacattatgatgcaaagtttttttatttatttgatctggcaatactatagtgggggcatatagcgttctactttcattaaattattttactataaaaaataaaccagtaatacaatagcaaattatcttttccttatacaaattggaggttcctctacgagggaacctcatactaaaggcttatattataaaaaattatagagtttttgtcgatgtgtttgtccatcatacgacttctttgatcctgtggtgtattttttcgcccattggtcctctatgtgtgggtacttaaataaggaatccttccgcacggccttatcactaggtgtatgcatttgtgtcacctagctagatgtaatttttccaccttaatactttgtttttatataatggaacatagcattccagcctttgctcaacaagctacaaccaattattacagcctaacactcataatgagtgcagttcaaatagaattatagaaataaaagacaccaaccatgaagaagaaacaaaccaaatactaccaacccaagataaagagtacacaattattaaattatgtttataaacctccatccgaaattggcaaacagatgcataatcgttttctcaagattacgacatgcaatctttaaaagctcgccatcttcatcacacctttgtagttgtatccaagacctaagccaatgtattgctttgaaaattacccaaatatatgaaacatatggtgttttgtcaaaaatcttatcattcctattgtaccatagagcctaacatatagcagatgctcctataagtataatttttctatttttcttgtccactccctaaagccaatcatcaaaaaaatatgagatatgctattaggagggtatagaccaaaagataactgaactgctctccaaataaattttgcataatgacattccaaaaacagatgatgaatgggctcattttttatacagaaacaacatctcaaacttccattccaattcctccttaccaaattattcttagttaacacaacccgtttaagcaagtaccacataaagatcttaatcttaagatgcatctcatatttaacactttgttaaacttatttaacaaataactattcacaaaacttattctgcaatgttgatgccaaactctgtagtctgtactgttaaatatatgtcgaaggaaatgtgcctaattaaggacagctcctgtagcatgaaggcctctctttgtttgggacggctaccaacaacccaaaattagtctagcgcgaggtagcaaatactaggggaaaaatcagttcggatagtttccgatacccgcacgtattttagaaacggatagtctcgaatagattttttttttatagtaccggatttgaaaatgagtacagatagttttttttaaatggaaacaaatttggaaagacgagatatggtaattaagaccagtatccggtagaaatttgaaacggtcagaaactatccggattcttttccatatctccacaggtagcaatcaattttattaaaaaacatctcttttccatatatcagcaggtatcaatcaattttaaaaactaagtatatatgcataactttatcatataaatttagatgaagataaactttatattaaaattgtagagctagacaagatctacaactttgttgcaggcaactttatcatctgagattattttggggtttaaatattcgttaggaaataccatatgtatttttacaactcacacatacgattcaaatgatctctgatggagatgtcctctataacaaagtacagagctcaatgaaatctagtactattttatagtttttgattttttctttatttaagaatatttgaagcgcaaaacaaacattataggtttcgaaggggtaaaataagatgaatagtatcttcaatctagaaaaaaaaacttgctaagtgagatgataagttgtgcattgaggaaggtggtcttgggttcaatcaacggactaggaagttaaaaattacttttacactagcaaaatacccatgcgttacactatgtgaagccaaaaaggagtaggttgnnnnnnnnnnnnnnnnnnnnnnnnnttgatattgatagacaatttttttcatattgtaaagattagtcatagtagaagaaatgtttttggctagctatcagatcaagctcacttcactccaatcccgcaatcactttcactctaaatatcaaaaggaaatcatacaataaatggaaagaaaaaacttgatgtggttaggatatgtaaacccgattcaattaaaaaaacatgtaactgtttctattttacttataactatataaaattgtgcaaaatctaaatcaagagcgctctcgatttagccctaaccagcgaccttatcagctattgtccaaatacgatcagccatttgtccagatatgtgtctttaagaatcttactttaatatagtactaattgatcaagcaagtaaaaaaaatatttctaccatctatgcttcaaataaaattttctcttaaattactcatccgatttacaatccgattacaccattgtgttcgtaacaattaaatctttacaacaagactcacatgattatattttaataaaaaatcacaaattactttatatgttaattactttaaaactttattaaatttacttttatatgtttaagaagtaacttagtgaaatctaaaagtaagttagatatattataaaagtaatttatattttttcatcaaaatataatcatgtgagttcttgttataaagatataattattacgaatacaacagtgtaatcggatcgtagatcggataagtagtttaagagaaaattgtattactattttcatagataatagatggagtgatagctctgtgtagtcacgtctataaaactgcattactatttctccaattcctatttaagctggtgctgctccagcgggaaaagcaaggtggtattattcgtgctacaatactgcgatgctgctgtgatcggttggtacaatatcgtgctgtactgtgtcgggctgctgcgatgtgggctggctactgggctgcggctgctatttgctgctgcttcgtgctgtacaatatcgtggagtagctttctatttttctctttttctcttttattactagtaaaagtgcccgtgcgttgtaccaggtggtgattacagagtgtgtatactgtttggtttagacaattaatctgctaaaaaaattatttgtttttggataaataatctgctatatatttgcgtaatatatatggtgtttagtttggatgatgtgtagcatgagagaaaatggatagacgaacaatgcgactgtctttacccaaaaggcgacggatgaaaatttgtatgatgaacggaacggagtgtgtacagtgaccaaaagatgtattagataattaggatcaatgtgacgatcggaaaaatacaaatatttatattaattatagattgatagatagagaagagatagatattataaaactttcaatcaactatttatttatttatttaaaaaagttattaagaatttaatttgcgttaaataaaaaaaagttattaagaagttgattagcgttaattacgtgacccagttagtgggccgagccttctcgtgtgtgggtagactccatatccgccgctggaaacgaagcgacgcttcctcgcccttatcacaaacgaaacgaagcggttagagagaagagggggggggggggggggctcggacaatgagaagatttttttcgctcttttttaagacggactcatttttttttcatttttttttatcattcacaaaattgaaatcggattggaatttgaggaacagacgaaaatacgaacgaatagagggggcgacgaccggaaaaatctaaatatttatattatagttattatagatttgcggcgcttcacagtccatgtcgcgtgtccggattttgtaccgcgcgaatcagcaatgaattaggaatcgaaggcagataccgatggacgaaaaaaaaattacacaaacattatgtattttttattaggtataggtaggtataggtttagatatgggtctcttaaaaggatggatataaaaatagattttcgcaaatggttgatggaccgcgtacaaaaactgaatatataaaatttagaaatattgacctattgttgtaggaaaataataaagcgatatgtcttcactaactaagtgtaacaccctgaaaattcgaccaacgaaatcaaaacaccaaaaatacggattttcaaaaactttttaagtaataaattgcatcatgccgattttattcgtctatttcattggattttgatctcggaatttattaatcgcgaataatgaataactaactaggaataaaccctaaaaatcaagttggctaaaaaaataattaaaatataaattaaaataaagattaggtgggattggaaataaaaaaaatattatcacgaccatattagcaataattaaattttagtacgatggaatgagaattaaccctaattaaaaattcaaataaattatataaacaaaataggagtgatattaaattagggtgaatttttagttaggataacacaaatatggagtaaactttgtttatgcaaaaattagaatttatagggctatatttaaatagaaaatgggctaaaatcgggataaataggaaaagttactgttcattgcggcataggtgttcgatcgtggtccccctagccccgcccc

SEQ ID NO: 17008 - DNA, 14110 bp, Oryza sativa
ggtagtagtttagatgtaattaacgactaaacaattagatgaatttttttagactattacagattagttttggataatctctataagtaatcgattcactgtagaagttcggatttaatcactaggaattttagacgtatatttggatctttatttgaattttaaccgaattcaaatcgtttcttcgcacgtaattttagagcccgagggagttgcggatccaagcgaggaccaagaaccgcaagactttgagcaaggcaagtcatcactatcccttgaacacgttgatccccaattgcgaaattatttcgtttataaataaaattgcatgcaatgatgaacattctacttgtgtttataccatgccttgattattgtttaccccttattccttcgtaaccatatttacgtatgagtccctagtcaattatgacaattgcttaaaaatgctattctagaatcatgcatactcatatttatcaaatgctaaatgcttgggcaatcacctttgggaaggtaattgagatgcggcatgtggagacatgagcaccacattgccatgaaattgatgacatgatttgggaaaggaaaataaaatgaaaacaaccgtttttgactggggcagacggaggatttgggtggtatctggaaaaggctagtaccgtccccggtcaattaaggaccgagccatgaagttaaacatgaaacgacccccgtacaaccgtacttctcgaatgggtatagacctagcggattagatagccgagcggaggcagtatccctgcatagatggttcacccctgagtgaggcaggcgcgctacggtggggcagccgttgaggtagggccgagaggcatgctctacatcggtgtcgccattggtaggactgccatgagtgtgtgagagagaacttaacttgaaccataatttaatatgtgtgtgagacttctcttttccgggagcgctagaactcctctcactgctagaaacatggacgcctagagtgcatgaggatttaagttcatggagcgggtactgccaatgcgaggttatcaaaaggctttgccatggcgcgtctcatgtgttgggacgaggctcatgtgttgggcagtcgcagagtgcgggtaaagtgtacatccactacagtgtgagtaaaccaaatctattcgaatagccgtgctcacggttattgagtaccgggacatgtattacacttggctagactataaattctttaacttgtgtgggatgggatattacatgatgatttttatgctgatggagccacttcctgagaggtgggaatgtggacgtcctcagaaaaccatgacgactcaatggcggaaagctatccttgggatcacaatggatggtggacagaaccgtcgttgtttaatgtgaacactggtattaaaacttgatcagtctatgctaggttttaggcttatgaaaagaattacaaaacttgctttgcgcaaaagaaccatagccatcctttgaattcttctgtcatgtgcattattgctgtggtggcttgctgagtacggttggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttcggtatcaatatctcgaaatttcaatattattttggaaaataccatatttatcgattacgaatagaagaaagataacaattgagcacatctggcgctccatttcacacaattattttgcgagaagacagaagattaaaattgaattacaaattattttgctagatccccagcaagcatgatccatccagattattggtgcatagggccagcctgcgacatgttaagcaccatcccacaaatcttcgacgcacttgtaaggcccattgtcacagacgaactgcattccagtcagacccctctgctgggggagtttgctgattttgtctctctcttcctcagtgagctcccagtcgaaaatatcaagattctccttcatcctattttcattgtatgtcttcactaacaaaacatcaccctgctcgtacatccacctcaaacaaatctgcaccgcaaattaaatattgaagtctcaattaacatggtatgcccatttaatctcttaccttaaattctgtgaacaactgttttctaaattatttatctgattgaagatctgattgcaccgttaatattaaatcctcttaacaaaatttcataatataatattctaataaaacatatatgtgtttgacgttttgaaatagtgtttcatacgtgagaagaaaaaagtgaatgtttcaagtggaaccaacctgagcaagcgtcttgcccttggtttgggcgatgtcgtgcaggacgccggagtccatcaccgcggcgctgccccacggcgtgcccttcgcccccagcggcgagtacccgcacagctgcaccccctctcgccggcacacctcccgcagcgtcctctgctgccacatcgggttcatctccacctggttcgccgccggccgaaccacggcgaacgacagcagctgctccagcttcttggcggagaagttactgacgccgatggcgcgcgcgaggcccagccggtggcactcctccatgccgcgccacacgccctccatgtcgaacgccggcgccatctcctccttggggaacgggaagtcgtagctgcccggcgccacggtcgccggccagtggacgaggagcaggtcgacgtagtccattccgaggttgcggagcgtctccctcgccgccggcacgacgcggccggcgtgcaggtcgctgcaccagagcttggaggtgacgaacacgtcggcgcgggaggcgacgaggccgcgccggacggcctccgcgacggcctcgctgacgcagccctccgtcgcgtacagcctcgccgtgtcgaagtggcggtagccgagctcgatggcgcggagcagcgccgccgtggtttcctcggaggaggtgaaggggaacgccgccgtgcccatgccgatgcgcggcatggtcgggagcagcgcgctcgcaggcacctccgggatggtcgccattgccattgccgtatgcagtgtagtgtagtggactagacaaggacgtgtgtggctatatataaagaaaaaatggattctgttcaacgcatgccgcaatgcagacaacacatgggacgataatgaaggagaaataatgaaagagaaattcgatcggcttgatttttcgtagctgagtagttgatcacgttgaattatcaacaataattcagtttttctgatttacattgtactattattattagtttactagtcatgcaaatcttgcaaaatgattaattacaaactgtacatgtaatgcccaaagctatgtcacgtgcaaagtgatttgtacacaaggctgtgaccaagacgagatctgttattgtcttatcaagaaatatatataaatcttttagtatcttatcaagaaatatataaataatgattcgatttccctctgacaacctagaaatttcgacaatcgcaccaaccgggatggcaacgatcaggatgctgttcgtccacgatatgcgatcctcgccatcggctagtgagatggggtctggggactccactcatacctaagatgtggatggttctaacagtcatggctatttgttttttcgaacgcgcaagctccctgtatacgaatcaattgttattctgctccaacagttgtaccgaaataatgaataccttgagtaggtagaaatagaaaaaaacaagaattttcctaaatgagaaatgttttctttctaaaggaaattaaataatattaattttgattaatatcagaatatcgaatgagtttatgcttcactaattgaatgataaataactgcaagtaaaggagataggtggtttaaaaataaacccaaaattttaaacatgtatctaaaatcacaacaaaaatagtgaaatgaaattagctcgtcgggaatgcatccaaaatcattatagacccagggaattaattaatagttcccaaccacgggtggagtgaaatccaacaaaaatagatcaagagtcgtatacatttaaactaaatctaccatcttaaatttagcatcctaaataaatttctaggtagctaattaaatttgcaatgcatcatctatggacctatatatgtataccaggggagtaaccatttttcgtgaacgtgtcgacgtgttttaaataagtggataggtatacagcaattaatatacatgtatggtccatacattaattgatcgcagaacgtgtacgggaatggtgccgtgcccatgcctgccgcacataattaagatagatccacatcatgatccatcatgattatttagatatatactccactgtatctaagtagcttgctagacgtcaccatcccacaaatcttcaactgatttgtaaggcccatggtcagagatgaattccaatccaggcaggcccctcagttggggcagctgactgatcctctccctctcttcatctgtgagctcccagttgaaaatgtccagattttccttcattctcttctcattatatgtcttcaccaataaaacatcaccttgctcgtacaaccacctcaaacaaatctgcacgacagagtaattatatagtgaaactttatttgacctgattttttgtttggtttaattaaatattttatattcatttaatttctaaactttcgtgttttgatcacttttgatatacatcctttgattccataatttttgacgttttaaacatggttgggtcaaacttttataattttaactatcgataatttttaaatatttattttaaaagcactacaacaacatatttagatttgtcttacaaaatcctataataaaaataaaaaattatttatttattttatcatagtgattttttatgtaatttgtatataagttggttgagtttgatcacgagatataaacattagacatatatattgaaatattcacttaaagttttctttttaccggttactagctttcacttacaaacaagtaaaaacataataatagtatggtaggcacagtatagagataaattgaaggcttacaactgatgatatgtaaatatgttatattagttatttagagttgttcttttaaacatccaaaatatgcaaaaccactctccaaaactatcttagggagtaatatagatggtattgcaaagtttagggggttagatgttcggttttaaagtttagggtgctaggtggatttgcatccaaagtttagaggggtatttggacttttttccttgttaaaaattttaagaataatggaattggagggagtagtatatatggtatgaatttttctcctacaaaatttagaaaataagtatatcaaccaacctgagcaagcgtcttgcccttggctccggcgatctcctgcaggacgccggagtccatcacggcggcgctgccccacggcgtgcccttcgcccccagcggcgagtacccgcacagctgcaccccctcccgccggcacacctcccgcagcgtcctctgctgccacatcgggttcacctccacctggttcaccgccggccgcacggcggcgagcgacagcagctgctccagcttcttggcggagaagttgctgacggggatggcgcgagagaggcccaggcggcatgcatcctcgatgccgcgccacacgccctccatgtcgaacgacggcaggatcacctccttggggaacgggaagtcgtagttgcccggcgtgaggctcaccggccagtggacaaggagcaggtcgacgtagtccatcccgaggttgcggagcgtctccctcgccgccggcacgacgcggccggcgtgcaggtcgctgcaccagatcttggaggtgacgaacacgtcggcgcgggaggcgatgaggccacgccggacggcctccgcgactgcctcgccgacgcagccctcggtggcgtaaatcctggccgtgtcgaagtggcggtagccgagctcgatggcgcggagcatggcggcggtggtgtcctccgaggaggtgaaggggaacgccgccgtgcccatgccgacgcgcggcatggtctggataagctcgctcgccggcacctccgggatggtggccattgcaacctgcagaagtgcacagtgtagtgtagtggagaggaggacaatgaggtttttctctgtgggtagctatatataggaaaagaatggatctcctccttgaggtttcgtgctgcaagacttaaacaacacaagtgacgatgaaggtaacatttttctaggtgaagcatgggcagggatagagctagagcgaaacagaatgtggtgttactctcttaatttactttactttagattaaagtttaacctaatacaaatgtctaagtttgtattaagggggtacatatacggtgaaaatagataaggtatagtttaaaaaattttctttatcgggttcctgagcaccccctaatatatactagctccgcccctgcatgggtaagttagtaagagatcaatatgcggtacaaagttcatttgcaatataaacctgaaatatcatgggataaacaaatgagcatctgagatttgttcttgttatcatgagtaattttttttgccacaagattaaccataagtaacttttttttttggaataaactatttagtggcatggataaatcttaaacaattatttatatatgctacggtagcttacaggtttgcaaatgctgtgttagttagtaccaacacaagactaattcatttttaccttttctattttactagtccatgaaaacttgcaaaatgtatgattagttgcacctacctgtacatgtccatgacccaaagccgcctaggctgatgtgccccgttgaaagcgatcgagatagaagtctgacgaagactatgacgatctattagttaccttattcagaaatgataaaaacgcatcgaggtttaggccctgtttaggctgtgtttgcttggggaggttgggaacaaatcttcttcgcacggaaaacggagcggtccattaacgcgtgattaattagaaattagctttttttttcaaaaatgaatcaatatgattttttaaagcaatttttgtatagaaactttttacaaaaaacacaccgtttagcagtttgaaaagcgtgcacgcggaaaacgatggagaggtgttgggaacccttgggtccgaacacacccttagtcacaaaacaaaattgttcacgctgtcacatcgaatgtttggacatatatatgaagtattaaatgtaggaaaaaaacaagagttaattgcactctggtccaccttttattgccaaagtttcactttaggctatcctctagctcatatttttactttagactaggtaagattatctttggtgcactttggaccgcccaagtcattttctttagctgcatctactctataatattgtaaacaattgcctgtgtaagttggaaaatattaccgggttacgggctgctgatgtgtttaaagttggaaaagtcatttatgtattcctaaaaagtttatggggtggtccaaagtaaaataaaggtaaagtaacctagcccaaagtgaaaaaatgtgttaaatggtggtataaagtgaagctttggtaataaacggtggccctaaacgcaatttactaaaaaaaacaattacacagattgtgtgtaaattgcaagacaaatcttttaagcctaattagccatgatttaacaatgtgatgctacagtaaatatttgctaatgatggattaattagacttaataaattcacctcgcagtttcctgacggaatctgtaatttgttttgttattagactatgtttaatacttcaaatgtgtgttcatatatccaatataaaaaccaaacccaaaaaatttttccaactaaataaggccataatctgaaaacgtgtaaaatgttgtgatattaactagagaacgaaatagagtgaaatctataaccgtagttctagagtgagtactacatgttattaacaatgtaaatatattaaacgacagagtattgtaaaagtaaaatttataaatagctgaaatttgaattgtggaacgaagaatagatgtaaacacagtatgagattaattgaaattagaaatggaagataaagtaaaattagcaattgaaattcaatacgagttaccaaacttgagtccctacaatactaaattaaactttggattaaaatgaaataataaaataattccgagtcaatataaaacaatacacaatattattttaaaattcaaaacaaaaattaaaacaaaactactcctccaaaacatggaaaatggttaattcaaccagtacaatgtacggaattggacttggtgattcttcactctctagtatgtcttgttatcattgtccatgtaatctctataatgattgattatagccttttaaagaaaagatgggaataaattctatgattaaaaaatatgtctctccctaattgttttctttatccgaccctgcatccatgtatgctcttgcttttgtcaggatgtatgtcagctatatactccataactcttggtcaagtatgctatagctagagctagcttatggcggccactttggttgaccagaaacagaaaggcaagtggctgatggctgatgacattgttccgcttgaagatatatgcttttttaaaataattataaagtacaacacagacactcacaacatacgtacactcacccctataaacgcacgcacgtaaaccctactcctacgagcatctttgaagactgagctgataaatcctaaagactgacgaagttactacagacgtctcgttgtggacgggtgcatcacatgccactaaaagcacaaaaccgttaaaatctaaaaaattctctcccataaaaatcaaacccaggatttaaggtgctactaaagtttaatgaggcgcgaagatatgtgctgatgcagtaatattgttgcttctttccatgcaaattctttgcccgtcgtgtgtcaaaaagatggggccactagccaccaatttttggaattatcggagaaaacagccttcccctcacacacagcctaactgttggctgcttacctggttcgttgcatcccatggcgactagcgtaaaacacaactacgaaaagcatttttccgtgggttcaaaaagtgttttttctacagagatcttacccgtctgcatcaggtgtctgggaaaataaatatttttccatgcgggcgatcaaccacatgaaaaaatacatctttccgtgtggtcaggttaagtggaccgcacggaaaaatctgatttccacgtgcgggtgcttatatcacctgcacgtaaaataaaaatcccaaaaaaaataaaatcaaaaaatccgaacccaaaccctagaagccgttgtcgccgtcaccatcgccatcgccgaatctgccgccacccacatcccctaccaccaaatccgcggccgccgcacgtggggagggcggcgccactccctaccgcctccttgttgtcatcggtggcggcgaaagcggcggatccagccatcgtggcggcggcggttgcggaggaccgtcgtggtaccgcaccgctaaaatgcgggtcccgcgtgcaccgtgctgcctagcgatttttgagactgtgcaggcactgttttcacactgtttgacacggcttcatactgtttggcactgtttgagcgacgatcccgcgttgtggttacgcagaaccgtcgtatgaacagtacaaaacagtgtacaaacagtgattgaacagtgccgacgcggtaaaaaattcgatgtcatcgtggttccgcagtttcaagctgtgggactatcgcggtcccacgctttcgtcccgcgggaccatcggttttgtgttttggatctgcgggactgtcgcgattccgcgttttcgttccgtgggacggatatatttttatatgtatgtatataaatgtaaattattaagaataagtatatttgcaatttttttcccaatccctctcacctttcaagtgccagccacgccgtgctgaacgcgatgagcagcagctggggcaatcgcggtccgacgtgtcattgagggtgggaggcgaagcgaactaccccatgccgatgaggacaaattgtgggcttaaagaagacttttaaggctctgaaatgatagtcactttttatttttaataaacctggtttcaagagaatttttaggggaaactagttttacattccttattcagttagcatgcgttttgagaatttgtagtgtattggcaaatatttgggcggcatgttttgcacagctcgctgagctgcttccaaacgatatttttacagaggagtgattgttgggctctaggctgattcggtgaagtgattttcggagctagtaaaaagaagtggcttctgctgattaacctagtgaatcactttcagtcgcagaaacgctcctttcagaaaatcagaagcaggaggaggagctttacgtaccaaactcaaactgacccaaagtgtgtactggcagcagtggcggaggcagctgcccgggctccatgccatcgcaacacacattgctccacagcataaacatcatttactcattaattgcttacataattaccttgcttcctggttccaaggaaggttaattagatgactagcgagttgtaccacatcctaatcttgctttcctgatgtatagtagccccgtactctaactccttgacaataaacaaccaacatttcattgataaattgtaacttggcaacaatcaactttaagtctagataaacggtacaattttccatatatatatatagggcatgttcactttgatgcaaaaaaaaaccttaccaaattttggcattggcacagtgtcggatcccaaaactaaatattcggaaaccgacatgtttaactgtatcaagccctggatcagtagattgatacagcttcaacaatctggattttcattgcgtacatttgaacaaggctccaaaggagatgttattacataaattaataggggaatttacaagattgtggctaactattacagcagaagctatagagtgtctcaactctaatattttgctatagacttaaaccatctaactaatctagatttgaaaactaggttgaaataatgctaacttatatgattgaactcctggcttcggcaagaacttcaatttaactctggaaaaaggggtttgaagcaagggtgagtacaacgtactcaccaagctattatattcaataatgaatgtataaaaaggtaatatttgagtaggattacgattacttgcagaaggcagagaatatagaaatagaaagcctgatgttttaaatgtagcagcatttagtaaaatcttgaattaggtttctaaccaaagtaccatatgagtcccgatactcaattccgtgagcacggctattcgaatagattcaggtttactttactgcagtaaatgtacgctttacccgcaatccatgacatgccaatattcattagcttagtcatggcaaagcttttcggttactaacatcagtggcacctgttccatgaactctcatcctcatgcgctctgaacgtaacgttatcagcagcgagaggagttctggcgttcccgaggtttttagagagagaactggttgagagacccccgtcatctcaaccaggttttcacaatacacacacacttgagctcaacaaatcatttacctgcgcctcggtaaatgttatatttgcccttcgcggcataggtttgcctcctgcgcgaggacttaaataagaaccactgtacagaggtaccacctttgctagataacctactttgcaaggtctgtccccattctagaattgcggtcgtactcgttcgtttgacataagtagttggtaataactatatcgactgagacagtactagccacccggaaatcaaccaattcgtacgtactgtcccaatctaagttcattatatttttatgcaaactaactaggcagggctaagcaaagctagcatatctggtttgctatgttcaggttatgtattcaaaatcatgtatgactaatgcatagaatataagagatatagaatatagggcatttatgctcaaaggggaggaataataacttgccttgctccaacgcgaataaatccaaggtaggcaacctgattatctgatccttgaaataccacaagttgccatccaaaataaaataaactctactgaagaagaggaagagccaaattcaataaaatccataaaataacaagaaaacgataaacgactaaaagggctagggtttagggtataacctatctcctttataaggtataaggattactgggctaatatgtgtaggttctaaaagattggagactaaagtggataggagattaagcaacatttgtcgcttatatttcatctgtgggttttagttgcttggagagtaagggatataactggttaagtgagtatgtggctagtaatggtcgaagttgggctttggtagaagaatggctaggatttacttgttctcgagtcgatgctgaaataggatagcatatcggctcgtatttcatgtataggttatgagtagttggagggtaaatggttgggatgatattgtagctggcgtggagtctagatagcaagctgattgaggtaggataaatatcagttagggtttaggtgtttgctagtcgttgctagagttgggcagcatggcgactagacttagcatcttctctagccgatgtcaacagacagtataacggctagagggataggaggtttgtgtgggtttagtggggcggaagtgttactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttcgatcttgggtttgggttttgccaggctttacaaccaacggtccaacgtcggggtcgatagaccgcacgaacgtccccatgaaaggcgtaaagttccaaccggcggctttttagtggctaaaaggtattttgaaaataaacggaaatattcgaaaagcaaatataagtttaaattgtaaattcaattataagatcaaatatttatccaaatggtatttgaataaattaaggaaatttaaataaaatattaaaatagcaaatttggtaccaaaatgtagattttgaatttagatgaatttaggtccaagtttcactggaatcggatctacggtttaggagatatgggcttctaaagattgggttttgaattaaatctagaaaagacaaaaatacactgttcatgggcccacctgtcagcctttctttttctttttc

SEQ ID NO: 17009 - DNA, 3974 bp, Oryza sativa
tcgaagaaaactagtccataggtagataaatattgtatcgttgaatctctcaaggtcgtttcctttgctttgctagctagctgcagaagaaaggaaaagctatagctattagagagagaggagggatcagaagaagctgctagctgctagctcgctgccggccggccggccggagaagtacctctaatatatataagtccgtcgatcgtgtcagccatcgccggcgccggcgttgatcaggaccatcaccatgcatccaccatactgaaatctctgtggaataatcctatatatcgcccaaggtatgttactactcccttaattcccttcgtgttcttttgtttcgaactaagtagcatcatatatttagaggaggagtggtatgctttagctatatggacttcaaaattaaccatagctgatgtacttgttcttctgcacaaaattaattaacctaacctcgtgaaattgcctagtaagcacaaaccaagatgatttagcaatctccattccatatgagcacacgcatgacatgagagagcaaattaagtcagcgcaaacgccgtagtgcgctgctatgctgaatagcaattaaggttccagcttgcactggttctggatcaaggccaattcttcattaggctactaactaaggggatttaatttctgggtccgaatttagcaagatttgttatattggattatccgagcagcaattgatcgagcttctttctgcgagtttgttaatactagattaatctgatgttttctttgattaccttcggggaattaatttgtgagtctatatcatggtaattaatttatttaactttttttttgaaacttaaacaactttattaacaaagacagagttaaggggatacaccctagtacatccacagatggatacaaaggtagcagaaacaccatctttaacgagatagagactaaccaatctaaggaaacaaacttccagatgcgactaaacagcagaagaggaccagatcgacggagctttgcggcactgccgcgacgactgaatccttgggcctccattggtgtgcacaccgtttgacagaccgaaaggctcctacgcctgccaccgcggtaacggcacaaatcggaggtttgatactgagccgtagattttggtgtatgcatcaccggactcagcaaagtggttccacggagtccactgttaaatctgaggagcaaaaattgctcaacccgaacggtagacccagcatggatactgctattttcgaacaaaaggaaatttgattctaaagaacagctagccaatatcacaaagttaaacagatggttgtgatggagcttctgtctttctaggtggccaaagattgctgagatagagagccactgagtcagatccgacaaaagcaaaagtaatgaacctttaatgttcaccgccggcgtcggcaacaaggcatccgccatctggaggtgttcaaggccatcggctgagagtagcaaggagggcaacagcttcgttcttgacttaattaggtcatttttttgcaaacacgcaaaagacttatgcattgatataatattagaaggaagcaaatagttacacgcgcaaaaggctttgcttcaactggtacaggtgttttcatcaaccttatctcttttttcttcatgacgtgtatgcttaacgactttaatatgtatagctctgatgctgcatttacatagaatcggttacatcaattagctcacacttctgcaacacaatattagccctccattgctaccaagtactgtgcttgcatgcttgaaatggagagtgctaaaaatatgaggttttctcatatgttttgtgcacaggaatacaaacatgtgtgcttttatatcacaaatttgctctatatacctgtgaaatttgctatattgtttctattaaaacaagtttagaagaattgatcctacaactgacaatctactccttttggtcctgcagcttctgtgttcaacatattttaattaagattggtattcttatgcttaccatgttatctttttttttaattattttggcagagacagggtggtcaacattgagggatctgtaatgttggtatacgacacagcttgcagaaaataagattatgattggaaatatcacacgatgctatgataagttgaagttcaaagtagacatcaatcagaatattaaggttttcacagaagatgagattaaacggattactagcaacttcagcattccgatcggacaaggcggctttggagaagtgtataaagggactcttgatgatgactatgatcttgttgcggtgaagagatatattagcaaagatttaaggaaagagtttatggaagaagtaagcatccatagtcaaatgagtcacagaaatgtggtggagctcataggctattgcattggagaaagtactctaatgattgttactaagtatatctccaaaggaaaccttgatgacatactccacaacagtgacatttccatccctttggatgtaaggctgggtattgctataggatgtgcggacgcattgagctacatgcattcgatgcatttatcgaatggcagtcttatttgtcatggtgatattaagcctgccaacatacttctagatagcaatctgacatcgaaattgtcagactttggagtgtcaaggcttctttcaggtggtgtcactcagtacactgtacatataaaaggaagcgtatcttacatggatcctatatactttcatgagggttgtcttactccgaggagtgatgtttatagtttcggaatggttctcttggaactaatagctcgaaaaagggtaagaaaaggtgacattaacctcattggaggtggagaaatatttgatgctgagatagcaaaccggagcaatatgaagattctaaaagaaatgaggaaattggcaattgaatgcctaacactggacattcataaacgtcctcaaatgaatgttgtggcaaaacgccttcgtacacttaaaaaagaattaaaagacatgcatggaagatactcagaacacattttggcatcacaccgctcatggcgaaaaaatgacaaccaggggccgagctataattctaggatgcaactgaagaagagtttgagcattttcaagagaaatcttagcaattcttctaagatcctattgggactcggcaatatgagaattttcacacaggaggagctaaatgaaatcacacagaattactcgtgtctactcagtggaggtacttcgggtaaggtttacaaaggaacgcttgaggacaatacggtggtagcggtgaggatattttccgaggcacttgagggtttcgaagaggcgtttatcaacggagggatgatcctatctcaaattgtccacaagaacatcatcagactcttgggttactgcttgaatgctgattgtcccgcatttgtgtacgagtatgctgctagaggaaccctctctgacattctagatggccgtgaagatttcccactgcatttacgcgtgaagatcgcagttgagacagcagaagcattagagtacctccattcctcagcagctggtatgatcagacatggctatgttgcaccatccaagacacttgttgatgacagtttcacgccaaagctgacgggattctcatgggcgcagaggctcaacaatgatgacagcgcaattcatgatcatgataagtactgtgtgtcactaaaactgaaaaccgatgtgtatcagtttggtgttcttgtcttgacgctcattagtaggaagaactttgcgttttatgcggatcacgaacaccttgtctcgcaattccttgcagcttacaaggcagataacagtggaagggcatttttcgacgatgatatcacaactcgtagcgaagatgttgctctcctcgaagagatagggaagctattgctcaagtgtatttgtttggaaatagatcaaagaccaaca

SEQ ID NO: 17010 - DNA, 1626 bp, Oryza sativa
tgcaatctgttttttatgcggccgatcccatgaggtttatctgaactgggttctactaggggatatagaaaattcatgttcaatgttggtagtggggtttcccttaatacatgtttataaataatttgcgatcatgaagctatatatgtaaaccatgtactccattgttattcagttcgtgcagcttagtgatgaacagattgtgctgcacctgtggaccatgtaaggtatcggaggtcctcctcttattctacggaggggctatatcttatagcccgcatccttcatcttccccaggttgagtggaaggaaggccacagtgcttttaggaggctccacaccgatagagtttagccagtcggttagggggaggtccccctatcttccccccaacagtagcacctcaagggctcaagttctggtggactgcaaggcatatcagagggtgacaatatttttgccaaaacaatgacacagttcataattgtttttgtatggattgaattatttatggttcagttcgaatagctagctagttactcccattggccagtggcatatccaggatttcaggctaggtggcccagctcaacaatttttaagaacactatagatttaatgtgccaacgtttttttatttgatcagattgcgtttcgtaaattctacacttgtacgttggcatattacatctatagtataataaaatgaaccaaatatctttaaatttaccattctaataggaaatccagtatcaaaatgaaattgaacctcgagggtgggaggagatgagaacatgttgcctacaggcagcggtcataatatgtctattgatgtcatagcatactaattatatatacttagaatatagtgttatatggataagcagtttaattataagttttgctgaaagtcatcggcatcgcctgacaccaatgttagcattgtagattcgtccttgctgccggtgtttgattctgcttcaaatcgccaccgccggttgccgccgtcgtttcacaaaagacgtgcgtgggaaggcagaattcaagtagacgctgtcatgcggcgaaacaacgaagcatcgatgtttttttagtagtgtatgcaggtaatgggccttggtccattctatggtggtacatgcatcacaaggatcatactgtagctctgcatccggcatcgactataagtattgttttgtcaacatggtcagaatttgttttttcatcaaattccttttacttttagcagaacatgatcaaattctactgatacttactgcaaattaacaaaacaaaatccaattccgatccaattggcctgaactactgtgattttataactattttatatgggccgtgaagttcaaccgttgttcctcaaatggaataagttcatctaagataccttaacttgtcaacgaatccgattttcatcattcaaccgaaaaaccagataaataattctctcaactattaaaaccggtacaatataggtcccatagcggttttagattacgtggccaatttgactcgatcttcatctgacgtggcattaacatggcacatgaaacaaaatttaataatttaaaaaataaaacaaaatatataggcccacatgtcagtcaa

SEQ ID NO: 17011 - DNA, 15383 bp, Oryza sativa
  unsure (1)..(15383): unsure at all n locations
nnnnnnnnnnnnnnnnnnnnnnnnnnnnnnnnnnnnnnnnnnnnnnnnnnnnnnnntttcatcaaattccttttacttttagcagaacatgatcaaattctactgatacttactgcaaattaacaaaacaaaatccaattccgatccaattggcctgaactactgtgattttataactattttatatgggccgtgaagttcaaccgttgttcctcaaatggaataagttcatctaagataccttaacttgtcaacgaatccgattttcatcattcaaccgaaaaaccagataaataattctctcaactattaaaaccggtacaatataggtcccatagcggttttagattacgtggccaatttgactcgatcttcatctgacgtggcattaacatggcacatgaaacaaaatttaataatttaaaaaataaaacaaaatatataggcccacatgtcagtcaaataataaaatttaaaaatagtggggccactacctcccccacatcccctctcttctctctcctccccttctccagttctccttatcccctcctcccatcgtggagtacacagcagcatgccccgcgatgtcgggggaggacggcggtgtggatgcagctgccgtgtgccgtccttgctggcagaggacgcgatgaggatgacgcagctgccaagcgtggatccgaaatccgccttccatttgagcatcacgccttcttccacgctgatctcaccggcgaggagctcgatctgcaggcggagggtacgaatgccacgaggacggaagcggtcgaagtggtcattgcgaccaccggcggcggaggaggagagccatccgtgatcttcgccggcgtcacaccgctagcgggaccccaccggattttcgaccatcaccggcgaggcggaccggatctggagaaaaggcgtggctccgtggagatgcagggacaccgccggcgaggacgggtttcctgtcctccctagcgccggtagcccctccggcctccccgtctcgtctgcgcttgccggtgtggagagatgagagagcgtcggtagagagagagaagatagaggttaggagaaagaggtggaggaagtgggacccactgacatgtggatcccactatttttttttgactgacatgagcctcaaatattgtttttaattttttggttttcaattttttattttttattttcttgggatcaaactgccacgtaagtgccacgttaatgccacgtaggacaaatgccgagtcaaacgatccacgtaagtgccacgtcagtcaaaaccggggtcaaatactgccgtggacctcgtttgtactggttttgtaagttggaggatgcgttgtatccggttctccggattgaggatgaaattcaggctgggcgataaattgagggacctaaagttaacttagtccctcctcaatttggtgtaatgggcttgaatgatccaggccttttcccaaagagataataaataacagtcatcttaaagtattttacaactattttctatgaggcaaaaaaatatatattaccaaaaaaaaacaagcactacaacccttaatgaatcgatcttagttgacactagaaaatcaaaatctcatatacttgttaggctgtcatgcactggcgatgcacccgtaatggcagtgccactccccactaactaaaccttgtagcacacacgtatgtagcaaattgattagcaaaaaagaaaaggattcaggtcctaacataatgagattatcaaacatgaaagtagctggacaagtggccaaacttgtcatatatcaagcagaaattaaaccccaattccactaattaatcggacaccactcagcagctaaatcaaaccaaacaaaagctagaaagaaaatggtgccaatttgccgaaccagaagctaacacgcgttaacgtacggtttggtatgaccacactaaagtacagtgctgaggagagccaacacccactcatcacttaatctcgcatcttctagtagaatttgctagaaaaatttggcttttttaggttaaatatcaatttgatttcctgtttttgaaaagaaaaacatatacctttatcgaatttattccgatacccttttcgcatacttgatatatgcggttgtaaaatcctttatgcgtgggaccaatgtaggggcagatccagcatgtgacatagagggtacaattataccctaaattattttgtaaacaccctttattaatttgtataatatatgtttgaggagtaaatgatttcgaattaacagacattgtattgataacctacagctagtatatacttaagagaaaatctcggtcaactgatagaaaacaagacatatttgcattactcatagtcactataaatcgataggtattatccatgtaggtgcgggtcatatatttaaataaatacaattctatatttaaattttgtctcaaaataaggacaatccaactatactacttattattgtgacattaatcacatttaattcaaatttctgttcgtcttacagtcagctaccatctcactccgtaccatttgtcatttaatagggggtattttggataattttccttctattttattttctcatctcacttctaaacttacatttacaatgagatggagcgagtaaatgttaaatctcatccaaccaatcgtttatattatgtaaggcacattgatcttatacacgaaggtacatgaaggtaagatcctgttttggatgtagggactaatttttaacccctgtcggattattgaaactaattagaagtattaaacgtagactaatgataaaactcattctataactctgtactaatgcacgatacgaatctattgagcctaattaatctatgattagtttatgtgatactacagtaaacatgtgctaattatagattaattagacttaaaaaaattatctagcaaattaactctcatttatgcaattagttttattattagtttacgtttaatacttctaattagtataaacattctatatgaaatttagtccctagatacatacaccaccaaaagtatggcagatgtttggcatgttgggcagcaaatcaccaccgacggaaaacggaacaaattttgcttgaaaagaaaaatcagtcgtttgcaggtgcagctcagcctatactccacttgagtgcggttgctattaataaacgcgtctcgtccgcctctctctctctctctccgctgctctgcctgactgcctccatcccccaccgcgattgagatggcagcaatggcggcgccgaagctcctcctcggcctggtgatgttggtcgggtgcgccgcggcggacagccaccgctacaggccgggcgacgccgtgccgctctacgccaacaaggtcggccctttccacaaccccaggtccgtccgtccctccgcctctcaatcttccttaattcggagtttctcaatctttcctgttccaatccccacaacgaatctatacgagtaccaatttaatttgtaggagcaagattagattccttctgaaatagtactgtacaagcgatattctgaaatactgcatcctattaacaaacctgcagaattgttgaaaacaagaaataatttggaataattcaggataaaagaatttaattatgcaagggatcatttgctttctttcagtagggtaataaactatgatatccattgctcccaggacagatactaccgaaatttaagacgcccacaatggctccctattttgtcttcttttttctttcctggatataataagtaatacctttaagtgcataccttgctgaataaccaaaaaattctcaacactgttcatgtgcagatgatataatggatctcattatctgacagctgctactagagactgcaaatatttctctagtagcgatgccgtcagttgcgctagatttgtcaaatgcttcaagtggatttatacataatttcttttctactagttgttgatgtatattgtagagtgaatcacagatgtacaaggttcagctttattttattctcacacattgattttgccccttgcagtgagacgtaccggtactttgacttgcccttttgtgccccaggttagattctccctaattaattaaggtgttgctagctgtaatctgccttatgtttacttagtgaactgtgtcatctcccaagtggaggccattgacttctttactataaacaagaaagattctttgcaattaagctgaattttgattcctaacaccttctagtacagaactagacttgtttttctgatgcttattcaattttacagaaagatgaagttctgacttaacctccattctcttttaatcaagttatctgtgttgtcatcaactacagagaaagtaaaggacaagattgaagcccttggtgaagtccttaatggggatcgtctggttgatgcgccctacaagcttgatttccgtgtagattttgatgccaagtctgtttgcagtagacggctctccaaggatgatgtggtcaagttccgacacgctgtttccaaggactactacttccagatgtactatgatgaccttcccttttggggatttattgggactaagccagaaaaggcagatgcaggggataagtattatctttacaggcacatcatctttgacatcctctacaataaggaccgtgtaattgagatcaatgtgcacactgaccagaacgcggtagtggacttgacagaagacaaggaacttgatgtcgaattcctttatacagccaagtggaaggagacacagataccgtttgagaagaggatggagaagtactcgagctcatctgtcatgccacatcacttggaagttcactggttctcaattgtaaactcttgtgtcacagttctcctcttgacaggattcctggcaacgatcctcatgcgtgtactgaagaatgattttgtcaagtaagttatcatttcctatcctttgtggtgattgattcgaagattgaaattttttctagtgacaatatagataggtttttatatattgggattctctagcttcattcataactaagaacaaaatatcctggacacttgtttatatagcttcattcgtagctttgatttctcaaggtttctattaatattattccctttgaaggtattcacatgatgaggaggaacctgatgaccaggaagaaacaggatggaaatatatccatggggatgtctttcggttccccactaacaaatcgttattttctgctgctcttggtacaggcactcagctatttgctctgtaagtccctattagttttacacactgaatttcctatagtgttagttttttaacggacttatctaacaattcatatgctggcctatgcagcacaacatttatattcctacttgcactggtcggagtattctatccttacaaccggggtgcgctttttactgcactcgttgtcatttatgcactcacttcaggaattgctgggtacagtgcaacctctttctactgtcagttcgaaggaaaaaactgggtatgttctattatctatattacagattagcattgcataaatgccttggaatcaggggtcgtattatcttgttattcctattttctgccaattaacatcttagtttcttctgtttgtaggtgaggaacttgctattgactggatgcctgttttgtggacctctctttctgacattctgtttcttgaacactgttgctattgcttacaattcaacggcagcattgccctttggtactatctgtgtcattgtgctcatatggacgctggtcacatttcctttgcttgttttgggaggcattgctgggaaaaacagcaaaaatgagttccaggctccttgccgcaccaccaaattcctgagagaggttccaccacttgcctggtaccggagaaccattccgcagatggcgatggccggttttcttcctttcagtgccatttacattgagctgtactacatctttgcaagcatctggggacacaggatctacacaatttacagcattctgtttatagtctttatcatcctccttattgtcacagccttcattactgttgctctgacctactttcagcttactgctgaagaccacgagtggtggtggaggtatgcattctttcaccttctactgttgtacttgctggattgcatatgatttccattctagcatcaaaacagagttgtcttcatttaaaaaaaaaacagagttgtcttcctcattagatatcacagtaattgtgtgttttctgccaattggttgtctctcaggagttcaagaagccattccctgctatgccttgcaagttctaatgcatcttatcctttcttttttttttcctctgatgcaggtcattcctttgtggtggatcaactggatttttcgtcttcgcttactgcttatactactaccgtgaacggtctgacatgtctgggttcatgcagacatcattcttctttggttacatggcctgcatctgctacgccttcttcctcatgctgggcatggttggtttccgtgccgccttgctgttcgttcgccatatatacaaatccatcaaatgtgagtagactatgcatagttggtgaaggccagagatgaaagaaaccagaggtagctgatgcaattgattagccattattcatagcaaaaggtagtgagcagtaaatctgttccattttgtacgactgatgtggtgaattttgcggctctttttttatgtgttatgtccttgtaatttgcatcattgttgaaggaatcgtgcttagcaattttacaccattccattcccttgatgttgagagacagtgctgatgaattttgtaagaattcagaggagcaacctcttgaatattatagcctgaaagcttgatccgaaacaaaccaatagaaactatgacatctgtaattgttttgttacccttgagtgaccactatagtctctgtaaacactagcaacatgtggtactccatattttaactttcggtttgatagaccagtcgttcaaaatagtttttaaagttaaaattagttatctgaaaacacttgttgcaaacaatggtatttgataaactaatcattcaaaataattttaaagttccaattctgttatgtatatcatgacctatgaactgaaagaacacacgaattaaagcaatggcaatttatggtacttgattaaagcaatgacaagcacacgaataacaggaacagctcctttcaggaatgttacatcgtccagaaacatcagcaggatgctcatagaattttccttcagactaaaacatatattagcaatgcccagaaacaactccacagctggagttgtcagagaagctacagcaatttgcgattcaatgactgaatcgacaggaaagttgcaagatgacgaacagtatagtagtaacatttagaatgcagaggaactaacagctaatataaaaactgatcataatctcccgaccttacatcattaggaacatactttactcttttcactttcaggtcagctaaaacaaaagcagcagcaaatagaagaaaatcaagaagcgacgggcttcaaagctgcagatggcagcctagaagaagtgtgcaggaacacagatggaactatccccaaattatccacagaagaattttcggagtaaaagacaacctggtttctacctcaaacgaatcggaatagctatacaacatttgacagttttttggatgaaaaactttcatatgaatttatacctcaatgccatatgaattagcacacgagcttaaaaacatgtgcaaattcaattaaatttctgtcacggcctaataccatatgattttaaaaaggacaaagttataattgaaagaaaattttatacacagtaaaatttaggagtgtgtgtactccctccgtttcacaatataagtcattctagcattttccacatttatattgatgttaacgaatctagacatatatatttatctagattcatcaacatcaatatgaatataggaaatgattgaatgacttacgttgtgaaacagaggaagtattagttagcaaccctgtagctgtatctcgtagaagagtaaacgaacgccagcaggtttacacagctgaggccgaacatgagccagaagaagcaatccagccgtcctcgattgagatcgtcgggaatccacccgccgccgccgccctttttcggcgccgtcgcccacgcgaccaccgcgacgatggccgagttgaggtagcttccggccgccacggcgacgaggctcaccgcggtgcacaggctctttatggtgtcgggcgcctggtcgtagaagaactcgagcaggccgacgctggtgaacacctccgccgcgcccagcgccatgtacgacggcgcctgccacacgatgctcgtcgccgcgcgccgccggcggctcgcctcgagcagcgccgagtacgccatggccagcgccgacagcgccagcccgacgccgagccgctgcagctgcgacaggccgcggcggtcgccggtgacgcggcgggcgagcggcatcagcgcggcgtcgtaggccgggacgcagaggaggatgctgaccacctcgaaggtggacagcgtcgccggcggcacgtcgagcgggccgacgcgggtgtccatcgccttcccctgctccacgaacgtcgacgacatctgcgccgtggcggcgaagaagaacaccaccgtcggccacacggtggacagccgcagcagcatcttgacctcctccacctgcgtcaccgtgcacagcatccacgggctcgccatcgccaccgccggcggcgacgccactacggccgccttgtccaggaacgcgaactgattggtgtgctcgatgatccggtagtcgccgtcggggagctgatgcaggagcgagctgtcgccgggaagctccacgccgcgattcctgacggcggcgacgaccacctggcagagccgcgtgagggggctccccggcggcgtgtggaacgcccggaggccgcacagggtggagcagaagagaaaggcggcgagcgcggcggtcatgaccgccgccgggatggggaagccgagccaccagccggcgcgctcctgcacccacacaagcacggtggccgccagcagcgagccgacgttgatgcagaagtagtaccagttgaagaaggacgccctcgccgccggcgccgcgtcgtcgtcgtcgaactggtcggcgcccagcggcgaggcgcacggcttgatgccaccgacgccgagggcgacgaggtagagccccaggaacacggtggcgcggaggacgccatcggaggatgcatcaaggtgtggggttgcgaacgacgccgagactgtgagcgtgatcatcccctgtcacagattgaaattttataacgaaatttcagaaatttttcgttctttattgttttttcagtccactggtgaagaccatcaaaataatttgtgaaacaaaaattaaatcttaaattttgattgacctttaagaaattcttgattgccataagaagatgttcttttctaaagaacttgtgaaaaaaaaacataatatcttcttaatttttgcttgacatttcgcagaaattcttgattgccataagaaatttattgttctctctctttttcagtccctgtaaagcatgaagaccataaaaaaatttgcccaaaaaaaatcttcttaagctttgcttgacctttaattccgaaattctctattgtcatatttgatatgcttttgtttgttatctaaatcttgttgtaaaaacatttcattcacaaaaatgtctgaataatgaaaattgaataaaggagtatgatatattttcacattaaaaactaagaaaaatctcttcaaacattcagtttttcgcattaacaaaaaacttgtttgagcatacttttcttaataaataaaaaagtataccatggagtagatggagaggaagaggaggatggtggtgcggcgacccaagaaggagtcggcgatgaatgcgccgacgagcggcgtgaggaagcaggtgcccgtccacgccgacacgtccctggcggcggcgacattgctctcccctaccacgccggtgaggtagctcaccaggttcctcgcgatgccggcgaacgccaggcagtcgctcagctccgtccccagtatcagcacgcacgccctccacccaccgccgccgcccttgtcctcctcctccttgccgccgccgccgttcggacgaagcagcagaggcctcttctcctcgtcttctgctgctgctgccgccgccgccgccgccatggagattttgcttccactgtgtctgtgtgtcttgctaggagctactagctcatggacttatgtcatatcgtatttccgagtgaatatttaagaaattttgatgagaatttagtgggggaaatttagattggagagaggagttaggtgtatgcacaagctgcaattgccaaaattgatttttgggatttgactcaaggtagtgtacatgccaacttattaaaaaaaaggatttttgttacgattagcctgttgtgttggttaatctagcgttgctgaaatgatggagtattttaagaataaaaaaaaaattctaaccttatatagattatttttttctttcatctaattttattattggtctatgattacatgagaggagaaatggggttctatactatagagttgcactcatagaattgatagttgacgttttcttttctttcttttttttttgaaatgtgtatgtagtactaatatctattgagttatttgttagaatctggtttccttaacggagattgaactagccattattttagctaatgtatttttcctttcagcaaagaaagctactctacaaaccttattaatttcagcaatgatagaggcaacgcatttcaattatctttagaaaaaatgcgcaagctgcattcgtagaatttgattggttcatgtggaaggtggggtttggatccagggacttaactttagtccctgtctttagacactaatttagagtattaaatatagactacttataaaactaattacataaatgaaagctaattcacttgacaaattttttaagcctaattaatccataattaaagaatatttactgtagcattacataggctaatcatggattagttaggctcaatagattcgtctcgcgaattagttcaagattatggatgggttttattaatagtctatgtttaatatttataattagtatccaaacattcgatgtgatagggacttaaaagttttagtcttatctaatcagggcctgaaatctgagccacgcaaaccaccaaccgcacgacaaggttaattagggcctgttcactttgatgccatttccaaccttaccaaattttgataaagttatcaaaaaagtggctatatttagtttgctgccaaattttgataactatataagaaatcctaccaaaattttggcaactatgccaaaattttggcatagttgccaaaatttggcattgccaaaatttggtaaggttttttttggcgtcaaagtgaacaggcccttaatttccatgtctccatcacactcacagtgccagcggttatactgggcagactagtcattcctctgttcctctttccacgttcatctgtaggatttaagggcctgtttagttcacgaatttttttttaactgtcacgtggcatgtttgaccggatatttgaaggggttttcggacacgaatgaaaaaaataatttcataactcgcctggaaaccgcgagacgaatctttcgagcctaagtaagccgtcattagcacatatgggttattatagcacttatggctagtcatggactaattagactcaaaagattcgtctcgcaatttccatgcaaactgtgcaatatgttcttagacagaaaaagtaggtagtagcacacattaattctagatgaagaaaaaaaaaactatgatatctctcattaaataatatgtggtgaataaaaatattgttgggagtaagaccggacagaagttctaatgattgtagctaacatataaatttataaaaaatgttggtcaaagctaaaaagtttaataagtataactaaaacgacgatgaatttaaaaggagaaagtacacaattaatataactacacatacagatggataagtcaccccaaattaacgcggtctctgaataaacgactgtcgcctatacttgtatacgaattagctcaaaccattccctggatcaacttaattattggacatgctattaatcaaccactatctatgactcggctaattggtgcatttcggcattcatggtacatctaatttaaaaatgcatgttttttatgggagaaatttttactgcactttaggaaatttgtagtacaccgaattttacatttaaaaaaatatctccactacctaaagtattaaattttatcataaaaaaatatggtacctttgaatatattctcaagatagtaaaattactctttttacttactgccgacgtggataccccaagacaggatgaatagggttttagggtacgttggtacgatgatctatacgatacaacatcaagcaaacaagaagacaaggattatactggtttagatccctcgtaaggtaatagccctagtccagtttgtatgagattgacatggaaaaccatagattccaatagaagaccgacgattccaagattaccggcgagatccttgtcgagatggtttcgacgagatctcccagcgagtaggcttcacatcctccgatttgtaggctatggtggtggtgttggcgtatgattcgataccttaggacccctagggatgtgtatttataccgtgagttaccttgatctccaagtagaactcggagataccgaactcaccacgatacagtacaatcctgaatcccgatccttttccgagtaggactatgttatacacttgcctatgaggattatttccataatcttttgtcgatttccttatcgggaaacatatcgtacatacgaaggtatgcagtatccgtatattccataagtcgtaggttagaaggttgtatcttacccgtaaccatgacacttacctcttgggaacccttcccatctacacgcaaaacagagtaatagattaacacatgattaattaagtattaactataaaatacttaaatggattaatatgatgtttaaagcaactttcttgtagacactttttacaaaacacgtatcctttagtagtttgaaaagcatgcgcgcaaaaacacagcctaagtaccttttgatcaagagcatccgaaaacatttgtttttaacttccatttgtttcttcgacaacaagtttccacactttccagtcagttgccaataatttgactatagcatatgcatccctgaaaaatcaaggggtggcccataagctcacttctatcacctctttacttattatagatgaaatattaaaatacgtctagtcaaactttcaaatcttaaatcaccaacagataaaattaatttatgaagatttgttatgtgaaaataattaatttgaagtatatgcttcaatggaaaaatacattcatatgattataattcccatatgaataatgtaaggctatgtacaacgttgtgtaataacaacctctcttcattaccatgtaagtaaaattgatgacgtggaaaagagatagaggaaaaagaaacatgggtgctacgcatcacagcggatcagagtcgacttttaatgtttattaaagagaattttgttgcagggtggagaaaaggaaagaagggtagtaaaaaaatattttggtaccttccttttccaacctccctcccttgatttccacgcgtacgcttttcaaactgctaaacggtgcgttttttttgcaaaaaatttctacacgaaagttgttaaaaaaacatattaatctatttttttaaaaaaatagcaaataattaattaatcatacaataataggtgctttgttttgcgtgccggggaggaggagggactnnnttttttttgaacacagcctaagagttcttattgtctcaactattgtagaagtatagttttctaagtgctagagtatgtatttacctttgtacatgtcttagtgtgtcgttgtccagaacgacgataagaaaaaaggtaaaagtgtcaggaagcctagagatcgtgaggatcccagacgagcaccttacgcgcgtactgtagccgatccggcaacacaagaaagaaaggaagcagaagaattttggcgtagcgcaacagctagctgcttttctggtttacttccttatataacaaaatgggattacaatgaaatcaaaaccactaggaccgcttctcacgctggcaattcgctgcgtccatccccacagctgctcaacgtgcgtcacgctctcggtgcacgatgcgggctctatgagctaatctcgcgaccctcaactggagcacgactgccacaagtttcggcaagctcatgcaaagctgaatcaaacaaatgcagaaataactgaataactaactaactaactaaggcacacacgttgtatttgcaacaatgagtaatttggaaataatcactgccaacaaaaagcttttggttgggggcggctagttgacgcaaattgagcttgtcctatgtctggcgaattgaatcagagtcacacacgagtcgcgagtagtgaggggacaatgcgctaacacacttttttttcttccccttgatgaaattgtataataattataaataaattactaagttaaaaaaattcaaaatttgagttgaaaggttaaaagtttgtgttgaaagttcaaaatttggatagtgttttaaaaattttctgtgaatatttgaaattttgagttggattgggtaggtttaaaatattttggtaaaagttttaattttgagttgagagttccgaatttgggaggaagttttaaaatttatagttgaaagtgttaaattttgagttttgaagtgttaattgaagtcaaagatttcaaattttgagtatagtttttcaactggaccttgtgcaactaaaaaatttctatccaaatgttaaatcttttcaaaatcacttcaaaaatcaaattacttaaagaagtactcattgaatgctcattcgcacattgggagtcctctgtgcgagtcgtgtgatatgttaagagtcacctgaattaaaagaagtggtgctttagaatcagaagtagcgagcgtgcactaaataatatttccatcacctatgatgcctacactcaactacaaatacactcatcgttaattaaccaaa

SEQ ID NO: 17012 - DNA, 3635 bp, Oryza sativa
  unsure (1)..(3635): unsure at all n locations
ctgttgtcgacatgttggtctgaaggtctgactcgtagtcgacaacagggtagtcttcctcctcgaatccgtgcccggcgagatcagagatagcgctttcgtatctcctgacggtatccggagacaccgtaggggaatagccatgcctatccctgaagtcgatatccggcggtgtgtcttggcgtatgtaggcttgtatgttgtggcttctggtgggcgtgtgttgattgtcatgggtgtcttccgtggtggttctcccctctcctcctagggggtcttgtatttatacccataggtgtccccttgtccaagtagaacgagggaaaccaatatggatacaatctgagtagtcattatcgtttccatgtagaactctagttgtctttccttatccggaactccctccatatccgcaggttgtttccgtataggacatggtatgtggtgggtcctgccaagatttagtcaactactattaggtatgtggtatccataaccatgacagtagcccccgacttcgatgcaaatgaacgaattcatattctcaactgcgcacagacattggagtaactgttatcgagcttatgtgaccgttctcggtgagattagagataacgttggacttcctttgtcagcctcatgcgggcaccgaaagggtttgtctaagtcattctctgatgtcaaccaatgaagtacatagcgtacgactaagtctcccgtcttgccgtaatcgagaatttggattgaagtcaagaaattctttcttggtgggtacaccatctcttcatttcgtattccttgtcgagatccagcaaccgttctcgagcgaccgagaaggcgtagagtctgcgacggagccttgccaacattggtcgtactcgccttagtcgatcttggtgtagaaccatagagacatggagtctttgtcaatgtcgaatagaattttcctaaaatcaatactcagaaaagaatattagatagaaataacccccgagcgaatgctcaaagggtgacatgttataatatgtatggtaaactgaaaatgaatcaaatttaccgaccaatgttttgtgtaagagtgtgttctcagttaacgactttggtcagtcgtttgagttgtacactctccctagcccccagccttgtcgtcggagaatcattttcggaggagaaggctcttggacccttgacctaccttggttgaataagcactgatcctagcccccagccgtgaagttggaaaagtcaacttccgattacacggcttggttaatacgcacggcgagaactcttacacgaccagatcttacatggtctttcgtctctgaaggatccgacaaggccttatcggctctgggcatccccaacggaagatcccttaggttcctcggaggccttgtcaagacggcgtaaagggacagtaggataggtttcaacgctaggtcgtcgtggtaagggatctctgggtaaaacacttggcgatattgtgtacctgctatcaactttgttgaaatagaggtagtaggagagtcgctacactgctagtcgaggactaggcagtagtcgtaactcgaccacgtaaagtggaaatagtgggagagacgttacatcgctggtcgaggaccaggcagtagtcgtaactcgccacttaaagtggaagtagtgggagagacgctacatcgctggtcgagaaccaagcagtagtcgtaactcgaccacttaaaatggaaagtgggagaaatgctacatcgctggtcgaggaccaggcagtagtcgtaactccaccacttaaagtggaaagtgggagaaatggtcgtggaccaggcagtagtcgtaactcgaccacttaaagtggaaagtgggagaaacgctacatcgctggtcgaggaccaggcagtagtcgtaactcgaccactagaagcaaatgtacgagagatcactacgattaactggttgagaaccggtgagtaggtgtctctcgatcattttgagtcgtggtacgaggaccactacgttattgctgtagtcgtacctcgaccatctgaagttgcggtgcgagagattgctgcgtactggtgcgagaaccagtgagtgagcagaattatctctcgaacaacgatgggagttgcggtgcgagagattggtgcgtactggtgcgagaaccagtgagcgagcagaattatctctcgaacaccgatggaaggtgcggtgcgagagattgatgcgtactggtgcgggaaccagtgagcaagcggaattatctctcgaacaccgatggaaggtgcggtgcgagagattgctgcgtactggtgcgagaaccagtgagcgagcggaattatctctcgaacaccgatggaaggtgctagagttggtttattgcaagtgtatctcatgtggccagcatgactcacgtgcctaacttacagcatatccggatgtccgttcgcaatcatgtcgggtgatcaagccgacgatgttcgcgaggaattatccattaacaaccttttctcgagtagtccagccatggccggtgctatgagataggtcgtcggtctttgttggtaggttgggtgcgataactccgcatttgtcgagaatgttctcgataatggagtgtactcgaccataacctagtcgagtgctcagttgttcctgaaaaatattttctagaagacaagatatatagcagataatatcgagtatgtattcgaaaaactgcatggatcttctagtattatcaggatataacgagcagattaaatattaggcattatgtaaaccgtaaacaagcatgatttatacagaggaaaacagagcgtgctccagcgttagaccgcagttggcctaacatcggggacgctcgcgcgatatatactgtataaagaacatgctctaggtaaacataataaattatagatctgacaatgccgtataatctgaaaataggtacggtaaattatatataaaatattgcgtacctttgtagatatatgccggatatatctacgaaattagtagattaattaggaaattaatcttactaattaccttagaatttgtactgcggctttttggctgtttagttgatctatttgcttttggcttacgtcaccagaatgagcagctcgattgccaactaggaattgaattctagtgcaatcacaggaactcctcaactccgattagactacaagccaatgaacagatcaatgcctcacgccagccgagtttggctactcgggcagccaatgccttacgccagtcgatgtcccacgcgtcgagggattggtgttggatcagtcttagatgccgctgacaccatggccctctgccgtggtgacgtgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17013 - DNA, 580 bp, Oryza sativa
  unsure (1)..(580): unsure at all n locations
ttacattggctatagaggatttggagctagtagtgggttaaactattggacttgctccaaggttgtgttctttccttcaagttgccaacctttctcctcgtttttggcgcgcacgtttctcaagctgctaaacggtgatttttttgcaaaaagtttctatacgaaagttgcttaaaaaaatcaaattaatccattttttttaaaaaaaatagctaatatttaattaatcatgcaataatgcgtgctccgttttacatgccggaggaggggttcagcttaagtatagttacggaaaacgagtatcgaccactagctgctttcgtttacattctgaaagagagtgaagactggttacgccccacgtggatgattccattccagtcgcgctcgcgccagacggtcgatgcgcgcaaagtcagggtcagctcttcaatttgagtaccaactatagataattaaatactccttatatctgaagtattattgtatcctcaaatctgagctcannnnnnnnnnnnnnnnnnnnnnnnnnnnnnnnnnnnnnnnnnnnnnnnnnnnnnnnnnnnnnnnnnnnnnnnnn

SEQ ID NO: 17014 - DNA, 1148 bp, Oryza sativa
taaaagcaactccggctccggccaacatgatgtaaggttattacctgacagctcaggggcccgaacctgtataaaaatcctcgtctccgtttcttttacctcagtctcgcgtatatcctagcaccgacgatccccatactgtccaaataccgtagtcgaaacatcaaacgtcgacacacataaatcatatttttgcattgaaattcaaaacgatcgatagatgcatattacaacttacctcttagtaatatttttttaaatttggccactttttgcataagtcgaaaacacctaagactgattcaaacaaattttaaatttcaatgaaataatcatgaaagaaaagtgaagtactttggaactttgatacgtatgtcatttatgtgtcataaatggcttaataattttcagttcaaaatacaacccatataaaatataaaccataaagagaaatgctaagaataaagtgaaacatttttaatagtttaggagtaaaatgagctgaataatagtttgaaggagtaaaatggacgaatttccttaatccgtttgttctttggttaattaacgatgagtgtatttgtagttgagtgtaggcatcataggtgatggaaatattatttagtgcacgctcgctacttctgattctaaagcaccacttcttttaattcaggtgactcttaacatatcacacgactcgcacagaggactcccaatgtgcgaatgagcattcaatgagtacttctttaagtaatttgatttttgaagtgattttgaaaagatttaacatttggatagaaattttttagttgcacaaggtccagttgaaaaactatactcaaaatttgaaatctttgacttcaattaacacttcaaaactcaaaatttaacactttccactataaattttaaaacttcctcccaaattcggaactctcaactaaaaataaaacttttaccaaaataatttaaacctacccaatccaactcaaaatttcaaatattcacagaaaatttttaaaacactattcaaattttgaactttcaacacaaacttttaacctttcaactcaaaatttggaattttttaacttagtaatttatttataattattatacaatttcattaaggggaagaaaaaaaagtg

SEQ ID NO: 17015 - DNA, 687 bp, Oryza sativa
gggcgaattcgagctcggtaccctacgaagcgccgtggtgcacgaatcgcaggcaggaagatgagccatggtgcgttcaagaaagtacttgagaagcttgctggtgaaggttataatcttaataatccgattgacctgaagaccttctgggcgaagcatggaacaaacaagtttgttaccataaggtaaaagacaatgaaattctaaaatttgttggctttgtaggttgctctgcagctgtttggtctgagtaattgtctgtatgtactctagattacaaactgcagaatccttttaggtgtaggttttaggcatgtcctgtccctttgcagtagtttacatgcctcatctgtgacctgggtgctgacctgtatggtggctatctgcatgtatctttgtcattatctttacaagtagcagtgtaatgcgacaatctctaatttaggtggcatgaaagttaatctgttcaacgtttctcattatgcttaagtcttatgtatacaatgctccattgcaatgcctggatgttttacagaatacaatataggggctatctcatgaagtagaaacggtatctttttcatgctgggtctgtatgcatgcaaaggttatatagcctatatatacatgtcttttcttttattgaactgatggttgcatgcatgatgaatgggggcaaaggttctg

SEQ ID NO: 17016 - DNA, 790 bp, Oryza sativa
actccgaacgtgcacttttctggattgagcatgaggcgatatcgtcggaggttgtcgaacgttttcccgcagatcgtcaatcaaggagtcgcttgccttggtcttgacaacaatgtcatcgacgtaggcctcgacattgtttctgagctagtcactaagtgcaccttagaccgtgcgctggaaagtgtttcctgcggttattagtccgaacggcatcttaacatagcagaataccccgaacggcgtgatgaatgctgtcttctcctcatcctcttttgccatgcttatttggtggtaaccggagtaagcgtcgaggaaactcaacaactcgcaaccggctattgagtccaccagttggtctattcgaggaagaggaaagtgatccttgggacacgccttgttgaggtcggtgaaatcgacacacattctccacttcccgttggccttccgtaccatgactgggttggctagccactctggatggagtacctctctgatgaaaccggctttgagaagcttgtcgagctcttctcgtatggcttgttttcgatctggtgaaaatctccgcagtttttatattactggcttgccatcgggtcgcaccatgagtttgtgctcaatcacctccctgggtaccccaggcatgtcggacggctgccaagcgaacacgtcagcattgtcgcgggagaaggtgatgagcgcgagttcctatttctcgcctagtgaagccccgatcttgatggtcttgtcggggttggcactggatagtggaacgatcttgattgcgccg

SEQ ID NO: 17017 - DNA, 403 bp, Oryza sativa
atcacagtataaggataaattgatggcttacaactgatgatatgtaaatatgttatattagttatttagagttgttcttttaaacatccaaaatatgcaaaaccactctccaaaactatcttagggagtaatatagatggtattgcaaagtttagggggttagatgttcggttttaaagtttagggtgctaggtggatttgcatccaaagtttagaggggtatttggacttttttccttgttaaaaattttaagaataatggaattggagggagtagtatatatggtatgaatttttctcctacaaaatttagaaaataagtatatcaaccaacctgagcaagcgtcttgcccttggctccggcgatctcctgcaggacgccggagtccatcacggcggcgct

SEQ ID NO: 17018 - DNA, 892 bp, Oryza sativa
  unsure (1)..(892): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtttcttgcaatctgattggggcacatcatcgagaaatcaaggaccgttcgatatatcctccggacattatcatccgtcagatctctctatttgcaaaatctcttctggatccttcgagaaagctctttttcaaatacatccttccacgtccctaggtaaccaaaaaaaaaggagagaatgttcccctccttgtctcttcatcgcacacggccacactgccgccgccagcccgccaacctccccaccgccaccatgaagtggatcaccagtttcgaccgcgtcccagaataggcgcactggatcctgcaccacctcaccagtgagctcgagcgccttagccatgcctcctcccagctattgccgctgcctctaggcgagtttggtgctgtaaaatcagatccacgatggcagatcggagatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17019 - DNA, 697 bp, Oryza sativa
  unsure (1)..(697): unsure at all n locations
tgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttggcttcctcgtctctggcagaggaatagaaccaaatcccgagaagatcaaggcaatcgagaacatgaagtcgcctacaagactcaaggaagtacagaagctaaccggatgcatggcagcactaagcaggttcgtcgctaggatgggagagcgaggacaacctttcttcgctctgctgaaaaagcaagacaaatttgtatggacacaggaggccgaagaggcattcattgcattcaagcgctacctatccaatccacctgtacttgttgccccccaacctaatgaagaattatttctctatattgccgccacgccatattctgttagtactgtcattgttgtcgagagagagaaggtgcaacgactagtctactatgtcagcgaagctctccacgacgcaaagacaagatatccacagatccaaaactgctctacgcagtaatcatgacatcaagaaagctacgccactactttcaagcccacagggttacagttgtctcctccttccctctcggnnnnnnnnnnnnnnnnnnnnnnnnnnnnnnnnnnnnnnnnnnnnnnnnnnnnnnnnnnnnnnnnn

SEQ ID NO: 17020 - DNA, 494 bp, Oryza sativa
  unsure (1)..(494): unsure at all n locations
nnnnnnnnnnnnnnnnnnnnnnnnnnnnnnnnnnnnnnnnnnnnnnnnnnnnnnnnnnnnnnaccttgtgatgatggacatggagggagtgtggaaggagatggaggagtgccaaaggctaggactcaccaaggctattggtgttagcaacttcagttgcaagaagctcgagacattgctctccttcgcaaccatctctcctgcagcaaatcaagtaaaagttccaaacattcctatacattataataatcttgactcttttggaattgcatctatatatataccatcaactagagaaaaacccattagcattatttagtgggataacaatattaaaaaatgaaaaaaaaaagtgtccacatcggcgattccggtcaagcttcacgatcagctagagcccacgtaactgtcaaactcagccataatgtccaatcaagcctcgccctctcacctccgttgcatatatgtctcagtactaagaaacgtttctagga

SEQ ID NO: 17021 - DNA, 1499 bp, Oryza sativa
  unsure (1)..(1499): unsure at all n locations
nnnnnnnnnnnnnnnnnnnnnnnnnnnnnnnnnnnnnnattattgctaagtgcaccttttgcacagaccgtgttgtttttcttggttttgtggtgactgcagctggcatcaaggttgatgaagaaaagattaaagcgataaaggattggcctacacctgaaaatgtgaggcaagttcgaagtttccatggacttgcaggtttctactgacgatttgttaaagatttcagcaccatcgctacaccccttaacaatttgacaaaggaggatgttccattcaagtggggagctgaacaggaccatgcctttgaagagataaaacaaaagctttgtgaagcactgctgctacaactaccaaactttggtaagacctttgagatcgaatgcgatgcaagtggtattggcattggaggtgtgctacttcaagaaggtaaacatgttgcctacttttctgaaaagttaaatggtccacatctaaactactctgtctatgacaaagagctttatgccttagttcgagttttggaagtctggcaacattatttgttacctaaataatttgtaatccattctaatcacaaatttttatgccttagttcgagttttggaagtctggcaacattatttattacctaaagaatttgtaatccattctgatcatgaatttgtgaaatatctgcaaagccaaggcaaactgagccgtcgacatgcgaaatggattgagttcattgaaacattttcctatgttgtcaaacataagtgtggcacagataacattgttgcagatgcttcgtctagacaatgtgctttggttacacaattagatacaaaagtgcttggtttggaatcaattaaaaaactttatgctaatgaccctgattttaacgaacctttctctaattgtattgctggaaaaggatgggacaaattctatgtgcatgatggattcttattttggactaacaaactgtgcattccagcttgctcgatacgaaatgttcttttgcaggaatcacatgctggggggttggctggtcattttggtgtaaaaaagactttggacatgctttctgatcatttcttttggccacatatgcgacgtgatgtccagcgacacgttgagcggtgcataacctgtttgaaaagtcccgtcttaatccccatggtctatatactccattatctattccaaatgtaccttgggaagatatatctatggattttattctgaggtaacctcggtctcagagggggagggattccatttttgttgttgtcgatcgcttctcaaagatggcacattttatnnnnnnnnnnnnnnnnnnnnnnnnnnnnnnnnnnnnnnnnnnnnnnnnnnaggaagatagttcgtctacatggagtgccaaagactatcgtttcagatcatgataccaaatttcttagttatttttggaagacattagggggtaaacttggcactaagttgttattttccaccacttgtcacccacaaactga

SEQ ID NO: 17022 - DNA, 247 bp, Oryza sativa
  unsure (1)..(247): unsure at all n locations
nnnnnnnnnnnnnnnnnnnnnnnnnnnnnnnnnnnnnnnnnnnnnnnnnnnnnnnnnnnatggggcgaggcgtgcgtcagatcgcctgtcgccacctaacccgcgatctgaccggtctgtgactggtcacagaccggataaacaagtgcactgcactgcgttacatgcggcgtgacacgctcagccaaaccgcaataaatgtggttaggtgagccccactgtgcttacctaacccatacacgcggag

SEQ ID NO: 17023 - DNA, 1266 bp, Oryza sativa
cattcgatttagaaatacagatccatgtttgagttgatttttaagattatttgcttttggaaatataaaaggagacgtttaagaaacctctttaaaaaaaactcgcatactaacttgagatgaaatatagactcctaattgcagcttatgattttcaaagaaaaaaatatccaaccgaattcccacggtgaattttaccatagctaaaccttataacaataataaaattaaaatagtatttaccgttgcaacgcacgggcattttttctagtatgttataaaaattgaagatgtttttgttggtactttagtatgtcatccatgaattagtcggtttttaatttcgttcgcctctgaaaatataggagcagtattataagagatctctttaaaaaacttgcatgctaactttcagactcagctcatgattttctagaaaaaatatatatcaaagcgaattctcacagtgaatctaaaccgtataacaatatttctcacttcatttacctgtaatgcattattctctactttcacaaatagaagagcccaaaaaataacttattttgggacagatggagtaaaaaaatattagcctgtttggtagagctccaactcctaaatttagctctaggagttgggtctggaagtggagtcgtggagcaacctaaacccagctctaactctctagttcattttgtgagagagctctacccagctccgctcccattttagatggtgctgaaactatttggctgagttctagcttcaggagaggtgaaggtggagttggagcagtagctatgccaaacaggtcagactatcttcaaaacacattattaaaaaaagagtaaagtccatcaccggtccctaaacttgtaccgttgtgtcatcccggtccctaaactcgcaaatcgaccgttcaggtcctcaaacttgttcgactgtgtcatcccagtccctaaacttgcagatcactcgtttaggtcctacaacttgttcagttgtgtcaccccggtccctaaacttggatttgaatatcatctgggtcaaataagacagtctaaagactttatatttaaaaataatttataactttttcatgtaaattctaatgaagaaaaactttatatcaaacttgtagccctcgatgcgatctacaactttgtagttgaatttttttattttaagtcattttttgtcccaaaatgtactcttaaaattaaaatttcaaaatatataaacatgaaccaatattttgggacctaa

SEQ ID NO: 17024 - DNA, 609 bp, Oryza sativa
  unsure (1)..(609): unsure at all n locations
nnnnnnnnnnnnnnnnnnnnnnnnnnnnnnnnnnnnnnnttagaaataaaccctaccactatgttggatgttttatatttatggtcttatgcaagtattgacggtgttaatttggtacttaatagccatcaacaaacccacacacttagctctttactcgtcccgagtaaatgttgaggattaatgtggaacaaaattttcaaaaatataataaaagtacacaaactattctaagccataactgtacctataaactttgcagtgtataacttaccatcttgggtaactgatgaatggaacggttgtgactcaagtccttcatgtttctcctgtcaatctcttgagttttcatatgttttcacaaagtatctatacttctcaaatgacttttctctcaaatcacgcatgtggtttaatttgtggatccttaccaaggcatattttgccgaattgtccctattctaaaaggttgtatatgtggagcttggtagggatcaatcggggcataccttgcatacatattttgcaaagccaaaaggtcggacccaaggagatagcgagttatacttttttgatcaagaatgtgcatgtgtgtgatatgtgtatggg

SEQ ID NO: 17025 - DNA, 690 bp, Oryza sativa
caagtactatctgtgaactattttcttaatgacaagttcaagtggtatagtattaaccacgcagtaaactagaagatctccaaaatggtgaaagaaatgaaaaaagttttgcaatctatcaagcttgaatgtatagtaacagttttttttttccatgtatctacaggggttcctagacatcaaaatgaaacagtggcttcggaacctgatgacacgcagcattgccattgtgcctagcttaatcgtctccatcattggagggtctagtggcgccggtcgtctcatcgtcattgcatcggtacaatcttttactacaaatgaaaatatcagtttgcccataagaacactcattaaaaaaaactgccatacaatcaaccatcttctaattttctcaataattagtaagttatttgctaatcgaaatgcttctttcttcaaaaaatggacggtatgtaatttgttgtacctcattccttctgatcatactgttaaaaagaatcaaaacctaatgcttgttttggtttggctgttacgtttcatacagatgattctatcctttgagctaccatttgctctgatccctcttctcaagttcagcagcagcagcaacaagatgggtgaaaacaagaactccatctatgtaagcactcccccatcaatcaatcaatccttctttctagcttgtccaca

SEQ ID NO: 17026 - DNA, 4063 bp, Oryza sativa
  unsure (1)..(4063): unsure at all n locations
nnnnnnnnnnnnnnnnnnnnnnnnnnnnnnnnnnnnnnnnnnnnnnnnnnnnnnnnnatagttatgatatgtaaaaaagatatatatatcgcatgtacatctatattgcaataaaaagacggtggttaattagtatattgtattgggaaaataccgcataggtgtctatatttttctccggtgatctttgaggtggcgggcatgggaggtggcgcgctgcaggggtgcaaccggtggtggcaggctacaactgctacaccccacctagcctattggatcccatggagaggagagaaggaagggagaagaagatgagccaccttcaagtaatcatgtccctggctacgctctttggaggctgccgcttcatcgggcatcgagccagccactcatcttctggtgaaagtggtgggtacaggtgattggccgccgctctagccgatctgtctcctaatccggctggccactaccatcgtagtagtgagcttccctttgagtatcggcatcggtaacgcctgtgggtgccacacatattcctagaggggtagtttccacgattcttcactcatacttgccatgaggtggacactcagagcgaaaaatgtcacaaccagaaaatcacatttcccaatcactactgtattaatccgcgtcctagaaaaaaatcatggtatacctcaacgaatttgatgcgaaagacacatctttattatgttgataatatttatattattataaaggccgtcagacctaacaaacaaaaataaacaacaacagaaaaacaaacctatatttccatcatcacatgcgctcaactagggtataagacaagactctacctaggacttcttctccaaagtttcacttactaaagaggaaaagattgaacaaaaatgaatataatcatcgtactcagcaagtcacaccgggagatgcatgattaatgcaaggtggtataatgaatagtattacagggttgagttttgcaacaaacaatcatttcaaatcattttaggaataaaagtcaattttagaaacatgttcctataatccaattaattatcaaggtcacgacccatgcgaacctacattaaaccacaggccaaaaacagattaaaccggccaagcagccttgtaccagattctaaatcgtcctaagccataccaggccaaccattccaagttttagttagctaactagattatccaaattttaactactaacttgagtacattactagggatgcccataatcgaggtacaactattcaaataggttttactatgattagaggtgtatatctttacccataagacacgccttcctcacatgtcaccacgtgcctcataccaccacggtacatggacggaaaaggtggcattgttctttactcatcctagccctgaacaaggggactgacacaaccccattctacagccaaggaccttgtgacaggtagaggttataattgcgtcccaaagcatcagctcacccatattgggagtgactactcgagtgatcttcctttgccacaaatataatctaggttatcgagctagctacttgagtagctttcctttgtctctaagacaatatccatcacaccagacttcgtctgcttctattcgtgtcccgatgcccaatactagactgagctacaaagtacgccttacccacactagacatgtggtagtacagtaatattttacaacagaagctcgagattaatcctcatagcggtcgaggtatggttttgggagttttgaaaggggaagagagtgtcatgtgaaggatatacctcctaagttccagagttaccataagtgatctgaaatagctcccgaaagtcacataataaaacatctacgtgttgctaattaagcatgctaagcataaacctaaaaggtctaataagcgccacatatatagttcttactaaccggttcttgttacatagggttgtcaagaaatagttaagcaataacaaccaatagggccataacaaggaataataggcctagctaagttaaacagttattcatcgaaatttaatacaacaaagtgcaataatttaaattaaaataacttctgtaaactgggattcgatatgctcaaggagagcatgacttaccttgctctaagaaaagggtcttctgaacctttaacaacaaactcaacccacactacgggatcctccagaatgacagcaactacacgaagcacacaaacaaaactaaaaccctattcaagaagcaataacaatacctagaaagcacaaacatggattctttatgttataaaaaaagttaagagaattgaactagttgattcagagatcatatgaccaagatcatctaaagtttaatgttgttatgacaattcacgaattattgtgattaattttagatctgtagaacatgtctaagacatcgacccaagaagaaaggaagagttgagttgttgacatttggaccttacatgtcaatctctagaccacagtagacaaagtgcatagaagcagtccgcggatctacggaaggggaacctatgtgtcaaccggaacaaatgaccgacaaatagatcccactagatgccacatgggctgcacatatgggcaaccacatggcgctcacatgagcatgtggaaacactgtcatcacatgtgcacatcactgcggcacgagcgaaagctgacaccgacgcacgaccacgtcccatcgacaaacaacagtataaggaaacaccaaaatgagagaaggcctgacgaggggatgatgagctcacgaacaggactggcacagtgaggagacaacgacgatgactgacaacgaatggacgaggacgatgtagacgaggagatgactttagtgacgacctagcggcgtaggcaaggcagtgctagagcatggcttgatgacgcgatgccgaaggttgtgatgatgaggtttggcagcgcgtcgacgaggcgggaatagcgactagaggcactccagcttgatagtgaaagacggcgatgaggacgatgttactgtggcagccttcgggcgattggagagcgaggttgaagtggagttcagcactgcgaagccgaaggcggtggcggttcagccgggcaacgctctggcgagaagaaacaaccggccagagttgcattgcgagatagaggaggaaggcggcgataatgaatgggttccggcgtgctttgggcgaagccgaggggtggccggggaaggagatggtgacgtcgggcagcactccaacaaggtagagtgaggaggatgtcgtggagagacgatgtagccaggagggaggtggcaaaacagaatgatgggagggagagagggctctgttttataggcaaaggagggagatccggtgatggaaagtgcggattggcagtggcaatcatgccgagcagccatcaatgccagcaaggaaaggcgcggccatttcgggcgtttcgatacacacaattattggggggaaacttagggaaaaaaataagaggaatgaaaggggggttaaaagtccccagtcaatttggaagcatgggatttaattcgggtggattttggggagcaacatgcagggtttatgttagttttatctttctagaaactctaaaaattgttctgattacataataattatttcttgtgctctgagtaacgttttagaccatggagattttagggggaaaaaaatactccaaggcacatttgaattctacttgtacgtatttcattgtttgtgatttcttttttggcttttaatacattctattattccatttcagaaattatttttaattgggataatttatcacgacatgacaaaaatcttattgtggatgtccacaatactgatggtgatatttcaaatgtcacgacctgttctgatggcatcgaaggtttcctatcggcgagttgtctagtactccgtatgaaatagtgtctccgtcagattggggaagcgggaaaggggaaacgatgatccgcatctgaattnnnnnnnnnnnnnnnnnnnnnnnnnnnnnnnnnnnnnnnnnnnnnnnnnnnnnnn

SEQ ID NO: 17027 - DNA, 533 bp, Oryza sativa
tccatactcctaatcttggcttgtggtatcctaagggttgtgactttgagcttttgggctattccgattcggattacgccgggtgtaaggttgatagaaaaagcacaaccgggacttgccaatttcttgggcggcccttgtttcttggtcctccaagaagcaaaattctattgctttatccaccgccgaagtcgaatatgtcgccaccggttcttgttgtgtccaactcctttggatgaaacaaaccctaaaagactttggctacaacttcaccaagatcccactcctatgtgacaatgagagtgccatcaaaatagccaataatcccgttcaacattctcgaaccaaacacatagatattcgccaccactttttgagagatcatgagaccaaaggagacatttgccttacacatgtgagaaccgagagcatattggccgacattttcaccaagcctttagatgagaaaagattttgcgagcttaggagtgagctcaatatcttagattctcgcaacattaggtgatgggtgg

SEQ ID NO: 17028 - DNA, 5216 bp, Oryza sativa
cgagctcggtacccccagaagcttgtttgattgctaaatcctccatgagttggctatggcatcgtagactagcccatgttggaatgcggaatttggcaactcttctaaagggggaacaatcctcgggctcattaatgtcacatttgagaaagatcgtgtgtgtagtgcttgccaagccaggaaacaagttgggaatccacatcctatcaagaacatcatgactacaacacgccctcttgagcttctacatatggatttattcgggcccgtggcctacataagtattggaggtaacaactatggttctgtcattattgatgatttttcccgcttcacttgggtgtattttctccatgacaagagtaaggcttaagatgtcttcaagcacttcgccaagcaagcccaaaacctctatgatctcaccatcaagagggtgcgaagcgacaatggaggagaattcaagaacactcaagtgaaggaattccttgacgaagtgggaatcaagcatgagttctccgccccatatgatcctcctcaaaatggcattgttgagaggaagaaccaaactcttattgaagccgcaagatcaatgcttgatgagtacaagacttcggatatcttttgggtggaggccgtgagtaccacatgtcatgccatcaaccgcttgtacctccacaagatcttaaagaaaacttcatatgagctcttgagtggtaagaaacctaatgtttcatattttcgtgtctttgggagcaaatgctttattttgagtaagaggcctcgctcatctaagttctcacctaaggtggatgagggattcttacttggctatgaatcaaatgcacatgcctatcgtgtcttcaacaaaacctccggtattgttgaagtcactagggatgtgacatttgatgaatctaatggctcccaaggagagcaagttgttgtacatgttgtaggtgatgtggattcaagtcaagctataggtactaaggctattggagacatacgaccagtcaagacgcaggatgaccaagaagacagggatcaaccttcgtcatcgacatccaatagccctacattgagtcaagtgtcagtcgacccggaagttccgggaccagatggtcggaaccttcgaacctctccaagccaggaagttccgggtccatctgccaggaagttccgggcagaggacagtcaaggcgtgcctacggcacaagtggatggaattgatgctgagggcactgtagagcatcctgatcaggctcaggtcccctcggtgcaccatccaagaatacatcacactgtccaaagagatcatcccgtcgacaacatacttggtgacataagaaaggaggtaactactcgttctcgtgtcgctaacttttgtcaacactatttgtttgtctcttctttggaaccaaccagggttgaagatgcacttggtgatctggattgggtgatggctatgcaagtggagttgaataacttcactcgcaaccaagtatggacattggtggagagacccgaccaaaatgtcatcggcaccaagtggatcttccgcaacaagccagatgaacatggagtggttgtaaggaacaaagcccggttagttgcgcaagggttcacccaaatcgagggtctcgattttggtgaaaccttcacacccgttgctcaccttgagtcaatccgaatccttttagcctatgccgctcaccatgatttcaggttattccaaatggatgtcaagagtgcctttctcaatggacctatctcggagttggtctatgtggagcaaccaccggggttcgaagatccaaggttgccaaaccatgtgtacaagctccacaaggcgctctacgggctcaaacaagcccctagagcttggtatgaatgtctccgagattttcttttgaaaaatggttttgaaattgggaaggcggatactactctcttcactaaaaaatctaagagtgatttattcatttgccaaatttatgtcgatgacataatatttggttctactaatgcctctttttgtgaagaatttagtagtatcatgactaaaaggttcgagatgtctatgatgggcgagttgacctttttcctcgggctacaagtgaagcaagtacaagagggcactttcatctctcaaaccaagtacgtgaaggacattctcaagaagtttgggatggaagatgccatacccatcaagactcctatgcctaccaatggccacctagacctcgacgataatggtaaatgtgtggaccaaaaggtatatcgctccatgataggatccttgctttacttatgtacatctcgtcccgatatcatgcttagtgtttgcatgtgtgctcgctttcaagcggagcctaaagagtgctatttgattgccgtcaagagaattctaagatatttagtccatactcctaatcttggcttgtggtatcctaagggttgtgactttgagcttttgggctattccgattcggattacgccgggtgtaaggttgatagaaaaagcacaaccgggacttgccaatttcttgggcggtcccttgtttcttggtcctccaagaagcaaaattctattgctttatccaccgccgaagtcgaatatgtcgccaccggttcttgttgtgtccaactcctttggatgaaacaaaccctaaaagactttggctacaacttcaccaagatcccactcctatgtgacaatgagagtgccatcaaaatagccaataatcccgttcaacattctcgaaccaaacacatagatattcgccaccactttttgagagatcatgagaccaaaggagacatttgccttacacatgtgagaaccgagagcatattggccgacattttcaccaagcctttagatgagaaaagattttgcgagcttaggagtgagctcaatatcttagattctcgcaacattaggtgatgggtggttggctaatttatagccaaacatatgtcactaaaatgtaaattaaaaaaaataaaaaaaaattaagcttttgtgtcttgagatcacttcttgtgtagaagatggtcttgataccaggaatgaagctaaaacattccccttttatccaaaaactcccttttgtgaaaatttttgcaaaatcctttgtgtgccttttattgcgaaattttggtttttatttccttcttgtgatgtattgtgaccatagttatgtaatgttgtttgttggctggtcatatacatcataagtctcttcatgtccatagttcctaatttcccttcgttaaattctcttctcctccttgtttttgggcctgactgcccttgttctgtcaggccggaagttccgggcctccctgtccggaacctccgggtgtcggggagtatatatactcagggggagttagaaatcccggtctctctcctcacttcttctccctccccgacgccagccctagccgccgctacagtaccccttgtggcgattttcaattccatccgtgaaaatttgattcctctctgtggaatcaatcacattggtggctaggaggttcttcccgtgatcgatctgcgatttcctctctcaaggtagcacttttgatcttctcttttggttcatcatgtttttgccccaatctctaaatctgtgaacctagggagaaaaccacttggatagtcttgtttctgctaccttgtagatcaccgatctataggatttgttcacatgcactggctatttttgagaccactgttcttcatttttgccggccggaagttgcacctggaacctccgggcgctgtccagccagcctgccattcttgattctctcaaattttgcctaactactgcactccaatttgttgattcctgttgcagtaagcactatgcctcgtgagaagagacagaaagcctctcaggatgtgtccggtgatgagagtcctcctattcattttcctcgtggtcgtttgggaaaagaaaaagtggttgaaggtggcagtagcagtggcactcgtacctctcccaggtttaccaggcaatccagcaatcgcccagttcagattcgtgatgttgacagtggtcaaggtagtgatgctccttcttcaagaggtcgtgggagaggtggtggtcgcacttctggggctggaagggcctctcatgatttccttgttggatctcgtgtgaatcccgttcggctctacaagactattggttttgacaccactcctatgcatcacattggaagacccaagtccaactaccttcatcagcttgccaagtgcagaagggaccgtttgattgatccaaagacacagcctggggagtcacaggatcctcgtttcagaactttaactcaattggattggtacaactcagtgattatggctagagacaatccagtggttgagatgaagtggattgattggacttacatgaggaagaagaacaatgaagtgttcaaccaagcaatgcaagtttgccacaacaagaatcttggagatattcttgccttggagtatgattggaatgaggaggtcattgcacagttctatgcgacagcattctttgatactactaggaagggaacttcttatgtaaagtggatgactgagggtgttaggcacaagatttccatagcacagtttgctgagatattgggcttagaggatgaggatctcaataggcctaacatacatagtgaagcacttcttcccatgatcaagactaaattcatgtatactagggatgctcctaggacttgtatgggaactactcatggtttgcatccaaactacaaggtgctgtactccatctttcgttggtctttgcttccaaaggttggagatgccattgctttgccttccaaacatgttcatcttctcagtcgcatgcgctacaatcagcctcctttcagtgtgatgcagttgatttggtatgagattgccaacaccattcttgagcctaagcgaggttgcatctatgctccattcattatgaagatgattgagacagtcaccggggtgttctacattaaagatgggcgccacaatcctttcctcttctccagtggcacctagatccatcccttctacctcagctggtccttcttctagtgccccaccgcaatcctcgagctcttctcccatcaagaaggcacttcaggcaatcttctgtatgtgtgctaagactgcaaagaaagtgaagaagatagaaagcgtcagaagg

SEQ ID NO: 17029 - DNA, 1298 bp, Oryza sativa
tcctactgatgttgacaccgctgcacagtccgatgagtctcatctcttcggcgatcccgagattgttccttcagatggagatggagatgagtgatcctcttcttctcttcatggtttcttgctttttggtgccttgatgctaaagggggagaaattgtgaattgaagggggtcatttaaatcatttttgctgccttgactgctgtctggtcatttggccagaagttccgggtcctgtgatctggaagttctggccaagcatattccctccctattatctatctctctatggacatgtaatcgtattctattatggttggatgtaatgactgttagatgttttattatcctttatgtcagtaagttagactatatgaatgttgcattttgatgtgatgtagtgttcttttcatctttttgagtgtttgcaatgtcatctagttcttcttctagcatatcactcatcatttaagcactcacatctgcttcttatttgattggggatagtgtgaagttacctttgagctttccttcgtttttatgcatattgtattcttctctcatttccttatatgcatatctttagggggagcttcacacttctctcatcatttcaatttaaattctattatctttttgtgtgctttaaccatgttgtcatcaatcaccaaaaagggggagattgaagatgcacttaaaccccctagtgggttttggtgattaatgacaaggtggttaaaggggactaacgtgtttatcaagtttattcacaggagtttagtcccaaagcaagttgtgatggctaagaatgcaaggagacccccaaatttgaatgctcctaagtgcgaaaaacaccgaaggtgattagactaggtttttcactttcgaaattgagtttaggaaaaaacatactattaagaggggtttcaagtgtggttctagggtatacaaagtgctcttagtcatatccatgtgtcaaaatatttttggaatcatttttgaaaaatgatttttgtccccgggacagagagggctacccggaggttctggccggaacttccgggcgccatttcaacagcaaattttcttaagtgctgcccagaagttcctggcacttttgcccggaacctcctggcaggcttccagtttaaacttgtgagtaacggctagatgacgtcatctagccgttatatatatggatttcgtccccaggccaccctttggctattccacttcagctctttcatgttgtagggttttctagccactcccaagcttcctttacttcctccactcaaa

SEQ ID NO: 17030 - DNA, 592 bp, Oryza sativa
cattctgtcaaacaggtcgattgcactcttggcaagtccaagatatgcaaaagaagaaaccattgatgaccatgtaactagatctgggttatggatcataccaaatgttcgttttgcttcttgaacaaaaccattcttaccataagccatgataagggcattgcccacttgtagaaagtcttgcaagcctcttctaacagtgtaagcatgaagctgagtagcctcattagcagccgccatgtcggcacaggaactaagtagactggcaagcgtaagctcgtcagggcaaaacccatgtctcatcatcgacacgaaaaggtcgaaggcttccttgcctctgtcatgcttaccatagcaaacaatgattgcattccaagatacggtatttctcagcaccatggcatcaaacacccggctagcctcaacaacttggccgcatttggcatacatatcaaggagcgcagtggctaccaccacattcaggtggagacccaacctgatcacaattccatgcaccgagctttccaggaccagcaacaggtttggcatggtcatagcacgaagaagaaaaagaagcacgcacactgagcaa

SEQ ID NO: 17031 - DNA, 720 bp, Oryza sativa
  unsure (1)..(720): unsure at all n locations
nnnnnnnnnnnnnnnnnnnnnnnnnnnnnnnnnnnnnnnnnnnnnnnnnnnnnnntaagattttcagacaagaactgaacacataataggaaggtaatgcagaaacacaatattatcaactaaaggtctgtttggcagtgctccagttccaaatattcttggagatggggctggcgatggactgggaattatatggtaagtccctgaaagaactatatggcaagcatctttcttaacgtatttaatatgtaagatagaagactaaacgttagcctacaaactccatagtccattctacgagaatccagaagcttccgtaaacagagcctaaataatatagttgaaaaagagaagaattcaacaaacagacaatcttgctccaatgatgttcgtctccagtatgaataattataaatgggtataaaaatataaaaggatttcatagactaatgattcagtgcaatggaatttcttcctgatacaactagcactaaacaggaatcaaattaaacaagatttaataaacaaaaataacgccgcacaatgatgatccatttcaatgtaaagtacagataccatggaaatggaatgtctggattgaccgtattttcctttccagcaggagcattttttccagtatgatctgaagcatcagaaaatagtatgtgaaatacaagaataacccattttttcacttaagagctactttgaagtggacac

SEQ ID NO: 17032 - DNA, 5246 bp, Oryza sativa
  unsure (1)..(5246): unsure at all n locations
nnnnnnnnnnnnnnnnnnnnnnnnnnnnnnnnnnnnnnnnnnnnnnnnnnnnnnnttggccattacatcagagttacagaccaccgtcgggtaagaaggccaatacttaaggtcacagcaaccaaatgaaccgaacaacaattgagcccgttcttcttctgctattatctgaaataaaaaagaacaaattccttttactcaattggtcttcatcctttgtaagaggtacttcctatccatatacatgtaggccatttgagccttcttaactctctcctaaatataaggtgctctagagttttgatgtaccttctccttttcttgttcttctatgtttgcccttaccaagtagatgctattgctaacaaatacatgactcatcttttccgattgggtgtaaatgaaggggagaaaatcatttgagttaatttgcaaatccttgtgataagtttaaacaatttaaactttgaactgtatatcataatttcatcactaagttctaataaaatgtttctgcgagacgtaaaaccagtatctaaaacttattttaggaacttcaataaagtctggtgcacaatgcattttccaacaagaatcagacaatctatggcacatcacatgcaaacaaagaaaagctttcaagataggggtaaattccattgctattagagtaatatatagctatatccacatggcagacatttaaatgaaaataaaagctttctacccatgaatgatgcatgctaacatttcagtgtgttgtcacaactacggtagaatgggctgatattcgttgctttgggccaacaactttcaatgaaatcaaactgtttgagtaggaatggattaagaagtactacaatgtactgggattcagatctatactactttaaaatgttggtagtggtggtggcaatgaatctaccaccaccactcctttcacttgtgtgggccccacaataatgttagtgacgcatttgtgctccctgagattcaaatggaaagagttgtgtgcctctgctttaactagcccagtagacatccaaaaactgatggcgaaatatgacttgataggtcaacagttttaggctttaaaaaataaaaatgaatgccaaatgttattttccaaaatcccgtagcaagccacaggcaaatcagctagtgtctgaagtatatgatgatcttgcaattgtgcctgagattcagatatttcaagtacctgacggcctagtggttgtggtgaagatataggtgttgaatatggcacagcttgaattgaacatttaggggtttgtgaagccgctgcgtcctttagttgatctgatcttgcaacttcaggagtgcttgaggagctatgtaccttttgaggtaaaataacatctgttatttcagcaggtggcaactgctcctcagttaccacttcaacagctgacaagtcctcatgactgcagttgagttgccaaagagaaattaagaacaatctgaatgcaagtggtattgatgacaataggtagttgtaatgtaggaaaaagtttaactgcaaggaacactttgatttaatgagcttggtggtttagaagcacaatggttatttatatacgctgagatgcataccactattaagctaccaaaaaagtggaaccatgtcaatgtctgacatatgcaacgcctttgagacatgagttggaagaaaatggagcataaatttattaaagttagatatatacaacggaccacccaaagttcaaacaaaacaaggtgtaaacatatttaaaatcatagcagttatcaatttattgaatctattggaagtcctacatgcagaagaaaaatgcatcgtagctgaacccacatcctcacttgacacagttgtatggttttcagacaagaactgaacacataataggaaggtaatgcagaaaccaatattatcaactaaaggtctgtttggcagtgctccagttccaaatattcttggagatggggctggcgatggactgggaattatatggtaagtccctgaaagaactatatggcaagcatctttcttaacgtatttaatatgtaagatagaagactaaacgtgcaagcctgcatgactgcagagtcgactctacgagaatcccagaagcttccgtaaacagagcctaaataatatagttgaaaaagagaagaattcaacaaacagacaatcttgctccaatgatgttcgtctccagtatgaataattataaatgggtataaaaatataaaaggatttcatagactaatgattcagtgcaatggaatttcttcctgatacaactagcactaaacaggaatcaaattaaacaagatttaataaacaaaaataacgccgcacaatgatgatccatttcaatgtaaagtacagataccatggaattggaatgtctggattgaccgtattttcctttccagcaggagcatttcttccagtatgatctgaagcatcagaaaatagtatgtgaaatacaagaataaaccattttttcactaaagagctactttgaagtggacacaacgaattaagataggagaatatctaatcctattcaaatatgctacactactgcagttattattcacacacaagttggggtacgaatggtcctattaactacaaaaattcatcagtgatcattcaatccatatgtttgaacataaattataagacaagctagactttgaagaaaacaagaaaacgacatgagctgtacataaagaaaaaattggatgccacatctataaacttgctacaaaacttcaagttttgcagaacaaagtcatgccagcctaccactagagttggataactgatgtgaacaataattgcaaaagagattcaagagacagacccaaataaagaagaaatagtaatctttgccgaataggaagaaaaaagattcatatttcgatacaagaagaatcgacacaagaaaaaggcaaaaaattaccccattcattctttccaccaagtccctggggccaccattggggatcagcagattcttggttactctgtgagacatggcaaaaacaggcattagacatttctgtaacaaagacataattgtcttaacagattatatgtcatgtttcaatataaaaagattcttgtaattgcaacaacccaattattttgcttaaccaagatcactggctatcattgcatttaagaacaagaatacagatttacttcctacaaacaatacagaatgtatcttatgaccagagggagaacaaactcaatgtggatagcatttgtattgaacactcttattgtggaaatatttatgtagcctcctgccacatcatgctactgtattgcagcactccatggatcctaccaaaacgtctacatggaatattatagctattcaaatcaatctaattgctgttcacaatgtaattacagcaattcagtatatacttgtatttgtcattctagtatatcagtatatggtagctgtacaattgaactagaaaggttagtgcaatttttgtgcttttcctgaacacaacttcagcatattgatttcagcaagttgttttggtttctttgttgttcgttcttttgtagatcaactagcaaaacactcatgctttgctatgggtaaaagaaaatatataataatatgttagacatgtttgcttatttgaatacataatattcacttgattcaaacaaatattagactattgtataatatcagaaaatatcaaggactaatttgcagaaagtacaaaagtagtggtggtggcagaacaaccaccccactagtgtcttttatagtagtatagatattttttcagacatatttttttctgtttagccatgagtttttgtaatatgttagctttgaaacattgagtaaagtgccatcttagtgatgcatttatgatatgcttctgctataacacattgtagatataaggtagtgctagttcggttgttaagggtttagcccaggcatgacggaatcctgggtccgccgctgactgacaatcttgttcaagaaattgtattgtttagaattagaacatgcccaaagcccacatcactaaatgtggtatttttgtactctccactagcaaagattgtctcaaccatgctctcatgcctctggagcttttttaaagttgaccacaactattatctgcttatcagttccaagaatgaagataatgcaagagcagtaagaagctataggctaagagaaataaaattccttaagaccaactattaggataaactatgaagttacaggtgaatgactacgacagattattggagtgaagtacaagaaacaaaacaaggtaccaggtttgaataacagcattacatcgtacaaagtagagaagttatacctgaattagacgagcctgatcactgcagaagcttgctccttcaccggcatatttaattggtgtgaaggagctatccacaaatgaaccacccccattcacctaatgtaccatgactttgacattaagacatgcatttcaatcaaacaaaaattagtagtaaataaggacatacatcttccaacttttgccaaacagcaccggattcacttgataagaaacttgaatcggaagctaaaatatataattcttcttcaaactgcaaaggtcaaaatataataaaggcagataaacaaaattagtactaaaataatcaaagactgttaaccttgttttctcaccttaattactgtgctccaatgattattccagaaaagtacacaaggtttcttttcttcaaggtctttatgcaagcatgacaagctgcaacaataaaaaattgtacttcaacatgttctttttctgttagttccaaagtattctatttcaaaacatgtaaattaaactttatacccatgggcagtcagttgagggccctgaagaaaatctgagatctgctccactaagaaaacattgagtaaagaataatattaatgtttagggtaaagaataatatttatgttaagattggcaaagttatgttcaaataatatgtaattcaaaaacgaaactaatgctgttgtccccgtgtttgatcagtaacgctgttgtcccccatggaaagtttaatggctctcagcagttgttcatcttcttcacgatcaccacgccctttaatccccatggcttctttttgcgatatatactctccaacttctagattaagttcatcataagaacttgtagcaatagctgacgcc

SEQ ID NO: 17033 - DNA, 6938 bp, Oryza sativa
  unsure (1)..(6938): unsure at all n locations
nnnnnnnnnnnnnnnnnnnnnnnnnnnnnnnnnnnnnnnnnnnnnnnnnnnnnnnnnagctgcaacaataaaaaattgtacttcaacatgttctttttctgttagttccaaagtattctatttcaaaacatgtaaattaaactttatacccatgggcagtcagttgagggccctgaagaaaatctgagatctgctccactaagaaaacattgagtaaagaataatattaatgtttagggtaaagaataatatttatgttaagattggcaaagttatgttcaaataatatgtaattcaaaaacgaaactaatgctgttgtccccgtgtttgatcagtaacgctgttgtcccccatggaaagtttaatggctctcagcagttgttcatcttcttcacgatcaccacgccctttaatccccatggcttctttttgcgatatatactcttcgactctagaggatccccttcatcataagaacttgtagcaatagctgacgccaactctgaatcctgataatcaatgtaacaattgaaaaccaaaatctgagaaatagttatgtatatgctatggttgtgtttggttgcctgcacctagcctagcgatagcaatcgggcctgatgagaatgactcaggaacaaagccctaaactaaaccctagcaatcgggcctgatgagaatgacccaggaacaaagccctaaactaaaccctatagcagtgccctcctattccttgcccactgctcatgctcatccatcatcctgttgtatgtatgtagaggtagaagtgaggtaaagccctaaactaaaccctataacagtgtcctcccattccttgcccactgctcatgctcatccatcatcctgttgtatgtatgtagaggtagaagtgaggtaatctgagggaggcgaggtgactgatatgtgcacatatgatgagaagctgtatctccacttctccagagcaggaacgaaggcccacacttttgcatttgcctggctaggtttggaaacaaacatatccagcaaaacagccagtttaattttaatactctgcttacactttcatcctcacttcatgtaaaagggttaactcgcttcatataagcaggcccccactcacctaaacttccgagttggtactaaaacaccaccacaacaacacttttgggccacatgggccaacacctcctacatctacaggcttcaaatgggctgaggtgttccattactgcgtctgataatgcgagaaaggtaccgtgcagcaaagcaaagaccccacattaagcatgatgctgcattgaagtgcaactgcaataactacacattcagtgttctcggtggtcttacatttatgcacaaaaaaagaacataacaattaggttcccttacctgatccacaagccacccatggaatacagggatttcaagataatcaaaaagtgcatattcaggtgagaacacaaagccatcagtactgcaatgtcaacatttcaaacatcagaacacacgcaagcacaaacacaaccaatcagcacattttatatcattatcaccttttaaaagtcacatttatgcatacttctctccagaggttttttgctacagataaaactttatgttggaattctgagtactgaaaaccctcatgcaactcaaactgcaaaagaaaaagggaagcctgagttacatttgtatttattgtgagaaattacagttatataaaagttgcaaacctgcatctttctgcatcttttaaggcgagaaatgatacgactaagaagatcatcctccatcacttcagttttgtttaggaacaatccaatctcactccttaggagaagaacattgcctgcacaggcacatgaaactaatgtaaattaagctaaacatagaacaaaaaaaaaaagggaagctgtatactcttacagatcacgataagaccgcatggcccattctcatgctggtgaataatgtgagtgggacgaccaaagaaatcaattgtcctagtcttgtaggacaccttcggaggtctggtcaccacaacattttgttcagtgttattcttctccttcttccgccttttgctgtctttctttttaaatttcttcttgtccttaagaatgagttaaacagaaagagaaggcagaatatgaattttggtgacaatcaactatattgcaagctactgtacttttctgcaatattgcatgtgtatattgtaatgttaatacatgcagtaggaacaacctcataatgagaatgggaactggaatcatagctgccatttgaattatgagtaaaaaaaacaaaagaaacttgaattgtcaaaaacaggaggcataaaagggtcagataagcttcttgttgatataagaaagccacttttatccaatctaatacctaagattgcgactattattctagatatattcccattttgatacagttgctcgatgcaacacaattattctacatcaccctcttctagcagtatagtaaaacaccaatctagaaataacataactatatagcagtatcaaatggcactaaaaacccagcaaattgaaatgtcaaagggcccttcgccaaatgtagtcaaaatgatttgttattaatgcatggtaagagcagtgaagtgtgcccactctttttgagtgaaaaattttaatcaacaaaaacacttgaaactttacttggaaaaactgattcttcagctcagtaaatcatctggaaaccactattacctttgcaaaagtgatttcttcctctgcaattatatcttttatcttcttttcattgtgtaaaagctcaggaaagtctccactcattgattcgataaatgcacttacaaggctgttcaaggaaaaaaaaagatcaatttaagtattataaatcccaggcagtcatcatataggacatgtattttttccctacagtctaagcagagttattgacccacattgcaagcaatttagcctactccaaataacaatacttgtacatgggtggtggcaacggtctgggaggaaaaaaattttccatatcaaagccaagtatcagctaaaataaattaaactatcaaatgaaaaggcacacatgaacctaaagcaatcatatcataggcctttgctaatgtgaatagaatcaaacagttcggtcagattccatgttaaatctgccaatgacaaaccaaatatttgttggaaaaagactcagactaaaacaaagtaatagttgataacgtccaccacatcagcccctaaattcactataaaactagtttgtttcatgttaaaccttttatcatactccctccatcccaaaatataagttattcgtagtactaggatgtgtcccatccagtcctaataccttatattttgggacaggagtaacagatatctgcagtaatgctcttcttccataatcacaggtgtagtcatattattctgcctcccatggtaaaatacttccatctcatgtgctatttttgcagttccactaaagacacatagcatatgcggtaacaagttaccatctcatatatgcaatactataacctaatacttctaggactatgatatgcatcagtgctgaactccgtatgtagtaccaagtatccatctcaatacatacaagataatagcatcctacaacttgagctgtggagtgttactgctggtgcaaacaataacaaaaaaagatggaaactatgtgcttgatgcagggtgcatgataaaaattctatttacatccaaaccacccatgcagattgacatggatattaccatgcaatgtagtatataaaaattccatgtgttcgtgcagtaaatttagtagtgcacggaataagctattcaacttagtaaaattatgtactagtacttttagagacttatatatgcacatccatgttagcaactgtaccatttaaactgatatttgatttccaaggttcataatgtttaaatccacaaaaccaaaaggactagcttttgtgtccagaggaaacattgttttgtggcattctgtgcaagaataaagttacgcaagcatatggaccaaaagacgtggcaaatagcatagacaagtgatcgttcttacattgtaagaaatcgttgcttggccttcaagttttgatgaccgaagtaaatagcccgcctaagcatattccttgctatctcaattcctaaaaaggatataatattacagacaggcaagaaccatttttcactacaaaatgaagactgaaaggataacaaacatatgacaaataaaacaggtaatggtagtgcagtatgcaccacataatcttttcagttcattaccgtccctagtaaaccaggtggaccaagaatctagaggatgttctgatgacagataaactttgaagatcatcataccatatagaatgcaaggtgacaaagctccttatttcattaacaaggcaaatacatctcataatcgcatttgcatgtgtcacaacaagaaaaccctaagcatttgcatgtgtttcatatcatttatcaccatcaaacagtatatacttaccaggctgagaaccatcggcaatagcaaaactacttgttcttatgtgatctgcaactatccggtatgccaaatcaacttcattaatatcatcaggaccaaatttaccagagtatggttgaatttcattgccagtacactgcatttagatgtgcaaattattcattaataaatattaatatatcatatacagtatacaaaatcaataggaaactatggctaactattatacagaataaaaacatcaagtgtgcatatgggcatcatacttggcggatggagtcaattgtcggcattaatatgtcggtgtcaaatttgctctttttcttctgaagtatagaagttaattgttcgaagttcagtccagtgcctacatgtttggctgatgatggcatcaatatgccacctgcttccttattgaactagaattaaaatgcaaacagcaaatgtaagtatgcataaggaaaaacatcatgtacaaataaaaataaaatcactgattacatataaaagcttatcaaccagtacccgaagaaaagcaattagcaatagcacagcaccgtgtagaaggaataaatatggatagtcatcatgtacaaataaaacaaactaactgattatatgtatatgaaaaaactttagccatctgcacaaaacagattaaaagaagtatactaacctgaaaaaaaacaagattccatatctcaatacaaccagggtcatcattgttcaataatgaagcaacatcatgatgaccaatctgatcaaaatatatttgactgcacggtccacaaggaccagtgtcaccattttggtagaagttaccctgttgaggtttatataattgttcgtttgtaagtaatgcaacaatagtaaaatcgaattgtatgagcaaaataatctgagagaaacgaacatataaaatgaaactaatacaacaaaatgccctgttgccaaaagctctcatcagtaagccagcacatgcacaataccttgttgacaagaggtagaactttatctgatggtagatatttaagccatatgtgttttgactccagatcaggggctaagcccgatttctcatcacctccgaaatatgtcacaaaaattctatcaacctccaattcgtagacctgcatatcagagaatgattcaggagttacagtctgaagccctgaatcagcaaacacaacatatgccctgaatcagcaaacacaacatataggtcgctgaccagatcatgattccatgaatgcaacatataggtcccagaccagatcaagagtccaatgaatgcattttaataacttaatagattgcaccttcaactgtttcacccgagaagcaacacatcaacttaagtgacatataaacggcgtttctcctaattgcagatagccacatttttcatcttcaaaaaaaatcaaacgttcatcccaaaacaatggcattggccaccatttttatgtttcaatcaatcgtagaaaaccgaattaaaaaaaatcgccctaaaaaaacaaaaactagtcattattcgggcactgtatacaacgtccctaaatcccttcagttgcggaagaactagataccccaattctcctgcacatcaggtaaatctgcagcccaaaaattaatcgcaagccacccaagacactagtggatcacaaatccaaatcccacgatttgcatagcccagtcgtatccacacatgaacacaagatagatggagaagagactaagacaggggggtgggggggcgggggggaactgttaccttagtcaagagctcccacgcaaatccaattgcctcctccttgaagtagtccccaaaggaccagttccccagaacctcggtgaaggtgaggtgcctatcatcgacggcgacggggatacagcggagagatttgcaggcgtgtcccgggcatccgagctgcgagccttgtgcagcggtgtctaggagcaccggcatgaactgattcatctcggcgtcggcgaaaagtagaggggaatcctttgcggcgaggatggtgctcggggaacaccgggtgtgcgccttcgactcgaaagaaacgtctcccgcaccacgcgggcggcccatttcggtggcgccgccatcgtcggtagtgcggggcggcggggcagtggatcgtcggttagggggacaagacgcggcgcgaggaagaagtaggaggaggaggagaggcggtaccgaccaaaaccctacaccctaggatatataagtaggatgaaagagccgcgccgaacgcccgcgtacagcgttgcggtgtcaagttcttaattagccgcacttaacgtgattagcataggactgattnnnnnnnnnnnnnnnnnnnnnnnnnnnnnnnnnnnnnnnnnnnnnnnnnnnnnnn

SEQ ID NO: 17034 - DNA, 7676 bp, Oryza sativa
  unsure (1)..(7676): unsure at all n locations
cctaccaatattttggtagggtagcattttaggtgaatggatttggattgataccaattggagaccaaattttatattatagtcaagaaagttctagaattatgtcaaattaatcatggacattaccattcacttggcttcaaaccaaaccattacattcacttggcttcaaactaccaaacaaattagtagggcacattttggcatcaatccaaaatggcccataatatataaaattttgattaataaatttattactatataaatatttttcacgtaaaatatgccgtttaactttttagctaagctggaatagccgaaaagagcgcaacctaataacaatactccctccgtttcagactataagacattttggcttttatcaaagtcgaatttcaagtttgactatgtttatagataaatgtagaaatatttacaatatcaaattagttttattaaatcaataattaaatatattttcataataaatttgtcttgggttgaaaattttattattttttctacaaatttgctcaaatttgaagcaatttgactttgaccaaagtcaaaacgtcttataatctgaatcagatggagtgataaaaattagggtatactccacgctttgctgtgggatacgtgaataaatgcaggttatacattattacagaaatgatatatgtatagtttaaatagtttaaaaatgatgtcaagacaatgatttgatatttcttgcatattgaattctaaaagtacaacaacgttgtaaataatatatcatatttgtgttatatttaaaatattctatataataattattagtgagtgatgatgtgcagcatttgcatgttaagctttaggagttagtggacatcaactttataataagatagaatatactaaaatatcatttgtaatggggttggtggatagatttgacaatgagaaaaacactaaaataccctttctaatggcgttggactgtttttctaagataatggaataaatttttggtctttgctcaaagagctacagctaattattatataaatatgctcaatgacgagcgcatatcaacaagtccataatagcacacccaataaaaaagaagcaaagcacaaactaatgaccaccaacattaaacaaaaaaaaccccacaattagtgaagcctatttgtgaatctccatccgaaattgatgaaaatctgcataatcgcctctaggttacgatatgcagaatgctaagtttgatgatgaggacacaactagctcggatataaccatgactaccttatgtattaataaaccaaaggtgcatatgttctacattaggtttacttattatatatttgaacaaacgttgctacacaatgagttttatgtgttttcgtttgcagaggtacttgcttgggcgaaagaaaagagaccgagcgtaaggaaagcgtggatgattagagaaggtctaccgttgtagcatttcacccgagagtattccaagggtatcgtatttattttatcccgtgggaagatctctacaggtatcgtatttattttatcccgtgggaagatcatgtagagagaacttgactaataatttatatattacttgtaataatcatattctaagtaggggttaagataatccaagggtagagtgacacacaagcatcagctactcattctcataatatattatctaagctaagtggaaagaaaagagaaagataatctattcatatacttctaatatacatagtatacatacattctagttaaccgatatactagctagtaccctctatccgatgccctcctggtaattcgagaagccatccctaactgccgagttccttacgatagcccgtcatgaccatacaaccggggctaaatacggaggaatacccttcccagggaattatatacacgtgcgcaggaatacccatactgagctatcaccatcagcggcccccctttcaactgcagcatataaccccaaataatgatatcccgtaatctagacaccacgtcttaaattattagatactactctaatatcatcgtcatgacatagagtaattgcatatgcaaacattatacccgcaccaaagcatctcccagataagctagcagtatattcattataacatgaacataatgtaaagtaggcattcatatactcggaaattatttcaataccataaatgtatatagaagaatattctaataaaagtacaaagcttacaaaagaggaaaggaaagctactagagccatacccgaactcttccgaagacttccggactcctgatttctactctattcctatttcactatcttgatactactaaactaaacttgatagaatatgagagagctcttgcttgaggtgtgtgttgaagtgaagagagtgaggggtttatatagcctcccaatgacagttgtgacggttggaatggtcggaaataccttccaaccgtcattgggggctaatctacaccgtccagccgcaaccctgcatccaacggcaccagggagggttcggccgaaccccctggttgagccgaaccaggggccggcccaaccagcccaggttttggctggtggccttctccgttgcttcacttcttagacttgtgaattttggcccaattcatcgtgttaattctgagttcttggcccattcatacataagtctgattctcgacattgtccgattgacttatcgtctgatttgacatcgattctcctccactttatggttattctttacaaaaggttagtgaacctaatactagtggaatattattattctaacatgtatatgcattacaagcataactagttctcctctattttggtaatattgatggtcgaaactggtcgctaacgaccgtcaacaacccacaaaataaccacacatatacacatatcacacacatgcacattcttgatcagatagtatgacttgctatctccttgggtccggtcttttggctttgcaaaatatgtgatgcaggtatgccccgattgatccctacagagctccacatatacagccttttagaatagggacaattcggcataatatgccttggtgaggatccacaaatcaaaccacatgagtgatttgagagaaagccctttgaggagtatatctgctttgtgaaaatatatgaaaacccaagagattgacgagaggaacaagaaggacttgagtcacatccgttccattcatcaattgcccaagatggtaagttagacagtgcaaaaattcataggtacaggtatggcttaaaataatttgtgtacttatattgtacatattttcggaaattttattccacattaatccttaaccttttcttgggacgagtaaagagctaagtgtggggatttgttgacggctgttaagtaccaaattaatgccgtcaatacctgcataaaaccataaatgtaaaacatccaacatagtggtagggtttatttctaacaatttccacgagtgttggtatatatttgtatgcaggtgacaagttactaaagttgagagaaaatatacatgaaggatgagaatataactttcatatccaagctaatggagtcttgagcccataaacccaataagatgcaatcatttgagccaatcttcagaagaatatacaatggggcccacatatcagtctctaggaggaagggctgggctagcagagccggccagggttcggccaaaccaccagctagtccatccaggcccatttttcacctggcagttgcaatcctcatccattggcggttgtgaccgtttctaccggtggaaaccgtcatagagaggacacttgtcaacacaagagagaaaatgctcttaggatgcttagcatctccacattcccaaggcatctctccacctataaatacggccctctcctctccctcattcacacacaccaaagcttgagctaaattataagaggctctattgtactttattatatattagattagggagagagagtagaagaagtcggaggagttccggagttatcaataatcctcttcttatttctttctgctctgttaattactctgattataatagaaatatcttttgagtaatttagttttgcttggtgagaattacctcttagttatttcctaatcagcgtgctagatcatcgttcactataatacagtaaaatagtgattgctttagtgagttctaaacactagaatagctattaattgcttagacatggtgtctaggtagttgatttccagtgtttgctctgtatcccacagtaggtgtgcagtgggtgtagaggtggtgacagccctcaagatcactaaagtccttcctgtccgggtacgtagtagagcgatatctgggagtagcgagctggccagtacccgaagtatcgcgttaggattaaagttaagctttccatagacattgtttctcaccggtgaatcctctctatcctttgcctatctttagcttcgtgtccttggatgaacctgactaggagttaacacacacgttccctatggaaatcgatacctgagaatactcctggggtgaagtactacatcggtattttccgtgcgcttatggattctatctgtcaggttaagaaataccaacaatggagcaacccacaattcaaaacctttttgctcctcgggctgatctttgtgagccatcctgttcttcaaaaccaatcctttcggatggctacgaaattagtcctgactttatagccatgattcaagagcaaaccttctctggtagtattggtgaaaacctatacctccatcttcgtgattttgagctagtgtgttcgtgcctatccatcgtaggcatgacacatgaaactcttaaatggaaattgtttccttttttctcttagagatgaagcaaagcaatggtacactctgtctgtcaggaaattccacggtgaataggagctaaagtgcaaattctgccttgccttctttctgttaacccgtgtaattaatctttgattagacatcctttctttttgacggaacgagaaggaatctctcgctgcagcctgggccaagttctcactgttaactcagtctggcccatactcgtctttacctgaccatgtgttgctgcaacattttcgatatccgtcggcggtcggaacgcgagnnnnnnnnnnnnnnnnnnnnnnnnnnnnnnnnnnnnngcatgcgggccaccgcgtctcgctcacaaggccacgccatccccagcgggcgagcggaacacgccgtcctccgcgccttgggcgtcgcccccaccagcactgggcgtgtgtccggtggcgctggtggcaggggccccccaggtggcctccgccctgtgcgcggtcggggacgccctgccagcagttgtatgggggcgcgtcggtccccagggcctactctcctcctgagggcctcgccttgggttctacctcaggcgcggtgcctggatcctggccccctcctggggcctattcgggctcggcctcgggcgcggcgtttggctccaggccccctcccgaggcctgggactccgcgccgttgtccggccactccatctcctcaccgaccctggttccccgcgccccggtcttggttgtttgcgcctcggcctcagccttctccgacctgtgtgacttgggccgctaggagggatcgtcggcaggggcgccgcaagggtggatctcgctaaaaagaaaaaaaagaaaagagaaaaacaagcaagatggaaaagataagcgaagggcataggttgaggaaccacgagatgtggcgttaagaccgaacctcagggggtggcgcttgagctccattccggggacttgataaactccccccggcacggcttggtctccgccgtcttgcacggccatttcttcctcctcccagccactagctatgcggtcattgagggctgcgccggttcggtgcccattgggcgcctgccaacggcgcactctgcgccgcccccgcagggccgggacggggagggagaggagtccctttgcttcctcttccccttcgggtcagaggggcggctgctgcccgaacccccgcccgtggacattcctccatggccgcctcgggcggataggtagcggtcccccaaaacgtggctgccgccagcgccatcacctccgctgcggtccccgcctgcgcctatcgcttgcatgatggccaggatggaggaaggatgttgtgggggattagcgacggctcgacatccctgaggctgagcacccactggaccactagcttgaggttggcatagttctagtcccaggtctgccccggatgagtccggatggagtcgtcggagccggtgtatgaccatgcaccccggacccgctcccggagaggcgcaatccggcagcgagtgtagtcgctgaagaccatggcaccagtcagccccttatactgcagaccggcgaggtagtcgatcactgcgtcatacgtgtctcccaacaccgacaatgaccgccagctcgacgtctgaacgggcggtgctgtagggagccaaaggtggacgttgtcagggaggacggtgtagaaccaatcgtgcttccagtcgtcccacttcttgcgtagcgtctgcccgaaatagtgctgttgcgtgttggcgcgcggctagaagtagcagccgtcggcttccgtcgcgggggacaccagttgcatggttaagaaccaacggaagaggcggaggcacggcctcaccccgatgaacatctcgcacagatgtgcgaagatggcaagtgtcagcacggcgttcagggtgaggtgcgccatctggatctcgtagaagtcctgaacatcgaggaagaaagacaaaaagggggagtcaatcccaccatgacgaacaagaggaagaagactggccgctccggataacgcagcgtcgggcatgcctcgcccaggataatcattgcccgaccggacgacgtctgtaacatactgaaaatttgctattttctaaatatgcatcatgtcgattcttatgttcttaataaccttcctaaacctaagaaattataattagagggacctcctaaaactaacatgcataaaatccctttttggtatttaaaatctttcgtggcttttattctaaaaattgatcttgttaaattgaggtattctctttgatttttgcatcttaaaccttctttcaaccaaaatttcctttattcaaatttagtttaaaaatcctttttacttttatgaattgtggtccaagaaatccaccaacacaacccttgaacctaaaccaaagtaattccaattttcttggaattaattgggtcctttgatcttaaacctatccttgattctcgatccaaatttccttttagcctcatatacttctctagaatccatgccatatattttgggctaaaattctatttattctactccctccatattcgctccacatactcaaaaatattcaaatctagagccatattatttatggtgttgaatattttgaattcctattttgagtgcatcaaacaaactcccactccaaaatattgcactcaaataaaccagaaaatctctcttctggaaattatatttggatataatttcctttcaaaccttcttattcaaatannnnnnnnnnnnnnnnnnnnnnnnnnnnnnnnnnnnnnnn

SEQ ID NO: 17035 - DNA, 1883 bp, Oryza sativa
  unsure (1)..(1883): unsure at all n locations
aacccttgaacctaaaccaaagtaattccaattttcttggaattaattgggtcctttgatcttaaacctatccttgattctcgatccaaatttccttttagcctcatatacttctctagaatccatgccatatattttgggctaaaattctatttattctactccctccatattcgctccacatactcaaaaatattcaaatctagagccatattatttatggtgttgaatattttgaattcctattttgagtgcatcaaacaaactcccactccaaaatattgcactcaaataaaccagaaaatctctcttctggaaattatatttggatataatttcctttcaaaccttcttattcaaatattctccgaattcgaatgtaacatactgaaaattagctattttctaatcttgcatcatgttaattcttatgttcttaataaccttctaaacctaggaaaatataattagtgggacctcctaaaactaactcgcataaaacctctctggtatttaatctcttttgtgtttttcatttaaaaacatatttggtatttcctgttggaattctatttattaaaccttctttcgactaaagctcttttattcaaatttagtttgaaaaccatttttattattatgaattatggtccaataaatcttcccatattacccttgaacctaaaccaccgaaattctgattctattgaattaattgttaacccatcctttgatcttaaacctatctttgattcccgatccaaatatctaaattcctccttttaatctagccactaatttaatctctgtggcttgatctcctattcggcacaagaataagcaatattataaatattaaaataattgctcttgtgctaagaaaatagattatatctttgtcatccaaatttccttttagcctcaaacaattctttgaaacccatgccatatatttcgaggctaaaaatcctatttatcttcatccatccatctcctcccatattctcaattatatcctctattttaggaatcatactattcatgccaatatatatattctcttcttctcatttgagtgcaacaaataaattccattatatcctctccctcaaaatattgcactcaaactagaaaatatctcctacataatttcctttcaaacttccctattcaaattccttccaaatcttctccaaatttaaattctaatcacccaaacccttgtcaaaatttagaaaaacatttatttctaatctgggccaaagtcttctttttcttcctttttggcccactggcccagtttggcccaacagaagcagccgctccatctcctcctgtgggcgccgtcaccgtgcgtcgtgggcacgcacggcatacccgcgcatgccgctaccatcgccgtggtttcacacgccgccgccaacgtcctgccgtcgtcgccaaggcatcgccgccgacgtcaccgccatctcacgccgccgacgtcagcctctgaagcaaaccgacatcgatgcccaatcatagaacgagaacgatgccgtcttcctcttcctcacgtcgccgctaacgtgctcctcttcttcttctcctctaaaaccgcctccagaaccgccatcatccaccgcccctcgccgcctataaatagccggcgagcccttctcttttccccacaccaagccgagccccgagcttctctcttctctctctcttccaaatgccggccatcggccgatctccctcgtcggagcatttccgaccaagccctcgcgccactaccttcgcctcgacgaggcaaatccattccctaannnnnnnnnnnnnnnnnnnnnnnnnnnnnnnnnnnnnnnnnnnnnnnnnnnnnnnnnnnnnnnnnnnnnnnnnnn

SEQ ID NO: 17036 - DNA, 7330 bp, Oryza sativa
aatagccggcaagcctttcttttttcccaacaccaagccgagccccgagcttctctcttctctctctctgccaaatgctggccatcgcccgatctccctcgtcggagcatttccgaccaagccctcgcgccactacattcgcctgggggaggcaaatccattccctaacctttcccttcgttttcccctccgagttaagccaccaccgccgccccctataccggccgaaaccgagctcttgttgtcgccgttccggcctcctccctaactccctttgccggccaccaccctcctcgtatgcgcgttgctcgggaacgcgcatggccgccgacgtcgccaccccccggccgccggagcgccgccgcccctctctccctctcctctcccttctctcggccctctgtgaagcgggaggaagaagacgacgggaggaagaagaaagaaaagaaaaagaaaagaatccctgacaggtgggcccatgaacagtatactttcgcaatttactctatttaatccaaattccaatctttagaaacccatatctcctaaaccgtagatccgattccgataaaacttggacctaaattcatctaaattcaaatccttcattttgatatcaaatttgctattttaagattttatttaaatttccttaatttattcaaataccatttgaataaatatttgatttaattattcttatatttgaatttccaatttaaatttatatttgtattccaaatatttccttttattttcaaaatacgctttagccactaaaagctgtcggttggaactttacgccttccatggggacgttcgcggttttctatccccgacgtcagaccgttggttgtaaagcccggcataaaccaaacccaaggtcgaagtgctgctcctggcaccccatgccttgatgcgtacagcggtcggagcttcactattccctcgacctccacagcacgccgcacagttagctctcgggctctgtgtgtgatcctagccgccactcacggttgtcggagtaacacttccgccccactaaacccacacaaacctcctatccctctagccgttatgctatctgttgacaccggctagagaagataccaaacctagtcattatgctctagcatcgactagcacaccaccaaaccctagccctcctaaccatttatcgttttcttgttatttatggcttttattgaaattggttcttcgtctttcttagtagaatctattttattttggatggcaacctgtggtatttcgaggatcggataatcaggttgcctatctcggatttatttgcgttggagcaaggcaagttattattcctcccctttgagcattattatcctatattctatatctctattattccatgcattacccattcatgattttaaatgcataacttgaacatatagcaaaccagatatatgctagattttgcttagccatgcctagttagattgcataaaatataacgaacttagattggaacagtacggtagaaatgcatgatttccgggtggctcatactgttccaaccgacataagattgccaagtacatctgaagaacgaacgagtacgaccgccaattctagaatggggacagacttagcaaagtaggttatctagcaaaggtggtacctctgtacagtggttcttctttaagtcctcacgcaggaggcaaatttacgccgagcagggcgattataatatttaccgaggcacaggtaaatatattgattattgcgcgctgtgtgtgtattgtgaaaacctggttgggatgacgggggtctctcaaccaattctctctctaaaaacctcgggaacgccagaactcctctcgctgctgataacgttatgttcagagcgcatgaggatgagagttcatggaacagatgccactgatgttagtaaccgaaaagttttgccatgactaagctgatgaatattagcatgtcatggatggcgggtaaagcatacatctactgtagtatgagtatttctgaaactattcgaatagccgtgctcacggatattaagcatcgggactcactatggcatcttggttagaaatataactccagattttattaaatattgttgcattcaaaacattatagaatttctccttctactttcttagctttctgcaaatagatctagccactacgcgagaccatgtcatctctgacgggcccaaaccctcacctttgacaggtttgatgaatattagcatgtcatggatggcgggtaaagcatacatctactgcagtatgagtatttctgaaactattcgaatagccgtgcttacggatattaagcatcgagactcactatggcatcttggttagaaatataactccagattttattaaatattgttgcattcaaaacattatagaatttctccttctactttcttagctttctgcaaatagatctagccactacgccggaccatgtcatctctgacgggcccaaaccctcacctttgacaggtttggtcttggtcagtgattagtggtcactgatgacaaaatcacctgtgacgggtgtgtcatctctgacgggataaaacttgtcacccatcacatatgagttatcagtgacgtgtcgtaactacctgtccgtcactgatgactcatctctgacgggttgtaacttacgacccgtcagtgatgacaaagcaagaaatacaatttttgaattttaaacgcaacaaaaaaacctcaaaaaaatattttgaattttactagccatcctatacatggtcacacatcaactacctacaaattcacaattttttacgcaatataacttgtatgctacacatgagattcgaactcaagacctcaacctccatatagagctcccttaccaactcacctactcaacaaatattgactactcacccaatgttattattttgtctatgcttgtctgaatcatttaacatatatttaacaccctaaatgacttcaaatgaaaatattatcaactaaatagttatagatctcatcgtgttttataacttttacatagaaaatatcttcattcgatgttgtttgaagaattcaaaatttcatttttcaaaatatatctcactttataacatgtaaactttgtgaaatgaaaatattttcaattataatattgtagatctggttgagttctatgactttgatacggggcatgtatccatccatgtcatttgaaaaaaactcaaaattttgtttttaaaagtagatctgatcacttgtaatgcatgttcggggatgtaaatgatctctaatagaaatgttgttagttataaagttgtggatatcatcgagagctacaacttttatataggacatgtctcaatccgaggttttttgtaaaatttgaaaatttgaattttcactcatcactaacgggtcatgactaccacccgtcagagataacgttatctgtgacgtatgttagttaaagacccatcagagataagtggtctcttttgtgatggttcataatactacacccgtcacagatgatctgtgacgagccattgttgtgacccgtcacagacgatctgtgacgggttacaagtgcaagccgtcacagatgacctcacatctgtgacgggtcctccctggtagccatatattgaagaggatattttttcggcccgtcagagatgactcatctttgacgaattgtgttggcccgtcacaaatgacccgtcactgaagcccagatctgtagtagtgctctactcaaatactattatttcatacattcatacttgaatataatagcttgctgagtacgttgtacccacccttgctttaacccccttctttcagagttaatttggagttcttgccgaagccgagagttcaatcatataagttagtttcctttcaacctagttctcaagtctagattagttagatggtttaagtctatagcaaaacattaggattgagtcattctatagcttctgttgtattagttagccacaatttgccacaattttgtaaattcccctattattttgtaatatcaactcctttggagccttattctaatatatgcaatgaagatccagattgttaaacctgtaacaatctactgatctagggcttgatacagtctaaacatgtcggtttctttagtctatatgccccttctctctctctatgctgttacacgggaaggagaggaggaagatgacgggaggaagaagaagaaagaaaagaaaaagaaaaagaaagactgacaggtgggcccctgcacagtaacattttatattttccttatttaattcaaatcctattctttagaagtccatatctcctaaaccgtagatccaattccagtgaaacttagacctaaattcatctaaattcaaaccccatcttttgaccccaaatttgctattttaatattttatttgaatttattcaaatactgtttgaatttatgtttgtcttttcaaatatttctttttaacccaaaataccctttagccactaaaaagccgccggttggaactttacgccttccatgggacgttcgcggtttactatccccgatgtcggaccgttggttgtaaagcccggcaaaaccaaacctaaggtcgaagtgctgcttctggcaccccacgccttgatgcgtatagtgggccgagcttcactggttccttgaacttcaaaagacgccggacaagtaggtcttgggcttttggtgatcctaacggttctgttgccactaacggtggtcgaaataacacttccgcccaactaaacccacacaaacttcctatccctctaaccgttatgctgtctgttgacactggctagagaagataccaattttagtcggtatactgcccaactctagcaacgactagcaaacacccaaatcccagccgatattcatcctacctcgatatcggcttaatcaaatgaaaccccagccagtctgctatccaaactccataccaaccatttaccctccaactacccataacctatacatgaaatacgagcccatatgctatcctatttcagcatcgactcgagaacaagtaaatcctagccattcttctaccaaagcccaactacaaccaatactagccacatatccacttaaccaattagattatttagtatatcccctactctccaagaaactaaaacccacacataaaatacaagtgacaattgttacttaatcccctctagcctccaaccctctagaacctccacataaagtattagcccataatccctataccctataaagaagatagcttataccctaaaccctagctctcttagccgtttatcgatcttttgctattttatggattttattgaaattggctcttcctcttctctagtagagtctattatattctggatggcaacctgaggtatttctagcatcggataatcaggttgcctatcttggatttatttgcgttggagcaaagcaagttattattcctccccttgagcataattatcctatattctatatctctattctatgcattagtcattcatgattttgaatacataacctgaacatatagcaaaccagacatatgctagctttgcttagccctgcctagttagtctgcataaaaatataatgaacttagattgggacagtacgtaggaattggttgattttcgggtggctagtactgtctcagtcaatatagttattaccaagtacttatgtcaaacgaacgagtacgaccgcaattttagaatagggacagaccttgcaaagtaagttatctagcaaaggtggtacctctatacagtggttcttatttaagtcctcgctcaggaggcaaacttatgccgcgaagggcatatgccacgaagggcaaatataacatttactgaggcgcaggtaaatgatatgttgagctcaagtgtgtgtatattgtgaaaacctagttgagatgacgggggtctctcaaccagttctctctctaaaaacctcgggaacgccagaactcctctcgctactgataacgttacgttcagagcgcattaggatgagagttcatggaacaggtaccactgatgttagtaaccgaaaagctttgccatgactaagctaatgaatattggcatgtcatggattgcgggtaaagcgtacatttactgcagtaaagtaaaaatgaatctattcgaatagccgtgctcatggaattgagtatcgggactcagatggtactttggttagaaacttaattcaagattttactaaatgctgctgcatttcaagcatcaggctttctatttctatattctctgccttctgcaagtaatcgtaatcctactcaaatattaccttttcatacattcattattgaatataatagcttgctgagtacgttgtactcatccttgcttcaaccccctttttccagagttaaattgaagttcttgctgaagccaggagttcaatcatataagttagtcttatttcaacctagttctcaaatctagattagttagatggtttaagtctatagcaaaacattagagttgagtcattctatagcttctgttgtgatagttagccacaaacttgcaaattcccctattattttatgtaataacatctcctttggagccttgtttaaatgtacgcaatgaagatccagattgttgaagctgtatcaatctactgatccagggcttgatacagttaaacatatcggtttccgaatcattagttttgggagccgacagcgtcggcatgaacttgcgcggcagacccgcgaacctctcgttggtaatgcgagagggaggcaggaagctgccatccagcggcacggagctccgtgtcatggcgtcaacgaaggtggtgtggcgagaagcgagtgtgtgtggcgagaggaggcaagagagcggcgagagctagggcataggagcgcagcggattctagtggtgaaaggatgtgaacaaaatccctcctcgacgccctttatcctcccctcctccacgcctggcacctcgattcttgcggccactcacttcgccccctcgtttttcgtgcccactatctccacgcatccgtttctagcgcgcgtgctaggcacgctgccgttgcgactgagacggaagtggaaccacgccctccttaattgcgcgcggtaaccggggaagccgccatcattattcgctggcaaatccactgacatatctgccccgcgcacctacccaggtgatgtggcagttacgaagtgatagcccatcattgccggggaggcggtttttgcttcgcgtggggccacaactacc

SEQ ID NO: 17037 - DNA, 6495 bp, Oryza sativa
gtccacgttccgctccggtccgatccgggtttccgttccctagtgggacagggtgcccagaagtcttcatccattaatgaggagtgacacatgcgtcccccgtgtcgtccggcttgaattgatgagggcacatgccgcaccaatgggcgtaaggacttccaagtcagaggaacaagacatgcattaaatgtaaagaatgttttccttcttccctaggtagcttttagggcctctgtggtaaccccttgaggtataaaaggaggtccaggcctagtgaagaaggggggttttttgaaggcattcggcttgcgtgaacacttgtattccccacagaatcaaccacatgcaggagtagggtgttacgcttctcagtggcccgaacctataaaaatcccttttgtctcgttgctctagaggggcccgaccccctccacatctctcttccactaagcctcaattctcacccgctacccccgatcgaactaaagggggccccatagtcccactacacgacacgacacgacccacgacacgatcatttggcccgcccaagcacggcacggtgcgactggtgttgagctcatgccggcccgacccaacagttggatcgtgcctgggccgatgccttgtcatggtgggtcgccccggcatgacggtcaaagaaaaatagttgaggggtccaaaatagacttacagccatataaggtacgggcccaaagaaaaaaggatacaaaatagacttattgtagccatataagacgcaacgcaaagctatgagggaggaaaaatagacttattatatggagaaacacgatgttgggcctctccagggccatgggtgcagcccgtgagaaggctcggcatgtaagtcgggtcgggcgggccatttggccatctatatcataaagtgcaaggaaggggatgatcgaggcaatctgggacgttagatttggtgatcaaacggctacgattgcgcatgtctgcctaatgcgtctactgtgtcaaaaatcaagaccaccattacgaataggggtgaaaatggggtgagtatttcccgacgtaccgcccgcctgacccgaggctcgcgggaggaatatgggagaaaaaatgggatatccgatactatccgagtttaaatctgaatttgttgggaaaatgtgggttaggatacgggaagacatgtatccgcccgtatgtccctattatataacatgtatgaaaatttattataaatccacctaaaaacatgataaaagattagttaatcactatttacgtgctcatatgtatattgtataattttttttcttgacgtatcttttttaatactttaattaccttattttatttaatatctatgaattagagatacaaatagatatccattcccgaatccgattcgaagcaaataatataggataggatatgggatgagtgatatattatccggcactacccgtatccgactccgaatttaaaagaaaatatgggttagggtatgggaatggcataatccgaccatacttgctcgttttcacccctaattatgattttttttaagtagaagaagatttacaaaactacttggtcaaaaatatatttacagtactatatctttttgttttcaagttttacggatctttaacgttctttggaagctttatttatatatctagataatactccgtacattgctgcgggacatttttatatgacctagagttgtaaacttgtagtaatagatatagcccgaaagttgtttcatgtagtctaatgttacatgataattaatttgaaaccctgatgtttgtaacagtaaattgtgaagatgttcacctgaaataatggaagttcttaattaattatcagcttctttgttttctgaatcacattcaccagtttgttatattcttaactcatgattgaatggttagcctgattaggttgcaagcaacttctgagctccagccatagctagctataagccagctacaaacatattttaaggagataaataagaagagagaagagtagagggctacagatttgtagctagctgtagcacgaacttcaagacgcagtgtgtgtatgacaggtgggaccatgtattaatagtgtagtatgtaactattgtatggatgagctattagattggctatagatgaattagagctagtagtgggctatactattaaacttgctcttacaacaaatgaacctgccatctacagtaacaaactcggttagtcgagcaacaatatgtaggctgcacatgtgaagttaacggtgtgtaattaacagtgtacatattttcaaatataaaaaaaatacgtacaacacactttgaacaatagattaagtaaaattctatgggaacatttggaagggccagttttacctcgtagtgctgtattgcactttattgagtaaacaaatagctgaaaaatttccctagtaaagcttatacatttctagacttttttaaactaaacaaaaacgtgatatttgcaggatgaattcagaaagagaaaaaaacaatccgtaaaatagaagctacggagaacgaatactaacacacttaactgatggatctaatatgagttttgagcagagagtagtgaaatacctgccctatactgcagatgacgatcagttgcacttctattttgtgtattgatcaaatcacttcatgcaattacatcctttcactacatctgaatcacctgataatactatggtaaggtagtgaatcacttgatgatactatggcaagaaaaatgagaaagaaaggagaaagattagagcaccttcggaatcaccttctattatgaaaaggaaaactggattctcataaaggcaaaaaccatgacatttaaaggtagaagacctggggataataaagtaaactacctcatcatcagagaataaaggtggccggttgggtagaagcttgcttcatcacttcagtttagggaaaattaaatctatgcaatatggtcattggctgggaaagaggacagaataatctgagccagctgcgggcctaataccaagatcaaagatgaataatgtaagagagagagagagagagagagagagagaatagaagtatagctgcctacccgcaggataatggtggcaggtgagagaatcttgaccaattgttagcgccaatacattgagcgagcacatgttcttattgtacaacaaatcaatgacttaactgcgggggactccctgcaatgtttgattcagaaaatcaacctagtactaatcagctggattgaacatacgttagatcgagagtacaactgaataaaattcagttaaatggtataaggtattcatcaccgttagctatttaaaataaccattgaacttaactctgacaaagagaatagggtaaattgatcattcgcttagagacaactgaataaatttcggaggaaggtttaaggaaaagcggtgcacacctttttttttttccttttttcagattgaagatctacaggagcagcataacacattcagaaggaaggctgtagataccacatcaccaaataactttctgtacatatcaaatatccaaagggataaaaataaagctacttactacggttatcaatgcagaacattgtacatgtggaaactcagatgaagcagagttggtgccttggtggagaaggacagagaacctgattgaagcattccccagtaataagcgaaggccaaggatgaattcaccatgacgttatgggagcagtaaattgatgtctttgatgacaaccatgaagtctgctctcgaagcagcggtttcatttctcatgacattccgaggaggcgaaaaggctaggaggcggcagccggcaggtgggcttgaactaaaggcagagggagcgccggatagggggagggacacgacacgggagaggaagtgacgggcgccgtcacctaaggcgctgcggtatagggaactggagggtttgcctctggttagggatggatacccgttgagttgggccataacatgggcttctttcggcccaataaacaaccggggaactctgggaggctgcttcatggcttcccttccgaatgattcagatcgtacggttcatagcaaatggggcgatgtgaagcaccaggaagcagagatttcctagtagtggggatgatttgtataggtatataggataaacgctcttcaaaaggtgcttttttaattttttttatgtcacgtcaaacgaccaaccaccggtcacaccatgctaagagacaggtataattcttgaggcagcctacttgccaccctcccaaataatgttatcatagattaggtggacttgaaatgatttggtactcacaaactcatccaaatgtataaatttggatgtcattaagcaagacctcttcatgttcctatgtgttcgatcctctcatgtgtttgatctgttaaattaggatggaacgacgccgacttcattgagcgtcatcttttcatatttacatacatgtatttgatcttataaattgggatgaatttgtgaagcgccaaataattttaggccccctagtcaggcaaaaaagatcctctaagagggtcgcaactcacaagtgggccggctgcaaaattgctaatgcccacgcatcagccggcgttaacattggtgaagtttaccacataagaaaaaatgtcctttggaaggtgttttcaagaaagaaaacactccaaaaacgttatggatatactcaatccgtttattgatagatgactaacttttgaaaacacaatcgggaactgactatccaattgtcgggtgatttctaacaaaaattcacctagattttttctactattatatttacatccaacagactacgaaagaaaatagcaaaattgaatcgggaaatactctatactccagcaacaactgggcccattcgctcggcccggcccacctcctcgcacgccatgcccacgccacgggcgcgcacgcgcagctgaagagagagcacccgcgcgcccacgcggcggcgcgtgcccggcacgcggcggcgcgcgcccccgcggcgaccggaggatctccgctcgaactccctctctctctctctctccaactaaccgcacgtcaccggaggccgccacgtacatgtgttatacattatatatatcagtcgtggtcgagtaggaggtttcttgcagagatcggggttcggcgccggcggcgagttgttgagaggcaaggcaaactcaggcgactgagctaaagaagccgcactagtatgggggtgacgaaggcggaggcggttgccggcgacggcgggaaggtggtggacgacatcgaggcgctcgccgatctcagaaaggttaattctctctgcaaatactcctggttgctcatacttaaatctacctatgaatgagggatcgcatcgatgtcgcagttggagttggacggacaggagtgagaaattattatctctgatctgattcctgttggtatgcactcttgctgtttgtgaaaatgccccagaggatgcatccacaggacacggcgccttcaatatttataagttgattcaatgatgggtttctttcatgtttctttgctgaaaaatcgtgtttagtagagtagtcttctatgtctctattcaaaagaaaagtggcattaagttataggagaaaataaaagggagaagtcgttttgttaattaggagcttctcctttcgataactatgacttaatagttcatttttattatggaacaaagatgagatacaaaacaatagattgtgatcacctcagtttttttgtttgatatcaagtctgacaaactaaggcattacggttctctgctcttgtttgacaaacgaagtctattgtacaatagaagtctgttgtttaatgtctctacttttggtcatctcttgtatggtttagcctagatctcagtttatcttactataggtcgccgatagtacaatatgatttgtttctccgccgtacctaatccaaaatcatatagcttgacattatctgcttcgcatagatgttcgttataagcttcaaattacaaatttcatattgaaagtttagcctcttcttgttggactataatagcgagtccatgtgaacatcatttcttacattaatatacatttcttcacatttgtggctagttattttacttgccctaccattgtcgcatttatttatatttccataactcattttccaatgcttagttgaatgtatcattcactcattcttgtattgtttgtacgtctttgagactttgactgaaaatagtcttagttttgtacctattttatattttgctttatgttttaattattttctttgacatgatgtgcatgcatatttattactaattggtcatgtaacacaggagccagcatggaaaagagtctttgtgcaggcattggaccaggctttatggtctgtttggcttacctcgatcctggaaatagta

SEQ ID NO: 17038 - DNA, 8748 bp, Oryza sativa
atagtcttagttttgtacctattttatattttgctttatgttttaattattttctttgacatgatgtgcatgcatatttattactaattggtcatgtaacacaggagccagcatggaaaaggtttttgtcccacattggaccaggctttatggtctgtttggcttacctcgatcctggaaatagtaatattctctctctaaatttattttctcacactcatatggtttctcacgcttgacgaattgaaacagtggagactgatctacaagctggtgccaatcacaaatatgaggtacattctctagccttttctatatgacttttcctgccatttatcacagttgtcatgtcttttgttacagcgagaagaaagaaacaattaactgatatgcttcttgatgtgctctttcatatgtttcttagcttctttgggtgattttgattggcctgatctttgcactgattatacaatcattatcggctaatcttggagtggtgacaggtaataaatagacactttcagcacacaattgatttaacatttcagttggaagtagcaagtaatgaatgtcaattgatacagggcgccatcttgctgagctgtgcaagactgaatatccagtatgggtgaaaacctgcttatggctgctagcagaactagctgtgattgcttccgatattccagaaggttggaaatagaatgatagatctaaataaaaaaaagttaatgtttaactgtcacctttgagtttcagttgattaagtttataaactctctcactgatataagtgtacgagcaacacttgcactgattgtatacagtctcttatccactaaacattatgatatgtagcactttttctgagaagaaagcaacaacatctaatctaatatttggtgttttttacacatgtaccttttgtgcagttataggtacaggatttgctttcaaccttttgttccacataccagtgtggaccggggttctcattgctggctctagcacgcttcttcttcttggactgcaaagatatggggtaaccaactatttatgactggatatatgatagatgtctgtataaaatgttttaatgaatgtctaaacatcattgtattgtatttgatcattactgtttggtcattgtaaatggtggtcattacaaatgggtttgttgttgaattgacttgtttgcatttttccttcatctatataactaggtaaggaaactggaggttgtggtcgcgctattggtgtttgtcatggcagggtgcttcttcgtggagatgagcatagtcaagcctccggttaatgaggtccttcaaggattattcatccccaggctcagtgggcccggtgccacaggagactccattgcccttcttggggctcttgtaatgccgtaagcagtcaaacatgcatatatacccccagttgttaatgtgtgcaatgtcttttttgcgtcttaagattcttctagggtagctgtaaacatgcataaggttttcaactctccagtaattacaaatctccacaatggtagttttagtctttttttagattttgacaaaatgcactcttgttaatcataagtgagcattatcagttattaattacaggcacaatctattcttgcactctgccctggtgctgtcgaggaatacacccgcatcagcaaaaggaatgaaggtgatcagatgtccgtgttcttgcattaaaaaagaaatggtactcctagttggctgatacatattccttcattcttttgtactccaggatgtctgtaggttcttcctctttgagagtgggatagctcttttcgtggctctgcttgtcaacattgcaatcatctctgtctccggcactgtatgtaatgcaaccaacctttcaccagaagatgctgtaaaatgcagcgaccttacattggactcctcatccttcctcctcagggtactgcatatatgtgcaaagttcatcaccatttatatttagttgtgttattttcttcacaaaaataaattagtcatgttatcattgaccatataatggtcatttacagaattattatttatttttttttcagaatgtgctaggaaagtcaagtgcgacagtgtacggtgtagcactcttggcttctggacagagctcgaccattactggcacttatgctgggcaatatgttatgcaggtatattttacctgaactctaaccttgtttacaaattaaccaagtactatctgtgaactattttcttaatgaccagttcaagtggtatagtattaaccacgcagtaaactagaagatctccaaaatggtgaaagaaatgaaaaaaagtttgcaatctatcaagcttgaatgtatagtaacagttttttttttccatgtatctacaggggttcctagacatcaaaatgaaacagtggcttcggaacctgatgacacgcagcattgccattgtgcctagcttaatcgtctccatcattggagggtctagtggcgccggtcgtctcatcgtcattgcatcggtacaatcttttactacaaatgaaaatatcagtttgcccataagaacactcattaaaaaaaactgccatacaatcaaccatcttctaattttctcaataattagtaagttatttgctaatcgaaatgcttctttcttcaaaaaatggacggtatgtaatttgttgtacctcattccttctgatcatactgttaaaaagaatcaaaacctaatgcttgttttggtttggctgttacgtttcatacagatgattctatcctttgagctaccatttgctctgatccctcttctcaagttcagcagcagcagcaacaagatgggtgaaaacaagaactccatctatgtaagcactcccccatcaatcaatcaatccttctttctagcttgtccacacatagaaaacaaaaacaaaaaaaatcctggaaaactaataatgcattggtaattaaaacctgcagattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgagcacagcaaagagccacccgtgtagtacccttccagaccggttaccggtgttggctggtttttattggatagatgtttaggtccaattttttttatataaaaaatccaatagatgtttaggtccaaatttttgaattcaaaaaccggttagcagtgataaccggctgaaattttggcccatgggagtagattgttgctttttttcttagtgattagttattggcagattggcagaatgttgtagctaggcaatctaattgtatggttagatatttagtcataaatccaagagtgagttttcttggatgcgaggacaaggacaatctaattgtatggttagatatttagtcataaatccaagagtgagttttcttggatgcgaggacaaggacaaatataaatgtaaataaatgcagttaaagtaacaccttgctcaaatataaatgtaaataaatgcagttaaagtaacaccttgctccttgtggacatctatctcttgttgatgccagtgttgtggatgacggaatatggatgtcggacggagatggttccgctaaacgaataatcggagtacgggcgaataatcggaatttgacggaaatttaacgttttggacaaatatatgtacataactcataatagcttattatttttgatagataaatgcatataactacatatatacctactattcttaaataaaaataaggataacatggcattaactcggcatatagtaaaatatatgtctgaacatatagtgataggtttggctcgtaacgcataaaggaaataccaaaagcatgtaacactatataagtgacactaaaacgacgttctgtagctatatattgctaggttacacaactaatgggcagtatcatgggctggctggcagggccttctggccttgtcacatgatttggcccgtttattcggctgattagtcggaaacggctgattaattgctaatgacggtgattatacgtccttaaacgattaatgatcagcgttttgctcattcgtgacggaggggtcggcgccaccgtattaacgcccgaatatacggccgtaccaaccgttatccataacactggttgatgctgaattcatttgggctactgttatgcccaggtcttgctacgtctattgatttccatgtttccttgagatttagatttggttacaagttaaaataatctctagagtttgagtgaagtttgagtgaaccatctcttagacttccatgtttcttgagatttagatttggttacaagttaaaataatctctaatctctagcgtttgagtgaaccttctctttttcttatttttcttgtggctcattaacttttctttaagctttcccgcaaaaaataacgtcttaggtactcttaaatcctgaataggaagctgtgagcaggtataaccaccttgtatcttgagaaatcggacttttcttctcaccttatctccgtttacattttttaattaaaattttgtagagctcttttttgataaaatctattttgtgcgcatgctcgatttggacttaccgaacgacacatctgtgcccacaagaaaaacccacacagcacggagccatgttcgtgatgctattttgggaaaggcgtgaatggaagagaaggaaatgagtaggcgtgcattaggactaatgcgctactgcacaaagcgtcttttttttttcctccatattggtcatttgcttttatttaggttcaacgttagagcttttcttccgtagccccgactcgagctgtttaatttggcttctctttagatcttttgtttttccatttcttcgctctacagatcgccttaaattagtcagaataatggcaagtaatatcaatagttttccccatcgctctcgcgtgggcggctcggggacgaaacctagccgccagcgccgccaaccccctcacccttccttgccacctcgccgccgcaagagcccgccactggaaaccaagggaccagccgggaaggtggtggtgggggacacaaccccgatgaaactccttctcgacacgaggtggagtggcgcgtgtcgggtgtggggaccagtggttagagtggttggcgtgatggagccagccacctcggaggcggatctgcctcccccctcagccccccccacacaccccgcaaccagatcgggagaggacggcgaagttcgcggcgacggcagcacagtggagtcgcggggcggcccgagaaagtgcggtcgtggccggcgaagggggatgcacgacgcggccggtggcaaggccgacgcgttcggtggcagcgtaggctagcgtgggcgatgatagggaggatgtcgcggtctaagaccgcgagaggccggcgtggcagacggcatgaaggctgtcgtggcttgtgaccgtgagaggccggcgtgttcggcggcagtgaccctttcacgtcaacggcaggggtcactgcgctgtgggagagggagctagcaagctgcggaggcgtcatggctgtggaggagaccggtggcagggccagctagcgatggggcactggtgcagctgaggttgagttggtagacattgtgtaggtggcagtgcttgggggtggcgggggcaagtgtggtagggaggcttgcagacgaaaacctagcttgggacttcccaagccagcaatggcagcgttttcggatatcgcgttccccctttcggggtgttgtcgagcggccacccttccatccttgataggaccctccaggtgaaaaccgagtctagctggatgggcaacgatgactgaagatgcacttaaaccccctagtgggttttggtaattaatgacaaggtggttaaaggggactaacgtgtttatcaagtttattcacaggagtttagtcccaaagcaagttgtgatggctaagaatgcaaggagaccccccaatttgaatgctcctaagtgcgaaaatcaccgaaggtgattagactaggtttttcactttcgaaattgagtttaggaaaaaccgtactattaaaaggggtttcaagtgtggttctagggtatacaaagtgctcttagtcatatccatgtgtcaaaatatttttggaatcatttttgaaaaatgatttttctccccgggacagagagggctacccggaggttctggccagaacttccgggcgccatttcaacagcaaattttcctaagtgctgcccggaagttcctggcactttttgcccggaacctcctggcaggcttccagtttaaacttgtgagtaacggctagatgacgtcatctagccgttatatatatggatttcgtccccaggccaccctttggctattccacttcagctctttcatgttctagggttttctagccactcccaagcttcctttacttcctccactcaaatctagagcctatcttgtgagattgagagattagattagagtgtaagagtattttggagatggcttgaagattaggtttgtttgagcactttggataccttgtgggctgtcacttgggcttattactcttggagatcttctcatagacggttaggtgtcgcccgtgagcttccaaagatcttgtggatgtcccgggaaagtttgtgaaggttttcttcacctccgcaaggaaacgaggtaagtgagtaaagattcttgtgctgagttttcagaggttgtcctaggtagagcaacttacacttgtggtcttttctagaaggaattgtgagttggatcttggtggtcactcaattctagaaaatgacctagaagtgttgagttgaaggttgtggacttcttctgggatctttgcataagtgaggcaaggggttaatcgagacccggctctttgagcacctcaacggagagtaggatccgtgtgatccgaacttcaggaaaaaatcgcctttgtctctcttgtgcatgatctgtgtttgaatctgctggtatcttgtgatttacatcttgtgcaaccttgtgcctgattgtctctagctaggacctgttttgcttccccaaattttgattttctctgttgctaggaagttcctggctcaagaactccggaagttccgggctgctcatctctgccaggaagttccggtgttcttcaccaggaggttccgggccctgttaatttaactgctgtgattattgaaaaaatttcagaaaaacctattcacccccccccctctaggctacatctctgcgcgttcaatgacgtctaagacgtcatggccttcctgaagacattgtctaggaggtcatgttccttgcattcaccaccttttctttgtttggtcatcggcggtttttggttgtcttcatcaggttgggtgagggactagtggatctccttctctcttgacctcttcctctcctcaacctctctacgtgtggataactgaaagctttttgacgtctttctatattgagtcggtgtttagcagagcatttgtaacctcccggttggccaagtggtgattgatcacgcttagcggcggtcggcttggtgctattgtcctctctagggtgtgctacgaggagttgccagctcttggtggtggtgtgtttgttttcatttgtttttcttggttacgacctcgtagggttgtaatattgtaactttttcttgctatactaatatgaattttgcattgtctagcgtgaatcattaaaaagagaatctaagaaatgccattgataagcatccaatttcaagaaataccatcaacaagttcaagttccatgaaataccatcttacaagcaattttatcctagaaatgccatcatcattaggattccgtccatcccgcgccattaaatacattgtaacttgtaagtgcaagttttattattgaaagaatagcgtatgtgactacgaggagtccatggaattgtcatcaactataagagctttcataaagaatatagacagagttatccataaaataaaggggttgtttggttttcataaactccctgcctcccagcgcacgcaagcgacgtggatgcctccgcgtgcgaacatgctactcgaagcgctctcagctaggggtggaaacgagccgagcctcgtgaaagcttggtgcaagggaagcttggcttggcttgctcgctacaaacaacgagctaaaactgtagctcggctcggctcggctcggctcgttaatgggctcgagctggcttgcgagcctggcatcaagtaaatctcaagtaggtctaacagaaatcgagaaacattttaccacatagaatttataatactgtgatagttttctttaatatgtcatcacaacacataaatagataatgtggcaatcaaacttaccatttccaacaaataaatagttagaaaaggtgcaaaatttttgtatataaccctatgcactaagccaaacgagcttgcgagcggctcgtgaaccagctcgggcttgactcgtttttgaaacaagctaggaaggaggcttgggctcggctcat

SEQ ID NO: 17039 - DNA, 13041 bp, Oryza sativa
  unsure (1)..(13041): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtattgcatttgcgccggcaacaccctcgacaccatcgccaggggcgtctccgctggcctcgtcccctaccaggacatcgctgcgccagcaacatctccaacccaaacaagatcgccgtcgcccaggagctctggatccctgtgcctgggtggacctccttcccgatggtgacggcgagctcgaggaagaatgcaagcaagcgacgacgcgcctccttccctatgtcggcagcaggcacgagcggaggcttcccccggtggtctcgatgcaggaaaggagttggaggcgcccaggcggggttcggcttctccaaatgctaagccactaccgccattgttgtcctcttgtcccatcgacgtggtagatcggagcagcaacgggggcgacgatgaaggccaacgatgggggcggctatagggccggcgacggagtccaagacgaagacacctcccgctccctccttccttagctcggcctaggacgaggcaacgacggacgagggcgtaggtagtggagacagtggagggcggcgatggatgccgccacagtagccggtgtccagatcatggcacgggcgatggctgctgcacgcgctcagcaatgcctcggatgaagggtgtgcatggagaaacaggcgtggctcccatggatggctagccggctttggctggccaaactagccggctttggctggctaagtttggccagcgaggaagcagtttggatggcttggccattcaaatagcaagcctgttggagtacaattttagtctaaaattgccaaattttgacttgtgggatagcaagactcttgaagatgctcttatagctctacaatttctgaataatccttgaaagctttaacaaataagcatattcacacgactgatacgaggattaagtgcatacaaaatgagaaagccttatacattattaattaagtttaattattataaattaaaaaattagattatataatattttagaagaataacttttataaagttttcatacgaaatactgtttagtggtttgaaaaatatgttaacaaaaaccaacccagaatcaggcgtgagtaatcttgagcggtttgtaacatctatataaaaggttttctcataaatcatgtgttaacaagaaaaaagagcgcatattatattagcactctctctgttaataaaaaacttaacttaaccaaggacaaatgtgacttatcttagtagtatagtaaatataaataaaaggttaccgaaatttattcgagaatgctgggaatcggtaaccggcagggggtgggggtggagcaaaatacgcgcacgtgccttcccccgggccccccacatgtctctgctcacctgccacgtgtctccaccacatactccgttgcaacaaatcacccacatattttggaaatgctctattaagggaattcgtttatttttttattccaaaaaaaatgtttcacctagtgcattcacaatgtttgcccccccccgacgcgcacatgcctcccccgggccccaccacatgtccctgcccacctgccacgtgtctctaccaataaatcacctacatattttggaaaccctctattaagggaattcgtttcattttttgttccacaagaaatgtttcacctagtacactcacaatgtttcactatatataaatctaaagttgcagtgaattgaaacattctttgcaacaaatcagccacatattatagaaaccctctattaaggaattcgtttcatttttttccacaaaaaatatttcacctagtgcacttataatattttagtatgtatggattaaatctttcactatttactgaaacattgtatttatataaggtgaaacaacgccctatttaaatgactgaaacattttcgatctacttagtgaaacaattccgatataattggtggaacaacgtgcaacatttaaaaataattcaataataaactaattttttcatcgaaatatatccatatatggtcttgttttaaatatttaattgcaacgaatttaatggtgtaatcggatcatgatttagataaataatttaagataaaaaatagtttaaagatttaattgcaacaaatttaatagtgcaatcagatctgatttagataaataatttaagataaaaaatagttcaaagtagttttggatgcatgcatgctgatgatgtcaggctgatacgtgcgtctgattttttctatctccatcgaaaatccgacgcgtagacgtctcccatttattatattatattagaatgagtcacgtttaaggtaggttgaattttgttcagagaaaagtaccagaaactcatccgtgagtagggcctacagagccacagcctacaaggcccatttataaaattctccaaccgggggcccatccatccatccatcctcgacaccaccgtctccgcttccctttccattcgcgccgccacctcgccgtcgcacccagcggcggcgccgccgtgccggaggagcggcgatgtggtgccagtcgtgcaaggaggagtacgaggaggaggacgccgggacgtgcaaggagtgctacgaggaggcgagcgagacggaggaggagctcaagcgcgagatcgacgacctccgcttccgcctccacttcctccgcctcccttccccttccctcgacgcctcctccctttcccactccgacctccttcttcacgccatccccgccgatgcgcccgcccgccccgacacccccgccgtccccgcccaccgcgtcatcctcgtgagtcattcttgcttcacttttttccaatcgattagtcccaacacgtagctttctttgttcatgccattcttgacttctcatgtgctagtgctcaattaagtttgtggactactatttgccagattgatctaggattgatgttccggtagccaactagttcatgattgattatatataaattgggggtcctgctggctacttagcggcaggtcgctgattttttgctggcttaaatcttgtaacccagagctacccctgtaaggatgaacttcgtttcattctgatgcctctggtcttcttcttctctagattgatttggattctagaatttccctagccataaccattgtttgcactgcctttgtttcgatgtagcctgatctgtgacgtacaaatttctctttccacaaagaacaaagatatgtatgcattatatactaggacatgtttaattgagatatagagtgggtaatgtgttaatgtctggcttaatattgttactttgctgtaccactgcaagtctgcaacaacatgttaaactagtctagtaactaataaaggagaagaagctgcagaactgtataagtgtgcagattcttcttcgcatgtttttagtgttttgagttccttttctttttccaatgtgttggtgctacttgctttgaatgtgtttgagttgaactcaggcatgttttgcaatgaagttttactagcagtaaaagacattatctagcaagtaaaggcttaaagctgatatccaatactccaatgtgatgaaggaggttgaatttcactattttagtgtctcaataacattgcatgttgtaaacagtatgacactgactaaaactattttgagggcatgtagtttttgaaggcatgaagcataacagagcctggacttcaactgtgatcttacacttatcactgttgatggacagagtttaagtggcttctaaaaatgtaagctgtagggtaaacaggaaaatatgcttctcggtacatgtgtattccaatggttattgactggatgtgacaaaatttgtataagactgattttgttcctaagaaagttaacttattatggtacaataataagctacaaactgtagcatgctcataaatctcaaatacagtcactttaggctgtgttcgggaggtgaggttgggaactcacctcccgtgcacacaaaacactttaggctgtgttcgggaggtgaggttgggaactcacctcctgcgcacacaaaacggagcgacgcattttcttatgattaaataagtatttgttattttttttttgaaaaatggattaatatgatttttttaagcaacttacgtataatttttttttgcaaaaaacgcaccatttagcagtttgaaaagcatgcacgcggaaaacgagggaggtgagttgggaaagttggggaaagaactcagctggagtagtacaatgagcaagcaatggcaagatatcatgttaacatggtaaaagagtcatacttgagtctttataagttattaagacttcatttatctagtttggaatgcattcgcccatcaataccttgacaatttttgttgctcttttttttttaaaaaaaaagtccgcattaattgtataggagcatgcatttgatcaagtgaagttgcatagaacctattttcttatgatataaatcaataaataacagatacgacaatatatatttttgagagtgtctatagtacttgcataccaatttatgtatctaatgcacaaatggaattaggtactcttctgcttttatgtttccttttcactttgtctttgctcttttgatattccaaaagtaatttccatgttgttagatctggaaagataactttggcaatgatgatccatatatcattcgcctgtagtgctgttatgataactttggcaatgatgatccgcatgtaatatttgtaaccttgtaaatatttcctttttttataaaattacactgctgggcaaagccctagcagttttcctggtaaaaaaaaaaagatctttgatgggagttcgaactacaggacatcacctgcctcacaggcaaacatgaatctcccgcttcttgaataggcaccccacagtagctactgctggttggacaacaaggaatattaccatgactatacaaattttggattttgctctcagtgagtggctttagagtatattcatagaggctttggaaaatatgtatttttgaactcgacgcaattccattcagattccttgatctgtcaactgtactgattcagtatttaacttttggctcatatgtaatgcatcatatctgttgtattttggcaaagatacaaatagctttattccttgttcacagactttcaattatatcatcgttcttctaatttcttagctagctattagtatgttctgtagttgatttgcttgagatatttcgcatttgtgaattagttgcatcttactgatgcacacggactagtttctgctgtagaatttattttattatccattaaactgagtttcttctctttgaaaacaggccagcagatctcctgttttcagagctatgcttgagaacgagatggaagagagccggagtggcatcatcaaaatatacgatgtgtcctacgacgtccttcgtgctttcgtccattacatgtacacagcagaagctctccttgacgagcagatggcatctgatctcctggtgttggctgagaagtacgaagtgaagaacctgaaggcctactgtgagaaattcttaacatccaaagtgagcaacgacaatgccatcacgcattatgcgtttgcgcatcgccacagcgcgaagcagctgctcgagacatccctggcagcgatcatggacaacatgtcaacgctggcagatcgggaggaatacaaggagcttgttgagaaggacccaaggcttgttgtggagatatatgaagcctatctgaacagacaagtgaacactgctgctgggaaggagacagattccagtagtaggaaggggtaattcaaaagaaaactgctatcagagatgtaattaatgttctaaccaagcttttgcatgttcatgctaggcaaagactggcacatcaaattgtcatcctgcggtgtaggcgcagaacagctatttctgtatatgctcgaattgatacctgtgtgctcgctactgatagaatgagatctattgccatctttatgtaacatataggtcaactgatatgtgatgatcatcaaacacactcagtatgaacaaaaaactaagtgtaaactatttgcaacgttgaacggttaaattgattaccagggctctgtagtgatttgtgcatcgttccgagagtgcagaacattgcatgaaccggactagcttctactaaccttgatcgatttctttagtgttcattgccatccctattgctacgttcatgcacgtttcatcggcgttgagattaaaaagataaaatatgttccaactagctgaagaacatatattattcggctggttgccaaatactatgagaaagtggtcttacatttggtgaatatttgaagtctcgacatttgaaatagggccttgagctctcaaaaagccagagataagttgcatgagagagtgctaaatgacagttaaaagtggtcccactcacctacatcaattatacttttttacttgtgatgtataactcaaatagagcaaaaaacaaaactcataattaaggactattgtaattctttgcattttcctccattaaccattagattgaagttgccattgtctagcagtaacttttctgaccttcgataaatacaaaaggctaacctttttcttttctaaaagaccaaaaggctacattttctgaagagaagtactccctccattccaaattgatctacatatagtttttttgaagttattcctaaatgatctacatatttgtgttcatttattaagtctattcgttatttgtacattggagtaaatagacattgatgcatgcatccatgcatacaagtatttataacccacatgtaatatcttaatttgttattggctaggaaatagtgagaatgatgcatgcatcgagtttgttgctagagtaaatatagtatgagagatttattagtttttcttggtcttagtataccatgaaatatgtagatcaatttggaatagaggaagtagcattcaagtttctagtgaaacaagctgacaagatccttcaatcctatcatattaaccagggattgcaggtttgcacaagattgaaacaaacaattccgttgtctgcaaaggctcctttgcgtgatgagagaaggtctcatccactgaaaacatcaattacaatttaatataatgatgttgtaatgatctgggaagctgcacttatctgaaaccagagtgtgacgtgatagcctgagtaaatcgctaaagtctaccaaaagcatcaaccattaagatagccagttcaaattaagtaccaaatctggtagctccttgatcagacattcactcctatcctaatagtcagcaaacagttcagatagctgatcatctgtccattcagttacagaagccatcttatttggctgtgaatgcaacgatgcactgagagtagttgcatcactgttacttacagagctattttcttgagttggcaggacaatgcccaaagttccagtaatgaagtccttttgctgatgctcattgggttttttgattgaagcgtgctcaacaagatgtgcgacatcatccagaccaatgtttagattattggctaacccataggtctcaatattcgtacttgacataacattatctggcaataccgcatcacccctttgctttttgctattagggtgcacccgttcaccttcaagaggtcgactcagcttttcatcagaactagctgcaatagaatttcccgttctagacatgaccgagcatccacctagagtagactgggaacatcttgtgtttgggttttcaggatcattcaaagtttgctggtgatgctcttcaccattgtggtttgatatatgcctgctgctgaggcgctgcatcaatgtttgtagttcaatcccttggtgcttacctgaactggaactagttttttggaattgctgatcggcactgtagcttggtgtattcttgtttgaaggatttatatctttttccttcatccttgtatctaggtgatttcctacaccttgagtactgccattgtccattcttaacgtactatctcgaacagcatttcctgcataattattatcagaaagtacatcagcaatcctatcatccctggtacttaagatcgtgcggcagatacctgttgtttgtccgtatgtttcaactccagttttcctgatgcggttatctccttggcatgaagaatcccgtgtttcttgacactttactgttatggaatacatgtaacatattattgttcttaagagattaatatagagaaagggatatgaactggaagttaccaggatgttgactttcagaaggacttgatgaaaacacttgcttagatgggaagcagaagtcctttggcacaagctgcaaatataaaaacattcataccgccatgtccttaaatgattatgatgttaatttaaggaacattgtaatggcagttcaaaagtaccattgtgaaagttttgtgaaatggttacatgcttctaaagaactgagacttgaaatacaagtgaatccaagtaactctgctgataatgcaaaggcttattcttgattaacacaaggtctgaagcatgaaaggcctaaatatgatggttaatctgaaggacaaacatcctcccagccagaagttttgatttatataattacatgtgcaagaatgtttggaagatctaaaatggtaaaataaagtatgattttttcatcgatgaacaatgtggctatcttgaactaatggtgtattttaacttcatgaaagttttagaagcaataaaacaaacaacaggatcatggaattgtaggatacctctctaccattttcactcaaaaaactgagaaggaaaaacagaagacaatgatgattctttacacaagtaagattcacagagtgccttcttttcatcctttactgatgctctagtatcattgtattatagctgtctacttccgtaacattatgtatcagtgcatcttatattattttcactctactgtgcagtgcacgtatagtaataatggcaattattatactagatagtaatataaagaaatgcaaatagtaccatctctagattttctttggtgacattaagatagcaacccttgtgagatggacggaaaacagctacctgaaattaacaatgaaccaattactccatatactaagttagtttgccaacaaaagaaatcctttttcaccacaacaccttacatttttcagaacaatgcaagaccctacagatacaaccatgttatcctcctttgtaaatactttctggtgaactgaagcaccaaccgtaccacttggatcctatcaagaataactcaccattatttcccaatcagttagcattcaataaatattccgtactcagattgtaaagtaatatttatggctttcggtttaattacttatctgaatgtctcttaatgtagcccactctacatgtaagatgcaaacatgaagagatgcagataatgcaataagaggtgataagtaatcagaagaaaaccaaccagtacatcaatcaaagaccaaagtccctttttccaattttaacacgagctaattcccgcatgacgcgaacatgataactcggccaagtagggatgcaaagtgggtagtcccgctacccgcataaaaacccgcttgctaattcatttttcatatggcagtataaaatttagaagaaaaaatgaactagaagtgggataagcgggttaaaaaccccgcttgcccgctccgcttgcatccctacggccaaggaatccaactcattccacagtacacacataatcatgccatgatgctttgtgttcgctcaccttgagagaaaggaagagatcaccgagcctgttcggcgcgcacgacgtcaccacgccgaccacctgatcacaaccaaacgccccaagactaatcaagccatcagcaaagacacgcacaaaactagcgaaacaggtagagccaggagatgtccacactccgcacgcaccagacgtgctcgatacaatgcccggtcgccacggatggccgcgatctcctgccgcttccacgcgcgcgcctcgcctgcatacccacgccacgatgagcaaccgaaaacgcaaaaccaaacacggaatgtctgatccggtcaccgcctccactccaccctcaccgagggaacccagcgcgtggagccacggggcgagcgagaagtcggggtcggtggcatggccgcgggcggcggggccggacgaagccaggtggggcggggagcggaggccgcgcgccgcgccctgggagagcgaggcggccggcgcggggtcatcggggcgaggggggcggaggcgggagggagaggaggccgggccgcggcggaggaagccggagtcgtcgaagtccagcgcgtctgcccaggcggcgtcctcctcctcctcctccccggcggcggcggccgcggcggcgctcgccggttgggacatggaggtttgggcctatggggaattgggggttttggggcggcagcgccggatttcggtttgaatttgttttttcttagggagtatgggcttgattgtttgataccaacttatcgtcctactaaaattttgataacttcaatagtagcaaatgccaagttgttgtatttctaacaagttgttgcatttatgcgatcacttataaaattcttgtactaaattgcacgtacatgccaaggtgttatactaaacgctcatttctcaagttcttacaccaaattgtacccacctgccaaattgatacactataggtgcaatttactctaaattttacatacaatagttcaaattcaatactaccgaaggttttggcactaccaaaattttggtatggcaaaaattggttctaaaccaaacaagccctattccatattagtattatcagaaaaacggacagacggaatccaatggggcggggggcatgagagcacgggatataaaagatgtgagcgttatcttccatattcgtttctcccatcaactcatttttctcctccaccaagcaacaacgctttgccttcctcctccctccatccactcttccatcccagtgatcatcctcctctctccctcctcgactcaagactattgtctccaacgctgacgacatccctatcctcttttcttccttcctataccggatccggagcatgtgacggagtggaggttggagagggcatgagagggagctaattatggctgtgaggtttggggattgtcgtgtctcatgtgtgagaaggaaaggtcctgggaaccgacaagaagatggatgcagcccggcctcgatgtatagtgacccggggagttgatgaaatgaatgagcggcattgggttttcttcttaactcattaattgtggtattacagggttcaccgttgcaattgatacccttggtttaaggggatattaagtcccaaggcttggtacccaaaaantatgcctgatacttaggtactagggtttggtacctcgagtatcatgcctgatacccaggtacaagcctaccagggtctagtatctcggaatatcgtgcgtgatacctcaggtgctaaccgatacccatagcaattaggtctgatacctgtggtatcgagtagagttaaggcgtgnagaagaagagcgcgttgtcgtcgtttggctggccagtaagtcaactgttgttgtctcatcttctcttctcccttcctctcatcgacgccttcctccttcctgtattgttgctatggttggtgggggcaaggcgctaggggttgccgttgcttcaacgttggagcttgaccatggttcctctttgctatgtatagcagcttgaaggttttatttactatgtatagcagctgaatggttcctctttgctatgcacgtccaggctccttagtccatatatttggagggcagaaaccatcatcttcgtgcactccatcattcctacgaacactcaaaagcataggctcatctaaagtaatttgattatttaacacaaggttagcattcacctgagagtgaatttccttccccaattgtttggctctgctccttgtaattggacccactatattagatgcacttttattaggaggtggggaagagtggctactagggatgtcctcatcagcctccccctcttgagaaggagtcgtcctcgactcagactcaccaacaaatggacacaaatctttgacattgaatgttgcactcacattggtatattcttgagggagctcaattttgtaagcattatcatttatcttctctagaaccttgaatggatcgtcaccccgaggggataacttactcttgcgctattggggaaatcgatccttgcgtagatgcaaccacactaagtcgccggcttggaaaataacagttttcttacccttgttcgcttgccttgcatattgtgcagttttcttctcaatattcctccttgtgtcggcatgtagcttcttaatgaattcatatctcttggcagcatccaaattcacctgttcctgtaatagtgaaggcaaaaggtccatgggcgtatgtggtttaaaaccataaacaatttcaaagggacaaaatttggttgtggaatgtactgccctgttataagcaaattcaacatgtggaaggcaatcttcccacatctttcagttctttttcagcacagcccttagcattgtggatagagtatggttgacaacctcagtttgcccatcagtttgtgggtgacaagtggtggaaaataacaacttagtgccaagtttaccccctaatgtcttccaaaaataactaagaannnnnnnnnnnnnnnnnnnnnnnnnnnnnnnnnnnnnnnnnnnnnnnnnnn

SEQ ID NO: 17040 - DNA, 675 bp, Oryza sativa
cttcattactcatcactgttgtatacaggtacgttgcaattgatacccttggtatcaggggattattagtaccaaggtctggtaccccagatatcatgcctgatacctaggtactagggtttggtacctcgagtatcatgcctgatacccaggtacaagcctaccagggtctagtatctcgggatatcgtgcctgatacctcaggtgctaaccgatacccatagcaattaggtctgatacctgtggtatcgagtagagttaaggcgtggagaaggagagcgcgttgtcgtcgtttggctggccagtaagtcaactgttgttgtctcatcttctcttctcccttcctctcatcgacgccttcctccttcctgtattgttgctatggttggtgggggcaaggcgctaggggttgccgttgcttcaacgttggagcttgaccatggttcctctttgctatgtatagcagcttgaaggttttatttactatgtatagcagctgaatggttcctctttgctatgcacgtccaggctccttagtccatatatttggagggcagaaaccatcatcttcgtgcactccatcattcctacgaacactcaaaagcataaactcatctaaagtaatttgattatttaacacaaggttagcattcacctgagagtgaatttccttcc

SEQ ID NO: 17041 - DNA, 383 bp, Oryza sativa
tatgacttttgtctaaacaagcaaatttctcttgaagagtctcattgacatctctaaggctagctaaagaaccattagccaaattaagctcattagctagttgttcatttttagcacattctttagctaagctctcctctaaggcaaggtttcttttcttctcatgaataagcaattcttcttgcctttcgagaagttgttctttactatccaaagctctcattaacttagccaaatgttgcatagcaggtttgctaaagctcttaagcacatcatctaattcattatcactttcctcatcactagaatcaacatcaagagaagtgtgagagggcttttgagtcatcaccttgcggccttgggccatgaagcaagagtagtgg

SEQ ID NO: 17042 - DNA, 543 bp, Oryza sativa
  unsure (1)..(543): unsure at all n locations
nnnnnnnnnnnnnnnnnnnnnnnnnnnnnnnnnnnnnnnnnnnnnnnnnnnnnnnnnnnnnnnnnnatataaaaacattcataccgccatgtccttaaatgattatgatgttaatttaaggaacattgtaatggcagttcaaaagtaccattgtgaaagttttgtgaaatggttacatgcttctaaagaactgagacttgaaatacaagtgaatccaagtaactctgctgataatgcaaaggcttattcttgattaacacaaggtctgaagcatgaaaggcctaaatatgatggttaatctgaaggacaaacatcctcccagccagaagttttgatttatataattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17043 - DNA, 1055 bp, Oryza sativa
gaccccaatttctctccatggatggcgctggatgagttccctcctgggaccgaggaccgcgcgcgcgcgcaggtccaggatgccgccgaccatatcgtcgacagcttcgagggctcggcccctcggcttgcgttcgcccccaactccgacgagaagggcaatgccggtggtgcagacgacagtgacgtcgaggccggcgatccgggcgcatcggattgagcccccagacccccgccattcttcagttttttcttcttttctttcttctaaggccttcgggcctcttttttgtatagatcaacttaatctgtaatcaaaaatgaagaaatttttgtgttaatttcatcttgctgtgagtatgagatgaggatgatctgtgtcgtggtccttttgtgtcttagcttgaataagggcttgtgcccaggttctggtcctcaaaaggcgcgggtcggggctagtgcctggggagatccacatgtcgagactggccaggccgggaacgtggtgaccgagggttatgggtgacccgattgtgggtttttgccgattcccccccggagttcaccacgcctcggggcacggctcggttctgggccccgtttggcgattttagccgacccgagcccccgagggcaggattgagcacgagtgacctatttcaagtcaagattcttcaaaaggaaaaaacagcacagatacagcctttaggaaattgaaactgcttttatagaaattcagatataagagaaataagaatatgcatatgttgtagcccccggccaaccctgcacgcccgaggggggtgcggggttggcccgagcccgaaacctgacacccgaccccccccctcaggggtagaagcgacgaaggtgttcgatgttccacgggttaggcagctcagtgccgtcccccgtggccagccgtatggagcccggccgggggacgccgaccactcgatacggacccttccacattggtgaaagcttgctcaatccagcacgcatttggacgcggcgtaggacgaggtcgtcgacgcagagtgatcgggcccggac

SEQ ID NO: 17044 - DNA, 9165 bp, Oryza sativa
  unsure (1)..(9165): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccaagcccgaaacctgacacccgaccccccccctcaggggtagaagcgacgaaggtgttcgatgttccacgggttaggcagctcagtgccgtcgcccgtggccagccgtatggagcccggccgggggacgccgaccactcgatacggaccctcccacattggtgaaagcttgctcaatccagcacgcatttggacgcggcgtaggacgaggtcgtcgacgcagagtgatcgggcccggacgtggcgctgatggtagcgccgcaggctctgctggtagcgcgcggctcggagggccgcgcgccgccttcgctcttccaagtagtcgaggtcatctctgcgaagctgattttgatcagcctcgcaatacatggtagcccgaggagacctcagggtgagctcggatgggagaaccgcttccgcgccgtagacgaggaagaaaggcgtttccctggttgctcggcttggtgtagttcggtttgcccagagcaccgctggcaactcctcgatccatgaatcgccgtgcttcttgagtatgttgaaggtcttggttttagggcctttgaggatttccgcattggcgcgctccacttggccattgcttctggggtgggcaggtgaggcgaagcagagcttgatgcccatgtcttcgcagtagtcgccgaagagttcactagtgaattgggtgccattatccgtaataatacggttaggcactccaaaccgggccgtgatgcccttaatgaatttaagtgcggagtgcttatcgatcttgacgaccggataagcctcgggccacttagtgaacctgtcgatcgcgacatacagatactcaaacccgcccggggcccgcctaaacggtcccaggatatcgagtccccagacagcaaatggccacgaaagtagtatggtctgcagggcctgggccggctgatggatttgcttggcgtggaattgacacgctctacatcgccggaccaggtcgaccgcatcattaagagctgtcggccaatagaaaccctggcgaaaagctttaccaaccaaggtgcgcgaggcggagtgggctccgcattcgccttcatggatatcggcaagaagcacaacgccttgttcccgaggaatgcacttcaggaggattccattagccgcgcgccgatagagggtcccttctaccagcacgtagcgtttggagatgcgatggacgcgttcactcccttcgcggtcctcgggtagagtcttatctgtgaggtatgcttggatctcggcgatccaagcaatcaatctaagggagttgggagcactcccctcgggtcccgaggcctggactccgacaggcctcgggggccggtcaggcgcatccgtctcccctaaggggtcgggtcgcgccgacggctgggcaagcctttcttcaaaggcgcccggtggggtctgggctcgcgaggacgcgagccgtgagagttcgtcggcaatcatgttatcccgtctgggcacatgccgaagctcaatcccgtcaaaatggcgctccatacgccgtacttggcgcacgtaggcgtccatctgcgggtcagagcaccggtactccttacagacttggttaacgaccagctgggagtcgcctaacaccaggaggcggcggatccccagtccagccgccactcttagtccggcaaggagtccctcgtattctgccatattattggtcgctcgaaagtcgaggcggaccaagtatcggaggacgtctccgctcggagaggtcaacgtgacccccgcatcggcgccctgaagagacagggagccgtcgaactgcatcacccagtgggcggtgtgaggcagctgcgaggggtccgtgctggcctcggggatcgagacgggctcgggagccggggtccactctgccacaaaatcggcgagggcctggctcttgatagcgtggcgtggttcaaagtgcaaatcgaactcagaaagttcgattgcccatttcaccacccgtcctgtaccctctcgattatgcaagatttgaccgagggggtaagacgtaactactgtgacccgatgcgcctggaaataatagcgcagtttcctcgaggccatcagaatagcgtaaagcatcttctgggcctgagggtatcgggttttggcgtcccggagggcctcactaacaaagtagacgggccgctgcacctttcgggggggccgatcctcttcgctaggggccgcatcctnggggcactcttcgtccaagcagcctcgcgaggcgcacttatcttctgtgctgatgacctcggggtcggaggataacaggggcggtcttcccacagtggcttcggggccgtcctgggggtcgggggctcctggcgtcgtcggaaaagcgggcaaagggccaactccggtcgtcaggggccttaggcctccgttcggctcggggacctcttctccctgctctttcccgggtcgggtcagcacagggttagcctcggggtcgaagggcgataggtgcggccttcccacagtggcctcagggccttcctgggggtcgggggctcctagcaccgtctgacaagcgggcagagggccaactccggtcgtcgggggccttgggccaccgttcggctcgggagcctctcctccctgctctctcccgggccaagtcggcacagggtggggaagcgtgaaatgagaattgttctcatcgcgctccacaaccaatgccgcactaactacttgcggggtcgccgctaagtagagtaacaagggctcgtctggctccggggcgaccagaactgggggagagcttagatacgccttcaactgggtgagggcattttcggcttcctccgtccaggtaaacggtccggagcgtttgagaagcttaaataagggtaacgccttctctcccagcctcgatatgaaccgacttagggcggccatgcaaccggtgacgcattgcacatccctaagtttgctggggggcgcatccgctctatagcccgtatcttctcagggttggcctcaatgcctcgggcagagaccaagaaccctagaagcttgcccgcaggtacaccgaacacacacttatcggggtttagttttatgcgggcggagcggagactctcaaaagtttccgctagatctgagagtaacatttcctggttgcgcgtctttacaaccaagtcatcgacataagcctcaacattacgtcctaattgggtacccaaagaaattcgagtagtacgttgaaaagtaggacctgcattctttaacccaaagggcattgtcgtataacaataggttcctatgggggtaatgaacgcagttttttcctcatcctccctagccatgcgaatctgatggtaaccagagtatgcatctagaaaacacaaaaggtcgcaccccgcagtggagtcgacaatctgatctatgcgaggaagggggtaaggatccttaggacatgccttgttaaggtcggtgtagtcgatgcacatccgaagcttgccgttcgccttgggaacgaccaccgggttcgccagccactccggatggatgacctcacggatgaatccggcttccagaagtcgtgccacctcctcgcggatgaaggcttgacgttccggggcctgccgccgcactttctgccagaccggccttgcgcccggccgcacggcgagacggtgctcaatcacctccctggggaccccgggcatatccgccggtctccatgcgaagacgtcagcgtttgcccgcaggaaggagacgagcgcgtcttcctatttgccgtccagaagaccaccgatccgtgtggtcttggacgggccgtcgcccagggcaacctccttgaccgggacctcgtcgcctgtgatcatccgttgcctcggggtggcgagggcggaagcgccaagcctctcgtcgccaccctcgggcttggatgcagcggcgaggtggtccgcgcgctgctccagacaagcgagcgcgactttgaggtcgccatggacagagatggggccaccgtggcccggcatcttcatctgtaggtaggcgtagtggaccgccgccatgaacttcaccaacgcgggcctccccaggaccgcgttgtagggcagactgaggtccgccacatcgaagttcacccgctccgtgcggaagttggcggatccaccgaaggtgaccggtaggtcgatgtgacctaacggccacgtgtgccccggcgtcacaccgataattggctgggacggccggagcaccatccccggggccttgatggcgtcaaaggccgcaggggaaaggatgttgagggctgctcccccatcaatgaggacacgccccaacttcacgttgcaaacggtgggagaaaccaccatcgcaatctgccctccccgggcaacgcacggtgggtggtcggtgtacctgcgggcaagcttctagggtgagggcaacctccgaccaccgcgcccgacacgtcgcctcatgagtaggggccgcggccagaagctctcgcttcatggccttgaagctccggcgagaaacgtgagcacacgctcccccatcgacagtggcaatggtggccccaggctcttggaaacctaggtcatcatcgccgtcatcgatgtcctcggcgggggccttctgcttggcctcacttcgccgattaccggaaggaaccgccggggatttgccctctcggcgctcctgcctcctctcctcctcccacttcctcgtccgctcagccaaacttttgactgcacggcagtccgcgaggtcgtgaagggaagtgttgtggacggtgcaccacttgccggttgggcgctccctgttgggagcgccggcctcgttctttttgcctcccgcaggcctcccctttcgggtggcccgcgaagcgccctcgacggcgaggacatgaccctcgtcgtcggtatgggctgacctcttcttcctcctcctgtcacgccgccctatctgagcggcggatccgggggcggccgaagctgccacaccggaaccggaggggttccaggtccatgcctcctccttacgagccactcggtccgcgagctgaaaaagctccgcggtagtctggggctccttggaggcgatcttttcaagcatgcggttgtgccgcacaccccccctgaacgcgtaaatcaccacgtgcgcagggatgcatggtatggtgttgcggacttgacagaaccgctgaatgtacgagcgaagtgactcatcatcccttcgctgtactgcgtgcaagtccgcttcctcacctggacgcggatatgtgccttggaagttcatggtgaactgttggcacaaatcctcccaagagtgaacagacgcgggtggcaagttcattagccaaccccgcgcttgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacattccgaaggctcgtcacaaaggctctacagccgacaccaccaaccgggggcacggagggctgatccccgcgtccgtggtgaggtgacactccggacgaggaggcgccctccgttgcgtggggagcacgtcggccattacgccggcgctcgatactgatgcgagcatccggttccccacgcagatcttcccgggtcggaggcgttgacgaaggagtggcggccgaatggcgaacagcggctgccgctcgccgcgccctccgtcttgacgatgcggagccggtggtagcagcaccagaggccttggtggcggaggaccgcccaccagcatctaggcgctgccgtgcagtcatgaccaatttggccacatcgtccagccaacgttgggctggagactccgggtcatgggcgacgggcgggtgatgtaggagcgcgcccgcagcttggagcgcgccctagggcgtgctgccgtcgccgtagacgaggaggcgacgctccccatctcgccgcccttctccacctcctgtgggtgtcgaagtcgcggatccttcggccctctcgagcgccttctcccgcctaggactttggcgtggagggggcggtggagtacgagctcgacggcgtgggtttggctccccgtcgtcaccgctcatactcggggagaggtcgtgcgcctttgctggctcggccattgggctgaacaggaaaaacttggcgcacacgaaagagtgcgagagctcagaaaatccctcgcagagccccctacctggcgcgccagatgacggagcgtggggctcctcaccgggagaccgcgcaggcccccctttgccggttcggccggggactcagggagagattctaagctctctgtatgtggaaggctcgcgagacaggaaacacacaagacacgggcgatgtatacaggttcgggccgctgagaagcgtaataccctactcctgtgttttgggagatctgtgtatgaaggagctacaaagtatcagccagcctctcccttgttctgggtttctaatctggaaaagtccagtcccccctctcagtgggcaaggtcctccttttatatcttaaggggataccacatgcacaatttctctcttttttgtggggacttaccccccccccttttcataaatggacggaggtttgtatagttgccgtccgagtcaccttctgatgagacggcccacaactacctccactttcgccgggagcaggtgcgacgtggaatcgtggctgtctgctgacgacatgaccggtatcagaccagtcacgtcggtcattcttgtccaccacgtgtcagcttagcaatctacatgctcgcccttcttcacacaacatcttgcctgtaatggtttaggatgaagcctggcatatatctgaccaggactaacgtgccatctctgggaggtaacacgctagctccagctggggacgagcgcctagaagccctcgtcctgacgggatggggcgaggcgtgcgtcagatcgcctgtcgccacctaacccgcgatctgaccggtcgataaacgagtgcactgcactgcgttacatgcggcgtgacacgctcagccaaaccgcaataaatgtggttaggtgagccccactgtgctcacctaacccatacacgcggagcaaaaacccacgaggggtcggggcgcctcggcactcggggccgaggggggtgcggcccgaccccctcggggggactaagaggagggcgaacgcatcaccctcgggcccgacgtccctcgggggtaccaggccacgtgtgcgattgtgtctgcctcaaacctctagtcatgatactcctgatcccatgtcaccgacagttaattactctggtttaatagaaatatcattctgagtaattaagatttactttgtgagaattaattattggttagttcctaattagcatgcaggatcattgttcactatagtccattaatttataatgattgcattagtgtttggccggcactagaatagttattaatatcatagacgcggtgtctaggtagttaatttccagtgattgcttcatatcccatagtaggtttgaggtgggtgtagagttggtgacaaccctcaattacactgaagtcctccctgtccgagtacgcggtagagccatatctgggagcagcgggctggccagtgcccgaagtatcgcgttaggattaaattaagctttccatagacattgtctcccactagtaaatcctctctaccctttgcctatctttgctttgtgtccttagatgaacctggtaaagagttaacacacacgttccctgcagaaatcgataccttggaatactctcgggtcaagtgctacatcggtatcttccgtgcgcttgcaaattctatctgcgacgttaagaaataccaacaagcatttctagagccgttgccggagaacggttgttgtttatctctgcaccttgttcatcctcatatcctttttacttttctttcttctaccttcacccctgctacccagagaaatgttcttgtaaaactcttctcgcccatggagccacaatatatctttcaactatctgctccacggggcaaattttacgagccacctccttcatcggagcctatttaacacctggctatgaaattcgtcccgaattcatcattacggttagggagaaatctttctctagtctagaccaggaaatctcctatcatcacctgcgagagtttgagcatctgtgttcgtgcctcttgatccaaggcatgccacgggagactattaaatggaaattgtttccgttctctcttcaagagagagcaaaacaatggtacatttacaccgttgggagtgtgagtggtagctggaatgaattgcgagacagattttgtgcctcacattctttcctgttagtcgtattactttcctccggatcgaagtcctcagctttcggtagaataataagaaatcaataggtgcagcttgggccagatttgttactctggtacagtctagtcccaaccttgccatacccgattttgcattactgcaacatttccatacgggtttggataaggagtctgcactttacctcaacataactgctggaggtcattcatgcacaaaacccccgtcgaaggaaaggaaattctcgatagaatatccaaaaataccttcgggcagtgatttgaaccccctccagaggcatctgtgtcaggtacggaggaacctgaaccgtcaacatcatcagatctaactgaggaatcctcccgggaactatctccagatattgaagaaattcatgatccgggatgtgctcccaaattcagggacgatcttctcgaatattacggccacctattctctagccaactctcgatccaatagaatatggatatctaaaggaaacagttcgggagctgacatcaatcatgagtgacgaatggctannnnnnnnnnnnnnnnnnnnnnnnnnnnnnnnnnnnnnnnnnnnnnnnnnnnnnnnnnnnnnnnnnn

SEQ ID NO: 17045 - DNA, 508 bp, Oryza sativa
  unsure (1)..(508): unsure at all n locations
ctaactttaattttgtgtagtctatgttaaagactgttgcatttaattcatttttccaacaatgactacaggtttagattggggaataccgaagagccttattacaaaggaacagctgcttctatggtttttcttgatcttccaatgatggacgtaaagtttgatcatatcaagatatttgataatgaacttgcacttatgatatgccatgactttgagaggtatttttctgttctatttcttcttttgtttcaaggatgcttttgccttcttaattggtttgtacattttgttgcagaagtaggctagatctgaactatgcagcaaaatcatttatcatggattttagaagtcagttggaagggatgttcatgaagaagtttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17046 - DNA, 704 bp, Oryza sativa
caatagggatggcaatgaacactaaagaaatcgatcaaggttagtagaagctagtccggttcatgcaatgttctgcactctcggaacgatgcacaaatcactacagagccctggtaatcaatttaaccgttcaacgttgcaaatagtttacacttagttttttgttcatactgagtgtgtttgatgatcatcacatatcagttgacctatatgttacataaagatggcaatagatctcattctatcagtagcgagcacacagtatcaattcaagcatatacagaaatagctgttctgcgcctacaccgcaggatgacaatttgatgtgccagtctttgcctagcatgaacatgcaaaagcttggttagaacattaattacatctctgatagcagttttcttttgaattaccccttcctactactggaatctgtctccttcccagcagcagtgttcacttgtctgttcagataggcttcatatatctccacaacaagccttgggtccttctcaacaagctccttgtattcctcccgatctgccagcgttgacatgttgtccatgatcgctgccagggatgtctcgagcagctgcttcgcgctgtggcgatgcgcaaacgcataatgcgtgatggcattgtcgttgctcactttggatgttaaagaatttctcacagtaggccctcaggttcttcacttcgtactt

SEQ ID NO: 17047 - DNA, 551 bp, Oryza sativa
ctcactatgggcgaattcgagctcggtaccctactccgacaaccgtgagtggcggcggagcggctaggatcacacagagcccaagagctaactgtgcggcgtgctgtggaggtcgagggaatagtgaagctccgaccgctgtacgcatcaaggcgtggggtgccaggagcagcatttcgatcttgggtttgggttttgccaggctttacaaccaacggtccaacgtcggggtcgatagaccgcacgaacgtccccatgaaaggcgtaaagttccaaccggcggctttttagtggctaaaaggtattttgaaaataaacggaaatattcgaaaagcaaatataagtttaaattgtaaattcaattataagatcaaatatttatccaaatggtatttgaataaattaaggaaatttaaataaaatattaaaatagcaaatttggtaccaaaatgtagattttgaatttagatgaatttaggtccaaagttcactggaatcggatctacggtttaagagatatgggcttctaaagattgggttttgaattaaat

SEQ ID NO: 17048 - DNA, 573 bp, Oryza sativa
  unsure (1)..(573): unsure at all n locations
aaattcgagtagtacgttaaaaagtaggacctgcattttttaacccaaagggcattgtcgtataacaataggttcctatgggggtaatgaacgcagttttttcctcatcctccctagccatgggaatctgatggtaaccagagtatgcatctagaaaacacaaaaggtcgcaccccgcagtggagtcgacaatctgatctatgcgaggaagggggtaaggatccttaggacatgccttgttaaggtcggtgtagtcgatgcacatcaaaagcttgccgttcgccttgggaacgaccaccgggttcgccagccactccggatggatgacctcacggatgaatccggcttccagaagtcgtgccacctcctcgcggatgaaggcttgacgttccggggcctgccgccgcactttctgccagaccggccttgcgcccggccgcacggcgagacggtgctcaatcacctccctggggaccccgggcatatccgccggtctccatgcgaagacgtcagnnnnnnnnnnnnnnnnnnnnnnnnnnnnnnnnnnnnnnnnnnnnnnnnnnnnnnnnnnnn

SEQ ID NO: 17049 - DNA, 684 bp, Oryza sativa
  unsure (1)..(684): unsure at all n locations
ttgaacatttaggggtttgtgaagccgctgcgtcctttagttgatctgatcttgcaacttcaggagtgcttgaggagctatgtaccttttgaggtaaaataacatctgttatttcagcaggtggcaactgctcctcagttaccacttcaacagctgacaagtcctcatgactgcagttgagttgccaaagagaaattaagaacaatctgaatgcaagtggtattgatgacaataggtagttgtaatgtaggaaaaagtttaactgcaaggaacactttgatttaatgagcttggtggtttagaagcacaatggttatttatatacgctgagatgcataccactattaagctaccaaaaaagtggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17050 - DNA, 10781 bp, Oryza sativa
  unsure (1)..(10781): unsure at all n locations
caagtacaataattggataacccgtctagctgtcgtcgacttggcggctagataaccaacttgtagtcgacggcagggtagtcttcctccttgaacgaactcatcgagatcagagatagtgctagatctcttttgccggccttcgcaggcaccgtattgggtttgtctaggcttatctctgatgttgatatgtggcagcgtattggtttgtgttgatctatatgtcttctggcttgtctcctctcctcctagggggttgtatttatacccatagatgccccctgtcgaagtaaaactagcgagataaatatggatacgatcctagtagtcctggttgtttccatatagaactccttttgtcattccttattcggaactccttctatatatgaggtttgttttcgtataagatatggtatatggtgggtcctgccgagcttagtcgattattattgggtatgtggtatccataaccctaacacctctttacctaccgccggcgaaaacgcgattttcattggtgtacacttagaggttcgcctcgaaaaatagagttgttttttatggcggacctcttagtgcggccgttaaatcggttttcattggtgatccgtagccccctatccctcgatatgtttgtgcttgcggttttcgcgtacggccgctagcaaaaattatagggcgacatcatgaaaaatcgttttttatagtagggattcttccacaagacaaattttgcaaatatctcgcaaatgttataaaatgtgtctaaggctattcccagtgtgcaggttccacaagagtttccatctcattagatgagatgtcatatagactaaacttatgacatgtcaatgattttatgaatagagagaaaaagttgagtatcgtctagatgaaacttgatttgcgcacttacctatacctcggaaacataatgaaatcccactgaatcatttcatcctataccttggaaatgaaatgaaatccccactgtgaccaaatagtttcataataccatttaataattaaatgtcatatgtagcatatgaaaccactaaatgaaactatgcattgaaaatttttctttcattcatcaaaccaaatgtttttagattatggctgcgttcgaatcttataaagattcacaaatacgggcatgcaaaacaagaaagctattagcatatgattaattgagttttaattattacaaacttgaaaatgatatatttgatactttgaagcaactttcatatagaaagttttcgcacaaaacacgccgtttagtagtttgaaaagcatgctaatggaaaccaaggtaaaatcttcatcttcatgataaaagaacggtgcctatgtgacactcttagaaatcataatatgaaactctctatttggaatggcctgaaatgtcttgtaggttgacttttaaaataccacttgaaagtgtctttagacgaactatggaactcctgatattacggatgatttgaaaaccatctctgttaagatgtactacacggaaggtttctgttgtaaggatttgatttatcttcgttcatttttctttctgtttttctatatatccaattgtcgacctcttcttctcattcaaaatatcttattgaataaactaggattaattaagttcatccgacatctctaaactttcatgaaaatctagaaaccaaccaaaaatgcacggttcaacgcggaactgttaaaaccatagagtagttcttgacttcttggaggagggttattttctagactttccagagtaaaatggacttctctgttgaaaccttggtaggtccgagaataatttaaccttaattgcaaaaaaaaagtttaggataatatgctagcacaaataaaaatgttttaccacgcaataaattatatatgaacaaaagtagccaataaatatatgagttgttgtaaccaatagtagcaaccatgcatcgatgctatggattgtaagtagccaatcttgtaatatccttccagccgtgttcattgtttcctatgcactctaagaattccgatcgacactcctagcaacaatacttttcttcttcatcgcacttaattagggataggaagcatagggaactagaatcatacatcctccatgagataaaggatcagctccagccaactgatgcataaggttgatacatattgcgatagaagttcaattcggcagccatccgtacctgccttacctgcgacttgttcccgcaccacactgcacaagggaagaaggcaacacagacatagctagagaacaacagcgatccttcttctcgggcttctaaactatgttttcacgaagtttattcattagcatttttttagaaaacgtttcaaatcattatcaactttataatatttgtcacttttaagatgtgaaattaaagatttatcacttacagtctatgacatgtgagccctcatgtgtctacgacatgtggatccagtgacaaatctataattaccacttgtaatagtgccaaataattaaatatctcagggaagtacggttggcacatacacacaagtggagggggaacttacatcacttggatggagggtggaacgcacgtgacgggaaggggtatttttaagatggatcaaaaataaaaaaaaaagtatcgacatatctaatggttgaaatgaattaaatatcaatggttagatgtattattatttattatagagtgaagtgcacagacggtctctaaacttgtttgagtgtgtaatttaggtccttaaactctcaaatagtttttttttaggtttccgaacttgtcatgtgttcatataaatccaaacaggctctactctacttcgtgagctaatgtggcatgccactgtagcacctacgttagtgggatccacaagtcagttacatagaaaatataaaattaaaaaagagaggagaaaaaaatgttcttaatgtttttcctattggtgatagacatgtgggtttcaatgatacagacgttaccatgacataccataccagcacacaaagcgggttggagctcgattagacctaaataatacacgatgcaagtttagagatcaaaaatgcattttgagagtttagagacatagatgacacacatgcataagtttggaggctatttgtgcactttactctttcttataatatttttttctaatttattagagcgttacataacgatttaggagcgtgtacaagatgtttaacgaagtcatagtatataatagatagacaaataaataaatactactatatatcttataggtggaagacatgcatgtaaatagactttaaaaacttataccacacaaaaataggaaaaggaaaaggtacatctgagatccctcatctcgtcaccgagttacaaaatcgttcctgaactgaaaaaccagatacaacgcatcatccaactttcaaaaccagtgcaaataaggtccgtcggttgtattgtccttggttatgactgacatggcgcttatgtaacacttcaccctcggtggtattatccctttgcctaggtcttcatccacgtggcattgacacgacggttacatagcaatttggtaaaaaaaataataaaataataaaaacaatggggcctactggtcagatccccttatccttttctgtctcttcttcctctctttcttgcgtcaggcatggaggaagggcagaggaggggacgcctctccatcggctgtgggcaacctcgatggtggcgggaggtggccccggctccggtggcggtgaggccagcggcgtgtataatggtgtctcgggctcctactcactctcgttgccggcgccggattcctcatcgatgatgtagaatcctccaaatgcagtctgctcatgtctaacacagggcacgcattcgtcaatacacaaacaaaattggccatatccaaatgcagtctgcactgaacaaaatcctccaaatgtagtctgcagttctgcactaaacaagaacgattcccaagttggatattgggtaaaaaacgattttagcaccgtcaattttcctagcgcggcaggcgcatcaacaacgcaaatttaccaaaaccgaaggaacgagaccaccgacagagctaccaacgatcttcccttgttcctcgagaaggacaaaggcatcacaacccccaagccaggaggagcagcagtagcggcaaagcatcagaaccttccggagctaacccaagggcagcaacctaagaatccaaccgagatcaccttcctcttcgtcgacaggtatcgcctgcttaccttcctccccctgcgtagcggcggcgggagcatggcaagaggcggagcancgcggcggagaggagggccggcatgacggcggcgtcactgacgcagcggggagaagggccggcgtggcgagcggtccttggatccacctgctggtggctaccactccattccctaggccctagcgacaccgcagccgaggccacctcccgccacggctgagccattagcgcataattaattaagtattaactattttaaactttaaaaatggattattatgatttttaaagcaaatttcatatagaaaacttttgaaaaaaaacatacaccgtttagtagtttgggaagcgtgcgcgtggaaaccgaaacaaacaaactcactttcacctcccctagagcagagagaggaagaaggggatctgatcagtggacccccagcatttcttattattttttctagatcaaattgtcacgtcaatgtcacatgggtcgaagacctagtcaaagcagccatgtagacgccacgtcagccaaatcagggataaaactattgaggatcttgtttatattggttttaaaagttggaggatggacgaggcacctcaaatatacttttacccccaaaatatacttaaaagatactaccttcatcttaaaatgtaactatttctagcacaataacttgtcctaaaataaagttttttctccacctacctcctctcaaccaatcacaatcattcccctttacctactttctcttttcaaccaatcacaccatttttttaatcattttttacctatatttatatttttaatagccgtgccgtcggaggaagtaaatcagtactagacctgtttaaaggacagcaatatggacaatatcaacctgcccactcacaatatgtgtgtgtgtatacagccataggattcattcgtttattcacaaacttcacttggtcctctcaaaatgaaaaaagaaaatgcatgcctacagttcagcttgattagatgcctcaaaagtaactgaaggaaaaatacttcctctcttcaacgtggcaccggcacattacacttgtattatttagaaagcaacggtccaattttaattgttacactcctccataataagattaggatgcatcaggaaaatagtatcgactttttctgcttgatttcgtcagttctttcatgctgaattcaccggtgcccaaagtagccgttgccgatgggtcgtcaggtgaagatgtttgctcatgttggtactttggacagcgcacactacgatcgatctgtcgtaggcattgccaaaagttttgctcaaaaatcaaacaagattagcattgaactgtgcgactatttgagattttttactttccccaaaatctcaactggaattgctcggtgtctacaaagtttctacgtagagggctaagtcaaaactttaaagtcgttttactctcgatttgccccaaatggtggttcaaactttacagtcgtttcacactcatcacactcaaatcaatggcaacattcaagaggtagattcaacatgaaacagtaatttcaaggcgatttaggcagtgagataatagcttggttaacttggaacgtcatggcaatgtgcagtccaataaacaaaactaaccacactagctttgtttttttcttactttgatgtcacaaggttaactgtaatgaatcaagaaggctcaaacttaacatacacacaccaaagccatccattcctcaaaataaatttaacaagcttatgcacatacaatcgaaagggctaaactacggtagacatcattcacctgatcacccctactagttattccaacaattgcaattttacaagtggtacagacagcatatactagtagtaaaaacattatcactgaccttctaccgatgatctaacgaaggaccttctccaccatacctggaaagctctagtaaggttcgggcactctgatcctttggatgcaaaacactgaaaccactcctcaaatagacactgctgctgcttgagtgggagggttagtagggcctgtcctagattttcctccaaagatcttacatccagacctttggagcatcgctgaagccagccgaaatcaagcaacatcgggctgaaccatccgtagaagaggaggctcctcagctctccacggcactgaacttttcctttgccgagtgcgatgaaaacactagcagatattcggcttagttcatacctcatcatgggtgatgcctgctcatgtatcctgatgagcctgtcttgctttgcccacagctccacaaactcttcagccatgtcaatattcacaagaatgtccaagagccagttgaggttctctgtctgctgagagattctctcaataaatggtttactgcccttgataactaatgcttgagcagtgtggtttgtagcctctgttgcttcgtcataaagatccactagtgaatttaaacaggcataacagatattatacaggctctctctgtttagccctgccatgtctttttggtagacagaacttttgcttagaaggccatttaccaaagattgcatatcttttcttgcaccactgttggtgctgctcgtgactgattggataagatgcactgtgaggtcttctgagctgctccagctgtgaggccgcaatctagccagaacatcttgggatattgcttcatcaaaagtacatcttgcaaagagattcttgagcttctcctcctcgttctcattccatggaactgcttctatgtatgacaaacacaatttaactcctctttcaaacatgattgatgaagacacctgcaattaaagcattaataaacaaattatgtacgtgattaattagttggcatttaataaactcattaccaatgcaagaaagaagcatttaataacatattattctgtaaatccccacttgagaaatatacatgctagaattgaaaagatgttacaaagatattggacagcaatggtggctgctttatttggatcactagatagcaattatgggcaacaggaatacttgcttttaattgcgggcctagatgcattcaaaccactaaatgcatttgtagctgactttcatagctgtagaatgtgatctaatggacatcaagccatagaatgtgtatggttacaagacttatagtgattgtattattatctaatccatgatttaacatattaaacaaacaataccagcatgcaaacaattcacatagaaagtgagtgatctacaacatctaatatggttataattatatacttacatatcactttgcataacttacatgaaagcaatggtttaataaaagcattagatgatattaaatcactaatatcccaggtcaaatgcttctcacacaatcatatcatattagtttcactcgaatgctagagctatcgttgtttggcatatgctgattataagccgtaacggcttatcagcgatcaaaaaatattccgttcgtaaaactttatatatgtgaactagttagcgatttaaaagccaatgctggaaacataaactacaatgaaaaaaacctcataatcaattcaaaaattaagtttccaaattaaattttggcagtggcttataagctgaaaggcaaacgctggggctctaacttgtgcgcctatcaaaaaaaaatgtgaaaatgagtattttggtaacaccacactggatatctaccaccaaaatggcttcggaaaatgaacatataaggaacacaacatcaatgtaccgtgaatgattgtttggttgcaatgcccactaaatttcctgccctgttgtgggtaacaaaatgccatccattattgcaagtagtactacttcttttgcaaccacatcatgctactagtaacacaaaatcaattaagagaagctgcttaagcttaatgcgtttccctcacctcgagcacatcaatggaagcgcgacacgccagcggcggcgagccaccgcagcggatcaggctggtacatgagctcgacggcggcgcggaacgcctccacattgtccaccccgtccacctcgatcctcctgccgctccctcctccgtcaccggcgggcccgcgcggcggcgccatggcggcgaagaaggcgctgctgtcgcagagcaccccggagtcgagctccatcaccacgcacgtactcccgtccctcccgcgaaggaaaagcctcagatccagcgcctcgtcgcccgccgcatccgcctccgccgacgccaccaccaacggcgccaccgccgccgacgtctccgccgggaccaccaccgtctccgccgcgggcgtcaccggcggcggcgggagcgggagcgggagcgggagcgggggcgcggagtcatcgaggtcgatgggcgagacgcgcccgggggagaggatgcggcgcgggtcgatgaggccgccgaggccggcgagcctcgacgacgtcggcgagctgtggaacgacgagatcgagggggacttgggcggcagcttattcctcccggcaccaccacccggcgccggggaggaagacgcccccgtggccggcggcgcgaggaaggaaggaaaggggcggaggtcggggctctgcggaacgccagcgaaggagcagcaccagccccggggcgttcgcgcggcggaccccgccgcacctcggcgccgcccgcggtggtggcgctgagccccgccgccttccatccttgccgtcgccggcgcagatctgggtggggcgcgagagagagagagagagagagagagagagagagagagctagggttcggaggcggcggccatgagaggggaggagggagaggtgtgatgagtggaacaacacgggacgagagctctctctctctctctgctgcttctttctctcactctgtgctgtggcactcactgtgcaccgcgtgggattggtccatgggacaagactggtaggtggggtccactgtaagtggggtcctcttcctcggataccgcgggcgtggtgtacgggcatcacgagaggagctggcactgcactggcaactcaactgggcaagagagggtttgcgatcgtctgcgtccggggtatgggtatgggcgtatggctgtgccgctgccgatcacacggaaaacggtcctaaacgatactcgggaggttccaactcccccacacgaaaaatggtggtacccgttaaaacgtgattaattaactattaatctcaaaagctcgaaaactcgattattatgattttttaaaacagctttcctatagaaaacttttaaaaagaatatacttccttccgtcccataatataagatattttaagtggatgtgacacagacatgatgtgtcatatccacctaaaatccattgtattatgagacggataaagtattgtttagcagtttaaaagcgtgcgtgcgaaaaaaaagtgagttgggaaagaaggagaaagaacacaaccttactcttataaaaataactttaacttttacttccggatatagtccctccttcctaaaattatttttaacttgttccatacatatgcatatctctctactattataaaaattaaatatgtttttgactgtactttggaacatcatccgtgtatgatcggtttctaagtccttttgctttttaaaatatagatatgtatttgagtcggattttaaattcattcgtttttggaaataatgaggaatcttataagaaatctctttaaaaaaacttgcatactaacttaaaagatgatcggacttataattgcaactcatgattttctagaaaaatatatatccaagtgaattctcacaacgaaactattatatatatctctactgttataaaaattaaaattgaagatacttttgcatacgttatctttctttgagttggtttttaagttcattcgattttagaaatacagatccatgtttgagttgaattttaagattatttgcttttggaaatataaaaggagacgtataagaaacctctttaaaaaaaactcgcatactaacttgagatgaaatatagactcctaattgcagcttatgattttcaaagaaaaaaatatccaaccgaattcccacggtgaattttaccatagctaaaccttataacaataataaaattaaaatagtatttaccgttgcaacgcacgggcattttttctagtatgttataaaaattgaagatgtttttgttggtactttagtatgtcatccatgaattagtcggtttttaatttcgttcgcctctgaaaatataggagcagtattataagagatctctttaaaaaacttgcatgctaactttcagactcagctcatgattttctagaaaaaatatatatcaaagcgaattctcacagtgaatctaaaccgtataacaatatttctcacttcatttacctgtaatgcattattctctactttcannnnnnnnnnnnnnnnnnnnnnnnnnnnnnnnnnnnnnnnnnnnnnnnnnnnnn

SEQ ID NO: 17051 - DNA, 5969 bp, Oryza sativa
aattcaaaaacttttcaactacaaagttgtaagtcgcgtcgaagactacaattttgatataaagtttatcttcattagagttcacatgaaaaagttatgaattattttttaatataaagtttttagaccgtcctgtttagggaccggggtgacacaactaaacaagttggagctaaacgagtgatctgcaagtttagggaccgggatgacacagtcaaacaagtttgaggacctgaatggtcaatttgcgagtttagggaccgagatgacacagtggtacaagtttagggaccagtgatggactttactctaaaaaaaaatgcacgaaagccaggacctaagcatagacaactggctaagagcgaggccatcctttcatgctaggcatgatttggattcaaacaggtgaattcaatgaaattagatgataatcttgcccatacagcatgtacactttatgtatctatgtacattatactctaggcatacatatgtacattatactcaggccacatgtaaccccgtgtaaaagccacggacactattagggttgtaatatacaaaagtttgcacataagaacaacaaaatatatgcgtaaaagaagaactgtttgtagacaacctaaaatgtataaaagctaagaattcactagtacaaaaactgtgataggtattttctcctatgttccggtttatttaaaaccgacacttattgatcgttcccacctctgtgggatagaaaaaataaaggaccaccaccttcgtacaactatatctgtcggttcaaaatatcccggttcaaaggcatccataacatattataggttctgttcttttaaaaaaccgacacctatgaaaaactaagccgagccattggtcatcgggtgggtattccttttaaccccactgagtcaacccgcgttcatcgtctctctctctctcatgcatcttgtcgtccctatcccctccagcttgccttcgtcgtcaacgccaccacccgtcgtcatgtccccccctcttcctcctcctcaccacatccatgcctccccccctcctactcgcttccacctctatccccgctgccacccatcctcacagccttcgctgcctctaccacccattgtcctctgcaccacattctcgcctgctcccagctgccctaatctcttattgtttaaggtttatgaatcttgttaatgatttactagtttactgatgcatataacatgtaaaaaaaagactggcaatgaaaatggtaatatctcaatgctatacgtgacaaattgaaaacatatttaattactattatattggacgtaggctaccacttagaagatccaataatcaacaatctcacctaattctagaagaaagtaatagcatacagagcagcaggggtgtactaaatttttaattggaaaaatggccatctatataagagagccatagctgtcatagtgccatagctcaagagtagcgagacaacagattcattagggattttttttttgtcattccagtgattagtattgccatatcattagcattcatatagggctgtgaggcatcagtaatacttgaaattgacttgctatgaaacacagtagtctggcaacatttctatgcagtagcacactgagcactcggttggacaagatctggagtgaacaatacctcgctcacggtgagagtccgaccacttacttttgcaaccgttgtcggagtgccgccatggatgtgagcaggcacatgagtcagcgatctggagcgaatggagccttcctgggcaacacacctgcaccgtagttgcagtcttcctgagctcatgatctgcttgacatcgacaggcaatggcagcgcgggcgctcgacggcgtgcaggggtggttggctagggcaagcaaaggcagattaggaggctgttaatctggtcatgaacttttttgattattttgcgatttgtgaagatcgagagaggaagggaaaagggaaatgcggcggcaaatccagccacatcctcttaaattggtatagatatatattgggaattttaatattgtaatttgcaaagtatacagtttcgtcgtgtttgcaaagtgctaactgcttttgcagattgtgagaacatttctcctttccattcgttcttcctatggtctgttaattcactctaccacactggtctataggccacacctctccttttaccgtcctctgccatcaccccttacctgtagataaaaccttcataggtacctgttctgagccctttgttggtgctggtttttttaaccaacatcaatataggggaactagtgaggataaccaatgggcacccaattttatttttacatgcgtgaaaaacctaaaaacatagtattactccctccgtttcacaatgtaagactttctagcattacccacgttcatatagatgctaatgaatctagacattattatatatatagattcattagcatatatataaatatggacaaaagtcttacacactgtgaaacggaggaatgacatatttcactaggcagccatggtcaagtatcgtttcccacaactcacaagattttaataccattttacctctctctccacctaaagacttcttaccatctcaccggaaaacacttattgtcttggaagcaaatactattcttttgatacttctatcattcgaaacatataatccatatttagatctacaactgaaaattttattaactacaaaattatcgatctcatttagatgatctacaactacaaattgttgacctcgaagaaaaatgtaatcaactccaaatttgtatatctcgtcgagttatacaaatttgatataaagtttatcttcatccaacttcatatgaaaaacttagataaaaacagacatatgtaagtggcgtcattataggtgccggttttaattgtcgattggcacctatgaactcatagaggctggtaataaccatacataatacccatatatgacggttcacagtaaaaaccaacacctttaacatcgtttataggtaccagtttattataataaccaacacctatgacttgagaaaactattggtgtaggtttttttatggacatgcaccaataagtaattataggtgttggttcttaattttatccgttaaaagatgaaaaacgcttcatagatatcggttttagataccggtacctatatgaccggtctatgttgtgttctgcactagtggctagcattgtcacagggtaaaatgtgttatggcttcattgtgggccaagcatgatatggttgaacaaggtcgacaaggtgctgatcgagaatgatacgtgaaagccaatctaagcatagtctactggatggctaagagtaacgccatattgtcatgttagacatgaatgcatgatttggaatatgcaaactcgtgacttcaaggaaattagataatgatcttgcccatatatacaacacgtatacgttatgcatatacgtacattatactctaggtcacatgtaaccgtgtgtcaaagcaatagacactatcaaaatcatagtatatataagagcgttaagttctcacataaagacaacccaatatgggtatataactgagaagaattgtgtatagccaacctacccccttatcatgtataaaagctaataatgtttgatgtgcatgaatgttattaacggcttatttgtttcctgatgcataaaatgtgtcgaaaattttgttaggcgatagaaattgtaatatctcaatgctatacgtgtcaaacagaaaacatatttaattactgttatattgggcagtggctaccagctagaaggattcaataatctagtcaactagatgattctccgtactttgctgcggaaattactaagtaacttttaatattttttaataattaagctaaaagtaaaaattatattagttattaacaacaaataaaaactggtttgtcaaactatgttaagagagaaataaatctaatagactatgtatgagattgtagatgaaatatatgatgttgcacgctttgattatatggatgaatatatggtaaatattataaaaatattgtgaaaaataatgtgaagtaagataattgtatgttaatttgtactcaatgaattatagatgatgttgcatacttacataagttttgtatgtaattattgctagtggatgataaggtgccatatttgaatgttgagctttagaattagcgggttataactttatagtaagataggatgtggaataaaagttactattatattgttaacaactcatttttctctattttctttaatttttcctcgtacttttcatacttcccctattccccctaaattcgcctcatatcccccgccttcatgtttttctttcttttttcacctcacattttcaccggcccatgtgtcacaagagtgctcatgccggtccggcatctttttaggttgtgccttgactgaggccttgcacgcggggcggcacggtacagaccgctgctgctgtcatgccacaccactgtagaatcaaggagttgatttagattttgtgatgaaaatattggtggtttgctaatgttaatttggagattttataagatggttgattttgtgaagtggatgttttcggttgaccctggcggtcagaccggccgagtgccgtcggtcagaccgcaggtgttgcggcggtcagaccggccggcccgacggtctgaccggcaagatcttgattgatgtcggtttcgggttgttttgttggatttggatattaccttcggggatttggcttctagatggtttctatgcgtatggatactgttgttatactaatgtgagttaagttgggacgaacttgggctcggaatatggtttcttggttgttgcatgtgcaggtgttgcttgagaccttgggatagtgttgccggtgatagattattggagtcaacttgggagaagttgatgtccagggatcaagagatcatgcgggatactaaaggctagaggacaatgcacgtagtgatgaagaaatccatatggtatacaagagggattgtgtacgtatggaaagaggagtcaaatttggaagggagtccgaattcgggaagtttgattgagataaggaaagagatgagttgtttacttgcaagagagggtttcctacatgggttaggagtcctaagttgtgttagattcgtgggctttgcatagcctacctcatgtataaatagagagggagggtgaggcctcccggtatcgattttagagagactagagttgagagaaagttagggttttgaatttagttcgagattttggtgagaagtgttgttggtgcactttgtaaacactagttgatgcaataaagtcaaaaagtttcaatctacatcttcgagtttgtcatgaatcggtgtttctgggtcctgacggtctaaccgcacgtgcgcgtgcggtctgaccggtgggatagcggcggtctgaccagtgaggagttggcggtctgaccggcggcaggagggcggttcgaccggcggtgataggacttcatcgtcgtcttcgttcgagggtaatctttaattccgcaaaagatttttgggtttttggttttccttaccattcacctcccctctgataggttattttggtcttgtgtgatcctacactctccttaattctaagtatactatagaatatataaagaatctatagtatatttagagcctattgtagttcagctctacatcttggtgtgtgttgaaatgaatgatgagagggccatttataggtggaggtgccttgggaggatagagtttcttccaagcatccaatgagcatcttcatcctcctagtgccgggtgtccagcttatgatggttttcaccggtgaaaacggctataaccatcattggggagcggattgttgccgaacgcaacctgggcctaaggca

SEQ ID NO: 17052 - DNA, 2700 bp, Oryza sativa
  unsure (1)..(2700): unsure at all n locations
gaaataactaagaggtaattctcaccaagcaaaactaaattactcaaaagatatttctattataatcagagtaattaacagagcagaaagaaataagaagaggattattgataactccggaactcctccgacttcttctactctctctccctaatctaatatataataaagtacaatagagcctcttataatttagctcaagctttggtgtgtgtgaatgagggagaggagagggccgtatttataggtggagagatgccttgggaatgtggagatgctaagcatcctaagagcattttctctcttgtgttgacaagtgtcctctctatgacggtttccaccggtagaaacggtcacaaccgccaatggatgaggattgcaactgccaggtgaaaaatgggcctggatggactagctggtggtttggccgaaccctggccggctctgctagcccagcccttcctcctagagactgatatgtgggccccattgtatattcttctgaagattggctcaaatgattgcatcttattgggtttatgggctcaagactccattagcttggatatgaaagttatattctcatccttcatgtatattttctctcaactttagtaacttgtcacctgcatacgaatatataccaacactcatagaaaatggtagaaataaaccctaccactatgttggatgttttatatttatggtcttatgcaagtattgacggtgttaatttggtacttaatagccatcaacaaacccacacacttagctctttactcgtcccgagtaaatgttgaggattaatgtggaacaaaattttcaaaaatataataaaagtacccaaactattctaagccataactgtacctataaactttgcagtgtataacttaccatcttgggtaactgatgaatggaacggttgtgactcaagtccttcatgtttctcctgtcaatctcttgagttttcatatgttttcacaaagtatctatactcctcaaatgactttctctcaaatcacgcatgtggtttaatttgtggatcctcaccaaggcatattttgccgaattgtccctattctaaaaggttgtatatgtggagcttggtagggatcaatcggggcatacctgcatcacatattttgcaaagccaaaaggtcggacccaaggagatagcgagttatactctctgatcaagaatgtgcatgtgtgtgatatgtgtatgggtatgtatgtgtatgtgtatagtatatttttggatggaaaaaggaaaataaaaaacaacaactcctttggtataccgcttcctccaattttctctctttggaaatttgagagagtgcatggctatctcctttttttttcatcatgccccatactttgtatgagcagattttttttctattttctctctctcatttttttttatcaatgctccatacttatatgagcaagactttatttttccttcttgtgcatagtcatgcatctctctttcttttttctttgaaagaattttggaggaagagacataaatgacatggagtatttattttgtggataatgaatataataaatgatggatgagagatgctaacttccagtgtagaagtttagcataacgtgcgtatgaggagtgtggtgtgatcttgatcatgaaagtatgaaaagtatctcacacaggtcacaataatttgacaaagctcaatgtaatgtcaagcggcctatacacatataaggttttgcaatgagaatcatatatggccttggtaggtaataatatagtcactaaggagtattgctctaaaagaatttttaattttcacaaaataaaatcccaagtatcatgaaagttggacatgaatttctttcgttcactagcacagaacctttcatctgtgatagccactaacatgcctggaattagcgggccgtcacaaggaagtcatctcaatcgggccaaaaaagcattcgattaagatatggtcgcacagacatattagatgggcataaaactcaggctcgtcatggatgacacctatccgtgacgggccgtagtttaggcccgattgagataacattccatatctcaatcgggcctcaagttggctcccatcacagatgaccatcatccgttacgggcaccaacttagggcccgattgagataacaactaggcccgccacagatgactcatccgtaatcgattgagatgacttagtatttttttctatttttcatatggaatgtttatatttgtgagtcgacctgtagcaaaataattaactgcagtataataattcattttattagtcaaaataatttttcgagtagtaaaggatttcaaatggaaaatttgtcaacaacaaagttgtataacttatcaagatttacaacttttattttggtcatttttctgtgtaaccttttttatcagtttaaatttgaatttgaaaatatgacaactttaaaacaacattttcaaatactaaaaagtcatcaacaaaaaaaaagttgttataacttatcaagatctataacttttatttttgacatttcttaatcgacaaagtgttagtaacattgttcacaaaactcacatatctctcatctggtttcataaactataacgcaaatatgtnnnnnnnnnnnnnnnnnnnnnnnnnnnnnnnnnnnnnnnnnnnnnnnnnnnnnnnnn

SEQ ID NO: 17053 - DNA, 2030 bp, Oryza sativa
  unsure (1)..(2030): unsure at all n locations
ccnnnnnnnnnnnnnnnnnnnnnnnnnnnnnnnnnnnnnnnnnnnnnnnnnnnnnnnnnnnnnnnnnnntatgtaacattgttcacaaaatttacatatctgcgttatagtttatgaaaccagatgagagatatgtgagttttgtgaacaatgctactatcactttgtcggatgaagaaatgaccaaaataaaagttatagatcttgatgagttatacaactttgttgttgatgactttttcagttgaaatcatttagtatttgaaaatgttgtttgaagttgccatatgtttaaattcaaattcaaactgttcaaaaaatgttatatagaaaaatgaccaaaataaaagttatagatcttaatgagttatacaactttgttgttgatgactttttcagttgaaatcatttagtattctaaaatgttgtttgaagttatcatattttcgaattcaaatttaaactgttcagaaaatgttatatagaaaaataaccaaaataaaagttatagatcttgatgagttatacaactttgttattgacaattttgccatttgaaatcatttactacccgaaaaattatttgaatttcttatattttaaaattcaaattttatatagttcaatcaaacccagatggagaaatgaccaaaataaaattagtagatctcaatgagggatgctggggtgtggcatcttggcccaggacttaataggattaatagaatactcataccaacaagttaccactttttatttctaaagaactctgaggttaagcgtgcttggcctggagcaatttagggatgagtgacttgcacaagcctggagcaagcacatgagtgaggacaaagtgtacaacaaaaaagacttgcctggcctaggagaggcgggacgttacatgggatttcttttttttttttgtggattatactcatccgtgacgtgctaatgagagtcatccgtgacgggcttttttgttggcccgattgaaatgtgtgtcatccgtgacggtcgaatgccccattgagatatttcaccacatcagtgacctttgcttgacggggcccctacccgatagagatggggcttgccgcccattacaaatgactgaacccgtgctagtggtcataaccatatcataaatatcaattacttagatgagcatggttccctatgatagatggttgttcacaagtgacaagtggtagcaaagaataaaaggtatacacgattaatcataggaagattctatttgttgagagttaatgttttcaattttcattttgagtcaaactaaattatatttaaactttcgatgcaggtttgacttacaaacaggggaggataagggaggagacgcgcaaacctgaccacacggcgaaagggtgacagagccaggctaggcaagggtcgggtgaacacttggtttggccaacccagccaggaattggttctggctgctgaattttgtgcacagccgtgggccagcgttcatcataccatcatgtcaagttgatcttgttgcgcgtcgggagttccgaaaagactcccccacatttgtcttgtaccttttctttattcaacaaaaacataaaaaacaaaatgggcttccatcgggatgaaacaccggccaaccaaactttattcaataatcctaggcgcatgaagttcctaaatttattttttttatctttatcttgataatttttttcatggcaacaatgagcatggtgggtatcttagcagggtggagatatgatgcacaaggtggttgagattcttaccggatagttcttaccaagcttagaactaaatcgaatgcaacaaagttttgcatttgttctgcttggttccatgtgcatctttgttttctcggagaccaaggagcgtggtatgagtgttgtagttattctacactgctccttagttgtctttttattgactgcaaaaggttnnnnnnnnnnnnnnnnnnnnnnnnnnnnnnnnnnnnnnnnnnnnnnnnnnnnnnnnnnnnnnnnnnnnnnnnn

SEQ ID NO: 17054 - DNA, 644 bp, Oryza sativa
aaaaagaatcaaaacctaatgcttgttttggtttggctgttacgtttcatacagatgattctatcctttgagctaccatttgctctgatccctcttctcaagttcagcagcagcagcaacaagatgggtgaaaacaagaactccatctatgtaagcactcccccatcaatcaatcaatccttctttctagcttgtccacacatagaaaacaaaaacaaaaaaaatcctggaaaactaataatgcattggtaattaaaacctgcagattgttggattctcctgggtgctggggttcgtcatcatcgggataaacatctacttcctcagcacaaagctggtcggctggatcctccacaacgcgctcccgacattcgccaacgtgctcatcggcatcgtgctgttcccgctcatgctgctctacgtcgtcgccgtgatctacctgacgttcaggaaggacaccgtcaagttcgtgtctcgtcgtgagctgcaggccggcgacgacaccgagaaagcacaggtagccacctgcgtcgccgacgagcacagcaaagagccacccgtgtagtacccttccagaccggttaccggtgttggctggtttttattggatagatgtttaggtccaattttttttatataaaaaa

SEQ ID NO: 17055 - DNA, 493 bp, Oryza sativa
tgcctgcaggtcgactctagaggatccccatatatttatagattcactaacatctatataaatatgggtaatgctagaaagtcttataatataaaacggatggagtacatagtatcactgttagtgatgtatgaatattggttcatgttacaaaccttcaacgatgtaccattgcctgttcttaacatgtaccagaggtgatcttctcaacacataattggttggaccagcataatattgatcaagaacaattaaggtttttagttgtcaccagtgatctcaccatccccttgactccggattcatggacgaaaaaatcaaggcatccccttgactccgggagggtgcttatcttgtggtggtcaacatcagtgagctcccaatcaaagatacctagattctctcgcaacctcctctcattgaagctcttcacgattatgcagtcaccttgctcatacactcatgggtaccgagctcgaattcgccctatagt

SEQ ID NO: 17056 - DNA, 1317 bp, Oryza sativa
  unsure (1)..(1317): unsure at all n locations
nnnnnnnnnnnnnnnnnnnnnnnnnnnnnnnnnnnnnnnnnnnnnnnnnnnnnnnatcttgccgcctgcaaaagtccattttctgcggcaggtaccaatccacgcatttggatttcctgttgcattctaatcctatataacatgggatatatgtaggaagtctctgtaaacacaaatcaagagctagcaaaaatgcctttagagtggacggtctcatgcattcaattcatgagcattttggcttgaattggcgatacaagtacaactagcatttctttatacagttgccagcagtcaaggtgttcaacaagagctacatcagtagttgggtgattaactaggtcatataatgttcagtactttgccactctctcccattactgtaattggcaacagtaagtcagaaggcaaaaatttaaattttaaaacttgattttgaatttgattttgatgcttttcaacatagtttttttttcagctttaacttttcaatcactaagaacatatatacaaaaattttactcacatatcattttttaatcgctaataagccgttatggcttataataagacatggccaaccgatggagacctgagtttaatgtgaaaattttgaagatgatagaacacgactgtttatgattgactttttagaggatatgtctgcaaggatgattggaacaagcctttggttgcggatgtgtcatggccaattttgtcaattatgccgccactttggcactttgctacttctttttggatttatttacattgaaaaagctctaatgggaccttacataaagtatagggtatggtaaatatgcaacgaacttgcacccccaacgaacttgcagggtacttaggttcattctgatttctgaattatgaaattcgtaataatcaaataccgagagttggatgcactattttactttcatcacttcattattttttacttgtttatttatttattgtgtctaggcatgacaaatgaagtgtaatgccgacgtgccaaaacaatgcaacgccatgaatttaaagaaaggtttgggagttttggtagcgtttgattattagaaaatcgataccacattgcagctgaaaaaatcaattgagaacacacaactacagatgatatgggttaattggatccatggcaatgcaaatatgccaattcaaaaaaatgcccgtgctatgcgcatatcggctacgtgctactggaatttaaagaaattgaaaccaattgacgaattcccagatgcatcctaatcctatatatatacttgggtatccatgaccaatgaatggaggtgtctt

SEQ ID NO: 17057 - DNA, 12789 bp, Oryza sativa
accaaaacatcagtatcggaaagtttgtaaaatttgtttgggtgtgtggtatttgcatgctgatagaactttaataaaaattgccccaaaatatatactttactttacaatatttttatcacaaaaatattgatagtacaaacttgaatatttttactaccactgtgtatatcttgggaacaattgttttaaactcttaagagaatgtcccctcgtctactcaaacgtgattcaaaaatcgttaaaaattgacaacattcataccatatatataaactactgcacaaaaatcaaatcaaaacttaactcacacattgagaaataaaaaaaaagataaatccagcatatgaatagtattggtgctattcatgtctgattttgtctttttcgtttcttaatgtgtactccctccgtccaaaaaaaaaaaagacaaactctgggttcccatatccaacgtttgaccgtccgtcttatttaaaaaaattatgaaaaaaaattaaaaagacaaatcatgcataaagtattaatcatgttttatcatctaacaacaatgaaaatattaattataaaaaatttcatataaaacggacagtcaaacgttggacacggaaaaccaagatgtctttttttgggacggagggagtagatagaatttgaaaatgatttttggtggagtgatagatattagagttaatttcactttgggccatactttattgccaaagtttcactttaaactaccatttgtccaatcttttcactttggactaggtaactttacctttgttacacaatgaaccaccccaaaccacatcttcagtttttcgatgatttcaagcaaattgttaacgacatgccaacaaattttcatacctaaatgcttgctatacctttgtcaaaagagacgctagacatcactaacgtaaagagttagagtggtccattacgcaagaaaggtaaagttacctagtccaaaatgaaaagattgtgtacagggtggtctaaagtgaaactttgacaataaaacatggcccaaagtgcaattcactctagatattagtaatatagtctacattgtcattttctttttatttttcataactattcacactgaatttgaacgaaaaagctacaaggggactcaagggattagaatcgtcatcctaccaaaacgacagcctaccaatgttggaagggaaacgagcggatgaacatcccgatgaatcctaacccacgcactctagtttcagtcaagatggctttaagcctgtcctaaaaaaaagtctcagtcaagaaaaggaagtgaatgcttcatatctcctttggacactggagctcacggaaggaacaagtagtgaaaaataagcaataaacttgagcctagacctgcggcccatcaattaatcagaatattcttgacatcttatattcttaggccatccacaatgtagccaccagagaggatcaatttctagagtttagcttatatattatgagtagaccatatggtcgtccttagtatatgaactaccaatatacatgaggctagccaaaaaataaaataacaacaatttttatcttctctctcctcttctctcacatggctacttttgctatataattgagcaggacgaatgagacctagtctaatgtttcctattgctatatactcccttcttcctaaaatatagcaacctaggcctttccgaattcgttatactgggttatgtccaatgttatcttaagatgctatattttgagattggatggcaactaccataggtaatactggagaataccttataactcaagtaatcattatacattgagcacgtatgagttattcttcattcgatctgaacccaaaacataatgttctatattcatcgctttaactttgttatatttttttcttggtgcttacgtacaagtatgagaaactgaagtgtagtatggccgacacacctcattgcatctggatgtttggctcatcaaactttcccacagcgcaagcaaccacgattgagccgcacagatctcttggctcacaagcaggtaactgaacttgaaacggtcaagtgcctaaatgtatacagaccagacttgcatcagaaagtccctgtctccatagcatcagattgggctgttgtgcatgattgaaagagaggtagtcaaatttcctaaatgtgtcttattcctatgattgtagcagtttggaatgttttagataattcttaaatcggtttgtcttcagcaacattgaatggttgaaaaatataatataatcatgtagggttccttttaaatgcacaagaatcagttcaattcccatcggaaatggtaagaattcctttattccaaatgtatgaatagagcaatgtgggcaatgtgagaaaggagtgataccgtgaccaaggtatgaatggactagatcaatggcaagatgctttgtacttcttggtagaaattcattttttttccttctctttcacactctacttcggagtatcaggatatttaatgaaaactatctaaagaggtgaagtactgggtgatcatagcttaagctatgagctttgggattggtatttgctgctgaactgcttatagtaggtttaccttattctgcttggccaccattaaccaataaatgctgaaggaattttagcaattccaaattccaatgcaggcgattttgcacataccagctgtaaggaaatgaaatcaataaagctttcatttagttgttataaactaacagtattgaaacaattcagcaaaacatctgaagttccataagtaatactctcctatcagcaacatttggggcctttttcacaagtaatttatttttttgtttggtgtgtttaaggcttatcgtaccacttaaatccttaaatccatgatgtgctacacccaatgttcaccccacctgtgcatcaggtccatggcttgtatttacagcgttcttgcagtactctcatgaacaggcaacactgatgcaacccaatcaagttacctactccactgtcctaccaaggcacacaacagaggtaccatgccactatacacagagaggatcctgagcctggtcatgcatgcgactctcagtcccttgacttgtttagtcccctccctccctttggtcaggactatccacccttgccttggtaagttcataatgtgttttccagtctaaaataattactattacttactgacccgagttagtagttgactggtacacatgattgcccaaaacaaatatggttgcttacatacaaaaatcagtatgtggctgttataccatattttgatatttacatggattacctagaagaaacggtagacttccttccttcctgggtgtacattatctcatgtctatggtaagtgaaaacctgcacaaggtaattctagtaagcatattatgtttgtgtatataatcaaaggataaaaaaacagtaaaatagatacatctcggaatgacctgagaatagtcacattaggaagctctgacagtattccattgtgaaattatcccaaacagctgaattaatcaaatgccagataaaaatcttgccattttaaaatcgatgatggatcattgcaaattgtgtcatcaccattgcaatcttgttccactaatgaaacaagaagttccatcattctttgcatctctcttgactgatggagcatcatatcattggatacaaatgtctgaacaattccacctatctctatccagctacagcccggcaccttgttgccacacatgttcctcattacacttcttacctttgcaagctcattccaatctcctgcagcagcatacgtattagatataagcaggtaattgattggatcatctggctttagactaaatagcctagaggcagcccactttgctgactcaatgtttcctcgcattctgcaagcaccaaggaaagctccaatgacatcaacatttgcgtcgcaggacatattgaccaaaaattcgtaggcatctctaatcctaccagctctccctaagagatcaactagacaagcaagatgctgcggagttggatcaattttgtagtccctcgtcattagaagaaagtacttgaagccatcttcaatgagcccagcatgactgcacgcagaaagaactccaagaaatgcaatgccatcagcccgtatgccttgttggagcattctgtcaaacaggtcgattgcactcttggcaagtccaagatatgcaaaagaagaaaccattgatgaccatgtaactagatctgggttatggatcataccaaatgttcgttttgcttcttgaacaaaaccattcttaccataagccatgataagggcattgcccacttgtagaaagtcttgcaagcctcttctaacagtgtaagcatgaagctgagtagcctcattagcagccgccatgtcggcacaggaactaagtagactggcaagcgtaagctcgtcagggcaaaacccatgtctcatcatcgacacgaaaaggtcgaaggcttccttgcctctgtcatgcttaccatagcaaacaatgattgcattccaggatacggtatttctcagcaccatggcatcaaacacccggctagcctcagcaacttggccgcatttggcatacatatcaaggagcgcagtggctaccaccacatccaggtggagacccaacctgatcacaatcccatgcaccgagcttcccaggaccagcaacaggttggcatggtcatagcacgaagaagaagaagaagcacgcacactgagcaaggcactgaacgtgaagccatcgccgggaaaaccagaccgcctcatggagccaaagacatcccagcactccctcacaaggccgtgcgaagagtagcaggagaccatgacgttccagagcacctggtcccggagcggcgtttcgtcgaacaccctgcgggcgcggtcgacgagtccggacttggcgtaggcgtcggcgagcgcggtggccacgcgggcgtcggagccgctcccggacttgacggcgagcgggtggaccgccgcgcaggcggggcggccgcggacgccggcgctggccccggagcggaggaggcggagcagggcagcggcgcgccgcatttcgtcgaacgggtggggtggggtggcgctggcgcagcggcatcgccgcccgtcacaaccagcagtgagccgcacgcgcggagtgaaagggacacggtttgggattttggattggccaaaatcggattgtgacctgacgaataccgtctcaattcaaaatttcaattctaagtgaaaagcctccaatttggttacgaatcttcacccgtacactgcttagtactagcttagagcatccacaatgtaggttttagagagggtatcatagtagagagagctctctggtactaatcctacaaactatatgtgttctttgacagacaataccattaactttttaaataacgcttgaccatatcattttattttaaaatcaatataaatatacttaagtataagtcatatttgaagtttctttaacgacaaaagatgccacaacataataagtgacatttttattagttttttaatacgatgaaacggtatgtcgaaaattaacggcatcatagattaaaaaataaaggattatatgttttgcataagtataatataattttcccttctgtgtacataacattactcacatgtggacatgtcttggatgctatgttttcttctttagaattagacttgtacttttcaaaatttgaaaatatacccttcaatgatttttatttaaaatagactgtttgcccaagaggtgaggtgacaagcacaaatatcactagaaatagtggcttaattaaatgcttaatagtatagttaaagtttttaaagtattatatggaaatgaatccagcatcaaaattaaacatgtatgagtcctaacgaagtaatgatttatcatgtttcgtgccctatacattatacaacacttgaatccaacaacgtatccgaaaatgcttcccatcgggtgcccaatccatgcctaaaagatcgggcgccctctcgtcttgttgcttatttctttacatggtactcttattcttattttatgccgtgtagtaatccttcatatgcatgcatgtaactattatttcttctaaactatttttccaatctacgatataattgcaccattaaattcgttgcgagtaaatatttcacaacaagatcacacgtagttatattccgttgaaaaaatatttattttttaaacggatttttaagttgcacatgatattctgaaatgttttagtaagtatttcataatgttttaatagtgacaacttaatgaaatcatagatatataaaaatgcatcaaaacattaagtatttgtgttaaatgcttcgaaaacaaatagtatttgattggttacaaatttataataactttgatctttttttcctttactgtaaataactctttttgttataaaattatattgttggccaaatgcatggcaatctttcccataaaaaaacatatatttcatatgattatttttgtgtttcacttgttcggacttaatgtttcatataagtgtttgttgatgttgcagttagccgttttaaatgttgtatttctttaaaatattttatacagtaaactgaaacaatgttctataaagagtgaaacaatggttgatttttttatcaaaatatacttgcgtgagatctgattgtagggatttagttatagggaatataacgatttagatcgtataattgttttaatagaaaaatcgtttaaaagtttgtttttacaagtgagatgagtgaaaggggatatagctactccctccgttttttttaatagatgacgccattaactttttctcacatgtttgactattcgtcttattcaaaaaatttatgtaattataatttattttgttatcagttgttttatcactcatagtactttaagtgtgatttatatcttatttatttgcataaaatttttgaataagacgaatggtcaaacatgtgagaaaaagtcaacggtgtcatctattaaaaaatagaggtagtacgttagttcacatgcatggaggttgtgcatgtaagtatgtcaggcagcacacagtagtaggggcgcccgatttgtagtgaggtcgccacatatcgcttgaaaattacagccaccggagaaaccctttatctctcctggtttgtaacccctaggtagcgaaccgggagggaaaatctgggactaaagatggccggcctcttttttaaaccgggactattgtggaaatagcctgacccagcaaaaataacttctcccgtagtgatcggttatacataggatgtcgcttctttgaataattcatagtgtatttggagatcgatctatcccatccatcatccatggtggctggttctcagggcattatttttatttgtggtaaacgcaaataatgtttaagacctcttcctaatcttaaggtctcttttatttacaggatagaaaaaaactaggaataaaaaaacataaaaattgaagtagacgattctcaaatcctaaaggaattaaaaaatatggaaaaataataggagccctttgatagtaccatgaaaaaacaaagaaaagtttaaaaaagaagttacattaattttcatgtgagctccccttctaaagtactaaagtaaagacagctatgtgtgatgaagtaagccctacgatgctcggttaagctttacaaaggttacccatagcacattaatgctaagttggaccggctaatagtatgctcgcatgatgttattatacttgccttagagatacccctcatgtgttgatgataatattatttgcaatcttctacatgtttttttcaaggagttttcccgttctttataggctagttcgatataagagcaagtttaatagtatagcccattacaagctccaattcacctataaccgatctaataaccaatttctatactaatataaaaagaaggagttgccccctccaatcctacaggtgaaatcaaccagttaaatcctaccgtccatctatcaattcaacgaatccaacggctcagcctctcctccccgttcccatcaacacctgcctgccagaaagccaaacccccacggtgaccacaggtcacccaaaaattacgccacctatcccctgccaacgcgccgcgccgtcgttgccccgtcatacctcccactacacctcaagcggccccttcaccgtgccgggcaccccctattcgcgcatgctttctactccgatggctcagcggagctcgagcgtcgttcgtcgcccactgcctaccccccaccccatggtgccaccctggtagatcgccattactcacggtgtcgcccaagaagttcgtcgggctccctgctccttccccatcacatgggcctcctcgccggtgatctcctcccttctcaccgtcaagtaacgtcgtcgatcccccgctgctgccacaccttgtcacattccagtgcatgccctcgcccatatggctagatcaacttgtttggatcgcatcgctcaagctggggttagttctatggatatttgctactcctgttgatacttgataggtatattcatctgaatcatctggtactatcaattgcaggttctggaccaggttggaatatattgaaagtgtgattggctcaacacgatagattgcattatcgatatgacagagtacatataggcccaagccttccatatctaccgcaaccgatttatagaaacaatatcggaggggataaggaagggagggaaacaaatatacacaatcgcaatctaacacccccccgcagtcggaacgtcgacggagcagacattcagactggaccggaactccgagaagatcgtgctgggaagacctttggtgaagatgtcgccgaactaggatgtcgtgggaacatgtaacacacgaaccgaacccacggcgacacagtcacgaacaaagtgtagatcaatctccacatgtttagtgcgctgatgctgcaccgggttagtagagagataaacaacactcacattgtcgcagtagaccagtgtagaatgactcggaggggtatggagctcatgaagaagctgttgaagccaggtagtctcagccacagcgttggccaccgcccggtattccgcctcagcactggagcaggacacggtgtgctggcgcttcgaggaccatgagacaaggttgtcaccaaggaaaacagcgtaacccgaggtggattttctggtgtcgggacaacctgcccagtcagcgtcagagtaggcggtgagatcgaccggagtggaacgccgaatgtggagaccgaggtcaggagtgccgcggagatagcgcaagatgcgctttagagcggcaagatgcggctcccgcgggtcatgcatgtgaaggcacacctgctgtatggcataagaaatgttaggccaggtgaaggtcagatactgcagagtgccggcaagactacggtagtcggtaggggcagcaacaggagcaccatcaacagctgacaacttggcattggtatccacaggggtagcacacggcttgcagtcagacatgccggcacggtccaagatctcaaggcagtactgccgctgactgaggtagagaccagaagactggcgtgtgaaagaaatgcccaagaagtgatgaaggctgccaaggtccttcatggagaactccaactgtagcgaccggatcgtccactgatggagagcatcagaggaagctatgagcacaatgtcatccacatagagtagcaggtagaccatatcagcaccgtggcggtagatgaacagagaagtatctgacttagcctcaacaaaaccaagtgataggaggaaactggcaaaccggctgtaccacgctcggggggcctgcttgaggccgtagaggaatttgttgaggcggcaaaccatgccaggtctggtggagtcaacaaagccagccggttgtgtgcagtaaactgtctctgaagagtgccatggaggaaggcgttcttgacatctagctggtgaaccggccaatcacgcgagactgccaggctaaggaccgtgcggacagtggcgggcttgacgactggactgaaggtctcgtcgtagtcaatgccgggaccgttggttaaaccgggaaagaccccaagggcctgtcttgtccaggctaccatctgcctgaaacttgtgacgaaagatccacttgccggtgacgacgttggcgccatgtggacggggcaccagatcccaggtgtggttggcctgaagtgcggagaattcctcttccatggcggacctccagttggggtcggcaagtgcggcacgatacgtgcgcggcacaggagagagggtagccacactgagattgaggcggtggacgggctgacgaagaccggtcttgccgcgggtcatcatagagtgctcgttgacgacgggtgagagaccgagctgtgtcggtatgcggacgccaggcacacgcgcactctgggggcgtgtgggggcgccggtcggcgggggccgaagaggtgctggtggcctggttggtgcgccgaccaaccgagcgaggggcggctgagctggtgatggtgcagtcggcggaggcccggtcggcgcgccagccgaccaggaggggctgggcaacctagccaaaggtgaaggaggcccagctgggggactgggcgaggcaagcccagtcggagaggctgacctgctggggccggtgcgcgtcggagaggccggcctgttggggtcggtgtgcggggccgtcgtggagaagcgggccgccggaccgatgtggtcagggcaggggcgtcgtccaatcggcgtcggaagtgaagctgagaaatcctaaaggaactccagatcagtagccacttcattgttagtcatctcagcaaaaggaaaaactgactcatcaaacaccacatgccgtgaggtgatcaccctgttggtggcaagatctaaacaccggtaccctttatggtggggggatagcctaggaacacacacggggtggatcgtggggctaatttgtggggagcggtggtggataggttagggtaacacttgcaaccaaacactcgtaagtgggactaggaggggtgtgcaccatggagggcaaagaaaggggtgtgatgctgaatggtttttgtgggatgacggtttatgaggtgggtggcgatgtgaagggcctcaacccaataggaagcgggaaggcatgcttgaaaaagcaaggagcgagtgatgttattgagagaacgaagcatacgctcggccttaccgttctgtgggaaggtatgtgggcaggacatccagagggagacgccgttggtgagaaataaagagcgagcggaggagttgtcaaactctctatcattgtcacactgaatgctgcgaatagtcgtggaaaattgggtcttcacaaaagcaaagaagtgagatagtgtagaaaatgtatcggatttaaaacggagtgggaaggtccacacataatgctagcaatcatcaagaatgacgagatagtatttaaatccagacacactaggtattggtgatgtccacagatcacaatgtactaaatcaaaatttgccttggcccgactagagctagtggggaagggaagacgcacatgatgacctaactgacatgcatgacaaagcgaggtggtgacttttggtggtggaatgacagacgcctgcgccaagcgagtaagagcctcatgaccaagatgtccaaggcgacgatgccataggtcggtgttggtggaggtagcgacaaaggcacgtgcagaggacgccgaggagtacgcatacgccgggagaggatagaggtcaccggaactattgcacctgacgatctcgttcttggttgggtaatccttcacagagaggccaaaagggtcaagttcaacagaacccagttatcacaagaaaaacggcgagcggaaataaggcttttaataatctcaggcgaaaccagaacattgttaagcacaaaggaataactgggataatgtaaaaaggcacgaccaacggatgtaatgggaagaagggagccattgccaacaataatgtgagagtgagtattgtgggtggggcgttgggggatggagagggtaccagtgtcagacgtcatatgagaagtagcacctgagtccatgtaccattcagtagaaggcggagtagtcagcgtggtcgtgttgtaggcgcctgcaaggacctgtgggtcccactgagaggggccgtttcactggaacggcgtggtggcgattggcgccatgggagtcggcggcaccgtggagggggccgcgaactgggccggcccaggcgcagcaacgaaggacggcgggtaggcgtgggccggcgcgttggtgagggcagcgcctgcgaagccgggccgtggcccgagaagacctgggccagcctagcctggccacatgtgaatgctcccagtccagggattaaaggccgtgggccatccctggttgacccatgtagcagaagcctgtgaagcggtggaaccctggtttccttggccgccgccgccgtggggggtgccaccgccgttgccgccgccgccgccgccggtgccgctgctactaccgttaccgcgaccgtggcgacgattgttgttgcgggagttgccgttggaggagttggtggatgacgagcagatgttggtggaggacgacgcgagaagagccgtggcagcgcccgtaggctgatgtcc

SEQ ID NO: 17058 - DNA, 4730 bp, Oryza sativa
aaagctgttgaagtttagactgctcgagccaatgacaggtatgttggtccctaatccatttcttttctatatgaattatatagtaatctacagatgcatgtgcaaaccagctgggtttgtacacgtactgaccacaggtgcagatgaattgtaaaattaagatattaagcaatatataaacaactaaatatgtatctgtatatataaggtttgagtatctaaaatgtttactgcactgaacttaacagaaaatttcagaaatctgactacaaacatatggaatttgcttcttccatccttcatgtgattggtggtctgccgattgcttctgatgaccgagttgctctgttggctttcgtaattaccgtcgtggccgcgcccttctgtttgttggtctcactcaccatggtggtaagcacaggcacttgatttttcttttatttttcttcatgcactaattattaactgaaactttgttgtgctatgagccaagtagtcaacgatatttcctttcttgcttaatttgattcttactttctttgccgagttcttaaattattggcaaataaatgcttggattatgatatgctgttgttggcaaatggcaatggatgcaaatgaatcagcaaggggagtttttcctatcctaggtcctaaaacttattgagcatagtgctcataaaaaataaaggagtgattaggctgcagtctgcacctccttaaggtgattgtattagattatgacctggttttttcagttctacaaaatttattatgtaaccatcagttgcaatgcaatgttacgtggattggaaatatttaccctgaaacgctgcacacatatcttgattcttaatcatgctctaatgatcagctggttgctaattgaaggtttgttgtgttcaacaagtctatgaaactcaattttttacgtgaagaatttatatggagtgctgcattaaaaaagggccacatttattattctactttttgagggttttctttagaggatgatactctcttactattctctttgtttctttttatccccaaatctgagagagagagagatagagagagtggacccagcacccttcttttgtggctttatctgattactgctcagtctttatccagtgtgttgtatgaaaatttttgcagttctgaattaatacttgtgtgttttaattacgatatgttcgcataccgaccacgcagtgtggtgtggtaagcttaaagctgacggccgagaggttgtccaagaatatatatatatatgtatatatatatatatatgtatatatgtatatatatatgtatgtatgtatgtatgtatgtatgtatgtatgtatgtatgtatgtatgtttttggttctcccaacaataatcgctagccatagttgatacaaatatgcattgctcagatgaaatgacaaacctagctagctatatctggtttcaggcttcttcctctgaactggaccgttggaatgccaggaatcttagtggcgacagtgatcaaagccaacttgaccctgtttggattgaggatctcaagctctctattcctcagcagtacggtcctcgcatgttggtaatcaactcacaggatctaaaatcattgaaagtttataatgtgtttctgatgagttcgtccaaacctcactttcttttcatccagcaagtgttcaatgggtggcaattttctcagctagcaacaacagcagttgatgactgccaatgctcactttatgttggtgactcaattcttaagttatttcaaaataattttaacagcgcaacatgttctttattgatcctgtaccaacctcatgaaatcgatcggtctgaacatatggatgatttagcccacacaacaaatcaatgcgatttggaatttaattatttggttagtattcactattcaggtgtatgcattaagtctcatgttatatgtaggtttaataatatccattgcttcttgatacagtacttgtcatattccaaaaaggtgaaaagattggtgttaaagttagaatattgctgcagctagatgatattgccttcagttttatgaaattactgctatccccatgaattgttcagagttcgatcattaattgtttgatttcaaaaggtagcagcatcacagtataaattgtgtttgtcccactaaatacttttacattcgttggtaagcaagtagtgattcaaaatagtggtttttatagagaaccatccaaattgtcatgttagtatagtctatgtgaaattgtcttaattgctagaagaatttatatggagtgcattgcatagaaatgattgcatagattcttcttcgtttgctaatatatactgtcaaaacgtgccttgcatgtgcacgattactagtatacaatagtagctactattaatatatggtcccaccttgtcggagatatgggcccgggggtatgccaagtgagggaaagttaccttcccatccagccatgtggctctccagcctggcccttcccccgcgcctcgcgagtctcagaagcagccagggggcctcggggtgccacgtcacgcccctcgggccctcgcgctgccttgccctgaggccctcgcccaactgccatgtggcggggggagcgagcggggaggagacccaggctgaaccgccatcaatgcgcgcggcgccccaactgtccctcaccgcatttaatacgctaagggcagacgtgcggtgccgtccgactgacccacgtcaatcgggtgtgaccagactgtgaccggcctatcgccggtcacgtccgattcgacaggcggccgcgcccccacgtccgtctctgtctccggcggagtggaggcaggtatgtcccgtcccatcagagtattattcggagttccctccacgtgaggaggaccgccacaagtcttcactcatttatgagggaatgacagggttgtcccccgtgtcaagcggggggtggcgctgggtcccgctcaaggacagactgctgcttagcttccgggcgaaggcacggatcgtggcccggtcgaggtaaagtgggtccccctcccgtgaaagagtaggtagaaccggcgcatgtggtatccccttgaactataaaaggaggaccttgcccaccgagaaaagggacgacactcagtaggcctgagctctagaaggagaagaccaagagcgctcttcggagttgaggaacctttgtaacactcaaccataaatcccacacacaggagtagggtgttacgctccatagcggcccgaacctgtataatcttgtcgccggcacgcgatctagaaaccctgagggcggatatacgatctcgagaggcgaaccctttccctcggccgaactcacaaaaggggatctcacgatctcccgctagagaggatcactcctcgacacacccgtcatacacacattttgtcttggagtccgtgctgcagctggctacagatctgtagcccgcttctcttcttatcttttatctcattaaaatatgtttatagctggctaatagtcgtagccgctctaatgttgtctggtattttataaaaagaaactcgtcaatctagtggacgagtcaatctagcaatgaaaccaaataggaccatgggttcggatatagtctgaaaccatctgatctgcaaacatctagtccactataatagttcagttaataatttattccaaactactcgtaaataacacgtagatactctccattggttttgctttctatgaccaagaatgttaataggcatagggcagctaaggttgaagccctatgttaaccccataactctcattatatatttaaaaaaaatgttatgtaattatgaaaaaaattaaacccttattaatttagctcattgttctgtggctaggggtggaaaaaaagctcgagcttggctcgagcctggttggcttggctcggctcgtaagccaaacgagccaagtccaagcctccttttcagctcgttgcttaaatgagccgagccgagctggctcacgagctaggccatcatatgtttatatccattattttactttttatggagttattatttgtcaacttaaaatttatcattaagattttgaagaattgaatatataaacttaaattttatatgttgatgatttgttcttatttttttttaataattacaaaatatatttgaagaggtgtttcaataggaaggcatgcaagtcggctcgagtttagttcgagccaggaaacgagtcgagccgagcttaagttttagcttgttttcttaactgagctaagataagccaaatctaatttattacgacccactgcgagccggctcggctcgtttccacccctaatactcatgtggcttcgccgctgcctgagaggcggagacacggatgacacgatctcacgaggcaaaccaaacaccatttcaaaatcttttgcgccaattttgtttttttcaaaactgtccagtccaccggcctctgccttcccttgcccgcgtgcccagcggcaagggtatcccttacacttgtctctcccaccactcgacacagcacgaggcgctgcattgcctacacttgtcacccgctcacgctcgcacgattctccaccacctccacgcgccgccctcccatccaatatccatcgccctcctcactcccctcctcctcctctctcggttgcgatggcgatggtgacggcgcggcagttcttggcgt

SEQ ID NO: 17059 - DNA, 3292 bp, Oryza sativa
tgcaccgtcgccgccgatgaccccgacgtggtcgacgtaatggcgagcaaggtcgccaaggtgctcgggccggactcggcgctcgccatggcgagcagcgtcggcgcggcgccggcgggggcggtggccgccattcggatccccatcctcagggtgtccatctacgacggaggagggacgccggaggtgaccgaggcgagctacgccatcctggtgctgcttcttcccccccacgacgccgccggcgggtggagcagccacgacctggagatcgtccaggtcgtcgccgaccaggccgccgtagcgctctcccacgccacggtgctgaaggagtcgcggtcgatgcgggacaggttcgctgagcagcacagagcgctgatgcaggccaagcaccgggccgccatggcgaccagggcgttcagctccatccagagcgccatgtgccacgccatgcgaaggcccgtgcactccgtagtcgggctggtctcaatgctgcaacatccggaggcagacacaatgcggccggagcagaggctcgccgtcgacgccattgcccgaacaagcaacctcttgtcggcgctcatggacgaggtgaccgtgaaccggcagcatttgtccgtgcagaggaaacccttcagcctgcacgcgctgatcaaggaggccatcagcgtcgccggctgcctgtctcattgcgggggagctgggttcctgcaccagccggaatgcgcgctgcccgaatgggtcgtcggcgacgagaggagggtcttccacctgctgcttgacatggtgggcaccctgctgaaccgatgcaacaccgggtccggggcgtgccgcctctcgttctcggtcaggatctgcaatgtgggtgaagagaggtatagccttgactggatcccgatgcgaccgaccttctccggttgcaacgtttgcgtcaagttcaaggtcgggatcgggagatctaggagttgtgctattgaaaggagtttgccgtgcgaattgcctcgtcgttctgcggccactaccagctctcagatggggcatatcttcagcggctacttcaacaagattgtgcaggtatatgggatcactcacaatacactctcatacaagtactggaagcagatctccaaatctattttgctgccttactgtactcaattatgctctgttttaaatacttcatccgtttcatattataagtcgtttgacttttttcataatcaattttcttcaagtttaactaagtttataaaaaaatatagtagcatcttcaacccaaaataagcatattatcaatatatattcaatgttatatttaatgaaactaatttaatattttagatattgctaaattttagtataaacttaatcaaactttgtagaaaaagatcaagcaacttataatatgaaacggatgaagtaatagaaatggttgacatctctctggcctctgttgataagcacatagcaagtacctacatatcccattgtttaacacagccattgtttaacacacactgactcaccgacagaaagcgttctggaaatgctagaattatcatcacttatcagtagtttgttgataaaacttctcagtttaattataggttctttaacacctgtaagagttgtgtaatccgaggaaacaaatgaatttactttatgtattacttgatcagatgatgaatggtaacatgtggtcggcgtcggactccgagggcgtcggagagagcgtcaccctgatcctgcagttcaagctgcagcagggacatgtcgaagcatccccgccgtacatccctcacttgaacggcctgagggtgctcctcgccgacgacgacgccatgaaccggggggtgaccaagaagatcctggagaggcttgggtgccaggtcatgtcggcgccgtcgggcgcccactgcctgagcctcctggcgagcgccgaggcctccttccagctcgtcgtcctcgacctcgacgatcgcgccgtgccctcggcggccatggaccggtttgaggtggccctcaggatcagggagctcaggaacagctgcggggtgctgatcgtcattgccgtcgcggctggcgtcgtcgccaccgatgatggcggcgccgtgcaggagctgtgccagcgtgccgggatcaacgggctggtccagaaacgggtcacgctgccggcactgggagctcagctctgccgagtgctccaggacaactgatgatgctgcctgcaatggagtgtgtaccgaaaagagcaaggactgaaattggtagatgcatcatgcaatctactaccaggtagtagaagaaaactggaatgtacagtaccgtattgctgtctctttatcatggtgttgcatctgccggccttttgcttcgttcatttaccgaatttgctggatgattatcgaatttgtctgaacaacatcatgtaattccggccaagctggtgtctgaagccgtgctagcagtcttttagttagcacggctctagacaccagttcatctcgtgtactcgataatcatctcgtgtactcatattatcttatttgataatgcgttctatagtggttaatatgaaattgtaattctatatgatacttggatgcttatataccaaacataagataatatgcttatataccaaacataagataatatgtttcaatgtacatggaattttatagcaaactagtgggttgtaaatgcatatgataaaggctatgaggaggacttagcgaatccagattaggaggtgtcgtccatggcggtggcgtgcggatccagaagaggggagaggccgtccacagcggcggaggtggatgaggtcatgaaggggaacccttcatgcagcaacatgatcgaaccacgtcttcaactgctacgagtttcatgaatttgtgctataaattttaatattttgttctattaatttgtgttgtgaatttttattcgctttttattcggttatgcatttgaggacctatagaaattagtttcagcactactgtgaatttttgtgtagatagtcccataacgctaacatagccgctaggcggccgtccgccatctgcaaaaggtgttttttcacatgccttaaatcacaggcagtgtggcaagtcattttccggccacatgctaaaactgttttttttcccaaaaacagtaccaagactaaggccatgcaaatatacatattggtgactagttataattaaatttaggtcatcggttattccctgtgtcgagtccgatcaccaaatttagtacaagctaaaaatcggggtaccgagct

SEQ ID NO: 17060 - DNA, 2436 bp, Oryza sativa
  unsure (1)..(2436): unsure at all n locations
gtgtttctcttccgattttgctaggttgtcccagtgccatccgttaacctctcacttttttttttctcacaatgccgaaacaaagaattctatataactccactagagtgtagcagaaaaaatggaacaaacgctcctaggaaaccgcggaacaaaagctttacgaagataaagcaccaaaagacggcaattgcaaagtatatatatatattcttttacgtaattgcaaagtatatactggtcggcagcagcattgtgcctttggttctccatatgatttatttatagatttgatctttttttcgtataattcctccaaatccagaggaaatcactagtgccgattttgatgatttgcttgttgatattaattatttggaggctcctatttcgccccgacatgatagttcatttgggtctgctacaacttccaccgtgcgtgcttatagtttgaatgcaccagaccagtcattggtggttcgacgagttctttctactcaattagttgcagctgagcaagggcaacgccataatttgtttcaatcacgatgcaaagtgaaacggcaggtgtgcaaatttataattgatggtgagagctgcaacaatattatattgttagtgccttgcttgttgagaagcttggcctgcaaacacgtcgccatccacacccgtaccatatgcaatggttgaataattcagggactgtgaaggtttcatctatggtccgcttgtcattctcaattggtgactatcatgataaggttgattgtgatattgttcctatgcaagcttgccacttacttttgggtagcccatggcaatttgatgtggattctgtgcacttcggccagtcgaacaaacacacatttattcacaaagagaataaggtggttcttgttccattatctcctgaagacataagctcttctgatgttgctcgcatgaaaagagatgagagtgagaaaagaaaattatgagagagccacacaaatagtaagggagagactcctaaaccatccagccacataaagcctcctgaaaatacaaaactgccacgacaacattttttatttgtgagaaagagtgatttgagagaagtgaggaacaccatagcctcgttctttgtgctcttgcacaaggaggtcctattttcagctaacaatttaccattgtcgctgcctagtgttgttcttgatttattacaggattttgaggatgtttttcccaatgaggttccagctagacttcctcccatacgcggaattgaacaccaaatttatttggtacgtggtgcttctcttcccaatcgtccaacctaccgcaccaatcctgaagaaacaaaagaaattcagcgacagataaaagagcttttggactaagggtatgttcgtgaatctctctcaacttgtgatgttcctgtacttttggtccctaagaaagatgggtcttggcgcatgtgcgttgattatcgtgctatcaatgctataactgttagatatcgccattcaattcctaggcttgatgacatgttagatgaattgagtggttcaactatagttggccataaggcccgaggcccgaaggcccggcccacggcacgcctttttggcccggcccaagcacggcacggcccgacttgggtcgggcccatgccggcccggcccgactgtcgggccgtgcctgggcctccccaccagcacgctgggctggcccggcacggtcgggccggcccggcacgatgggctggcaggccagacccggtacacaaagtatatggaataaaaatagacatataaatgtcaatgtctaaagaatagggaccttaaatagacttattttagctatttatataccacagcacaaagaagagggaggtaaaatagactttttttagctatacaatgtcacagtccaataggagggagaaaatttatacttattctgaggaaaagcacgatggcccatcgtgcctatcgacccgcctgggctgtgagtgcggcacgtgggctggcactgcacggcccggtgcgtcggtcggccgtccggcgcccacatgccatctataggtttttttccccaaaaaaccccccccccaattttttttttttttttttcccccaaacccccccaaaaaaggggaattttggtgggaaaatttttnttaacccaataaaggccgggggtttattcccacccaaannttttcggcaattgaaaatgtggttgatgaatgaaagacagcatttaagactaaatttgatttatatgaatggcttgtgatgccctttggtttgacgaatgctccttccacttttatgcgtttaatgaatcatgttttacgagctttcattggaaaatttgtggttgtatattttgatgatatcctgatctatagtaaatcaattgatgaacatcttgatcatatctgtgaagtcc

SEQ ID NO: 17061 - DNA, 1499 bp, Oryza sativa
  unsure (1)..(1499): unsure at all n locations
tcgtgcgccgccagcgtggcttcccggatggtgacggcggcctcgcggtccgccagatccctctccacgacgcaggcgcgctcttccagcgccatggcgcgcgcctcaagggcctcttcgcgccgccgggacgccgcttcggtctccaccgcccgctgttctcgggcagcgacagcgtcaagcaccccctggccggcgtcgagcttcttccctagctccgcctcccagctccggtattgaaggcggagggtgtcctgcgcctcgttcatcacggtggtggcaatgaggacagcccccggctcctcctccacttccttggcgatctccgccagcaccttcttacgagtttcaagctccgagacgtgccgccggtgagccttacggcccacctccaccatggcctccaccgagcgtcgccctcttggacacgcgcccacgcggcgtcgagctccgcccgctctgcctgcaggacctccacctgggcacttaacccatccaacaccgtggtgtttgcggcggccaaggcctgcagaaggggctctgcgttcagtagggcgatagaaggcgtgggaaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgtctcgtcctggcgaaatccggcctcctcccgagcggcttccccggcctggcgggcccgggcggcctcctcccaagcggcttccccggcctggcgggcccgggcggcctcctcccgagcggtttcctcggcctggtgagcccgggcggcctcctcggcttcccgtaggagatccgcggcctctcgccggtcagattcccgcctgagggcctctgcggccgccggatcctcggcctcagactggccggacttggaatggcgggagggacgcgacgggatctcgctgaaacgaaagaaaaaaccagaagacgaacaagatgggtgagtgaaaactcgcgttgagagaatgaatacagccacgatgggagagagacgaacctgcgagggggtcggttaaacgaccactttggaggggaaatgaggtttccccgagatggttctgtctcccccatcttacggggccgcttcttcttgcgctccccctcgggctgcgatgttggcgcagccccctccgggcgcctgttactggcacgcgccgccgcgccccctcggggaggagatgggggaggtgttcctccctgcttcctcttcccccgggcgtcggcagggcggatgctccccgggcccctgtcgcggnnnnnnnnnnnnnnnnnnnnnnnnnnnnnnnnnnnnnnnnnnnnnnnnnnnnnnn

SEQ ID NO: 17062 - DNA, 1139 bp, Oryza sativa
cggcgcaatcagacgacggaggtagtcgccgtacaccatggcccctgtgagcccctgggatcgcaggcccgccaggcggtcgagtacggcgtcatagccatcccccagatctaccggcgcccgccagctggaggcctgcaccgggggctggctcgaaagtcgcaggcgcgcttcgtcggcgaggggagtgtagaaccagtcactcttccagtcgtcccacttcttgcggtgggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatccccgcgttgggggtgaggtgcgccatctggagatcgtagaactccagaacatccatgaagaaagaagaaaatggtggaaccagccttgccattgcaaaggggataaagaagacggaccgccccgggtagtctggcgccgggcgtccctcgcccagcgtgactatctcctggccggggcagattccggcatgaagcggggcgacagcctagccttgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgccaacgctgtgcccggctcctcgcttctcgcgcccactatttcgccccctcgtttctcgcgcccacgcttccactaatcccattcgcccgcttgcggcgcatgaggtgggtatgcggttgtggcagtcgagatagatcatatcgtgcgcgcattaattacgctcgccgaccgaagcgacgttaccatatctttagacgaaacgaatcgccatgtccagattcgtgtgctactcaagtaatgtggcagtcttgaagagaccgctcattgttgacagcagagttaccattgccgatgtgcgtggtttg

SEQ ID NO: 17063 - DNA, 6806 bp, Oryza sativa
tagggtattacgcttctcagcggcccgaacctgtatacatcgcccgtgtcttgtgtgtttcctgtctcgcgagccttccacatacagagagcttagaatctctccctgagtccccggccaaaccggcaaaggggggcctgcgcggtctcccggtgaggagccccacgctccgtcattaacgaagtacaaaaataaggaaaggattaccgataactccggaattcctccgacttctattttactctctccctaattctaagtatataccatataacatataaagatcctaaagtatacttagggcctattgtagttcagctctacatcttgttgtgtgttaaaatgaacgatgagaggagtatttataggtggaggtgccttgggaggatagagtttcttccaagcatccaatgagcatcttcatcctcctagtgccaagtgtccagcttatgactattttcaccggtgaaaacggccataaccgtcaacggggagcgatttgctaccaaacgcaacctgggtcgaggcagcggcctctgtcatggttcggccgaactccggctcagttggccccggttttcagcctggacatttattttggaccccttattctattggtatggatgtttggcccatttagaggtgtttaatttggttttgggtctaaaactccataagttcggatacgagtttgattctcctcttccttcatgtatatttcttctcaacttaggtagtttgtcacttgtatatgaatatacaccaatactcatgaaaattgttagaaataaacattaccactatgttgtatgttttatatttatagtcttatgtaggtattgacagcgttaatttggtacttaacggccatcaaaataatcacctatataaatttactaactaaaaggggcatctatataagatagccatagctcgcgagacaactcattcatcataacgttatatcaagtgatccaccaccacttagaacaaagctttattattttcctctcagtactcatgcatgctttctgtcgttccatcaattaatatagccatataattatcactcaagcataggattgcgaggcatcagtaatgcctgaaattgggcgctgttgagatagtgtcttctactgaaattgggcgcctgtgagatagtgtctgctaggaacattttcgtgcagattcatccaattacatctaaaatatgttatgtggcttcattgtaggccaaggatgcatgtagcaaactgagaatgaagccagaaccaagcttagagattttggctaagtggctaacagcaaggccatcttttatgctaggcatcctttggaagcaaactaagggctcattcgaaatgtagggttgaaaaaaatataaaacataggatttgaaaatacaagaatttcggacatctttgaaatgcaagattgagaaaacataggaataagaaaaacataagaatataatgttatgattattgaattcttatgggattataaaacacagaaaagtctctaaactatcgtttgattagcacatagaaaaaacgcaggaattttagacacatgaaaaggaaaacatggggtgaggcctcatacttattttcctccaaaattgctgtagcataggaatttcaaaggaattggtagaaaacaattatttgttttaaaggactctataggattatttctcataggataaaatcctctaaaattcatgtggtttttcctttgaaacaaagggggccttcataggaatggatgtctagatgaaccatgggaaaaacacgggaaacaacggtacgtgaaaagtttattagagagttaactatagtcttatccctaaaaaagcattaaataataaaaaggagaagcctgatgatgcttaagccttgcgtacgttagtgtggcatcagggcttcatttgcctcgatcctccgcaatgagaaagaaaacaaagaggtcagactggacatttttcccctgcagttttcctacaaaattagcaccataagaaagtttccaccatttttccaaagggataatcctccattccgaatggacaaacagtaccatttcctattggaattagaatcctctgtttttcttccatgaatccccgatccaaacaagccctaaacatcatgatgtataaaagctaagggcccctttaaatcatagaaataaaaaaacgaaggaataggaaaaacatatgattatgagagaaatacaagtataaaacagatgattgcaaaacacaggaaaaaatcataagaatgattgtttgattgagccgcatgaaaaacacaggaatttgaggagagataaagactcaaaggattcttaacatgaggcaaaacctcatgttaaatttcctccaaaacttacatgggaagagacattccgtaagaatttcatagctaggattccataggatttattcctttgattcaaagggctatataaaaaaaattcctataggaatgaaaccctttaaaatttctatgaatttcctttgaatcgaagggggccaagaatgttaacagcttattagtttcctgatgcatataatttgtcaaaaaatattggcggacgatagaaatcgcaatatctcaatgctatgcatgacataatgaaaacatatttcattatattggacatagcaactactagagcgatttaataatccagatcaaatgtggaaagctcctattatgttgttcatcagtagagcttctccttttccactgttacaaatggattttcttaagcttcccctcattacaattgcctgcttagtgctaagtagttacaacatataggatatgcaacttggtatttaaccaatagaaataacgtgagatgaacacaaacactttattataaaccttgtaaccatcatcattttatctgtctcatggatatatactggggaaaaactcatgcgcttatgtgtgaagcatgatttaatactattacatggatatccaaaatgaatgtaggactgttgaatagatgtagtacaaatgagcacatcaaaagttagaaattaaattgcagggaaaatgaaagcatgcacggaaatatagcatggtgcatgatgtactttgttttcaaccataaataaacagctgccatagctattgatatcatatcagcacatacatttttttgatcttttgcgattgagaacagaaactttgaatcaatgaacgcaaaattttgaaggaaaaattaagtaaatgtgacggaagctttttctttttttctttttacccaaacacagcatggagagcctcctactgtaattttccattataaagagaaagttatgtacaacaggcaaaaaataatttttgagggaaaaataattacaaggagaatgaagaatgtacaacattggttatgctaaaagtcctagctatgatgtctaagtggttttttttcttttttttttttttgctctgaacacatgcacacgcaaagcaaaatcctctttgaaatgggaaaaagctttgatgtggcaatgccatgccacaggatagcaacatacaatgtggcacctcttaccacataaatagtgttgtaatgaagctttgcggtggtaatgtcaaagaatattggcatggtcaaaaggttcaggttaaaaaaaaagtttgacattgttcgttgttaaaaaaaatgcttttttaaaaaaattaaataacaaaagattcagctctaattcacctatggggcgatacagtacatacactgcaacccgtgcaactatgcaatatatttattccctatgtttatctcttggctttgcaggacggaacacgttcttctgggtttaagccatgaactggtcttgccttttatttttaatccgcattgaatttatcttgttagagatgacacaccagagccatggcctagtccctgtggcctccaccctgactagccacttgtcaacagtaggttttaccaaacttgcaatacctcacattacatttaaggaatattggcattattaatacacaacaatttaattttttgtccatcaaacatcatttttttttaccagagagagtaaccaagtattcaaatcgcattagatgccttctcttctgcgaattcagaaacagctatctcatcttataagttcagatttcagaatgaactccaggataattgagccaccagcgaatcctcggcccctccaagcaacaatcgcccagcttcattccccctgctccagctttggggagcaggggagacagggcgggacactggaacagaaaatgaaattgcattagtccatgctgagcaaaagatgaacaaggaacgtcctcttggtgtcctagaacccctggcagggccatgaatgctcacatggaagaatcgcccatttttcgcttgcgattgcgtggcagaataactcacggtctctgaatgcacaaggtgaaaatggttccatgtgtttctggtatcccagtaggccagtatacttctgatcaatgctttgtgtggagatctctggtttctataaaccccaggatgatgatggctcttgtgagttgtgaccaccaatttgtccaatggttgtccttgctcccagctgcacatgaagagcatgagaaagtagtcaattagttgagaacccagtactgtagtactacgaataattgagctctgtgcgatacttccaagttccagcatgtattttaccagtatttatggttcaaggggcaataattatattattattactattgaatgaaaatatcgacaacaataggactgcttatttcagttgggaatatcaaaatcaactggaacactgagcattcactttactagcagataaggtgtaagttgcaaatactcctactagatagtaaagagaaggaccagttatgcgatcgatttcctcacaatagtttgtccactgatacaacatcgggtagtcttaaagtagtaaaagttttgtacgggaagcataatagatggcatcaaattgcatgtcagataaatgtgatgcagataaggcttccacagaggagaatctaatgtatgcaaaaaatgcaaataaataatattcttttggaccaaactagactccaagttatgctgtagtacctaggtttttgatatgcctaaacctatgatttccttgtgtttcagtaatgtgatgctatcgacctggagatctttaaaatcataaaaaaaaaagtactagatatgtgaaatcatccaactcaggagtcaggaagcacaaaattaccgctggcacgaatttgaaggactgattagttttaatcctcggacagcagcctgaaagcaaattaaaataacttatcatgagtcatgattggagtgacaaaggtaaaaaggaaagaagggctggagagtcagaatgacctggtgatcaaaacttcgatgatcttcctgaatgatggaaaacagaaaagttacaatataagccaatcagatcttctagtctctataaactaaagcaacaatatcttgagattagccttgaaaaaagaagtcctgaactgatgtttcaaaatttgttcacacccttccttacaaaagttcaaagaatgcaaaagcatgtcacagtcttacagaatgtgaattaaaatgtcaggaaagcctcatcggacaacatgaagattcaaaattagatcggttagacttctactagtacttcataaattaattggtcacttagtcatctcttagcattaggtgtcctttttgttaaagaataaccttgacactgtaaacattagggtaataaaaaggtaaagataggaaaaatgatgaaatggagcacacggcattaaacgaattttacaggaaaaagttcaattccctaaatcagggaaattcctgagaaatagagtccagagtgtccatcagctttctatgtcatattatcttcatctattttgtgattttccatatcaatatcatctctttgggtaatgctgcttaacctcagacataaataaacaacaaatattctctttgctaatgacaactttcagtagcatatataaaaaattcaatcaatttatcactccaatgttgtcttatattcacatggaaattattataagattttgcacttaacattcgtgtccctgctctttttttattctccacaacaaatatctcctaaatgtattacagaagagaatcactactgtaaatccaggtaatttgttgtcttaatttaattcaatcataaatagtgttcaagtcgacaatgagtactcaagcataaaatttgctgaataatccagccaaaactaaagataaatttccacagtgaaaatatgagaaatcagacaacacaaagtacccatatatcattaagaaaaaatgtatgttcctatagctctaatgacccaggagacagtcagaccagtatgtctgtactgaggaagaagcggaacacaccacaatcaaatgtgaagttcatcctggtatgagttgtcactgtaaaactacatcttgacatgagcacagcaacttctgcctgcaatgcaaattctcagtggaggttttgtttcttgaaaaagaaatttcttctttaaatggatggtagttcactattaattttacattcatgcttgtaacaaaataagagcagaaaaattttaccttgtaaacaagcttggtgaaaaaaaatttaccatatcataaattcataatagatggaagaggattgaacatatacgactattgatctagatgaaggtcacagactggcagctatgtaatcagcatggtccagaactata

SEQ ID NO: 17064 - DNA, 1007 bp, Oryza sativa
  unsure (1)..(1007): unsure at all n locations
actttttcagttacacttggaaaacggctgtaaaagagcactccagcgattaacttctcccataatcacagtgaagcaatgtcagcaaaaactagctgtatcttacacagttgttgccctatcaagcattgaatagccccagtacctagccacaaaaaggtcctgccacaaggactcaaggacataaggtcctagggtcccaactctcaacctttacacatgagctgcacaagacagacaagcaggcaaggatcttcnatagttaagcggtgtgcatttctttaagcaatcaaagggggtgtcctctatgattcatgcattcaatcaaatcatcaacngctgatctctctctgagtctctctctctctctctctntaagaaaaacaacttaccagtccatcctgttcaaatggtaatctagtatttattttgcacatgtaggacgagcaacactcaactaagcacttctgatgctgcagtgttctacattatcttacccaatgtgcttgctctgtatgtctcatgagggccattaaaccgtcaactgtttcatatatctctttcctcctcttatgccttgtatctttagccaaaaactcatgaacctcactgcctacctggattgagctacttccaggcactttctcaattccccaattacgcatgcttgtgcgtgcatcgatcacaccatcccaccttccttccaaagcactacaattagaaaccaggacttgataactagaattaaatggttctagttcagttatcttcttactgacatattctataagctctgcattaccatgtgcaacacaagaacaaagcaacgtgacccatatgacaacactaggttcaagaggcatgctttcaataaataaaatcgcctcctgtaagttacctgctcgaccaagtaaatccaccatgcacccatagtgctccattcttggttgaatgttatatcgctcaaccatttnnnnnnnnnnnnnnnnnnnnnnnnnnnnnnnnnn

SEQ ID NO: 17065 - DNA, 1516 bp, Oryza sativa
  unsure (1)..(1516): unsure at all n locations
nnnnnnnnnnnnnnnnnnnnnnnnnnnnnnnnnnnnnnnnnnnnnnnnnnnnnnnnnactcttgcgaagaaagtgcttgaatctcttgacaataaaagccatttcttcatcttgactttcttcaccacttgactcttcttcttgttttgccttcaaagcaacttcttgattcttgatcatggcggcattcttcaccatttgtctcacttcacgagcttcctcttcttgcatctcatgagacacaattcttccaacaatgtcacttggggtgagcctcttgaagtctttcctttcccgtatcattgatacaagagtgggatttcttggaccaaaagtacggagaagtcttttgacaacaaagtgatttgtcatgtcctcactcccaagtcctttaatcttgttgacaaggatcatcatcctatcatacatctcttgtggtgtctccttgtcatccatcacaaatcttcctagccttccttccaatagttcaatcttggcatcacaaatggcgggtgatccctcatgagccaattgcaaagtatcccatatctccttggcctcctctagtccatcaaccttgttgaactcctccggactcaaggcggagagaattgcattggaagcttgagcattgcggtggatgagttgttcttgctccgaagtgagctccatgtcctcatgaggtacgtcaatacctgtacacacaattttccaaatacttggatgcaaagagattagatgcaacttcatcttgtgcttccaagcggcgtaatatgtgccatcaaattgaggagcacgcccggaaggcacggagacgaagttgtgagagggaatggtaagtttgttgtaatcaaaaggtatagtggctccccttgggtgatggagttcccttgttgctcgctccatcttcatttccaatttccccgtcctttccccctaagtccgacatcgtggatcactcaaagcggtgaagcttgaatcaagagcaccttgatctgataccaattgaacgcacagagatgtagcctagagggggggtgaataggctttcctgaaattttctcaacaatcgcagcggttaaattaacagggcccggaacctcctggtgaagaacaccggaacttcctggcagagatgagcagcccggaacttccggagttcttgagctaggaaattccgggcaacagagaaaatcaaaatttggggaagcaaaacaagtcctagctagagacaatcaggcacaaggttgcacaagatgtaaatcacaagataccagcagattcaaacacaaatcatgcacaagagagacaggcgattttttcccgaagttcggatcacacggatcctactctccgttgaggtgctcaaagagccgggtctcgattaaccccttgcctcacttatgcaaagatcccagaagaagtccacagccttcaactcaacacttctaggtcattttctagaattgagtgaccaccaagatccaactcacaattccttctagaaaagaccaca

SEQ ID NO: 17066 - DNA, 978 bp, Oryza sativa
  unsure (1)..(978): unsure at all n locations
aaatgcattgtgcaccagactttattgaagttcctaaaataagttttagatactggttttacgtctcgcagaaacattttattagaacttagtgatgaaattatgatatacagttcaaagtttaaattgtttaaacttatcacaaggatttgcaaattaactcaaatgattttctccccttcatttacacccaatcggaaaagatgagtcatgtatttgttagcaatagcatctacttggtaagggcaaacatagaagaacaagaaaaggagaaggtacatcaaaactctagagcaccttatatttaggagagagttaagaaggctcaaatggcctacatgtatatggataggaagtacctcttacaaaggatgaagaccaattgagtaaaaggaatttgttcttttttatttcagataatagcagaagaagaacgggctcaattgttgttcggttcatttggttgctgtgaccttaagtattggccttcttacccgacggtggtctgtaactctgatgtaatggccaagtcagtgcctactgtttccaacaagagggggttttcttcatttgttgacaaacccctctatatttcgaaagcttcatcagagcaccgtgcccaacaaagtgcttttacaaatcgttttctcgaatttctcagagggtcagacttctaactttaattttgtgtagtctatgttaaagactgttgcatttaattcatttttccaacaatgactacaggtttagattggggaataccgaagagccttattacaaaggaacagctgcttctatggtttttcttgatcttccaatgatggacgtaaagtttgatcatatcaagatatttgataatgaacttgcacttatgatatgccatgactttgagaggtatttttctgttctatttcttnnnnnnnnnnnnnnnnnnnnnnnnnnnnnnnnnnnnnnnnnnnnnnnnnnnnnnnnnnnnnn

SEQ ID NO: 17067 - DNA, 660 bp, Oryza sativa
  unsure (1)..(660): unsure at all n locations
cccaaccaggttttcacaatacacacacagcgcgcaataatcaatatatttacctgtgcctcggtaaatattataatcgccctgctcggcgtaaatttgcctcctgcgtgaggacttaaagaagaaccactgtacagaggtaccacctttgctagataacctactttgctaagtctgtccccattctagaattggcggtcgtactcgttcgttcttcagatgtacttggcaatcttatgtcggttggaacagtatgagccacccggaaatcatgcatttctaccgtactgttccaatctaagttcgttatattttatgcaatctaactaggcatggctaagcaaaatctagcatatatctggtttgctatatgttcaagttatgcatttaaaatcatgaatgggtaatgcatggaataatagagatatagaatataggataataatgctcaaaggggaggaataataacttgccttgctccaacgcaaataaatccgagataggcaacctgattatccgatcctcgaaataccacaggttgccatccaaaataaaatagattctactaagaaagacgaagaaccattttcaataaaagnnnnnnnnnnnnnnnnnnnnnnnnnnnnnnnnnnnnnnnnnnnnnnnnnnnnnnnnnnnnnn

SEQ ID NO: 17068 - DNA, 1314 bp, Oryza sativa
  unsure (1)..(1314): unsure at all n locations
tagggcgaattcgagctcggtaccctgttgggcagtcgcagagtgcgggtaaagtgtacatccactacagtgtgagtaaaccaaatctattcgaatagccgtgctcacggttattgagtaccgggacatgtattacacttggctagactataaattctttaactggtgtgggatgggatattacatgatgatttttatgctgatggagccacttcctgagaggtgggaatgtggacgtcctcagaaaaccatgacgactcaatggcggtaagctattcttgggatcacaatggatggtggacagaaccgtcggtgattaatgtgaacactggtattaaaactagatcagtctatgctaggatttacgcttatgaaaagaattacaaaacttgctttgcgcaaaagaaccatagccatactttgaattcttctgtgatgtgcattattgctgcggtggcttgctgagtacgggtggtactcacccttgcaatattcaaacttaatcagaggccggagatgaagcttcggaggatccctatgcctattaccaggagggtgatgaggacgatggcgctcaataggtcttagttacggtcgttgcctgtggcaatagcgtgccgctgccttaactccgctgccttacctacttctgtttttgaaatgtattccggaccgctcggtccgatgatttaagactgtgcctgcgggcttatgatgtaataattcgtactagactctcatgtatgtgcacttgatatttcagctataagttcgtgtgtaccagactacttgatccagggaaatggtactgtttacacgattaattcctgttataaaaacgggggtctaaggaagctcaatttgagaagttttatatcccgggagatattcattaccgtattcatttcactctatattcgatccatatctttattgataatattttattacgtttttatacaagttttcaattctgattatgtttctgaaaaaaatgaaaataaacatggtagatcaaattttcatccgtttctgttccattttcataactagctaatactgaacagaataattgaatgcggcaggtaaaatcgttgcagcaatactcatacatcaacctgaaacgaccatcctaggctgtgaccaagatgatatctattgatgactttttaagaaatgctagataaaaaagtattcatgttcggtatcaatatctcgaaatttcaatattattttggaaaataccatatttatcgattnnnnnnnnnnnnnnnnnnnnnnnnnnnnnnnnnnnnnnnnnnnnnnnnnnnnnnn

SEQ ID NO: 17069 - DNA, 747 bp, Oryza sativa
  unsure (1)..(747): unsure at all n locations
ctcgcngacgcatacgccaagtcggaactcgtcgaccgcgcccgcagggtgttcgacgaaacgcccgctcggggacagggtgctctgnaacgtcatggtctcctgctactcttcgcacgcccttgtaagggagtgctggaatgtctttggctccatgaggcggtctggttttcccggcgatggcttcacgttcagtgccttgctcagtgtgcgtgcttcttcttcttcttcgtgctatgaccatgccaacctgttgctggtcctgggaagctcggtgcatgggattgtgatcaggttgggtctccacctggatgtggtggtagccactgcgctccttgatatgtatgccaaatgcggccaagttgctgaggctagccgggtgtttgatgccatggtgctgagaaataccgtatcctggaatgcaatcattgtttgctatggtaagcatgacagaggcaaggaagccttcgaccttttcgtgtcgatgatgagacatgggttttgccctgacgagcttacgcttgccagtctacttagttcctgtgccgacatggcggctgctaatgaggctactcagcttcatgcttacactgttagaagaggcttgcaagactttctacaagtgggcaatgcccttatcatggcttatggtaagaatggttttgttcaagaagcaaaacgaacannnnnnnnnnnnnnnnnnnnnnnnnnnnnnnnnnnnnnnnnnnnnnnnnnnnnnnnnnnnnn

SEQ ID NO: 17070 - DNA, 587 bp, Oryza sativa
  unsure (1)..(587): unsure at all n locations
nnnnnnnnnnnnnnnnnnnnnnnnnnnnnnnnnnnnnnnnnnnnttctattggccgacagctcttaatgatgcggtcgacctggtccggcgatgtagagcgtgtcaattccacgccaagcaaatccatcagccggcccaggccctgcaaaccatactactttcgtggccatttgctgtctggggactcgatatcctgggaccgattacgcgggccccgggcgggtttgagtatctgtatgttgcgatcgacaggttcactaagtggcccgaggcttatccggtcgtcaagatcgataagcactccgcacttaaattcattaagggcatcacggcccggtttggagtgcctaaccgtattattacggataatggcacccaattcactagtgaactcttttgcgactactgccaagacatgggcatgaagctctggtttgactcacctggccaccccagaagcaatggccaagtggagcgcgccaatgcggaaatcctaaaggccttaaaaccaagaactttaacatacttaagaagcacggggattcatggatcgaggagttgccagcggtgctttggggaaaccgga

SEQ ID NO: 17071 - DNA, 751 bp, Oryza sativa
  unsure (1)..(751): unsure at all n locations
nnnnnnnnnnnnnnnnnnnnnnnnnnnnnnnnnnnnnnnnnnnnnnnnnnnnnnnnntaatagactagagcacatatatgaacaaaatgaagaaggtgtaatatatgttagattgcgattgtgtatatttgtttccctcccttccttatcccctccgatattgtttctataaattggttgcggtagatatggaagtcttgggcctatatgtactctgtcatatcgataatgcaatctatcgtgatgagccaatcacactttcatggtatcatattagtttctttcctctgcttccgcatcttctccaccccagccggccggcgcctcccaccgccgccatggcttctccctcatctctcacagctgactccgtcctcgaagataccatcaagttcatcaccgacgccgtccgctcctccttcaatcccggtcctggcctccaagtcgacgacggcctgaccgatgctgtcaccggcaacgccgccgaccgcgccgcgaacgctgcccggacagccctcgctcttgtgctgctcggcctcttccagtcggcgccggctactgacgacgtcgtctcctccgcggtgccactatcgacgcccttgacggctgcgcccccgacgaccgtcgtcctcgcgtccgcgtcggcaccgccaccggtcccttctccgacttctgcgggcgtactcccgcccgagctcctagcgctcctcgcccgactcggatcaccaccacgtcggccgcccctactcaa

SEQ ID NO: 17072 - DNA, 710 bp, Oryza sativa
  unsure (1)..(710): unsure at all n locations
nnnnnnnnnnnnnnnnnnnnnnnnnnnnnnnnnnnnnnnnnnnnnnnnnnnnnnnnnnnnntgagtgtgtttgatgatcatcacatatcagttgacctatatgttacataaagatggcaatagatctcattctatcagtagcgagcacacagtatcaattcaagcatatacagaaatagctgttctgcgcctacaccgcaggatgacaatttgatgtgccagtctttgcctagcatgaacatgcaaaagcttggttagaacattaattacatctctgatagcagttttcttttgaattaccccttcctactactggaatctgtctccttcccagcagcagtgttcacttgtctgttcagataggcttcatatatctccacaacaagccttgggtccttctcaacaagctccttgtattcctcccgatctgccagcgttgacatgttgtccatgatcgctgccagggatgtctcgagcagctgcttcgcgctgtggcgatgcgcaaacgcataatgcgtgatggcattgtcggtgctcactttggatgttaagaatttctcacagtaggccttcaggttcttcacttcgtacttctcagccaacaccaggagatcagatgccatctgctcgtcaaggagagcttctgctgtgtacatgtaatggacgaaagcacgaaggacgtcgtaagacacatcgtatattttgatgat

SEQ ID NO: 17073 - DNA, 244 bp, Oryza sativa
tccaaatattgttgctgtgtgatcgatgggcagcgtgtcgtgcggcagatcagcggcgccggcggcgctcgttgcacttgtggtggtgtcgtcggcgttgctgtcactgtcagctcgctgccagtgccacgccgcgcgatcttcccctctcgcggccgccatgtcgccgccgccgtcggccgtgacaacggcggcggcggcggcacgcggcggcggccgcgtgctgcaggaaggaggaggggaa

SEQ ID NO: 17074 - DNA, 1023 bp, Oryza sativa
agtccgatcaccaaatttagtacaagctaaaatttttgtccgtgactagttataatttaatccggctctaaatttcagccccgccgttgatatttataggcaaacagtctcccataaaaagggctctcccagcaagccatcatcaacctccaaaacacataagagaaattcaataattacacacaaaaaaaataaggcataagaaggcagctgcagctgctagctgctgttgttgttggtagtagttttttgggcaccaattttccatggagacgaaggtgaggatgagctgcaggttgggcactatggtggccctggtgctggtgggcgtcgtgctggcggcgatcctgcaggaagccaccgtcgacgcggcatcgtccagcagcgactcgccggcggcgaaatcgggcaccggctacctcgactacggcaacctcaaggcgaagctgcctccaccgggcgtcgccgttaccaagaggccatgcatagcaaaagagaaatgccgcggctgatcgatcgatcgatcgatcatcaccgacgtacccagacggatgaaacggatcgacgtacgtactgcttatggtgtcagcgtgttcttgttttttttttcttttcttttctttctttccgatggaattgaaacgtgtgtgttcttgtttttcttcttctcatggcatcgccttggctttctatatataatgaggtttttaatgtcactaattaattaaccacctgggatatataggccacattggtgaaaatccaactgtttgtagcgagtatagtgcgtagagtcgtgctccagcattattaatacatcatcacaccgatgattaattcttctcgttgttgttgttatttggataaattatgtgttttatcgttggtgatggaatctatgtagagcatcaacaaaatatataatccatatagatggggtccacacatattagctttaactattgcattattcattgtatatcatgccattgtagcattagaaggagagagagatgggagtag

SEQ ID NO: 17075 - DNA, 949 bp, Oryza sativa
  unsure (1)..(949): unsure at all n locations
aagcaagaagaaaagcggcaagaatgggaagaggaaagcttaaacagaagtccttgcatctgaatacgaacgcccgcccaaacacccagacccacagggcagtgatacaaagagaatatggtgccccatacacaagtcggacagacattctctggaggaatgcctcatcttcaaaaaatcatcggaaaggaagctggctttagagaagggtaagcgagtacgtgtagtcgagaaggcaactgaggcaaccactcaggactcggactccgcgtacccagattctgatcttcatgtctcacacatcttcggaggttccacaacatactcttcaaagcgagaatacaaaaaagtagagcgtgaggtttgttcgacatggcagggggctgcacccaagatgaagtggtctgaacagaagatcgagttctcagatgaagaccaccccaaggctgctgttataccatgacgatatccgatcgtggtcaaacccactattcggaatatcaaggtagcgcgagtcctcgtcgatggcggcagctccatcaatcttcttcgccaacactttggacgcaatgggatttccatgaggcgagttgacacctaccgatcaacccttccatggaatcacccctcaatcttcgtccaagccattgggcaagatcatgcttccggtgactttcggccaagcgagcaacttccgaacggagcagataacatatgatgttactgagttcgacacagcatacaacgccgtcatcgaaagaacggcactcacgaagttcatggccgcatctcactacgcgtatcaggtactcaagatgccctggccaaagggaacaatcactatccaagggaatgcgaagctggcggtccaatgcgacaagcgaagcctnnnnnnnnnnnnnnnnnnnnnnnnnnnnnnnnnnnnnnnnnnnnnnnnnnnnnnnnnnnn

SEQ ID NO: 17076 - DNA, 721 bp, Oryza sativa
  unsure (1)..(721): unsure at all n locations
nnnnnnnnnnnnnnnnnnnnnnnnnnnnnnnnnnnnnnnttatacgaagtgttggatcctcccagcaccaccccgctgcctctccctcgccgcctcgcgccgttgccggatccccgctgtcagggcgccgtcgatatatcgtcatctagtctccgtcgagccgcttcgcccttgtgtctgcatcgcacctcgccgtcgatcccacgcagtccggccatcgtcgatccccgcattagcctcgcgccggcaccggatctcctgctgtccggtcgccgtcgatccctcgatgtccggtgtccactgcgccgccaccgcgattcctcgctgccccccctacgcaaactcatccggatcacgtctccctcgctgctcctgtctaagacaaaggtgaatttatgttgagttccagccggacaattgtttggcctgcagtatgaagcttgtggagcagtaaatctgccagcgggtaggtaggagcagggtctcattgagttgctcccggccaggactgcgaagctgttgattcattgtcgtgtcatgctgagataaagcctttatctaattttggtacattctcacatattattataccatggaatcaaaatataccaaggtaagagttttcagccttgaaaattcacatgtgcattgtttcaggttcatatatctgacccaattagtgcccttgccaaattcagttccagaacaacatgcaagtccc

SEQ ID NO: 17077 - DNA, 703 bp, Oryza sativa
  unsure (1)..(703): unsure at all n locations
nnnnnnnnnnnnnnnnnnnnnnnnnnnnnnnnnnnnnnntttcactggaattcggcttgatgagactattttgcccctccttgtcggttgaaaggggatcgagatcgagcatggcgaggtggtcaccgttgctgacaagggcgtctacggtggtgtgagatggggcaagaccgagcttgccggccgagcaacgcgagcgcccccatggccgttttcatgggcgctgggacaccgccgcgccgtgtggagcaccgcctacttgcgcgccgcctctgccttcgtgaccacccagcaccttcacctctgcctcctttaaccggtgccgtcccggcaccttctcgccggaccggccttcttttcccatccacccgacgccgcctggccgcccttaggctcgcgccgcgctgggccaaccgccatcgtcttggtcgggtcgtccgccgtgccgccgcacccagtcttggcactgcaccagctgcgccttctcgcttgcttagaaggaagagagaaaaggggaacatgaagagaaaccccggggaagaggagaagataagagaaacccctccgtggcgaccgcaatgtgggtgttcagccacgtatgacgagacacaacttgtcctcccggacgttgctgatgctgaactcgccgccgcttgccgcaagtcccggcgcgacctacgaccaagacagttggtggcagttg

SEQ ID NO: 17078 - DNA, 536 bp, Oryza sativa
  unsure (1)..(536): unsure at all n locations
nnnnnnnnnnnnnnnnnnnnnnnnnnnnnnnnnnnnnnnnnnnnnnnnnnnnnnnnnnnnnnnnnctcggatgggagaaccgcttccgtgccgtagacgaggaagaaaggcgtttccccggttgctcggcttggcatggttcggttcgcccagagcaccgctggcaactcctcgatccacgaatcgccgtgcttcttgaggatgttgaaggtcttggttttaaggcctctgaggatttccgcattggcgcgctccacttggccgttgcttttggggtgggcaggtgaggcgaagcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17079 - DNA, 741 bp, Oryza sativa
  unsure (1)..(741): unsure at all n locations
nnnnnnnnnnnnnnnnnnnnnnnnnnnnnnnnnnnnnnnnnnnnnnnnnnnnnnnnnnnnnnnnnttcctggaaggcctgcatttggtcaatttgattactcttgtcatgaaacgaagccgaaatcgtgggcagttccaactgggcgagttctcactccccagtaccaacagtagcatacattaatattatggttttcccacaagtaatacaataatcctctacctaccactgctgataatcgtctcatttggaggcgaaacagatcaaaatgctaggttgcaggctgaatataaaatttaagatgggacaatacccatactacctgccttgtattcttcctattcttcttcttcttcatcaacaggatgcgcttctcaggccggagccggcgtattaccattccctggcaggccagtggctctggcctctggttggtttgctcctggagcactctggccggcgtcggcaggcggagcacgggaggtcgggatctgatgggatgcagacggcctcggaaggtaagaggaggcccctggtcgaggggggagcggagcaagagccccggccggcggcgggattcggggtcgcatcgcggggagaagcgaggttggcggagagcccgagagggcccagccgtctatcgccaaacggcgaagactccaccgaatgaaacggagctgggccgtcgaccgtcgcccgtcagactcgttagactccttcaatatttagagcatcagca

SEQ ID NO: 17080 - DNA, 685 bp, Oryza sativa
  unsure (1)..(685): unsure at all n locations
nnnnnnnnnnnnnnnnnnnnnnnnnnnnnnnnnnnnnnnnnnnnnnnnnnnnnnnaaaattatggtgtagtaggaagaggagaaggggaggaggaagggggagaggagcgtgttatgggggatagcgatcacccgcccattagcgacacccggagtagagggcgagaaaagaggagtttgaagccgttgacacgttgtggccacgcgttgagcgcgtccgagagcggtcggcgccggttttctttttctctctcgcgttaagcggtgaggaatgaagatggacagggactgggctagctggggaggctgccaagtgggtccaaaccgtggtaacctaggctagagagaaagggaagggtagaaacatgggtagactagattttggatgattttccaggtttatttctcttcccatctttcttaattcatatattaatttgtggtgcagataaattcatgtagattttactggagttaggtgattatacctagatttcatttttttttacacttaaaaattatgtgcagtttgctctcagaaaaatggataagatgggctcaccaaaattttgtttgaattgttagaaggcctaaacagaagaattaaattctggaaaattatacttactcttaataatcaacctagtatttgaataaattatttcccttatacacttcccacttc

SEQ ID NO: 17081 - DNA, 734 bp, Oryza sativa
  unsure (1)..(734): unsure at all n locations
atcgtcggcacggtgtgaacggacgagaaggagagaggattagggtggcgtgaaggtgaagannacgcagggcggggtggtggggttgagatctgagcgaagggcgtgggcgggtgcgcgaaggaacgagcccatgaggggcgtgaagggatcgatgtggagcactggatgtcgcgatcgtatcattaatatcacgcgtgtctatcacgttagtgtcaccaataccattataaattttttaagtagtaataactaatatctctatttctatctctatctctatctctactactccctccgtctacttttaataggcatatttcatcttagcacaatgaccaagaataagtaattctacttatcatccatttaaacatgctactctctccgtctacttttgatagacatatttctaaatctaaaaaaaatatttttgatagacatatttcaattgaaccacttatcatcttaatgactttctcggatttaatgcgtgaatctccattcttccacacaagattggctacatgggcatcgagaaatataaatattaatgaattgttttttttacgaggaataactaatgacatgtttaaatggatgataagtagaattacttacccttgttcattgtgccaagataaaatatgtctatcaaaagtagacggagggagtactagttatttctcgtaaacaaacgattcattaatatttacacgatgcccatgtagcca

SEQ ID NO: 17082 - DNA, 3773 bp, Oryza sativa
  unsure (1)..(3773): unsure at all n locations
ttttgagaggatgtggttttggaagatttatattgagtaaagagagtgtggatgacttgatatgcaacttgaaaattgttctgaaggaatgtgcgtcaggcaaggcttacatagggaaatctcgcggcacaccactgatggcgataaagatgtcaactgcagttacagagaaatggaaagacatgcttgggaatgaaatagctgtccaatctagaattaagcacatgaatgttgccaagcttatcggttactgcttagatcattcggatggtacagtgcttatatacgagtacggtgcaattagcttgtatgatgttctttttggtgatgcggggaagatatatcgtcccttcacttgtgacctgcgcctgaagattgcgattggtgctgcagagggcattgctcacctgcattcacttggcgtcgtgcatggcgatgtcagcattaacgacatactgctggatcatgtctcttcgtccctggtaaagattgctggctatgggacatcagggctccctgacatcgacaaggctctggattcgcttgaaaccggtcatgggaagaaggagcatgatgtgtacagttttgggcttgttctcctaaccctcttcacgtggaagaaggtgtcactgccacatgatctcaagtccgagcctgacaaacctgtgctactgcaccaggaagccatccgtgggcgtagatgcaatcatcttgagatgatcaagggcttggcttcacggtgtctgacgtccgaggcgacgaagagaccatccatggtggaagtagcaaaacatctcaacttcatacttatttttcctgaaaggaggaaaacttgccatgacctggcgatttatcaatctcgaatgctttcggactaggctaggctgcaagaactagcagtcgtacatgggttttttttttagtaaaggtgccgtatacgttgtagatgctatatataattcaagcaacatgtgtattttatatcctgacaaaaaaaaacaatgactcttgcttcttctcaggtttggtggctctttcttgtttctaattcttattcagtgcatttgtctttttttttaagataatggagtataattcagtgcatttgtctacatctggccctttggcctttctttcttgtggccgattttgctcggtcaaatttttgtgtaacagaagaaattaagccgcatcagtttactttggatgttgcttggattggtactgtttcttgttttcatgtttttttgtgaaactttatgtaggatcgaacataaataatcaagcctacgagggggggtgaatggtaaggaaaaccaaaaacccaaaaacttttagcggaaataaaagttaccctcaaatcgatggaaatctcgacgtagtcctgtcgccgccggtcggactgctcgtacgccgccggtctaaccgccgctttgtagccggttgaaccgtcggtatgtcaccggttagaccaccgaacccgataaaacacaaatcgaagaactcttaaaataaatgacaactttattgcttctctctgtgtttacaaagtgcaacaacatcactccttacaaaaatctcgactaaacttaaaactaactaaattatcaactccatgctctgaaaagcgatacaggaaacctcacgctccctctctatttataccacaaaaacccttntaattcaaaggtagggtgaagaacctcctatacacaaatatggactcgatacttcaatttcctttttttccaaaatccggagccggacccaaggtagactccttcttccctaactggtgcttgtgcttggccgctgagccgagtcggctttgcaccaccgagcccaactcggtcgcccaggccagaccaatttgttgttgttttggaccacgtgcacagcacctgcgcacacccaagcccatatgcatgacagccttccatccaatcggccacacacacgtgcccaaccaatctcagcacatacacacacatgcatgtactgatcacacacgtacaacacacgtacatgtatcatacacgctacagtacatcaagtactgtagcaaccatgcactccaccatacatgaacatctctatcttctctcattcctcttcgcgaacaccaacgcttgcacacacacctcgtgaagcccgttgcgaagatctttcccacactatgtccatccgccgtgtgccatctcgtattcaacttcgtcacccggtatccttgaccgtctggacctcaactcctccctgagtttagttccgatccccaccgttgaccgaagttgacctccaagaatcctgactctagtcaccttctcacatggtatcccgatcgcactagacctctgttcctccctgaacatagtcctggtcctcaccattgaccaaggctgacctcaagtcacctgcacacaatcagacaaaacaaccgtttctgggcatagatatcacaacctgacccacattagtcacacgcactcacaccaacatccacacatcttttcaaaccaattcattgattaaatcatttgcatagccaattgttcatcacaaatattaatcatgacagtgatttcacactttccagtttttacctctctcgtgggctccaggtggatgtgtgttttggccaaaaaaaaaagatcttctgaaaggttctgccttaaaagagtttccaattttcatttccaaatgtggagggatgatggtcctgattgtaaatttgttattggtgcacataatttgctatccgtacaatggcaccgttgcaacttgcaatctaaagagaattggctttcctacgcagatgatgttgaaacagcacaaaacaagtatcacaatgcacagaggggaaacagaaatgaaaaaagttcagacgcgccagcacagtcttcttcttcatcttcagatctctagcctcttaacgttgggtctccagccaaaccttgattgataaacttcacttgcaactcgccttatgagcctggcccccagtagcaagtttcttcggcttgtttcctgtttctgcaaagttgtccaggtttcaacccaataacaagcgagaaagatcagatcagtaggatcatgtggaagtttttttttcaaaacaagctttatttctaatcttccaaatagcccagatcatagcagcaaggccaaccacaaccagattcccagtcaatctgtcaattttgtttagccattgtccaaacaagtgctgaaaattaaggataggttttatgttgagagcacaacaaacaacattccataacaattcttccaaatgacagaattggccattttttatcacccttcctccaaccttttttaaacaagttatctttagtcagaatcttgttcttagcaaacaaccaaataaaaatcttaattttcaaaggtattttgaatttccagactttcttaaaagggaacaccacctgtttcattttgagagctttataaaaagttctcacactgaacttgccatctttactaatactaagttcccaccaaactttatctctacaatgtgcattgataaccagggagtcccaaccagccttgattttgttctagtccctaagtttttcactatgctaatgctatcaatccccttttggttaatatttgcaattgtcaccattttttttcacaactatattataagagcaattttatggtccttgaggaggtactatgaagtaccattttttctattataaatttggtacctcatggtatctaagtactatgaggtaccatgaggt

SEQ ID NO: 17083 - DNA, 1000 bp, Oryza sativa
  unsure (1)..(1000): unsure at all n locations
nnnnnnnnnnnnnnnnnnnnnnnnnnnnnnnnnnnnnnnnnnnnnnnnnnnnnnntagaattgctcatattataaaggtcaggaaattggtcacacaaaggtctactcctatccagctgtcctcccagaagagagtatctttcccattgcccaaaatttgtgtaacatgtttgtaaaacagatctttaatctccatgatgccctgccaaaaatgtgagataccaggtttctgttttactgcagacaaaggttttcctttcaggtatttctctcttagaatatcttgccaccacacatcctcattttcaattctccacacccattttcctaacatggctttattcattatatctagatccagtacccccagatacccccccccccccgatctctaggtgagcaaaccagaagccactgaacaaggtgaaactttccaataccctaatcttcttgccacaagagcctccttttaaaatagtccatcctatccctaacaccctgtggaagtctgtagaaagagatcatatacaaagggatattggttaggcttgaattgattagcaccagtctccccccaatagactggattttgccttgccaacatcctaacttgtgttccattttattttcagccatcttccagtctttgttcagaattcttttttttgtcaatggggatacctaaataggtcatgggaagctctccacctttacaggtgaaaatctaactgtacagggattgcttctccttagcctccccaaaacaaaacacttcacttttgttgaaatttattttgagaccagagagctgttcaaacagacacagctagtatttaagatgtttagcttgttcaagatcatctgacagcaagaaaatcgtgtcatcagtgtattgcaaaattgcaaccttgttatcatcatttatccccaacccctctatcaactcattattcacagctctctgaaccagcactgtcaaagcttgcatgcctgcaggtcg

SEQ ID NO: 17084 - DNA, 545 bp, Oryza sativa
gttcgcgtggccaagatccaccccgtccacccctccttcgtcgagggtcccgtcgccggagaagcccgttcccgtcgtgccgacggtaaagggtttgccatgtcccgcccgccttcggcccagtattcccgcctcctataggcccctctcttcctctctaatctctttcttttcgttctttaggtcgtcccggtcgccgtcggccgcgtgtcgacttccctccgtcgctcctcgtcgccggtcgccgccgtccccttcggtgaggaactccctcccctttcctttactttcccgattcccgtgcgtcgccgccgcccgcgctcgccgtcgcctttggtcgttgccgccgtccgctgccgccgctttcgcgtcgcttttgcgccgtcgcctctgccgccggttgccgtcgccggcaacgcgttcgcgcgcgcgccgtcgccgctagccatggccggccggtcggctttgatgccgagccaagcccggcgggcgcctctatcgccgcccgtccgatcggcccgagggcgatctgggccgtcggtccc

SEQ ID NO: 17085 - DNA, 767 bp, Oryza sativa
  unsure (1)..(767): unsure at all n locations
nnnnnnnnnnnnnnnnnnnnnnnnnnnnnnnnnnnncgggcatgatgtgaggtggaagctttccgactacgcgatgaacgaccaggagagcttatcgagggggtgggcgttttccgacgatttccgatcacggaggagaatttcctcccccttctcgggatgttgccgccactcgttgtggcagcagcagcagcaacatcagacacctccttggcgacgttctccttcagccacgccgccgcctgatggtccacgagtggcccgataatatcagtcagagggagagcatacgcttcatgaagtcacaatgcgatcccgaaagaaaaatgcaaaagggccgctgagtacacttacattgatggtggcttcgcgttcggctgcccccttctcgcaaagagcaacagggacgttgctcgccgttgtagggccgctgatcatcacttgaccaacgcggcgctctacagtttcgctgttcaaacctatagatcgagaaccaaaattgataagtcagggggaacatatacttaaggaatggaacccagaatacgagaaaaataccctgaggagaaaccccggtcgcattcttcgggcctggtagtcaaaagcttgatgggctcgagcctagagcgggttgatccgtctaccgatgaagtcagcagcgacttcataccccgacaaccctcgcactccgaggtcatcgatgacatcgatgaaagactgaaggaaagggggtcaaggcnggcctttgcaggnccngacgaaatatt

SEQ ID NO: 17086 - DNA, 727 bp, Oryza sativa
ctgcgccacgtatatgggataagtgagcacagctgtgctcacctaacagcatttattgcagtctggtcaagcgtgtcacgctgcatgcagtgcagcacggcgcgtccctttatccggtctgtgaccagtcacagaccggtcagatcacgggttaggtggcgactggcggtctgacgcacgccatgccccatcccgtcaagacgaaagcctctagtcactcgtctcaagccggcgttaagcgtgttatcccttagagatgacacgttagacccggtcgatatatgccaggcttcatcttaaccattacaggcaagatgttgtgtgaagaagggcaaacatgcacgttgccaagtttacacgcggtggacaagaatgaccgatttgtgaccggtctgacactgaccatatcgtcagcgcacagccatgttcccacgacgcgctcacccccggcggaagtggaggtaggtgtgggctgtcccatcggagcgtcattcggacagcaaccgtgctgatctccgcccattcaagagaaaaagaacagtccagtttggaaagagaagggtgcatgtggtatccccttgaagtataaaaggaggaccttgcccatagagagggggttgggtgattcttttccagatgatgagctcagaacggggggagaagtaagctcacaactgttgctcatttataccgcagatcaaccaaacacaggagtggggtattacgc

SEQ ID NO: 17087 - DNA, 524 bp, Oryza sativa
  unsure (1)..(524): unsure at all n locations
ctatagggcgaattcgagctcggtacccttggcaggcgaggtagggcccggcatgcttcgggacgccgtctcccgtctagaccgcgccggccggcaagcgggcctctggggcgggcggactgcgaagtacgccgccaaccaggggggcctcacccagcgcctctcgaagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccgggaccgaggacggcgcgcgcgcgcaggtccgggacgccgccgaccatatcgtccacagcttcgagggttcggcccctcggctcgcgttcgccctcaactccgacgaggaggacgatgacggcggagtgggcgacannnnnnnnnnnnnnnnnnnnnnnnnnnnnnnnnnnnnnnnnnnnnnnnnnnnnnnnnnnn

SEQ ID NO: 17088 - DNA, 705 bp, Oryza sativa
agttctggtcgccccggagccaaatgaacctttgctactctacttagaggcgaccccgcaagtggttagtacggcgttggttgtggagcgcgatgaggacaatcctcattccgcgcacccccaccctgtgctggcttggcccggaagagagcagggaggagaggccctcgagccgaacggtggcccaaggcccccgacgaccggagcaggccctctgcccgcttgtcaggcggtgccaggtgcccccgacccccaggatggcccgagggccactgcgggaaggccgcacctatcgccctctgaccccgaggctaaccctgtgccgactcgacccgggagagagcagggagaagaggcccccgagccgaacggtggcctaaggcccctgacgaccggagttggccctttgcccgcttgtccgacgacgccaggagcccccgacccccaggacggccccgaggccactgtgggaaggctgcccctgtcgtcctccgaccccgaggtcgtcggcacagaagacgagtgcaccccgcgaggccgcttggacaaagagcgccccagggatgtggcccctagcgaagaggatcggccccaccgaaaggtgcagcggcccgtctactttgttagtgaggcccttcgggacgccaagacccgataccctcaggcccagaagatgctttacgctattctgatggcttcgaggaa

SEQ ID NO: 17089 - DNA, 650 bp, Oryza sativa
  unsure (1)..(650): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccagcccacccgccacagccgagccacccaagaaagtgatcaaaacgactaagacgccgaaaccagacggcgcaatcaaaatcgtcccactctccagtgtcaaccccgacaagacggtcaagatcggggcatcactgaacgagaaataggaactcgcgctcatcaccttcctccgcgacaatgtggacgtattcgcttggcagctgtccgacatgccgggggtccccagggaggtcattgagcacaaacgtatggtgcgacccgatgccaagccagtaaagcaaaaactgcggagatttacatcagatcggaaacaggccatacgagaagagctcgataaacttcttaaggctggtttcatcagagaggtactccatccagagtggctagccaacccagtcatggtgcgaaaggccaacgagaagtggaggatgtgcgtcgacttcaccaacctcaacaaggcgtgccccaaggggtaccgagctcgaattcgccct

SEQ ID NO: 17090 - DNA, 674 bp, Oryza sativa
  unsure (1)..(674): unsure at all n locations
nnnnnnnnnnnnnnnnnnnnnnnnnnnnnnnnnnnnnnnnnnnnnnnnnnnnnnnctcgctcccgctcggtgagcgcgtcctcgcggttgcggtgcgcggactcctcttcggcgcaggcggcctcgtgcgcagtcagcgttgcctcccggatggcaacggcggcctcgcgatccgccaggtccctctccacggcgcaggcacgctcttccagcgccatggcacgggcctcaagggcttcttcgcgccgccgggatgccacctcggtctccgctgcccgccgttctcgggcagcggcagcgtcaaggaccccccgggcggcgtcgagcttcttccctagctccgcctcccagctcccgtattgaaggcggagggtgtcctgcgcctcgttcatcacggtggtggcgatgagggcagccccccgctcctcctccacctccttggcgatctcccccagcaccttccgacgggtttcgagctctgagacgtgccggcggtgtgccttgcggcccacctccaccatggcctccaccgagcgtcgcccctcttcgacacgcgcccatgcggcgtcgagctccgaacgctctgcatgcagggcctccacctgggcacttaacccgtccaacaccgtggtgtttgcgacggccaaggcctgcagaagggtaccgagctcgaa

SEQ ID NO: 17091 - DNA, 805 bp, Oryza sativa
ttattattcaaaggtttatatacccattccaatttgattttgaattcaatattttttataaaaaaaaatgcccatgcgttgcaacgggtgaggttattttacctttatttattgttatacgatttagtaaggtgaaatccattgtgagattcggcttggatatatatattttcccacgaaattatgagctataattaggagtccgatcatcttgtcgacggtgagtaaccgtagaccggatatagagggtattggggtacgctggtacgaggatctacgtagtccgacatcaaggaacaagagagaaagattataatggtttaggccccttagtaggtaatagccctaatctagttgatatgggattatatggaaataaccacagattacaaagggaatagtagaactcggtggtaccgacgagattgtagtcgagttaattagactagaccacccggcgacttggctcctatagtcttcggcttcgtaggctgtggtcgtcgtgtagcctatgagattcgatcccttaggtccccgcggggggtcccttttatatcgcaggtcaggcggtctccaagtaggactcggaggcatcggaccctgcacaatatagtaacgacccagtcctatacgggtaggaacctttccattgacagactttgtgatggacttccttagcgtattcagaggacgtccgtatatgcaccgacataccgtattgccgtatagcatacgtccaagggtagagggtataccttatccgtaaccctgacaatagcccccgacttctacttaaatgaactca

SEQ ID NO: 17092 - DNA, 747 bp, Oryza sativa
  unsure (1)..(747): unsure at all n locations
gacttaaacaaattttttaattggtgtttgtcgacatgatacagtcagtttttctgtcaacttgaacattcagttatgctaacttagctatacaaaaaatacataccaagccagttttgtgagtagaaactaacattatatagtaggatcgaattgattcctcatcggtttttcttgagcaattgttcatccaattgatgatcaattgcacatgagaacactcaccaaatctgtagttcatctcatattcaacttatgtataattctgataatctcaaattgatcttttccaatctgcagaagttcactgttccacaaaaatacttcatgcatttttatgtggtcggagtgctggcgacaacaattttgcttctggcaatatggttctatgcatatatgaaattgacaccattattgcttgagtcatcaagttattccacaattttcagtcatcttgtaggctcaaattcattctcttttggtcgtgttcgctcgcgcaccatgggacacaagtatcgtgtctggcgaacagtatttgcacttctattgatggaagttcaagtgctgagacgactatatgagactgaacatgtgttccactacagtcctgctcggatgcatattgtaggatatttgacaggtctattgtaagctccatcttgttttatatcttttatgttctagatctccatggcacatttgttgtgaaannnnnnnnnnnnnnnnnnnnnnnnnnnnnnnnnnnnn

SEQ ID NO: 17093 - DNA, 3839 bp, Oryza sativa
  unsure (1)..(3839): unsure at all n locations
nnnnnnnnnnnnnnnnnnnnnnnnnnnnnnnnnnnnnnnnnnnnnnnnnnnnnnntttgcactttgaaccacgccacgctatcaagagccaggccctcgccgattttgtggcagagtggaccccagctcccgagcccgtctcagtccacgaggccagctcgggcccctcgcagctgcctcacaccgcccactgggtgatgcagttcgacggctccctgtctcttcagggcgccggtgcgggggtcacgttgacctcgccgagcggagacgtcctcagatatttggttcgccttgacttttgggcgaccaataatatggcagagtacgagggactccttgcgggactcagggtggcagctggactggggatccgccgcctcctggtgttaggcgactcccagctggtcgttaaccatgtctgtaaggagtaccggtgctctgacccgcagatggacgcttacgtgcgccaagtatggcgtatggagcgccattttgacgggatagagcttcggcacgtgcccagacgggataacacggttgctgacgaactctcacggctcgctttctcgcgagcccagaccccacctggcgcctttgaagaaaggcttgcccagccgtcggcgcgacccgaccccttaggggagacggacgcgcctgacaggcccccgaggcccgtcggagtccaggcctcgggacccgaggggagtgctcccagctcccttagattgattgcttggatcgctgagatccaagcatacctcacagataagactctacccgaggactgcgaagggagtgaacgcgtccagcgcatctccaaacactacgtgctggtagaagggaccctctatcggcgcgcggctaacggaatcctcctgaagtgcattcctcgggaacaaggcgtcgagcttcttgccgatatccatgaaggcgaatgcggagcccactccgcctcgcgcaccttggttggcaaagcctttcgtcaaggtttctattggccaacagctctcaatgatgcggtcgacctggtccggcaatgcagagcgtgtcaattccacgccaagcaaatccatcagccggcccaggccctgtagatcataccactttcatggccatttgctgtctaggggctcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacagcccggtttggagtgcctaaccgtattattacggataacggcacccaattcactagtaaacttttcggcgattactgcgaagacatgggcatcaagctctgcttcgcctcacctgcccaccccagaagcaacggccaagtggagcgcgccaatgcggaaatcctcagaggccttaaaaccaagaccttcaacatcctcaagaagcacggcgattcgtggatcgaggagttgccagcggtgctctgggcgaaccgaaccatgccaagccgagcaaccggggaaacgcctttcttcctcgtctacggcgcggaagcggttctcccatccgagctcaccctgaggtcccctcgggccaccatgtactgcgaggctgatcaagatcagcttcgcagagatgacctcgactacttggaagagtgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctctcaccaatgtgggagggtccgtatcgagtgatcggcgtcccccggccgggctccgttcggctggccacgggcgacggcacagagctgcctaacccgtggaacatcgaacaccttcgtcgcttctacccctaaagggggatcgggtgtcaggtttcgggctcgggccaaccccgcacccccctcgggcgtgcagggttggccgggggctaccacatatgcatattcttatttctcttatatctgtatttcaataaaagcattttcgatttcctaaaggctgtatctgtgctgttgtttccttttgaaggatcttgacttgaaataggtcactcgtgttcaatcctgccctcgggggctcgggtcggctaaaatcgccaaacggggcccagaaccgagccgtgccccggggcgtagtgaactccgggggggaatcggcaaaaacccacaatcgggtcacccataaccctcggtcaccacgctcccggcctggccagtctcgacatgtggatctccccaggcactagccccgacccgagccatttgaggactaggacctgggcacgagcccttgttcaaagccaagacacaaaaggaccgcggcacagacatcctcgtctcatacacacaacaaatagaattgacacaaaaaatttcctctttatttgattgcagattaaattagtctatacaagaagggggcccgaaggcctcggaagaagaaaagaagaaactatttaaagattggcgggggcctgggggctcactccgatgcactcgggtcgccagcctcgtcgccactgtcgcccactccgccgtcatcgtcctcctcgtcggagttgagggcgaacgcgagccgaggggccgaaccctcgaagctgtggacgatatggtcggcggcgtcccggacctgcgcgcgcgcgccgtcctcggtcccgggagggaactcgtccagcgccgtccatggggagaagtcgggatccctggcttggtaactcgccagtacgagctccaccgctcctcgggcgaggtccctcgaggatgacttaatcgtcctctcgagctcctcggggagccgttggagagtcccggctatcttcgagaggcgctgggtgaggcccccctggttggcggcgtacttcgcagtccgcccgccccagaggcccgcttgccggccggcgcggtctagacgggagacggcgtcccgaagcatgccgggccctacctcgcctgccaagcggagggcctcgacctccccggcggacgagtctagcgcgccctgcagatcggcgatggtgtgttcggcagctgcgaggcgggcggttaagtcgctttcgcccgcggccgccccgctgctgcgcgccctcgcgtccaactccttctcccgcgcctcgagctcagcggcccgctggttcagcgcggccctctcggcgcgggcaccttccagattatggcgcgcctgctcctcccgcgctgcctcgcggagggacaggctgtccgccagccgttgcgccgcggcctcggcctcctcgagagctcgctcccgctcggtgagcgcgtcctcgcggaggcggagcgcggactcctcttcggcgcaggcggcctcgtgcgcagtcagcgttgcctcccggatggcaacggcggcctcgcgatccgccaggtccctctccacggagcaggcacgctcttccagcgccatggcacgggcctcaagggcttcttcgcgccgccgggatgccacctcggtctccgctgcccgccgttctcgggcagcggcagcgtcaaggaccccccgggcggcgtcgagcttcttccctagctccgccttccagctcccgtattgaaggcggagggtgtcctgcgcctcgttcatcacggtggtggcgatgagggcagccccccgctacttctccaccttcttggcgatctccccagcaccttccgacgggtttcgagctctgagacgtgccgggggtgtgccttgcggccaccttcaccatggcc

SEQ ID NO: 17094 - DNA, 4040 bp, Oryza sativa
gctccgcccgctctgcttgcagggcctccacctgggcacttaacccgtccaacaccgtggtgtttgcgacggccaaggcctcagaaggggttctgcgctcagtggagcaacggaaggcgtggggaagagccgcctcgaagaggatgccgcgcggcttggcccgccgatggacgtgccggactcggggatgtcccccggacctggtttgtcctgagcgtcgcacgagggagtgggcccaagcgatgcgcccgcggcctcgtcgtgagttgcctcggaagtcgtcgtcgcctcggcctggcgaagtctggcctcctcccgagcggcttcttcagcttggcgagctcggacggccacctgggcagcttcctcggcttctcgaaggcgatctgcggcctcttgccggtcagtttcacgggtcgcctcggaggatgtcgtcgcctcggcctggcggagtccggcctcctcccgagcggcttcctcggtctggcgagcccgggcggcctcccgagcggcctcctcggcttcccgaaggcgatccgcggcttctcgccggtcagattcccgcctccgggcctttgtggtcgccgggtcctcggcctcagactggccggacttggaatggcgggagggacgcgacgggatctcgctgaaacagaagaaagaccagaagacaaacaagatggatgagtgaaaactcgcgttgagggaatgaatacggccacgatgggcgtgggacgaacctgcgagggggtcggttaaacgaccaccttggaggggaaataaggtttccccgggatggttctgtcccccccatcttgcggagccgtttcttcttccgctccccctcgggctgcgacgtcggcgtggccccctccgggcgcctgctgctggcacgcgccgccccgccccctcggcgaggagatgggggaggggttccttcctgcttcctcttcccccgggcatcggcagggcggccgctccccaggcccccgtcgcggggcccagaagcacgaccccctcccggggtagattgttcccccctgcggctcccgcccgcgccatcgtggcctcgaggagcccgctcctccgacgccccgaccgcctgcatgatggtcaggatggaggcgcggtctggatcgctgcagagggggaggactccttgaggaatgagggatgcctccacggagctgagattcagcacccgttggaccactatcttgaagtcctcaggagcccagtcccatttgaccccctggtgggtcctcatgtagtcttcggacccggtgtactcccaggcgccccgggcgcgctgctggagcggcgcaatccggcgacgaaggtagtcgccgtacaccatggcccctgtgagcccctgggatcgcaggcccgccaagcggtcgagaacggcgtcatagccatctcccagatctaccggcgcccgccagctggaggcctgcgctggaggctggctcggaagtcggaggcgcgctttgtcggcgaggggggtgtagaaccagtcgctcttccagtcatcccacttcttgcggaggacgcagggaatgtagcggttcagcaccggcccccgcggctggaagtagcaaccaccaaccaccgacggcggcgacaccggctgtacggtgaagaaccaccggaacagccgaagggatgggcgcaccccgatgaacatctcgcacaggtgcgtgaagatggccaatgtcattaccgcgttgggggtgaggtgcgccatctggagatcgtaaaactccagaacatccatgaagaaagaagaaaatggcggaaccagccctgccattgcaaaagggaggaagaagacggaccgccccgggtagcgtggcgctgggcatccctcgcccagcgagactatctcccggccggtggcagattccggcatgaagcggcgcggcagcccggcctgtctctcgctcacgatgcgggaaggcggcagcacgctaccgtcaagcggagcggagccccgtgccatgatgccggaagaagagatgtttgagagcgagcgcgtgtggcgaaggtagggcacaagaaacaaggagttagggcgcaagcggcgaagacaaggggaataatggcgagaggaaggaagcaaatctcttcctcggcgactttatacccttgccaacgctgtgcccggctcctcgtttctcgcgcccactatcttgccccctcgtttctcgcgcccacgcttccactaatcctattcgcccgtttgcggtgcatgaggtggataagcggctgtggcagtcgagatggaacatctcgtgcgcgcattaattacgctcgccgaccgaagcgccatcaccatatctccaggaaaaacgaaccggcttgtcccgatttttagaccggccccacctgtcaccaggccttaggaagtggcgtcacgcccgaccgcttccctcgaggagggcgatcgccctggcataacgccgggggctactgtcggtgacatgggaccgggagtatcatgacttagagacttgaggcagacatgatcacccacgtggcctaaccccctcgggggggggggggggggtcgggcccgagggtgatacggccgcccttctctttgtctccccgagaggtcggaccgctcccgtctcggccccgagggccgaggcgccccgaccacttgtgggttttgcgccgcgtatatggggtaggtgagcatagcggggctcacctaaccatatttattgcggtttggacgagcgcgtcacgccgcatgtaacgcagtgcagcgcactcgtttatccggtctgtgaccagtcacagaccgatcagatcgtgggttaggtggcgacaggcggtctgacgcacgcctcgccccatcccgtcaggatgagagcctccaagcactcgtccctagccggagccggcgtgttagctcctggagatggcacgttggtcccggtcagatatataccaggcttcatcctaaccattacaagcaagacattgtatgaagaggggcgaacatgcagattgataaactgacgcgtggtggacaagaatgaccgatttgtgaccggtctgacactggtcatgtcgtcagcagacagccatgttcccacgtcgcgcctgcttccggcggaagtggaggtaggtatgggccgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggattgatttttttggggggggggtccagaacgatcagagagggagagagtaagagctctctggttctccagctcttttgtagcttcttcatacatagatccaccaaaacacaggagtagggtattacgcttctcagcggcccgaacctgtatacatcgcccgtgtcttgtgtgtttccattctcgcgaaccttctacataccgagagcttagaatctcacccagggcccccggccgaaccggcaaaggggggcctgcgcggtctcccggtgaggagccccacgctccgtcagttatacagtttaattaaggtgaaattcactgtgtgaatttgcttggatatatatattttttagaaagtcataattaagctgtaattaggagtccgatcatgtcaagttagcatgcaagtttttttttaaaaaaagacttcttacatgactccttctgtgtttccaaaagcgaccgaacttaaaaactaactcaaatatgtaaatgtatttccaaaagtgaacgaagttaaaaaccgactcatacacgaatgacgtacgaatgtaccggcaaaaacatcttcaattttataatagtagagatttgtttaatgataaatttagtaactttaattttacatgattaagcttttttctaattaatagtcaaagttaaaaatatttggcttaatactatattaaaaatgcttatattttagaacgggcagagtatatttcattcaacaaaaatttct

SEQ ID NO: 17095 - DNA, 2121 bp, Oryza sativa
  unsure (1)..(2121): unsure at all n locations
nnnnnnnnnnnnnnnnnnnnnnnnnnnnnnnnnnnnnnnnnnnnnnnnnnnnnnnnnnnnnntttttttaaaaaaagacttcttacatgactccttctgtgtttccaaaagcgaccgaacttaaaaactaactcaaatatgtaaatgtatttccaaaagtgaacgaagttaaaaaccgactcatacacgaatgacgtacgaatgtaccggcaaaaacatcttcaattttataatagtagagatttgtttaatgataaatttagtaactttaattttacatgattaagcttttttctaattaatagtcaaagttaaaaatatttggcttaatactatattaaaaatgcttatattttagaacgggcagagtatatttcattcaacaaaaatttctttaggacggatggagcagtaaatactcagccctactggataagatatgctcagtcgctgtcgttggtatacaaggcagagggccaggttaagcacaattgcactaatgtcccattccaattatttcagtaaggtgtcccatcaaaaaaagaatatttcagtacgtgtttttaatagaaaaggcgtctcctcgtaagcacccggaaattctgctcgtggaaataggcgctgctcgtggaaaggcctcactttcacagtagtaataaaaatgaaccagcaattccgtaataaaaattctgatggcgtcactttcgccgtcccggccagaaaatacgaagtaaaaaagaaccagtgatttaagcgcgtcgatcgatcgacgagggactatgtatttaccgacttactgagaattccaggcatcactgatcaaccgtactaacaataagccatagctagtgatcgatcgatggccggcgtcgtagaaaccgccgacgaagctacccaagcaccagctgttgcttccataagtaccgcagcagcatatgcacggccggtgggcacactgcttgatccgaagctgttcatggctgctcgccgcggtgacatcaacgggcttaaggaacttcttaggccagacgacgacgacgacgacgacgacgacgaggtagtcatcgtggacgtcgaccctgtgcctgctgctccctcctcctcctcggcctcggggtcgtcgcatcatcagctccaacaacttgatgatcatggggtgaccagcaacgagggtgactccctactccatgtggtcgccacccgcagcggcggcggcgacggcgaccggttcgtcgcctgcgccaacacgatctactaacacggcagcagcaacggcgccctcctcgccgcgcgcaaccacaagggcgacacgcccctgcactgcgccgcccgcgctgggggtgcccgcatggtcgcctgcctcgtcgctctcaagacggctgaggtggtggccgcgcccgcgggagacgggccaggtgtggaggagttcctcaggatgcggaaccagtgcggggagaccgcgctgcaccaggcggtccgcgctgcctgcacggcctgcatagacgagctgctgctggtggatccgatgctggccaccgttccacaggagggggagggtggcgcttcccccttctacctggcattttcactgggtaaactggatatcgcacgccatctgttggacaaaactaatggccagttgtcctactctggactcgacggacaaaacgtgttgcatgcggctatttctcgtggtcaaggtacgtgaaaatgatactaagggcctgtataaatcttctggcaaaatttttcaccctgccacttcgaatgtttggacgcatgtatagagtattaaatataaacgaaaaaaataactaattatgcatattgcgtataaattgcgagacaaatcttttaagcctaactagcatgatggcccgcgcagattgcgcggctaacatcattatattttctctcatataatagcatatatatttttttattatattattaaaatatattataatgacaatataattttaaattttacaataactttacgaaactactaatgtataatattcatattatattttatatacgtattagttattaattatttttaatatcaaattttagttatttgtaaattatatatatttctatatggactctagactt

SEQ ID NO: 17096 - DNA, 4024 bp, Oryza sativa
  unsure (1)..(4024): unsure at all n locations
nnnnnnnnnnnnnnnnnnnnnnnnnnnnnnnnnnnnnnnnnnnnnnnnnnnnnntttatatgcgaaatctgtaatttgttttgttatagtctatgtttaatacttcaaatatgtgtccatatatttgatgtgacacgttaaaatttttcacccctgatctaaacacagcctaacactacgctagatcggctcacatgtgatgggtcaaaagtacttgtcacggatggcctcatctttaatggattaataaggccataataggtgaggccatcggccgaggcctgtcatatttatttggttacctgtgatgggccaaaatttacacctgactgaggtctacctttgccgggtgcaaattctggccctttatcggtataaatttcagcccaacacaagtaaccatatacatgtgatgggtctcactattttagccaatgattgcaatttcggttgaagttggtcaaagtttatttaaattcagttaaaatttcggtcaaaaaagtgcaaaaaaatcccgaaattttggtcctaccgaaatcaccaaaatttctgccggaatcaaaagtgtaaaccttgtgttctaacctgtcaaaggtgagtttaactcatctctgatgggctcaaacactgacccgttagaggtgttggaaccctatatatacccttaccgtcaattgctttccatctcaatcctgcacacttttcacttttcgggtggtaaggtaggaggcgaatttttgctggatgcatgcatcttattttgcgggctaattaagagtgatcgagattatcacaattaattaaatacaaactgcaactgcatatatacataatacatgcatgcagcgctgcctgtgcttttggagtggctgaaggacgtgacggtggacgtgcaacaaggcgaccgtgctatcagggtgcctcttgtatcgcatctggcgcagcaaagggaccatcagacggggagcacgcctcttcacctggctgcatcgctggaagggtggccatacgtgggcattctttctaaatggttcccagatgtttggccgcggccgaaatcagcagtcgcgctgctgctagaagccaacacatgtgcagcgtatcaaccggacgctgaaggattataccccatacatgtggctgccttggctgacagcctcgacgtagtcaggaccatgctgcagaaatgcccggactgcgccactttgcgagatgccaaagggaggacgttcctccattccgcggttgaggcggagggatacagagtagttgaatatgtctgccgccgaatgccaaaagaattttcgtccgttctgaacatgcaggataacaatggggacaccgccctacaccgagctgtccatctagggaatctgccggtttttaactgcctaactcggaatccgcatgtacatctgaacataccgaacaagtatgagttgacgcctcttgatctttcatggattacagtcccttcatcgttttattatgattcggtaagttactagtgctattgttcttatttcaagaggcagttccctccacccaaactttataagttatccctccatccaaaagtttaatacctatttcattttaccatcaaaactaaagagtaattaactcatccactacgtacaaaaccattaaattatacacaaacaaataagtaataagatggtttctcggattctggtcaacaatttaatttagggactatctatacaacattcaactgaaaattagcctaaaaatctatcaaatgtaactgtaacataattacaatgtaattttcataattacactatatttatactataattacatatgtaatttttataattacactatatttgtactataattacatatgtaacttacatgtaactcacatgtaattatagtataagtaaaatataaattcaaactagatcataaaaatatagtagcccaatgggacagtcactccttcatcccatgaggtcaaagatcgacccctaaatatggttttgtttttcttcctaaaagcacatatcttgatgcgtattaaactgttatagcatgaatctaggacacattcaacggtttagaaagtgaaagatttagccataaaaaatctgtcaacaaatatttagcaattccatttaatttagtatatagagattacaaatacggtttaaacttttggaaaaaccaaaaggtgaaatagattttagacttttgaatggagggagtaatatttttatacaagatcattgcttaaatgatactagtatattaactgttcattctcgcagaatccaaggggtctcatacaattatcattgcaatttgtgggagctccatgcggtgcaagtcgaccggacctcttatcccaaaaacacatcccaaagatagacaacggcaaggtctcggcgcatctaacaaatgcatcgcaaatgctgggcattgtgtccgtacttgtcgcgaccgtgacattcgcgtcagcattcacgttgcccggaggttaccaaaccgggtcggataacgcggcaggcacaccactgcttgctgggagctatgcctttgacgccttcattttatctgacacgctggcattcatttgctcgtgtatggcgaccttcagcctgatcttcgctggggtccctgcaatggacatctctatacgctgcaggtacttcgaaatttctgccctcttgctgcggagttcgggaagaagctttgtggtcgccttcgcgttggggctatacctggtgctggctccagttgctcacacgatcgcgactgcggtctgtgtgattatctttgtgtcttcgctctacgggaattcggaagcctggcagatccttcgtgtcgcagacatggcccgtgctagattgggaactcgaatgcatgtagcatggactttaggactcacgttctataacgtctttgttaatttgtttttgaacttctggtccttcattataatctttggcctcccagcagtaattcggaaggttcatgcaagggagtagttttcgctacctttccatttccttcgttagcattcggttaaaactaaatctccatgtgatcaattagcaagggacgcatgggctatatacatgtatgtaatcatcccatgtacaagattcatgccccttcatgggctatatatatgtatgtaatcatcccacactactgaaaaaattatctttgttggttcactcaaaaatcacattagtcctggtttgagtaaaaaccaggattaaaaatatctttagtcccggtttgaaaacacacaggtattttttgatcattactccaggttagtaacaccaaccggaactaaatattacttttactcctagttcaaaaacatatcagagccctgttatttttagtcccggttggtgtccatctttagtcccgattgtttataccaaccgggtctaaagttaaaaaaagttgcgaaaatccttgcaccgagccacgcgcgctgcctcgaccttatcccctcctcttctcctcctcccctctcattttctcgatctcctccacctcctccccctccccctttcctcccccttcccctctcctcccctctcccctccctcctctgacgatgacgacggcgacagcgggtggcggcccggcggcgcacgatgcggtaggcgggcggcagaggtcgggtcgccaaagcggcagcagcacacggccgacggcctaccctccgccagatccggtgggaggggaggccgggtggcggcggacgggcgaaggcggcctggcggagacggccgggcggcggaggccgagaggcggcacacggccggacggcgtgttttgtgaaaattttatttttggaatgatttgtaatttttgttgtagattattttagattttgggatgattttgtgaatgactcgtggatgtggatgattttgtggatgggctaagaactgtggatgatttgttgtgnnnnnnnnnnnnnnnnnnnnnnnnnnnnnnnnnnnnnnnnnnnnnnnnnnnnnnnnnnnnn

SEQ ID NO: 17097 - DNA, 11242 bp, Oryza sativa
  unsure (1)..(11242): unsure at all n locations
tttacttctaacatgttatcacgcacgttagttgttccacttaacgatagaaggccaagaatacgttcttcgtcaacaggagattggtcgatttcttccaaggtaagaacatgaatcaatttcattcttctacctttgccatcggcatcgagtggctcttccccaaaacctttcgcaagatgccgcaatggtgttgccatgccatggtcactgctaaaaaaaatactcattggtgctggctccaaaggtcttataggtgccagatttggaaccggcacctataccaccgttgccgccaccttcaccaccacacgcgtgcgacgtgaagtaggcgggtgccaggggaggaggggccaccgccgccggcacgcggaggagaaggggggaggaggggtggcggatggagaggacggtggaaaggaggagaccagtgtgagagagatggagaggaggcagtctcgaaaatataaggaccgagaggaaggatgatggcctattttttttaataggtgccggtacctatagttatattataggtgttggtttttttaaaagtccaacacctgtagtattggtacctgtttttctctaaaattgatacctgtaatgtaagtgtaggtgtcgattcttctaaaaaaccgacacatgtagtattggtaccagttttttccctaaaactgacacctatgtgtttaaaggtgccggttctatatttttttcattgtggcagaggtgagaaaaggggtataggtatcggttttaaataaactggtacctatgggccagtcgtagtagtgggtctttggtccgatattgcacggagaaatttggtgccgcccatgcttgcatcttcgttggcaaccccgacggcaccggccttgctagctccggcagcatcggcgccaccaccacagccgacccattttgactggccacggcaaaggcgctggccatccactcaaatgatggcatcaccttacagggggaggatttttttttgaacttttttatttttaaattataaaaacagaccattctaaaacttattacagaatctaaacctttggccatatcaactagtctggcgtggcaaaacaatactgacaccccacacatagcgagcataataattttgtcctactacactagcgagaatagtgtgaccaaataacgttgccacgccagccagaccgacgtgaccaaataacgctgccatactagccagaccaatgtgatagtattattttaccacgccaatctaactggtgtagccaaaaggttcatatcttgaaaataagttttgaaagagtttgttttaaaattaaaaatttaaaaagttcaaaaaataaaataaaaatttgagggagagaacggccgcctgccgaaccccactccattctctccaccgcgtggtgccggaccagacccccctcccccgggtgtgattggtcggtgaccagccgcgcggggctgcacccgcacggtcagttttgcccgccttagtccattagtataactactgctgctacaaatactacaactactactaatactaccacattaccactaccagtaatagtagtaatagtagttctattaatactagtactactactataattatatatatatatatatatatatatatatatatatatatatgcgcgcgcgcaaagtttatatactacgtattaaaaaatttaaaatactaaaaaatatatcatgtatacaaactttgtatatacatatacaaactttatacacacgcatataaagtttgtatatgagcatataaagtttatatacatgtatgtatataaagtttgtatccacacgtataaaaaaccaaaaaaccaaaaaaaaagaaaaagaaaaccagagaaaactattttttttaaaaagaaaaccaaccaaaaaaacccacccacgtgggcttcccacgcgcgagcgactgccccccctctccgcgtgccacgcgtccatccacgcagggggaggggcgcgcgccgcgtgccacgcgtctatccacgcaggggaagggcgcgcggatatccactttttagcggatctgcccccaaaccacgacatatgtcctacttccctgcccacttctacatggatgtgcagccactgggggatggggatgaaagcgatggagtatgtgtagctgtggctgatggcagaatcgcggtatccctcctacgtcgtggccccgggccaatgctcctccctcctcgcgcaatgtgtccacgccccgcccgtctcttgacaaagtgaaaaggtggactctgaagaaaatggcagaacagtttcagagcttcaagggagatctgtaccagaaatatatcctgaaggggcagacaccgaacttcgacacattcccaaagctaagggatcactgggacgagttcgttgcatataagacaggtgaacaagggcaggcgatgatggaaagaaacaaagaaaatgctaccaagaagaagtaccatctccgcttggggtcaggcggctatagcgtcacgatgccgaagtgggaggagatagaggctagcttgcttgagaggggtatcgaaccggcccccgctaattggccggaatgatcgaagttctggtactatgctcacggtggaacgctcaacccagctgatggctccctgatcttcggcgatcagatacgcgagggtgcgcgttgactaacagacgtagtggaagcctcttctcagggcacgttccgaccggacagatagaagcacgagctgttactcgccctgcagactccagagcatccaggacgaacacgagggaaaggagtgattccttggaagattgggttcaaggagcacatccacacgtataggagttggatgaggagcaagagagattccgagggtaagattgcagattttgagttcagggtatcgagccccgagctcagcatgcaagaggaggtggcaaggaaggttgatgaatgtcacgcccagaaattcccgaatagaattccaagcagaatgtgcattaaaatccccgtccaggaccggccggggtacacaaacgacaatgttgacattcagatccacgtcttacaaatatcataaaagtcttacataaatgcagcggaaagaaagaaacacaccaggagctaagccttgactagaactgcagcgggaacaccactccacaggcatcctcgacggcacgggcaaagcctattcctcggagaaaccttcatctgacacatactcgtactctggggttgggaaaagtagagcaagactgagtactacccactgtactcagcaagtcataccggaatagaggcatgatgcagggaatcatcaaagaagagctaaagtggatcatttgcataaagcgagcatttataaacagaagttgaaagattaaacagttgtaataattaattagtattacctatccactgtccaacgctatcccacgttgcaacaggcccaaccatccacctaaactatccaaattttaaagattacactagggtgatactaatcaccggtgaatctggttgacccgcccataaccgcgggcacgactattcgaatagttttactctgatcagaggtgtacaactgtacccacaagacacagccccacaacacgtttccatgcgccgacatgccaccacgacatatcggaaagaggccgtgacaggacccttcgcataaccccctctagccaagcacaccacacctcaggtttcacccccgtccccagcgggcaacgggcagtcccctctcgtgcctaggtgaatccggaagcgacagaggccgtcgcagggcccgccccgctccatcacgcccacccttgcctggatgcgttgactagaggagagctacactacaagcccagccgttgcccacgctggcttgtggtaagtacgataagttcttccagggcatcccgcgaacaggtccttaattgccatgggtgcgaccagcaaaaccatgcacccacaacccaccatgtgatttattttaattaaccaacaccaaagcggtgtcactaatccaacaaaaccattagaaccaacagtctaaacattaataggattttccccattgtgcactagttgaactaagcatggctaagcaatccctggtccaatctctagtcatgttataaccccaagctgacaaagggacaaggtacaacaataacatggctaagacaataggtaaacatcccatagtaacattataaaacaatgcaatatttgaaaggaaacaatagagcatttgcaatataggatcaacatgttcaagtgacaagcatgacttgccttgctctgctgctggaggaacctcggcgactatttcgaagtacaccggagcgtcggaggaaccggaatctagcgacatacaaggcaaacattgcaaacaggctataagactactgaaacagggaacaaaaccatttttaatggattctacacatttttcttgatttactgagacttgaatgggcttaaacggagctcggatgaattagttatgaattttagaagattcactgtgtttattactatacaagaaaaaccttaaatcatttattgcgcaataaatcccagggctgacatcagcacggagggggcgcggcgccggcaagcgggccccaccggtcagcggctcagggggagcggttcaccgtggactgggaccacgcgggtggtccaccgccggtccacgggaccgacggcccagatcgccctcgggccgatcggacgggcggcgatagaggcggccgccgggcttggctcggcatcaaagccgaccggccggccatggctagcggcgacggcgcgcgcgcgaacgcgttgccggcgacggcaaccggcggcagaggcgacggcgcaaaagcgacgcgaaagcggcggcagcggacggcggcaacgaccaaaggcgacggcgagcgcgggcggcggcgacgcacggggaatcggggaagtaaaggaaaggggagggagttcctcaccgaaggggacggcggcgaccggcgacgaggagcgacggagggaagtcgacacgcggccgacggctaccgggacgacctaaagaacgaaaagaaagagattagagaggaagagaggggccataggaggcgggaatactggccgaaggcggcggacatggcaacccttaccgtcgcacgacgggaacggctctccggcgacggacctcgacgaaggaggggtggacggggtggatcttggccacgcgaacccgacggcggcgacggcgcggtgcggcggcgagcctagcggcggctagcggcggccggagtagcggaaacggcggcggcgggtggttgcacggcgcgggagcgatggggagcacgagggagttcggcgagaaagggaaaaagcgagagggagcgacggggaagcttaaataggggaggggagggccggacgtggccgggagaggcgggatttcgccggccaacgtgggaaagtgggggagaagaagattgcgggattcgaaaatcgaatcccggccatctcgggcgctggcgcgggcgggagatatagggtagtgggcgcggggtacacggcgcacgcgcgggcgtggtcgacgtggcccgaagaagccgaaggcgtgccggcggttgcgggcccggcggttgcgggcgcggcgccggctggagtaggaagacgggcccgacaggtgggccccacctgtcggcgaccccgagagaggagggaggcgggacggcctggatgggcctcggcctgcggccggcccaacagggaggagggggaggaaaggagagaatgggccagcggcccattcgaaaaaaaaggaggaaaaagggaggaaaaagagaaagaaaaaggaaaaaggattttccctggaattaaaatattgcttgctcaattttaattggttaaaattatttctagagctctgaaaattccactaaaaatcctgttagtgaatttcgacatgtagaactcaagcaaaattctacatgccaaatccgattattatttgcattactttcttagggttttctcttgatttgcacctgcattttcttggggggtcgtttataaattaaatttttggcttgggaggaaaacttcggggtgtgacaatgaacgcatggccgcacatcggtccaatgatccccagccgaccattcctcctgcaatggtgagcccatcaggaaatcgtagcagctgcgcctcaacggggcaagtaggatcacagagcatggacgccatgcaaacccaggacgaaaccacctgccccgttgatgacatcactcagcggacaccatgtgagctgcatatccccttcaagaacttatcaataaaggtaaactcgtagtttatagattttagatttggccattccgctagttgctgcttatatatgttgattactaataaataacctctcaccacatgaaggtggcgtcgggcatggccatctcaacggacccttcaggtacttaccactacaggccgattccagcaggatactccaaggtcgaagttgagttggtcgaaggcgcgtacgaggacctcgagctggattaccctggaggagacggtgagacgcatctacaagacacaagccacgccattattccatggcgcaagcggtacatcatcctccctgggcgacaagcggcgtctcgtgcactatctcctccggctccgccatctcctcctcaggctcctacaccgtctcctcctcatgctccagcaccgtctccacctcaggctcctgcaccgactcctcctcaggctcctgcaccgactcctccgcaagctcctcttccggcaccttctaagtcaagggccccccaagctccaccacctgcccccacaagggcaacgaagaaggcgaaaattgacgccgccaagaacaaggacccagggtacgattgcacgcaagaggagcttgacgcttacgtggcatcagaagtcaggagacaattcaagcctcgaagtccagaaaagaagattcctatagacccgagtgtcaagaacttcttcaggggtatgtctacacctgccaaggaggccataaagctattggactatgagcgaacactcaagaaagcatcttctggaaagtccaaaccagtccctcagcttggagagcaaccaaactaggagatcgagccgttggtgaccggtgaagattttggaatacaagactttattaatgacaccgggctaactacggatcaattgctaggagacgcaccaatcgaaaaggcggaagtgaaatacatgtacgaactcggtaaaccgcttgtcaagcctgagctgttgcagtccctacccacacaaatgtacaagttccatcagctgtatatggagatgagcgccaccggtagagagatgatcggagcgaggatcagggacacggacttcttgcaaggagatgacattctctggatcaatttcaagggaatctacgaactataccagctggacgccctcgacgtctctattatgagttgctggattttgtaagtatattgttcggttagacttcttactacatctcctttaattaattaggtccttctatataagtagactatatataatatatactcccttttatcgttgtagaatggagattcaaagggcccgatggcgggggttttcgatactggattcattgacccccggaaagtaaacgtcgcaatgctcgaccaatatccgcaagccacagaggacaatctcgtccatctcctgaaggcgcagcattacaagacgttcatactgttgccgtacaacacagagttagtttaattttactgtcttcctataccaaatttcattcccgtacgaacatgctaagtgtttcatatgtaatgcatcccacgcacattgcagattccactgggtgcttttactcttcgacttggaggcctgcaccgtcaacgtatatgactcaatggataaaaaagagtctacgtttgataaggttttcgaacttatagacaggtactgtcataagttcctatgttaattaagaatcttgttatagttaattgctactacgaatcatagctttaaactccatatagggcttggtatcggttccgtcatttggtccgcggcaaatggagagaaagacttaggcggaagttcaaatttcctgtgattacacatgctctacatttatatttctccgattcaaatacatacaagtgtatattaattagatctctcgtcatttatttatagtgcgtaaagcaaaagcagggaactaacttgtgcggctactacgtgtgcgagtattgccactgccttgcagaccaaatcatcaccacaagagagctcgatgtacgtacaaataaattcaaaatttcattacgtatcgatttgttgtttaattactaatcaatttcatacattcatatagtttattcgcatgagggataacctgatcacacacaaggaatttatcgcggtggttcaagaacaacttatgggattcatcaacgaacaaatccttgatcccaagggtgaattctactacgacggaaacacaattcataggtccttagcttctgagatagcgactactactacgtcgaaatcgtagctagctaggacatataatgaattataattaatacatgactatgtttctatatgcatgtgtacacattttctataatgtaaatatatattttagtcatatatatatatatatgcatttgcataacatatatatgtataaatacatatatattatgcatgtacatatgtattgaaacatatataaatataatataatatatatatacatatatatgtattgaaacatatatatatatatgtatggtttatatatatatatataaaccatgcagcaacagggccatgcaaacaaaaaaaagttagctcgatctaacaccaaccggtactaaagatggctcagtcgggcactggatgatcgccggacactggtcgattacgacatccaggagtccacgctccacctcgccgtccgcctccgcggcggcagccgcggccactatccctgcctcgctcccggcctcctcgccctcgcgcgcaagtacatcgagatgaagatgatctgccgcaagtatgcacacgcttccgatccgatcgatccaaaactcaagtggggttaattttgggagtacccctggttaatttgaacatgcatctatctagttcgctccgttcaaacaagacgcagtagctttgtgttgcaaattaagtaaactttgtctttgcatgattgcatcaacggtatgaaatgcgaaaggaaggaatctcaattggtgtgcatctcagctttctgatgattttgattcacagccgccttgtttgcatagttaattagtttcttgattagttgggtggattcttgatgggcataaatgatgaattaattagacgtgtacagttacattattattgagctagaagcctataacccttttgcggcaaatgtattatctgtctgtccttttaatcaacttgtttaactgtttgcctctatgagttttgaaagttttgtcatttgctagccatttacttaagcttgctttactgcttaacttagcaaatcagtcataatggactaaaatctttaggcacaaacttctgactttgccattcatggatgtgctgtctctttctttccctgaagaagctagataagttgttccgctactaacattttcttttcttgcaggtgctatgcacgccttccccccaggtctacaaactgccgcaagaagaagtgtggtcacagcaacaaggtgagccttgttatcaagctatcgaagtgttctttgtgtgggctttcgctgattgtcttattggccatggccgtcttaactgtatccatattcttggcttgagtcatcagtaatcctggcagcatccatgcatgttcttaattagcagcatttcaaccaatgtcttaatttatgcttgtttcagaactgtcattgcttggtatctataaatattcttattaagccatttaggcatcaatacttgcactttgacattatgttgtgtttttcacagttttgaacagtctgtatatagtaagtgtacacttggattcactaggtagatgatagtggatttaaggtgacaaacatgaattccttcattctttgatctgatgtattttacaacattcctgttttctttttcagctaaggcgtaagaaaaagttaaaggactactgaaccatgggaatggaaaagcgaannnnnnnnnnnnnnnnnnnnnnnnnnnnnnnnnnnnnnnnatgggatgtctttaagtcttaacatgatagaactaccgctgcggttagttgaatgagatgtcttagcatgatggaactgctgttattagtatcatactggagtttaactcaagccctagctagtttaacatttactgctgggttatgaaccttgattacccgtttccatatgctaatggtggtttaattttgaagcatggcagttacatgctccagaaaccccggctgaaagttgctgaactttttttttatcacactatggatattactgcatcgtgatggttcggatagaaatgctagttgcagatgaacattgcaaatattaatcttctggatgcaatgttccctagctgtctactgtgtatcgactagaagtgatttttgagaagataccgagaggtgcgtaaaatttgatatattttggtaccactaatagaaggtatcaaatctacgctaaattaaaaaaattaatatctttttatgtgaatgaattttagtatattttatatttcgtcgtaggttgtttatgagtaattcaggacgaaggaagtaggtaagtgtgtatttagttcgcgaaaagaaaattgttgggtgtcacatcggacgtttgaccggatgtcggaaggggttttcggacatgaacgaaaaaactaatttcataactcgcctggaaattaccgtgagatgaatttattaagcctaattaatccatccttagcagatgtgggttaccgtagcacttatggctaatcatggactaattagtctcaaaagatttgtctcgcgattttcatacataattagttttttatctatatttaatactccatatatgtgtcaaagattcgatgtgacgtttttggaaaaaaaattgggaactaaacaaggacaagcatcacacgtttttgaaaattttttttggaactaaacaaggacgagcg

SEQ ID NO: 17098 - DNA, 4092 bp, Oryza sativa
  unsure (1)..(4092): unsure at all n locations
nnnnnnnnnnnnnnnnnnnnnnnnnnnnnnnnnnnnttcggacatgaacgaaaaaactaatttcataactcgcctggaaattaccgtgagatgaatttattaagcctaattaatccatccttagcagatgtgggttaccgtagcacttatggctaatcatggactaattagtctcaaaagatttgtctcgcgattttcatacataattagttttttatctatatttaatactccatatatgtgtcaaagattcgatgtgacgtttttggaaaaaaaattgggaactaaacaaggacaagcatcacacgtttttgaaaattttttttggaactaaacaaggacgagcatcaccaacagtctacctatcttattcccaaaactgatttggagggattttagccaaaaaaaaaacagcttcaacggatcccctactatcctacccgagttttagagttcccttctcccgattccttgttcagtttgtatacggacactaaagttgctcccaatctcgccctcccgcctctctcctcccgttcccacgcgtgggagatagcgatctttctgagcgtgaaagaaaaaaaacggaattttctcctcccgttcctgcgcgtgggagatagcgatctttcggcgcatgaaagaaaaaaaatggaattttccgttggtagtttaacagaagggcccacttttaagttttggggattgaatttagactatctgttagaggaggagttttttcactttctattcttctatctactttatagttcaacaaatgctttcactcattctttcattcatcactcaactattcaaatcatctggtgaaaatccaacggtccaaatagatcactagcctcccacctccatcgaacgcgtcatcgcgctgcccctaatcgcctccctcaatcccgcgccgcatcctcctcccttcctctctctctctcgcctatcgcctcgcctcccccagacgccgccgccaccgtcgcctcccccagacgctgtcgcctcgcctcgcccgccctatcgagcccaccccctcccttcctcactctcgcgcctcgccggggggcgggactggcatcctcaccggcaatggcgatggctactcggccgccttctcctggtgaacagtgggggcccacctcgcgtttaggaagcccgtggtggtgctggtggtggtaccatcggcaggccctggaagcgttgtagaagcggtggtcgcttgccatgcctccggccgagctccacggcggtgcccatcatcccttcaatcgtgcccactctccagcatcaaagctccatcatcgcccccatcctcgccgcgttctccgcatcttttgctagacgcggcatgctctccacgaatccaccaatggcatgccttgcctcactggctcacttctgagtcatcgtcctgactatgccggctttgccctccatcttgttgagattttacaggttggttggcgaccttggaccttggtcatttcttttcttgattctcccctcatgttacatgtatatgtggttattcatgctttctgcacaccttttcttgattcttctatcatgttacatgtatctgtggttattcatgctttctgcagtctgcagatctctgatatccaaatacgatatgtccgcttcccacgatactaccaaatgttgctaatagtgatcagatttacatagtatgttatgcctggaaataaatagagaatgcactgatcaacttaaattcccggttttttgttacagaaaatatcttcttcatttgaatggagatgtgaccctgtatgctcttgcttcatgctagcagtgcatggcatgcatttgacattttttttaaagcgggcaattaatatatggatcctctaatctttagtaattttattggtttcttttcgagaataaaagagattgggcacactccaggactgattcacgcacatacggatttatgtggttgtctgtcctcgtaatggtaattctgtgcattgcactatcgcagttcttctttttcgaagccttttctaggtttccgttatcaaaagatatctaatttgcagaatatatactaggtggtggagattttatttccttcaggacatagatgttgcaagctattgcaaaagcttatgcctctaaacaatcatattcttgcagagtggaaatttaatctgggggtaaatcttgcatatttctttgtttcagcagcagttattacgctcacattttttctagcaatgttggttccatgtgcacaacttactattaactttcaatgtgacagttttaacatattcgatggcgctgaacgtaacatcccaaatcatgaattgctggtggccaggtgaagccacctaatggttctcaaatcttagttgtgatgtggcggtgatgagcaagcttggacaagagcccaaataagatatgacttaaagtggtgcaagttaatcaggacagcaaagacgcttagtcttatgaagaaatgtcacatatacaggaaaggatgagattggccaaaatgtttttttagtcttctgatttgcagatgcttgattggagttatcctgctcctgccacaaacaggaaatggtaagaactaagtagagtgtatactcacatgcatatatatcattgagttgggtgattctaaattaatatttggcacattgtagaaaatattggtttcaagctattttttttatcaagcatacatgacctaaaaggcatatggtttctatcgtaacggttgataactccatattgatctgttctttagaaattcatgaaatagacatttgcatgacatctggaatggttatcttctttgttgaatgttctttcaagaacttgcacctttttgtttaatcttgtaaatttgatgtgtaattgagcttgtagggtgagagaatcaagtgtgattgagcagatctatactctatgtactgagattgtgtagagtaaagacgatgtagtatttccttttataatacaatttgtcacgcttcatttatttttcttatggagcacatgttgatttcaatcattggaatttgttctaccctttggtatgaaatttctcttactgattaaatgatcttggtatgaaatttcccttttggtatggaatttgttatacctgtcctgatgtgatgtccactgctagagtcctactatttagcagaaaatcagtgagataattgatagtcccccttgaccataatggtgtatcaaatctgttctgggacaaggtaggcaacatggcatcaagccactccaaaggacaaaatgttgctttgtgacaagtgaataatacagccactttctggtatcgagtctaggttgcccattttttatttttcttgattttttttcatgttcttaaaaaaatgcttcaacagaaggatcatttgagattaagaaatgatcctttgaagatttttgtttttttgctgttaaagcctcatcatatatcttgctaattatgctatatgagcaatcatacaatcaattatttatgcaaagatgattaagtggaacattcaagattcaaagtggtatataatcaagtattcttgctgccattgcaagtatattaattagatcactgctggcaattggatgttgaaaatgcaataaaaatgttgaggcatggagatttatggtatttgacattatggcccatttgttttattggtcaatggcatgtgtcttgcccatcagcactgtaaatttgtaggttgcgaaaccaataaactaattagttgggctattttattagttactgaagtgtggaaaatgaactgcagatcacttttttttttcaggagagctgaacatcattttatagataagcataaatcttttttatgaaacaacactgaactattttatgttatgtgcaagtgcaacccccacaaagtgatttttttttaaaaaaatattttggttccaatatattaggtttaatttgtatgttgatcataacgtgcatcggtgtgcagaggctatactgctcaannnnnnnnnnnnnnnnnnnnnnnnnnnnnnnnnnnnnnnnnnnnnnnnnnnnnnnnnnnn

SEQ ID NO: 17099 - DNA, 3271 bp, Oryza sativa
gctgtttctcctcaggagagaatgagttggtgtagatgcttctttcccttgtcattatgttttcttccctgaattcttttatctgctcttccatttcatgccatgttgatatcatccccatgtgatatggtgacaatgttttcagtattctgccattcacttgttaagatctagaagattaaggtatttttcgaatatctattcattggttgccttgtcccttgaacctcatagatgggaatcattatcaatctatcatcctaaatataaactactccttactgcgcatgatagccattctattttgagttttatagagccatgatacaatgtctgtaagagataagcgacggatacaccaccgccgccatctgtcaaggccttgagaggccgagaatattctctctcggtattacgaaccagctcagaaacatactctataatgtccattcaaaaacatactctgtaatttcagagaggagtaagtgccaatatagtggttttaattaacatccaaacaatatagatagaatgcgagcatgtgatacttctttgtttataacaattttgtgtatcaatcttttttgcgaatttatctcattctagacttggcaaaatatgttttctttcttacggttgttcgatatatatcattaaacattgccgtagcgttagcacgagcggattactagttttcagtttagaaaaaaatatttttttagagagagataatagataatctgttgctgatgctctaaatattgaaggagtctaacgagtctgacgggcgacggtcgacggcccagctccgtttcattcggtggagtcttcgccgtttggcgatagacggctgggccctctccggctctccgccaacctcgcttctccccgcgatgcgaccccgaatcccgccgccggccggggctcttgctccgctcccccctcgaccaggggcctcctcttaccttccgaggccgtctgcatcccatcagatcccgacctcccgtgctccgcctgccgacgccggccagagtgctccaggagcaaaccaaccagaggccagagccactggcctgccagggaatggtaatacgccggctccggcctgagaagcgcatcctgttgatgaagaagaagaagaataggaagaatccaaggcaggtagtatgggtattgtcccatcttaaattttatattcagcctgcaacctagcattttgatctgtttcgcctccaaatgagacgattatcagcagtggtaggtagaggattattgtattacttgtgggaaaaccataatattaatgtatgctactgttggtactggggagtgagaactcgcccagttggaactgcccacgatttcggcttcgtttcatgacaagagtaatcaaattgaccaaatgcaggcctcccaggaatttgaagatgcagatatagttgaccttcacacggacgaccttgcaaccgcttctacctacctgaaatatgattgatgatagtagtttcttcctcagctgcacttcttccacctcctccaatctgcacttgtgcagcctgtgacgcctgagaatacatcaagtgaggctccatttcgtaactgctcgtcgctcgtccgtgcaggagcctattaacctacaggtaccaaaatcgaatttcctgtcagttctaatttcctcctctatttctactttacttttgccaaaacatgatatagtagagtgcccgacatgggatgcgtaggaaacgctcattcttgaagttgaaccgattttgaaacttaaaaggggactgttgctatttgaagaccctattatacatagcatagcgacaaccttctccaaacttgttactaacagactagcctcttaattctattcagaaatagcatatcaagatcatagaaaggagaagataaaaaaacgaagtccctttttttacatcaggaacctttctagtgttccattggcatccccatcactccgccaaaaagaactttatcaaatactagttccttgcagctagcagtatagagcactagtacgttatgagtaactataataaaattgtcatcctccaaactgtcacccttcaattattatcgttgattcagttttctggcagattcaagttccactagccccattcctgtgatgattgatcagattttgcacctccctctgcgtataattggttatttccttcatcttaatggccaatgtagttggtgttagggatcgttcttacacctttttccaaaagcaagaaaatttggttttaaaaaaacatggaaaatatttgccatgcacatacatataacatagggagaagaataaaaggggtaaaatcctaaaacataggccaactgggtgagcaatgtttatgcatataaagccttcattctttcatataaaatatttttctagatctgtactgctataaataatatttatcatatatatttatgtgacaactgctaaaattagctctgtcttgccacatttgtttcttcaaattaaaattgtctcatcttctattcgcaataaaactaaccagaaattttacacatgacttcctcagaaatcagaaaagtattccatgttttctttttttttggctttgcacattataaactacagaaaaaagatatatagtgatttcagtaatgcaccatcttcatgaatttgcaggcacaatataactatatcttctgttcactcttatgggagattggtatgaacaattttcacaatcttttaaggatgctgctaaggaaatgttggcaaaaacagatattgatccaaacgttaagtgcttcacaagaaagcagatgaagcgcatttcaaacaactacagaactatccttgggaaagggggcttttctgtggtgtacaagggtaggctcaatgatggccgtgcagtggcagtcaaaaaatataattggaaaacacagaaaaaggagttcacaaaagaggtaatcatacagtctcagtttagccataagaacattgttaggctattggggtgttgtgttgaggcagatgctccaatgttggtcactgagtttgtccccaatggtaacctttccaaccttctgcacagcaacagtagccagtttcctgtttcattagggacacgcttacagattgcactggatgtagcagaagcacttgtatatatgcattcctcccaaaatcatccaatccttcatggagatgtcaagccttcaaacattcttttgggtgacaaggatgtggcaaaactctgtgact

SEQ ID NO: 17100 - DNA, 1381 bp, Oryza sativa
cttgcactcacttggcattgtgcatggcaatgtcagcactgtcaatatattgctggatgatctttcggtactcaaagtgattagccgcaattacccagtaaagattgcaggctatggaacatcagggctccctgacattgacaaggcacagcacacaggattcttcatggaggattcgcttgtaaccagtcatgggaaggagcatgacgtatactgtttcggtcttgttctcctaacgctcttcacatggaagaaggtgtcactgcaagaggcggataccgtgtttgagcagctctgggacattggaccgccacatgatgtgaattccgagcctgagaaacctgggcaacagctcaaggaagccatccttagatgccgtcatcttgaggaggttaagagcctggtttcacggtgtctgacgtccgaggtgacgaagagaccatccatggtggaagtagcaaaacatctcaagaacataaatgatttacatgatagcacagcttgccatgagctggcgatttatcaatctcgaatgctttcgggctaggctaggctgcaagtagcagtcgtacatggttcttctttgagtaaattaaggtgccgtagtagatgctataatgcaagcgccaagcaacatattacatatgtgtattttatatcccgacaaagaaaaaaagacatgtgtattgcatatattttgtaacagcaacggatgtttgtcatgttgattctcgtggcgctgctgccatataatgttgattgacagatccttggggaaccaacggatgaactaatggacctctcggcatcctttgccaatgactcttgcttcttctgaggtttggtggctctttcttgtttctaattcttattcagtgcatttgcctacatctggccctttggcctttctttcttgtggccgattttgctcgatctttattttttgtgtaacagaagaaatttactacggctcatttgctccagtgcatgcaggtccttgtggccctttggatggtactgtttcttgtatttatgtatttgtgaaaatttccagttttaacctctcttgtggccttgtgggctccaggtggaagtgtgtctggggtaaaaaaatcttttgaaaggttttgccttaaaagagtttccaaagttcatttccatatgtggagggatgatggtcctgattgtaaatttgtaattatacacataataatttgctatccttacgatgacaccattgctagggccggtcctgacattttggaggccctaggcgaactgcgaacttacactatgagcccttaagaaattaatgattttttttacttctaatatatatactctatataaagcacattgatttatcatagagtgacacaga

SEQ ID NO: 17101 - DNA, 4379 bp, Oryza sativa
  unsure (1)..(4379): unsure at all n locations
tagtcccggttgtttataccaaccgggagtaaaaataattggggtctgtcttgaaccccatgacttattgaaccgggattaaaaatgatctaacaccaaccgggactaaagatcaaaaagtacccctcaacttttaaaccgggactaaagatgctttttagtcccggtttttattagaaccgggactattgtggaatttggctgaccgaccaaagatggtttctccaccagtattggttgacttctagttctgcgacataccttcagttcaggagcgcctgagaggagaggcgatgacgatcagtcgatcacaggaatcaaaatcaggcgggcggcaggcagccaggcaccaccgcacccaccatgggccaccagccaccaggcaggcaagcagccatgccgcctccttaggcgggtcggcgatggcaatcagctgattaggcgcactggcgctagagcctagaggtggcaactgcggcatggcgcactctcggctttcgcggtcgcggattagggcattggcgattcggcgacgaaccgacacggctcgatcttgggtctcgcgagtcatggtgtggacgacagacaaagcgacgcgcctctggctcctgctgatgatcgatcgcacgcgcgactgggttactaggctacggctgggctaggagaaaggaggggggggtactccatcctctttagccgatgtcgtatgtcgacatctgcgcgacgacgaggatgacctggagccatcagcggcgcggattggggctgcggtggtgcggagcgtcggcgatgtatggagcaggcaggatgagacgacggcagggggcggcggtcgaggggggcgcgggtataggggaaggctctatgagggaggagggggagtcggtggcggcgggtgacggattggggtggcgccgtttttttttgttgcggaggaatcgtgtgcgcttttttttcggaagaggagttcgtcgctctcaacgtgtcgatgtacgtcgcatgtctaccttggcttcaccatcaccacgtagtagagataactgtgccatgtgtaattgtattgtaaacatatgaaatttccggtgtattaaattagagcccacagctgttcattattttctgatgaaattacacccgtactgggccgagtcgcgcatcccccgagtcccgagtcgcggtcgcgcatcgcctctacgcgagggtgcaaagacagaaggagggatgactgaggcagcggcggtggcagtggtgccggctgcctcctctctcgcgactagggcgccaggcggaggtttgggcggcgccggctggaggtttggacggctgagggctcacggcggcacttggcagtgggagcggctccccacagcattggaggagtgtggcggctctgcatagaagatttggtgcaaggtaatcnaaaccctagactctctccctcaaaccctagacatctcaaatctggttcattttttgggattgattgcctggatgctggttaaaatttccgatatctgtgtctattattgcttgattttttctgtatacttcaaccacattatcactgtacttgccaacttagatttctagaaagatttggtcagcaaaatttagtaccaacttagattggatacttgtactatcgatccatagatatagtttacatgagatgtacaccaaaccaacttgtgaaacaacaaagaaaaccaactgtaacatcgaggaaaaaaatactattcaacacctttgagacgacagagggtgaggtgcacacctttaataaggcaatgcacctcatgtgtaagcctgccagtggggcgggtttgatttggtgaaatgggctggatgctgatttggatggtagtggttggattaattttgaattggagcgggttggcctgtgaagaattgtggtttggactggagtggatgcgggatggcctgtgaggacaatccatggactcagcccatgggttagccagtgcacctgtgcactgcgtgccgccacgcgcggcgcagagcgctgtcaccgccgagcgccaccaccgctgagcaccgttcaccgccaccgccgagcgccgtcaccgccgttcgccgccaccatcgccggactcactccccggtctgcgaggaggcaaccgagaaggaaggtcgttttaggcctcgtcaagaagagggatcgggcaggcacagtcgcttggcatcccgctctccaccctcgacgaccacctgcgcatcgacctcgccatcgacagcgctgaggttttgaccttttctttcacttctttttgattaattcagttccatgctgattgtttgtcctgcaatcccttctacctttgctaacttccctcgcgagaaaaaaaaagttgtagctttatggagaaagtaggacaaaaaaaaagaaaacttatatggttgtggctaaggaacttaaattggcagctcatgcaggaggtcacgttccagattatgaaggagagaacagtcttagttgtcagttcttgattatgctgttagtggcatgaacttcagtggtagtcaaccatgcaaaaaatttgcccccattgtactcctggatggttggaggacaatctgtcttttttttttttgtcatgcagattagctagtagcattcgagagggtctatctttgtcattttctttttctgctgtgtagatttgcatctgaaaagtggataatttagcaatatgtctctctgttgtaaaggggtggataggaactagtaccaagtaaataatttaatatgatgctttaattgtaatgataaatccagcaagattataccatgatttgcaaatattaatcattcccatctgtaatatatgtcattagtaaaaggaaacttaggcgtatgttggtccaaagtgtcatatattgataactagagctttatgttggatctgaatgactatctcctaaatcattgccaggtctggtagtatgagtgttaatttcatatatgcaaagaaccatattgccagaagcaaaattgttcccgccaacactccgaccacataaaaattcatgaagtatttttgtggaacagtaaacttctgcagattggaaaagatcaattcgagattatcagaaaaatacagaagttgaatatgagatgaactacaccattagggatcctcaattttctggaatggtatcttagcatggatgaaatattttatcatcagctcttcagttttttttaggatcaaacatgaaattttccacgggttgtttcctaactgttgctacctatttctaacttcacaatcaactagtggacaagattcacaaaatatggtttatgagatggctggttcctgattttctagttgatgataacattaatccacaatatttacactgtgctttttgaagaccatctatcatgataagcttttgctcaaaatgttccctcacttttgctattttacatgtttgagatttgtgaagacaattcatggctagagctattagcagatgaagtttcagaattatgcatagacatgcttacatttactacttgtgctaaaaactagtgaaatgataagcacaatgcaaccatgacaatatcatgtagtacagtataaacagagataagtgtgaaaagtaataagattagtgataatcaacagagttaatagaccaaatggtgtagatgaacttgcataataatccaaatatccagtaatagctttgataatccaataatcaacagagatttgaattatttatatttttattagcaactttcaaactgtaagtgttgattttagtcgaattgtgatgctatgagatataatctattatattattaaaggaatagaaaaaggagcctccacgttcgctctcatagcctagaaattctcacattagtcggagaaaaagaaaaacagagtccatatagaaatacaatttagaaatagctaaattcggaattaaaaaataaggaatattaaaagaggagactagagtccatatagaaatacaatttagaaatagttgaaattcggaattaaaaaataaggaatattagaagaggagactagagtccatatagaaatacaattagaaaataactgaaattcagaattaaaaataaggaatattagaagtagagtataaaaataaggaatattagaagtagagtatagagttcatatagaaatacaattaggaaataatagaaatttagaattaaaaataaggaatattagaagaggagactagagtccatatagaaatacaatttagaaatagttgaaattcgaaattaaaaataaggaatattagaagaggagattagagtccatatagaaatacaattaggaaataactgaaattcggaattaaaaata

SEQ ID NO: 17102 - DNA, 5074 bp, Oryza sativa
  unsure (1)..(5074): unsure at all n locations
atatagaaatacaattaggaaataatagaaattcggaattaaaaataaggaatattagaagtagagtatagagtccatatagaaatacaatttggaaataattgaaattcggaattaaaaataaggaatattagaattagagtatagagtccatatagaaatacaatttagaaataatagaaatttagaattaaaaataaggaatattaaaagtagagtatagagtttatatagaaatataattaggaaatagttgaaattcggaattaaaaataaggaatattaggagtagagtatagagtccatataggaatttaaaactaactaaaattcggaataaacataataaaattaaaagtagagtttagagtccgtataaaaatacaatttacaaataactaaaatttgaaattaagaaaaacatgggaagaagagtttaaagtcaatataggaatacaatttagaagtaactaaaattcaaaattaaaaattaaagaatattgaaagatgagtttagagtccacatagaaatataattagaaataataaaaatttagaaataaaaataaataatattggaaaaagagcctagagtctatatagaaatacaatttacagaaaattcgaaattaaaaaaaaattaaagacgagtctagagtccatataggaatatatataatttacaaataactaaaatttgatattaaaaataattaataaataacacgtatataaaatacaatatcaatattacacattggtagtattggtagttttgtaatgttattgtgaaatttaaagttatgttgtcaatttaatatattttagtaatataatgagaaaacatatatgctactatatgagataaaatataatgatgttagccgcacaatctgcgcgggccaccatgctagttgctttattatgtcataatccgagcaaattttgtgggctcacggtgttataaaatttttgaacatgaagtaggaacacccaacaagaaattcgttataaaatttttgaacatgaagtaggaacacccaaaaagaaattcctggagttgccattgcggcgtcgccttccatggagagcgagggctggcctgccctccagcctctgctgtgcttcgcctggatcgccgccacactccccatcattgccgctgcgctgccaatccccacggccgttggaggtcacctccttcgccggctgctctcggccttctcctcccgcggcaagaccgtgaggccctcccccgcctcatcctctggttcctcctcttctaaggcggtaagatcggttcaaggtgccgcaacacctatttgctgcttcgccttttctgttctcattggactatcgcatggagttcgtatgattccttggtaaacgtaacttggttagaccttcttaagttaaacggaacttgttcaaagcaaatataagtttgggttgtttaagtccaaagtagctagctactgttttgtagtgtttagttgatgcaaatctgaaatactatcgattgatcttgagaagatgataacattttgaagaaattcgttcttaatcgttggggaaccactcccgagttctggacttaaaacaaattttttaattggtgtttgtcgacatgatacagtcagtttttctgtcaacttgaacattcagttatgctaacttagctatacaaaaaatacataccaagccagttttgtgagtagaaactaacattatatagtaggatcgaattgattcctcatcggtttttcttgagcaattgttcatccaattgatgatcaattgcacatgagaacactcaccaaatctgtagttcatctcatattcaacttatgtataattctgataatctcaaattgatcttttccaatctgcagaagttcactgttccacaaaaatacttcatgcatttttatgtggtcggagtgctggcgacaacaaatttgcttctggcaatatgggtctatgcatatatgaaaattgacaccattattgcttgagtcatcaagtattccacaattttcagtcatcttgtaggctcaaaatcattctcttttggctcgtgtcgctcgcgcaccatgggacacaagtatcgtgtttgccgaacagtatttgcacttctattgatggaagtcaagtgctgagacgactatattgagactgacatgtgttccactacagtcctgctcggatgcatattgtaggatatttgacaggtctattgtaagctccatcttgtttatatcttttatgttctagatctccatgcacatttgttgtaaaaatagcccccccccccaaccctttttggaaagggtagttantcatgtcctttactttattctgttgttatgtnacatgattatgcttaaaggtttatanataattcttgtatgcagtttctgcagctcatacatgtaggttgtccacaaaatatacacccgtctaatgagttaatttactgcatgatttttcattgacctgaactaataaaaagaaataccacttcgttagaaaatagcccaagtgatgctgataactacactgttcaattcttgacattttatttgctttcttctgccacagtgcttatattaggaagaggatatgcattcatgctaccgatgataattttttcatattattgttgttgtacttttgttttcatgtataacattttcagattgacttatagtttggtttttcttcatgccagctactatgtagctgcaccattatctctcgctagctcttgtattcctgaagcagcagagtattttcaaggtcaagtacctgagttcgtagtaaagggtcgtgcgagaatgccagatctagtaattgattcatcatctctactacagcctcttctaaagttggggtggacccagtggataggtgctgttatattcatttggggttccctccatcagatccgttgccatgcaattcttgtaagtatctgctctctaatgtccctagatatactagcaagtttttttttacatatatcggcagcatcagaaatcttcctaaggaagaaaaagaaaagaatgaaataaatccacccatatgctgtaagttggaactgtcaaactgcaactgcaaccataacttgttagtgtaaagctgaaggtatggcttgctggaactgttctattttttgagagggtggagcccatcaggcttaaggaaccccatttacacaaattgcttggtcaatcaacatcaggaatcttccatgaaatgccaatcatatttaatgggttatgcatgtttttctgtttctgtatgtcagaaactgtggtattattcatcgttgtcttggaaacttctaggctgcggttaatattttgaatttcatggtttattttttattgcttttacagggatcgttgcgtgaacacaaagattatgatgaatatgtaattccttgtggtgactgctttaatcgggtctcttgtcctcattaccttgctgaactagtgagtgtttttcctatgtcctcattttcagtatgtggcatatactgttttgcaaaatatggcaggtcttgttactctgcttatttaacaacgtcaagttagattaggcctatcaatattttcttgggtttgtcaataaaaatcatcttgggaaagtttggacggattccaattggtggaagcactggactgagtgtctgagtagcttctggtccagcttcaactcctggctggaataggttgggggagaagcagagaacttgtatgttgcttttgctgggatttagagtttttacacggaagctgaattccagtgcagacttctcatcaaatttgttctgttacccatttcatcaccgtagttctctgagtgcagtaccatctgagagtgaatatgtccttttagtatcacccgtactgacatatgcgaacattctttgcatggcttaaagatgataaaactggataatatcttttgagttttcatattatctcacttgtgtgaagtaactagatgattctaacatgacagcacatatgtttccgtgtagcagaattggtgctttttgacttgacagttgatgcagtagggcactgagctactaaaagagctcctgtggttttaaattattatggcattaacatttacagttactttggcttgtaggtaatatattttggcatgttggttgctagtggtgcagaagacattccagtgtggttcctgttcatatttgtggtacgccgtacagtaactttttgaacaaagatactcagaatccaactaacgtgcaattatcatctacatttagtttcttttgtttttgttccagtagattgaactatcttttttcttttttcatttttgcagatcacgaacctgtcatttgcagcagtagaaacttacaattggtatcttcaaaagtttgaagactatcctcgctctcgctatgctatcattccatttgtatgctagtgtctacgaaatggctacattatgtaaagcttatgtatttgcacacaattacgacatgtaacttagcttgatgtaaatgtgataacaatcatacaacgtactaccgtagaggctggaagtttaatatcagagcacctatgtacgttgccagtagtaatctttgtgcttctacagatttaaattacatgccaattatgtcatcgatgaaacatgtttggcattttaaacttaaatgttctgcaactcaaagtgatctagggtatgttgtgctcgtcctttgtataaggaaaaaagtgccgtcatgtttagagacccaaatacctgatctggtctggaaaacggaagacttctggatttatcagagcgataccatttgaactttaagctttaggcagatgagttgctataattttctcaaccaaccacaagtttaatacagtgacaaggtcatcatcctctaaagtagcacgccgtcaaagcaaattaacagaaggatagcctactaaaagaagaagctgagctgatgaaagtgagcaagaggtgccagccaccaaccctcacacctggccggtatatgggggtgagaggcgtttagttagaa

SEQ ID NO: 17103 - DNA, 6447 bp, Oryza sativa
  unsure (1)..(6447): unsure at all n locations
nnnnnnnnnnnnnnnnnnnnnnnnnnnnnnnnnnnnnnnnnnnnnnnnnnnnnnntttgcacacaattacgacatgtaacttagcttgatgtaaatgtgataacaatcatacaacgtactaccgtagaggctggaagtttaatatcagagcacctatgtacgttgccagtagtaatctttgtgcttctacagatttaaattacatgccaattatgtcatcgatgaaacatgtttggcattttaaacttaaatgttctgcaactcaaagtgatctagggtatgttgtgctcgtcctttgtataaggaaaaaagtgccgtcatgtttagagacccaaatacctgatctggtctggaaaacggaagacttctggatttatcagagcgataccatttgaactttaagctttaggcagatgagttgctataattttctcaaccaaccacaagtttaatacagtgacaaggtcatcatcctctaaagtagcacgccgtcaaagcaaattaacagaaggatagcctactaaaagaagaagctgagctgatgaaagtgagcaagaggtgccagccaccaaccctcacacctggccggtatatgggggtgagaggcgtttagttagaaagcacatccactgatccgcgagaggggacatgctccttgtcttttctcggctaatcctccctcgtggacatgtattcaatcacattgccgactcggatcttcttttgaagggagagcgctacgcgtcggacatacggcgtgagacgaaaaatcggacgcatccatgagccgtctgatccgcacacacgctatcagccacccgacgtcatcaagcattcatacatgcaaaactattttaaactattattttaaaaaatatttatccaaatcatgattcgattgcactattaaattcgttgcaattaaatctttaaaataagaccacacatggatatattccgatgaaaaaaatagcttattattgattttttttttaaatgttgcatgttattccaccaagtatattggaattttttcactagttagatcgaaaatgtttcaatcgtttaaatcgagcattgtttcaccttatatgaaaacaatgttttagaaaatagcgaaagaatgtttcaagtcaccacaacatttgatccatataaagtaaaacattataagtacactaggtgaaatattttttgtggaacaaagaatgaaatgaattatcttaatagagagattccataatatgtggttgatttattgcaaaagaatttttcaattcgctgcaacattagatctatacatagtgaaacattgtaagtacactaggtgaaacatttttagtggaacattgtaaatacttattgaaacacttaaccaatacatatgcaacatttacaaataaactagtgaaacacaataaactacttactgaaacatacaaatagcaccatgagatacattaaagaaaagatatatacattgtgacaataataaatatgtgcaacataatagaattttagctgaaacatctgattctcacatatgaaacattaagtttaattggttgaaacatatgtgtgtgtttttattataatatagttatgtgagatcttgttgtaaagatttaattataacgaatacaatggtgtaatcggattgtagattggatgagtaatctagaagaaaaatcgttttcaaatttgctaaaagggtgttatgtacatgcaaataacctcgtgtcatctctcctttatgcatattaatgctcagaaaggaagcatatgtaacagatagaggatctgacaaaggctgtatgcggcaaaatcataataagaggtgtccgatttttttctcaagatcgaacgatcggattgaagcattttccttcttttaagtgttgtttactacagctcttactagtataatccttgttcttttgcacggctaaaacactagctcagactactcaacgacagacaccatcagagctgaactttccctggttcaggtgttgggatatggaattagaatctatccgtggaactcagaaaaagaaatttgcaattgccactgttttatcagcgagttgctagtgcttgttcgtttgctcgctgcactatttactttataggagcgtggtgacgttgcaggagttggtgccggaaatccgttaactgaaactaatgagataaactcagaactgatagtgaaatgccgatacagtagagtaggcgcctgaaaactgacgaacataaggcataattggaatccgacgtttctcaaggttcgttcgtcaaaattttcagcttcgatttccaacgtcactgaattggatgccaccgtgtgtatagcctaaacatctcatttttaatgagagaagagatcaaattcggcatcgatcaattcgatggtttcttgatggtcctacgatgagaagttgagaacgatgtgtgtgtgatgtgagagccagtccaacctctgccgttttggacggctttgccacgggcagcggacaataagcgaaaacgcgacccaaaccttctttcggcagctgcctctcgtcgtcgttttcccgctcattttctgcatttcggctgggacttggagtcgttttcttctacccatgaggacacgcgaggtctccgctcggagtgtgtgacagtgtgagactcatccaagagcaacaatggtgtgatttctcttacgctttgtacatccacaagttgacatttattgttttttttcgctctccatatttcttcacgattcaatcaatctgccatggtgaggtcatggactaactcaccaaccatgagtccatgacctcaccgccattattcagtttctgtgtattgggcttcttgtttaagaatttgagatgcgtccttgatgctttgtgatgaatagtggaaacttggatctaggaatgcttaattattttcagattattcacctgattatttgcacaatgttggaaaaaataacattttggggacaaaaaaacattcttctattgtatacttagaccacttattttaaattatttattaatgttgtcgaatgacaactgtgtccgtcgaagaacgtggttcgctcttggtggaaataaagcagaaaattaatatttttattgaaattgttgggatcctcccattacatgccctatggggcctatttttaggcttagtacatgcccctgcacgctagggttactaagtagagagaaatttatatggctacccttatgatagtaacatttatgagggtaattatagacaatatgaccttgggcccttatatgggccactaaatgggcctcatagggccattcggcctgcttggttattgaggctacagcttcgggggcgaaagggctcggccctgtggtgaaggcctcaggcttcgcctagcgcttcaccctgaagtccttgtctttgcgatcctcggatctctaccgcatgtggtacgccttggtggttgtggatggcgtttcggtgacatggtcgaaggtcctcatggcatgcctgcaacaagcccttcacgggtaaggatgagtagtgagcttcggtcgagaccgtgtaaagccccgggtatggcatgaggcgccccctttcggccaatattcccgtcgaaacctatctacttttgagaaaaaaaaagtcataagtgaaaaaatctatttccttttgtcgacgtttgatgtcgcgattccggtatttgcatagtatggggatcgttggtactaggatatacacgagactggggtaaaagagatggagacagcgatttttatacaggttcgggcccctgcattgtcaggtaataaccctatatcctgttggtcgaagccggttgttgctcttattcatcataatcacaccagtacaatatttggggtagcctatctaactgttgtcgacatggcggtctgaaggtctgactcgtagtcgacaacagggtagctttcctcctcgagtccgcatccggcgagatcagagacaacgctatatctctcctgacggtatccgtaggcaccgtaggggactagctatgcctatctctgaagtcgatatctggcgtcttgtcttggcgtatgttggcttgtatgttgtggcttctgttgttccgtgtcccctctcctcctagggagccttatatttatacccataggtgtccccttgtccaagtagaactagggaaaccaatatagatacaatccgagtagtccttgtcgtttccatgtagaactctattcatccttccttatgcagaactcttcctatatccgaaagttgtttccgtataagatatggtatgtggtgagtcctgccgagatttagtcaactactattaggtatgtggtatccataaccctgacacctttccatttatgggctctttggtggtccatttttgccttgggagctaacggttcgcattcggccttttactgtgtcatttgcccctttttattgtgcgggccacgggctatcttcgcgcagatagccgttggttcaagggatgcatgccacacatcgcacatccatcggtttggcactcaacggtcgcgagggcggaggagtataaatccaacctccccctttcccccggaggcttacctcagttttttaccgcagcacttttctcctcaattcctgcttcttgcgctcacgcgttccaggaagacagctattcacccagttcccctttcacctttgtagcttcgccacttctcaagccgaaatggctcctaggaagactgcttcggccgcgacaaccgggcccgatctcggagcgatgccggatgacttgtccagcttcttgggcaagttgtttgtcaaggagggtgatctgggcgaacttgtcgcctctggggcagtcgtcgaagggcaagctttccttagcgcgagaaaaatataattatgaatagtgtacattgttattagaagatggttgttccactaaaatgctacatgagacaattttcactgtgcgcgtgatcgacagtttagcaccgttgttatgagaagacagttccactaaaatgagacgtggcatttttcactgtgctcgcgatcgacagtttagcaccgtcacgtacccctatttgaggggtggctcggctctttctcctccatatagctaattcagccttagacacatggtctgaccgcagtgtattgtcctgtctgaccggccacacaatggcggtcagactggcctttgcggtaaatgtcctcccaacggtgacacaccttctcagacaaacagagatggcttgttttccttcaactatctgccatgcatgtatgtctctaggatcatagaaatcaaaaggatgctcaccggagaggaaggaatcggccacggcggcatttagccggagttggagaagacgaaggcaatctccatctccggtggacgaatattgggaaatcttgaggtattttggagaggacctcgaggggaagctggtggcgcgacgactcatcttggcgtggtccagatccacggcgctcggtgcatgcactggagctcccgtgggcatggcggcgttcccgtcgttgcagtggatgaaatgaggtggtgtcaaaagggaacttgttcggcatgaagggtagaatatggaatgggaaagagttggtgatggagatggctcgacgacgggtggctgcctccttcttcttcacggccggcaacgaagaagagatggaagtgggaagctagagctacatatatctcttggtttttcagcttagagatggagaatgaagtgtggcgacgtgatctggaggagtagagcgaaaagtctaatgggcgatcgatcgcctcgaacgatcacccccctcctccacatggtttcctttttaggcaccgcattactttcctattttagtaaatttatgcgcctaaagtttgtacacctcaagtttacatatctaaagtttatacacctaaagtttagagacccaaagtttataagtcaaaagtttatatatccgattcaaatttaaatttgaattcaaatattttttatatatagtattttctatacatccaaagtttatagacccaaagtttataagtcaaaagtttatatacccaattcaaatttgaatttgaattcaaatatttttttatatagtatttctatacacctaaagtttagagacccaaagtttataagtcaaaagtttatatatccgattcaaagttgaatttgaattcaaatatttttttatatatagtattttctacacatctaaagtctatagacccaaagtttataagtcaaaagtttatataaccgattcaaatttgaatttgaattcaaatattttttatatatagtgtttctacacataaatttttctaactttgttttttatttttttaaatttatggtgtagtannnnnnnnnnnnnnnnnnnnnnnnnnnnnnnnnn

SEQ ID NO: 17104 - DNA, 10539 bp, Oryza sativa
  unsure (1)..(10539): unsure at all n locations
nnnnnnnnnnnnnnnnnnnnnnnnnnnnnnnnnnnnnnnttactttcctattttagtaaatttatgcgcctaaagtttgtacacctcaagtttacatatctaaagtttatacacctaaagtttagagacccaaagtttataagtcaaaagtttatatatccgattcaaatttaaatttgaattcaaatattttttatatatagtattttctatacatccaaagtttatagacccaaagtttataagtcaaaagtttatatacccaattcaaatttgaatttgaattcaaatatttttttatatagtatttctatacacctaaagtttagagacccaaagtttataagtcaaaagtttatatatccgattcaaagttgaatttgaattcaaatatttttttatatatagtattttctacacatctaaagtctatagacccaaagtttataagtcaaaagtttatataaccgattcaaatttgaatttgaattcaaatattttttatatatagtgtttctacacataaatttttctaactttgttttttatttttttaaatttatggtgtagtaataagagaagaaggggaggaggaagggggagaggagcgaaaagtctaatgggcgatcgatcgccccgagcgatcacccccctcctccacgtggttttccttttttggcaccgcattactttcctattttagtaaatttatgcacctaaagtttgtacacctcaaatttacacatctaaagtttatacacctaaagtttagagacccaaagtttatatatccgattcaaatttgaatttgaattcaaatattttttatatatagtattttatatacatctaaagtttatagacccaaagtttattattcaaaagtttatatacccaattcaaatttgaatttgaattcaaatattttttataatagaaaaaatgcccatgcgttgcaacgggtgaaggttattttaactttattattgttatacgatttagttaaggtgaaattcattgtgagaattcgcttggatatatatattttcccacgaaattatgagctataattaggagtccgatcatcttgtcgacggtgagtaaccgtagaccggatatagagggtattggggtacgctggtacgaggatctacgtagtacgacatcaaggaaacaagagagaaagattataatggtttaggccccttagtaggtaatagccctaatctagttgatatgggattatatggaaataaccacagattacaaagggaatagtagaactcggtggtaccgacgagattgtagtcgagttaattagactagaccacccggcgacttggctcctatagtcttcggcttcgtaggctgtggtcgtcgtgtagcctatgagattcgatcccttaggtccccgcggggggtcccttttatatcgcaggtcaggcggtctccaagtaggactcggaggcatcggaccctgcacaatatagtaacgacccagtcctatacgggtaggaacctttccattgacagactttgtgatggacttccttagcgtattcagaggacgtccgtatatgcaccgacataccgtattgccgtatagcatacgtccaagggtagagggtataccttatccgtaaccctgacaatagcccccgacttctacttaaatgaactcatgtaaccaatcgcgacttctgatgtcggaattgttgtcgttctcaactggtcgatctcggtgtgaggaccgtagagacaaagagtgttcgacaacaccatgcgaagtccaacggttatgagtaaatttaaattaaagtccaagaaaccgcctgacgcaacggacccagaaatttccggtggccatctctctcctttccttggaattcgcaccgtcggtagtgcgcctatttaagggagttttgggaatccattttggagtccggctgttgcgagaaactttcaagccttcaggagctcttcgtcttctccgcttctgcacaaaccctagcttgttcctctcagccccttctccggtgatcttcgacggggatggagctcgacaagtccacttctaccagcgcgtcgctgaagaagttgcaggaggaaggcgctctccccggtcgcaggaccatggagagggaaccaggaggtattgaacctaaacctgtcctgggccgcatggttgcagttgaggactatattctctgtggtttccttcctcctccctctgagtttcttcttttggtcttgaatttctacggtctttctctgctccatttgaaccccagctctatcgccttcctcagtatcttttctcatctttgtgaggcctatattggggttgacggagctcgtggctcctcaccgggagaccgcgcaggcccccctttgccagttcggccgggggcttagggtgaaatctcaagctctcgctctctctgtatgtggaaatatcgtatgcccgccagaaaacacgagacaccgacgatctatacaggttcgggccgctgagaagcgtaataccctactcctgtgttttggtggatctgcgtatgaatgagctacaagtgtgagctgacttctcccccgttctaagctcatcatctgggaaagaatcaaccaaccccctctctatgggcaaggtcctccttttatacttcaaggggataccacatgcacccttctctttccaaactggactgttctttttctcttgaatgggcggagatcagcacggttgctgtccgaatgacgctccgatgggacagcccacacctacctccacttccgccgggggtgagcgcgtcgtgggaacatggctgtgcgctgacgatatggtcagtgtcagaccggtcacaaatcggtcattcttgtccaccgcgtgtaaacttggcaacgtgcatgtttgcccttcttcacacaacatcttgcctgtaatggttaagatgaagcctggcatatatcgaccgggtctaacgtgtcatctctaagggataacacgcttaacgccggcttgagacgagtgactagaggctttcgtcttgacgggatggggcatggcgtgcgtcagaccgccagtcgccacctaacccgtgatctgaccggtctgtgactggtcacagaccggataaagggacgcgccgtgctgcactgcatgcagcgtgacacgcttgaccagactgcaataaatgctgttaggtgagcacagctgtgctcacttatcccatatacgtggcgcagacttcctaaaggggtcggggtgcctcggccctcggggccggggcaagcgcaacccgacccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaggggtagagccgtttcttgacctctttcgcttctactatgagttgcgttggatggaatccaacagggtgtcaggatgcgttggttttcgacttagggatggcctgaagtcgcgctatatccccttccagtgcccctcttctcgtagtaaatggcgggtgaggtggttagaaaattcggatccggtcttggttgttcccgaggagcaaccgaacaatatttcgtcttggactgccaagcccgccttgaccccctcccttcagtctttcatcgatgtcatcgatgacctccgagtgcgagggttgtcggggtatgaagtcgctgctgacttcatcggtagacggatccagccgctctaggctcgagcccatctagcctttgactactcagggccggaggatgcgacccgggtttctcctcagggtatttttctcgtattctgggttccattccttaagtatatgttccccctgacttatcaattttggttctcgatctataggtttgaacagcgaaactgtagagcgccgcgttggtcaagtgatgatcagcggccctacaacggcgagcaacgtccctgttgctctttgcgagaagggggcagccgaacgcgaagccaccatcaatgtaagtgtactcagcggcccttttgcatttttctttcgggatcgcattgtgacttcatgaagcgtatgctctccctctgactgatattatcgggccactcgtggaccatcaggcggcggcgtggctgaaggagaacgtcgccaaggaggtgtctgatgttgctgctgctgctgccacaacgagtggcggcaacatcccgagaagggggaggaaattctcctccgtgatcggaaatcgtcggaaaacgcccaccccctcgataagctctcctggtcgttcatcgcgtagtcggaaagcttccacctcacatcatgcccgttatactccaggcctcggatgcgtctccccgcctccgcgacggcagcggcttgtgacgcttggcgagaagtaagtggatgaacttgaggttttgtcgcttcgttgagctcttgcagcctgtctcaattgcagcctttcacagggcggcgcgggcgaaggcggcataagacggatctggagggacttccagcgcgtctcctgccgtgtcctcgactgatgtcgtggtcgtgcccaggagccgcgaggcgacgcccagcggcccagtcagcgatctcgcggctggtcggggtccgccggctgtcgtcctcacctaggaggagctccaggtcaagatggggcgcctcctcgaggctggtgctcgcggcattagccacgagatcgtaaaggcgagggcggcggcggcgtcgtcggcgaacgagcgcgccgaccggctgacgcatgatttggcggaggtttgcaaggacctccagaagatgagggaattggtggccggcaacgagcgacaacggcaggggctcgagcaccgtatgtcggagctcgagaacaacttgttggaaatctgtggctcgctgcgggtcacctacactggtctgcaccagctcgccggggagtgcggtgtcaagaccaccatccctgcgaatcccaatgaattctcgctgatgacttcgcttgcggaactggcgacggcgatggaggcgatcccctccaagcacgcggccaggatcgaagaggagatgtctaacgggatttataccggggcgtgccatgtccttgcgtgtgtgaggctggcgcatcctgaactcgatcttcggaagatcctggatcagggggtggctagcgacgcgcgcaaggatgtgatggaggaagtcagagacctgggggagtctgtcctccccctttttgaagagtaggaccgccgcttgtttgtaccccttaaccaatcgtgctttgtaaaacttttcgttggttccaactgcttttgtgtgtgcaattgttgccttagttttctttggcattttgattccaggtactttgtctgttgtttgtagagatgtcggtgtcgagaatgtccagcagcgcgggcagcctgaattgcttgaggttgcttcgacacttgagctcgagccgtacatgccgcgggatggcatagaccaggatctgcccaaggagacggacgtggtgtcgacttctttaggttggctcttgtcggttccctttcctttacctcgtctgtcttgattgggttgacttagatgtttgcatgttgagcagacctcgagagtgtgcttgctgatcacgaccgtcgcatccagtattggaggacgaagtttgaggtcgccgaacttgagaggactatattggaggtgaagagggatcgggctgtggaggcgctccgaggtcgcgaggtatggttcaactcgtacctcaggagttgttgcataaccatggccgttgtctgcagagagctccgagtacctcgcggggatcccgaggagtcagcggctggctacatctcgtggctgaacggggcttgcgctcagcttgaaggcatcggcgggtgtatcgacgaggccctaaaacaggaatgtcgtccatcgagtcgatacgccggagggcacatactggcgtgtatacgagatcatcgtccgcagttgcacctcgagttccttcacgaagggttttcccgttctcggaggaaccctacggagatagacaacctagcgaagttgatggctccgctagctgagaaaatcttccattcaatggattggcattggccttcttggtagtgcctatatatctgtgacaaacatcttaagaaaaaagtaatgtattctggaattctttgcgatctgtaagaaatgcttgtgaaatagaaaggaaatctatctaactaagctttcttatgctgggtacggtgtgcacgagtgtcttctcacttcacgacttcgatcagtcacttgagttatacactctccctagcccccagccttgtcgtcggagaactcttctcggaagataaggctcttggactctcgaccatccttagttgaataagcactgatccttgcccccggccgtgaagttggaaaaatccatttccgattacacggcttggttaatacgcatggcgagaacacttacacgaccagatcttacatggtctttcgtctctgaaggatccgacaaggccttatcagctctgggcgtccccagccgaagttcccttaggttctttggaggccttgtcaagatggcgtaaagggacatgaggataggtttcaacgctaggtgtcgtctgggtaagggatcatcgggaaggggcactgtgattgaaatctggccttaaaacagactttattgaagttgtaagatgtcttacaaatgtggacactattgacttatacataaaatttatgcaattggtcaatgttccatgaatttgctagctcacgaccatcgccgtccgcaatcttgaatgagcctggccgcaagacttgtgtgatcgtgtacggtccttcccatttgggtgagagtttgtttcgccctgcctggctttgaactcgtcggaggacgtaatcgccgatcgaaagtatgcgtgctcggatgcgcttctcgtgacatcggcgtagggcctgttggtagctagctgctctgacggcgacccgttcttgatgttcttcgagtaggttcatgtcgtcgtttcgctgttcctcctgatcctcgtcggagtacttctgtagtcgtgtactctgatgacataacttggtagggagcatggccttcgagccgtacacgaggaagaagggtttctctttgttggacgttgtcggtgtggtgcgcacgacccatagtaccgaggggagctcttcgacccacttcttgtcatgtgacatgagcctatcgtagacacgggtcttgatcccttgtagtactataccgttagccctctctagccctctcgacctgtccgttactctgagggtgagaaaccgaagcgaagcatatcttgactcctagtccgatgcagttgtcttggaaatcagcgctgatgaattgggagccgttatccgttatgatgcggtgaggcaatccatatcggcaaaatatccccttaatgaacttgatggcgttgtcggccttgatttcccccgtgggtgttgcctcgatccatttagtgaatttgtcgatcggcacggacaggaatgtgttgcttcgatccatttggtgaatttgtcgatcgccacgaacaggaatttgtagccgccctgtcctcatgggaatggaccgagtatgtcgagcccccagcacgagaacggccaagtgagagggatggtttgtagtgcttgcgttggtagctttgtgtgtttgctatgaaattgacaagcttcacactgttgtaccatatcgcaagcgtctttgagggcggttggctagaaaaatccttgtcgaaaggcttttccgaccaatgtacgaccggcggcatgtgacctgcagaccccttcgtggatgtcgacgaggaagtgtttgccgtcgtcagacgaaacatattttagaagtactccgtttggcgccttcttgtatagatcgttcccgatcatacagtagatttttgcttgacgggttattttctcgacttctgcgtcgtcctcgggcaactcattgctgcttatgaatttaatgagtggggtccaccagtcatccctggtctcgatgtcggcaacggcacaatctgcctctgtagcccccgagccgatgtcgggggtgactgggctatcttcgtcatttgcctctttcactgatggttttgtcaggatatctagaaaggtgccgggttcgagtagctctcgtctggacgcacgccgtgctagatttgatgggacctcgatcccatcaaatcttttttccagcttcttgacttctgcaagatatttggatagctcagggctagagcatttgtaatctttgtgcacctggtttgcgactagttcggagtcccctttcacgatcaatcgcttgactccaagtgcagctgcagctctcatcccagcgagtagtccttcgtactcggctgtgttgttggtcgccctgaagttgaggtgaattgcatgcttgaactgatctcccgaaggtgatgtcaagatgaaccccgcacctgctccttggctgttgagcgcgccatcgaatgccattgtccatgtttcgttgtcggtctggctatctaacctgttttcaggcatagttcaatcggctacgaaatcggcaagaacctgggacttgatggctgttcgtgtataaagtggatgtcaaactggcttagctcgactacccatttcgtaatgcggccgacaacgtctttgtttctcacgacctcgccaagagggaaggcggagacaaatgtgactctgtgggcttggaagtagtggcgtagctttcttgacgtcatgattactgcggagagcagtttttggatctgtgggtaccttgtctttgcgtcgtgtagagcttcgttgacgtaatagattggtctctgcaccttttctctttcgacaacaatgacagtactcacagagtagggcgtagtggcaatatagaggaacaattcttcattaggttggggagcaacaagtacaaggggatttgacaagtagcgcttgagtgcgatgaacgcctcttcagcttcctgtgtccatacaaatttgtcttgcttttttagtagtgcgaagaagggctgtcctcgttctcccatcctagcgacgaacctacttagcgccgccatgcatccggttagcttctgtacgtccttgagccttgtgggcgacttcatgttctcgattgccttgatcttctcgggatttgcttctattcctctgccagagacgaggaatccgagcaaattgcccgacggtaccccgaacgtgcacttctcaggattgagcatgaggcgatatcgtctgaggttgtcgaaggtttcccgtagatcgtcaaccaatgagtcgcctgtcttggttttgacaacaatgtcatcgacgtaggcctcaacattgttacccagctgatcgctaagtgccccttggaccgtatgctggagtccaaatggtattttgacgtaacagaatacaccgaacggtgtgatgaatgttgtcttctcgtcctcttttgccatgctgatttggtggtagccggagtaagcatcaaggaagcttaacagcttgcaaccagttgttgagtccaccagttggtctattcgaggaagaggaaagtgatccttggggcacgccttgttgaggttggtgaagtcgacgcacatcctccacttctcgttggcctttcgcaccatgactgggttggctagccactctggatggagtacctctctgatgaaaccagccttaagaagtttatcgagctcttctcgtatggcctgtttccgatctgatgtaaatctccgcagtttttgctttactggcttggcatcgggtcgcaccatacgtttgtgctcaatgacctccctggggacccccggcatgtcggacagctgccaagcgaatacgtccacattgtcgcggaggaaggtgatgagcgcgagttcctatttctcgttcagtgatgccccgatcttgaccgtcttgtcggggttgacactggagagtgggacgattttgattgcgccgtctggtttcggcgtcttagtcgttttgatcactttcttgggtggctcggctgtggcgggtgggctgggagtgtactcgaccatgtcgaggcttcgcttgtcgcattggaccgccagcttcgcattcccttggatagtgattgttccctttggccagggcatcttgagtacctgatacgcgtagtgagatgcggccatgaacttcgtgagtgccgttctttcgatgacggcgttgtatgctgtgtcgaactcagtaacatcatatgttatctgctccgttcggaagttgctcgcttggccgaaagtcaccggaagcatgatcttgcccaatggcttggacgaagattgaggggtgattccatggaagggttgatcggtaggtgtcaactcgcctcatggaaatcccattgcgtccaaagtgttggcgaagaagattgatggagctgccgccatcgacgaggactcgcgctaccttgatatt

SEQ ID NO: 17105 - DNA, 11597 bp, Oryza sativa
tataacagcagccttggggtggtcttcatctgagaactcgatcttctgttcagaccacttcatcttgggtgcagccccctgccatgtcgaacaaacctcacgctctacttttttgtattctcgctttgaagagtatgttgtggaacctccgaagatgtgtgagacatgaagatcagaatctgggtacgcggagtccgagtcctgagtggttgcctcagttgccttctcgactacacgtactcgcttacccttctctaaagccagcttcctttccgatgattttttgaagatgaggcattcctccagagaatgtctgtccgacttgtgtatggggcaccatattctctttgtatcactgccctgtgggtctgggtgtttgggcgggcgttcgtattcagatgcaaggacttctgtttaagctttcctcttcccattcttgccgcttttcttcttgcttgattcgggcgcgtccttggctagcttcttctctcctcccgcctttggtttgtcgtttttgcgtctcaatgcgtcgtctgcatgggcacatcgatcgacaacctcgaataaccttcgagtagtagtgattcaccttgttgccaactcctgggtagtatagcgatctctgacaccggttttgaaagcgcggatcacagaagcatcggtgatatcggggatcgtatttctccactcattaaagtgccgaacatagtccctcaaagattcaccctgattctgtgttaacacgtgtaaatcgtcttcgatcgcgtgacgcttgtaagttccctggaagttcgcgacgaattgttgccataaatctgcccatgaagagatcgagtaaggtgggaggtgcatcagccacgaatgcgcagaacctttcaacgccgtcggcagataatttactaacgcgttgtcgtctgtcccaacggcgtatagtaccgtggagtagacctggaggaattcttcagggtcagaacttccatcgtacttctctattgctccgggtcggaatctctcgggccatcggacatcacgtagagaacggttgaaagccctacacccagcgctgggggcagtgggttgtcggcgatcgtgtgtcctccgtggacgtctatcggatgatgaagacggagatgatgatgacgatgacgacgatggctcactaggctccggtgtgcgattccaagggcgacgttcaggttctcgagagttctgtcgtcgtccaccattgttgtcctgcgccgatctccattatcatcaccgtcatgctgatgccctcgaccaacatcgtctggtgtccgatgttcgtgatcgtcgcggtcgcggcggttgtgacgattacggtggtgttggtctccgttcgagcgtcctcctcgatcttcgccctcgcgacgtcgtgaagaaacacgatgtcgggaacgattctcgttgtcttgcgcgcgtcgtgcttctcggcggccatttagatggtcgtggagatcgccggtgccgcgaggtggaggagtagctcgtctcggcgacgtccgctgctccggtggttcgccgtcggtaccgtcagccatgggtcgttcaggttgtgctctggtagcagcttcctcgaacgcgttactgagattggccaccgattcccgtagtcgttttgtccaacgtgcgagatcatcgttaagcacaggttgtaaggagcttctctcagtattgcgttgacggtgccgagatgctgggccggcgtacccgtctggttctccgcctctgcgttagcctgtgcggatgtgctagtcccaccgatggcaaacacgtcgcgtggtgtactggaagatgacgagccacaatcttcgagtaagtgaaggaccgatggctcgtggggattgatgtcgattactccaacgaatcaatccgaggtcaacgtcactccttgttccttgcctgtatcctcgagagaggttcctgactgccggaccttaggaggcgtcgtcttcatggcgcggagaaagaccttgcagcttgagaagtcatgattcttcgtcttgtgaataggacaatagacatcatgagttggagaagtacgctggattccacgctctttgcaagcacggatttcagtttgtacgttgagaaaaacccagcaagcttgcaagttgtgcttcctggacttgtggataggacaccaggacttggcgacctcggaagctgtcctcgtcggctcgcagtccttgtcggaaggacaaggctcggccgcgctaggaatcttctcgggctcgcatgacgtcgatgttccgttctccgccacggcgggaggatccttcgacatgggaccgtccgggtttataaccacggcgttctcgtttccggttattgatgaaccagccgagattggcaccgtggtgtaaaccgggaagacgatttcgccgacttgagtctacaccagcattgttgaagcagggattccttggatggggccggtgttgactctgttgtcgacgaagctcgatgtcatagtagtagaaccttgagcaccaagtccctctacctggtgcgccactgtcgacggtgagtaaccgtagaccggatatagagggtattggggtacgctggtacgaggatctacgtagtacaacatcaaggaaacaagagacaaagattatactggttcagaccccttagcaggtaatagccctaatccagttgatatgggattatatggaaataaccacagattacaaagggaatagtagaactcggtggtaccgacgagatcgtagtcgagttaattagactagaccacccggcgacttggctcctatagtcttcggcttcgtaggctgtggttgtcgtgtaggctatgagattcgatccttatatccccgcggggggtcccttttatatcgcaggtcacgcagtctccaagtaggactcggaggcatcagaccctgcacgatatagtaacgacccaatctatacgggtaggaacctttccattggcagacttcgtgatggacttccttagcgtattcagaggacgtccgtatatgcaccgatataccgtattgccgtatagcatacgtccaagggtagagggtatatcttatccgtaaccttgacacatctgaagttagcatgtaattttttttaaagaaattccttatacgactggtaatgtatttaaaaaacgaacgaacttaattcaaaattataatatgttgtacgtactgcaagtactaaatttgtaatcaaaattatttgtctttgttaggttgcataattttttttcatatatttactttgttatgattttatagttatttagttatttttaattttggatccatcctaacaatatggaatatccatataattttagctttggcctgtttcaattttgaacgttgttttaaccttttgagtaggtgcaaagccgcatgcatgcaaagtcagcccaacgtgtgaacatgcaaagtcagttgaacgtgtgagtggcttgaactgacatgcagtcgaaggcttgcatgtgcatgcatgccgcgtccctagaggacccggtcacacaccgacacacgaacgagtgaacgacgccgaaaattcgaacgggactcccatgcaggcgacgatgaacacgcacatgacattgaaacaaacaacgagacgggtaggaatcgaaaacggtaacttaccaaaaattttagcaaaagcatcttcaatttttataatagtatttttatacgcataaagtttagagaaacagagtttataagtcaaaagtttatatatccgattcaaatttaaatttgaatttaaatattttttatatatagtattttctatacatctaaattctatagacccaaagtttataagtcaaaagtttatatacccaattcaaatttgaatttaaatttaaatattttttatatagtatttctacacataattttttctaactttgtttttttattttttaaaaaattatggtgtagtaggaagaggagaaggggaggaggaagggggagaggagcgtgttatgggggatagcgatcacccgcccattagcgacacccggagtagagggcgagaaaagaggagtttgaagccgttgacacgttgtggccacgcgttgagcgcgtccgagagcggtcggcgccggttttctttttctctctcgcgttaagcggtgaggaatgaagatggacagggactgggctagctggggaggctgccaagtgggtccaaaccgtggtaacctaggctagagagaaagggaagggtagaaacatgggtagactagattttggatgattttccaggtttatttctcttcccatctttgttaattcatatattaatttgtggtgcagataaattcatgtagattttactggagttaggtgattatacctagatttcatttttttttgcacttaaaaattatgtgcagtttgctctcagaaaaatggagaagatgggctcagcagaattttgtttgaattgttagaaggtctaaacagaagaaataaattctggaaaattatagttactcttgataattaacctagtatttgaataaattatttcccttatacacttcccacttccatgcagtttaatgcatattttggtgagttaagattttagccaattaaggtttataattagtctattattagactcgtttgactgatttatttgaggtattagcttaagtgataaattctgaccaaaatttcagtgtgttgtacacattggatagtattcatgtgaatttttccaagatttaattatgtataaatatttttttagtaattgatctagtctatcctttatatgtattttcatctcgaaatgcatttgagcatttatagattttatatttgaacacttctttacctaaggtgatattattaaacttagtttcatacccaacatgcacacaaggactcaaacctaaccatgatctatatgcatatgcatgcttacactttgttactcaaattccattttggtttggaaaggaaaagttttaactagccccaaaattccctatatgcaaaagttgggttgacctacctaggtttaaaatgaaaattttaagctcgcaaaaataaaaaatttatcttccaacaattttgacaaggaattttaaaccctagaatttaggtatgttacagtcctgcaacgggcctactattcgatctgttcacctcgaaggcagatgattattatcagtggtgtatttatgagtattattacttgtaacaaaactaaaaggatactccctccatcccaaaatttgtatgacagtgacgttttttcatataacgtttgaccattcatcatattaaaaaattgatataaatatcatttattttattgtggtttgttttattatcaaagaaattataatcttaatttacacttttgcatatttatactaaactttaaataaaacgaatgggcaaacgttatgcgaaaagtcaacggtgtcatttttttgttgggaaggagggagtatatagtattagtggtaggatctctttgatctaaaaaaaaaatagtgtatgaactcgcccagttggagtacagcccactgcccacaagttcatttcatgaaagttataaaagtcaaccaaattcagcagtgtttaatctttcggtttagtcatttatatcaaggtggccgaaataccaaaatttctaaaatttcggtccaaaattatatgaatttttaaataaaatttgattaaatttgaaaaaaatattacctaattcatgaaaaaaatttaaaaatttcggccgaaataatatcatatccgaaattttgaaccctgaaatgcaggccttctggaggggtagatagttgacctttatgccgacgactctgcaagctgcaacgaccgcttctacctgcaatatgattgatgctatatagtttcttccccggctgcacttcttcatttcttcctcctcttcctccgacatgcacttgtgaagcgactcgaggaatccaataagtgaggctagctccatttcataacagctcatcgggcgtccgtgcaggtactcaaatttcttgccagtaatatttccatcatctatttctgttttacttttgcaaagcatgatggagtagaaagtccaacatggtatgtgcttggagctttacgaaacactcggtcttgaagttgaactgatatgattgttgaaacttaaaaggaactgatgctattcaaagactagataaatccattcatgttccagtcttaagtattatgcacagcccaacaacaatcttctccaaccttcttaccgctaacagactagtttcttaatcacaattcagaactgccagttcaaaatcgaaggcaggagcaaaacctgaaatcccttacttcacatcaggaaccttttatatctatactcctttaaaaagagtagtgatggtggtgattggtgaatctgccaccacccccaccaccaactcaggacccttttggagtaaggtgatgccaaagggtccacacatcaaccacctccaccactttgttgtgaaggaaaaatgatattgtgaggccatagggctcatgttatttaccgatatatctagaatttaagaaatgatgtataaaaaataatgataatagtatgttttttttttggtaaatctcaaagaggacaaggagtgcatgttttcatataagaagaagaagaagagagttggtctagtttttgaatgataatagtatgttaataatcattttcatcaattaaaatcccgtgcaaaatgctagttagcattaagaatgcatatggacgaaagagactacccattggcatggccaacactcagcaaagaactttttatcaaggttttcaattttttttaaccaaagagatctgtaaatttttgctatacacaccccaaaaaataaaaataaaataaaattttctccgggtatctacttcatgtttgattcacgctaaaattggaagtttgattgaaattgaaacgatacgatggaaaagttgaaagtttgtgtgtgtaggaaagttctaatgtgatgaaaaagttaaaagtttaaagaaaaagttggtatctaaaccagacctttttctcatcccagatatcaactgtttactgcatttagaccatttactatgtgtactatttccctgtttcctaatgtaccctacttttgatgctcaaccaaatactagttccttgtagctcagcagtccagagtattagtatgcttgcgagtaactatcgaaggaaggagtaatagttttccatcctccaaactgtcacccactcaccctccaagtattatcttttgattcaggattccagcagattcaagttccgctatccctttttctatgatgatcaatcagattgtgcacctccctttgcgtatccttgattcttttccttcatgcagttccgccagtgcagttggcgttttgggaccgttctcacaccttttccaaaaagcaataaatttggtttgaaaaatatggaaaatatttgccatgtaaatataatgataggcccaacatagaaaaaggtatccctctaaccaaaaaacccaatcctagctacgaacctggacacgcatatgtttgtctttttagacggagtagtacgtacctaataaaatagaggtaaactgggcgaggaatgccttctttcttgcatatctaaggaatttagtagatctgtactgccataaataatatttaacgtgtatattttggtaataacatgctaagggcctgtttagactttagatcccactcaaaattttacaccctatcacatcaagcgtttgaatacatatataaagtattaaatatagacttaaaaaaaattaatggtacagattgcgactactttgcaaggcgaatcttttaagcctaattgttccatgaattgacaatgtggtgctatagtaaacatgtgctaatgactaattaattaggcttaataaattcatctcgcgatttactaatggatactgtaattagtttttttattagtgcccgaacacctcgtgtgacaccctatataatacccgaactttacatccctgtatctaatctacccctaagattagctctgtcatgtcgcatatgtatctttaaattaacattgaattgttatggtcagtagcggagctagtggcggagctagccaggagctacgcctagggctcatttatattatcttgttctaatgttctactaatccacacagattttagaaatttaaataaaatttacatggagtcatgaacccaggcctagggcttgagccctggctgccctaggcctggttattgttaatccggtaggccataattaggagtaaactggagattatcaaacatgacttgctccaaaaggtgttccatctgtttaattaggtggtgtttggatccataagtcctatggacttattttagtcctaggactaatcactttagtctatggctgtttggctatatggactaaaagggactaaagtacattaaatgcgctgtacaatgaccatattgccccataaaaccatgcaaagtggactgcaccatgccccttgctgcagcatgccgtttgctgccgctgctaccactttgcaagccaaaacattgttgttgcacgactgcacaaccaaatgcaagccaaatcaatgtttcaccccaacatcacaagcattaacccatcataatttggacaaatacacaccttcagcaagccgaatcacaagcaataacccatcatcattttcattatcaatatcacaaccaaatcacagaaattcaaagaagctcatacacatctcaagttgtcgaaatacatcacagaagtttcaatgttacaaattacaagcactcatggttcaattaacaagttcaaccaaatacaattcacaataaatttgaaccatatattacattcctttcaaagaccacaatccatcggcaacccagtcccgaaattggttcatcacatgcgagtccaaatcatttgttggttcgctagatggagaagaggttccacccaatggatcataattttcatcttggtcataattatcgaactctgcatcagccatttgactgtctctaatgaaattatgaagtgctatgcatgcatgaataattctgctttgctttttctgcgagtagctaggtaaattaaacaaaatcatccacttgttcttcaagaccccaaacgacctctctatcacattgcaacacgaagaatggttgtaattaaagtgctcccttcttcccctaggcaatgtgctttcgttgtacttttggaaatgatatgttatacccttgtatggtgtaagataacccggcctatttgggtatcccgagtctacgagataaaactttcctggaggtggctttggtaacttgccactaaatctagtttgagcatcattgaataccctcatatcatgaaccgaaccaagccagctagcaagcacgaaaataaatctcatatcaaagtcacagacgcacataacattctgactcttctccttatgtctattcctatgttaaacagcagctgaatttggcaccacaacttggatatgagtaccatctattgctccaatgcaattatccaaatatggtatgtactgtggagaaagcaattttttatggactgttgagaaaagaggatcttttggcctaatgatatcttttgcaagtcttagtagagcggtcaaaactgctttgaacttagtatgtactgttctaagagacctaacaaatcggtcttgggcttgcctaattgattggggagcacctactatccacaaaaaaagacccaaagactccatggaatccattttgtttgtggacttcaactcatatgattccacaagcaccgaatgtaacctctcaaaaactggcatgtgcatcctaaacatgttgtaacaagcagttctattggctaatgttctcataacccaatcatgtccagactcaggtgctactcttcttagagccttattagagtaaagttccaagtaatacgtaccaatcatgccagcaagcatacatgctcttctcctgttcatttctcttttcttcaaaatagaaatgataagatcaatctcctcatcactgctgtcttcctcacagctatctttatcagcattgccctcaccatcctacatgactgacatatgcatagaaagggagcacatcataaatataatatgaacaaacttcaacaagaaaagaagggaaggtagttaaatagatccacacatcacatgttgattacatcacatcacatcaaagtagtagatagttcaacacaaaagtagttcagaactaatgcagctaagacccaactaatgcagataagacccatctaatgcagctaagacaccataatgcagctaagaaagacaccatatgcagcaatggcagagtgcctctagtgcagctaagaaaggcatcatctaatacaaattcttatgctggcaccatctcttcaaccacataaatcttgcttcattagtgctaatattctcaaacataactctgttatgtttggaagcaaacaactgtgtggcacaaaagtattccacattgtcttctgctgcaccacactctactgccaacttctgacagtgtgtcaaggactcagccatttcttctttcttctgctcctttaacttcttgctgttaacaagttcagtaattagggtattggacttatcacttttagaggtgaaagaattgagcagccccctcatgagcttcaccactgggctcttgcttttttttccaagacttgaagctgtggacacatcacagctgctactccctctcttcctgctgttagtgctcatggggctattctcaaaaccatcccctacagctctttcccctctagctgtctcccttgcatcccctgcttcctcttcttcttcctcttcatcttcatcttcaaaaccagggatatatgctgtggaaccatcaactgcaactccttgaaacatctctataagaaaatctaagtactcagggttgccatggcgaaatttcttggcatcccccttctcctgtattgacacttaatcaatatcacagatatctccaaaatcatgtaaactagatcaatttttgacaactgcgtaccttaattttttttcccaccaaacatttgatgcaattatttctccactagcacttctaccagctccagtttgttggttcagccacacccaagcaacgtaataattctttagatgggtgaatctattctttatctgtttggttgaatgccttaggttagccctttggaaatatttggccttcaaattctggtaccctctagttgtccatgctccattaggacaatgcccatcccttatttcctcacatgctatttcacacaatgtgtaagttttttcttctgtccaaattgccttgtcatatgtattctaggaaagaaaaacatgatttaaccctaaattaaccacatgaacagcaaatgacatattacaaatgcttagcccacggcatgcatagcaatttaaatatcatgagcaacaattgacatatttcgaaagcaataaa

SEQ ID NO: 17106 - DNA, 3545 bp, Oryza sativa
  unsure (1)..(3545): unsure at all n locations
atctgttagtaggaggggaaatcagggaaggcgtcggcctggaagttcagatccaggccccccgatccccctcccccaaaatggatgccagcgccagatccagcatatcctgaagacccctgcgagaagccgtagtcggagccgtccatgtggccggctggagcttcattgaacgactgggagaagaaatcgtgaggatttccccccgccattgctgatgcgcgattcgtgaggcttgcgcgagtggcagcggcttgcacgacgccagcgagccaatcggcgggcagaggacaagctagcgcgaagcagtggtggaggctagcgcagggagatggcggcgacggcgcggggtcgagaggagcaagagagagatgacacgaggaagagatgaggcgaggaagagagtgggcgaggaaatggatagggttggctaccgtgaaggggcagcgggtggaaaagaggcactttagtcccaataagcacctccatttgggacttctggactaatgcactttagtcccattttaatccctcctgtttgggactctagggacttaaagtgacttaaagtggaggaacttcttttttagaccctcaaagaaacagggccttagctttgcgcattgtaagttacagataaataataaatgcagtgctttgaataatgcaccggcttcacgaatttgcaggcacaatataaccacatcttctgtgtcactcatatgggagattggtatgataaactttcacaatcttttagggatactgcgaaggaagtattggcaaaagcggatattgatccaaatgttaggtgcttcacaagaagacagatgaaacgcatcacaaatatttacagcactaccttgggaagaggagggttttctgtggtgtacaagggtatgctcgacgatggccattcagtggcagtgaaacaatataattggagaacacagaaaaaggagttcacaaaagaagtgatcatacagtcccagtgtagtcataggaacattgttagattattgggttgttgtgtggaggcagatgctccaatgctggtgactgagtttgtcccgaatggaaacctttctgaacttctgcatgggaacattggtcagcttcctgtctcattagagacacgcttccagattgcattggatgtagcagaagcagttgtatatatgcattactctcaaaatcatccaatccttcatggagacatcaaaccatcaaacatacttctaggcgacaagtatgtggcgaagctatgtgactttggaatatctaggcttctctgcatggacaatgatgaatacacggggtttgttataggaagtatgggatacatggatccagtgtaccgtgagactggacgactaagcccaaaatgtgatgtctacagttttggggttgttctgttggaactcatcaccagaagcaaagggattgatgatcagaacagaagtctagctagagtttttgctcactctagtatagatgaaagatataaactatttgacaacgaaattgtaaccaacgagaatgtggacttcatacaggaaatggcaaaccttgcacttgattgtttgaagtctgaaatagaagatcggcctcaaatgaaagaagtcttggaacatctttatagtctcaaaaggaaaatgttggaacaagagaggaagattgcagagttgatggaagagagaaggattgcagagttgacagagcgaagaactgtggcatttagggaaatcaaggccatattgcaagatatttggtttgaaagactcgtcacaaaagaaaaaaatagattccatcgtaggcaaccccgaaacaaggtatcaacctcagaggcattttcaggaaaaagtagtgttctcattcagcgtgccattgtcaagatttgcatgggacatttgaaaaacattcgatttatcgtgataaagatgtctgttgaggctgatgagatttggaaagagatgtttctttatgagatgatcaagcaatctagaattgagcattgcaatgtcgccaagctttttggctgctgcctagatcatgtggatgccccagtattagtttataagtatggtgacataggcttgcatgatgctcttttcggtaacgcgtggcagcagtttgattgtccnnnnnnnnnnnnnnnnnnnnnnnnnnnnnnnnnnnnnnnnnnnnnnnnnnnnnnnnnnnnnnttgctcacctgcactcacttaatgtggttcacggcgatgtcagaactgccaatgtagtactggatgtttattctaaatctaagctcgaaatgcctgggataactgcatttatggcaaagattgcaggttatggaacacaaaggctcctttccttggataaggccaagcatgaaatatttctaacagagaacatccattacaaggatccacacttcctcaagactgggctcatggctaaggaatatgatgtatatggttttggcgtggttcttgtggagctcttcgcacagaacatggtgcaaatgcatgacgtaaacatggtgctcaaagaacttgatggcattcctgctagatgccatcatcttaaggaaattaagaaacttgcttcttggtgtcttgcatccaaggtgacggagaggccagcaatggacaaggtagtacgatgccttcgagctgtcttgacaaacctgcaaaatcttcatgatccctgcaactgcaagtcaatgtataataagtctgcgatgcagtccgagcaaattaccagtgccaagtctgccagtagctgatagctccacaattgtgatataggaagttaatacaagttcccaattaatgtgacctaaatgtaatattaatatatattggtatatatgtgtttgtagaactatttgctggtcaaatatagggcaaagccataaacagtaataatatttcttgctggattttctgctgggatccagcgattggagagacagaaaatgtactgttagtagtagagatggcaataatgacaacacaaacccttctaattgtgtttccagcagatatccagatcttaagatgctgtttatatatgtgtaacattatccaattttacaataaccctcgtgatcgacaatacgggggttaaattcatctcactagagcttttttggttgttttgttgtttgttctgaggtttggttgttgcatgtttgcggaattgcatgcgccacagatagcaagtagcaaccgctgtatttagttctactagttagcgtgcacgtgcaaggcacatcgaattatatctaatggagtacaccatgttggttttttacactaacaatgaagaggagaaatatcaattcaaaaaaaacacattgcttgaaccaatcgagatacaatttatgttgtcaatcatgttcgaagaacgtgcggaagcattaggaacacagagccacctaggagtgttcaaccctagcacatgtggtggttagtgggggtgtggcgtcacaacgcttcatatttaaggttagaggacttttacggtacattctacttcaagtattcaagtatatact

SEQ ID NO: 17107 - DNA, 6457 bp, Oryza sativa
cccttctaattgtgtttccagcagatatccagatcttaagatgctgtttatatatgtgtaacattatccaattttacaataaccctcgtgatcgacaatacgggggttaaattcatctcactagagcttttttggttgttttgttgtttgttctgaggtttggttgttgcatgtttgcggaattgcatgcgccacagatagcaagtagcaaccgctgtatttagttctactagttagcgtgcacgtgcaaggcacatcgaattatatctaatggagtacaccatgttggttttttacactaacaatgaagaggagaaatatcaattcaaaaaaaacacattgcttgaaccaatcgagatacaatttatgttgtcaatcatgttcgaagaacgtgcggaagcattaggaacacagagccacctaggagtgttcaaccctagcacatgtggtggttagtgggggtgtggcgtcacaacgctccatatttaaggttagaggacttttacggtacattctacttcaagtattcaagtatatactgttagtatataataggtaggttcggtatttgttaaaaatctgaaaagggttgtttagtcatttaaaatagagattattttggtttttttaatcatgaatagtgataaactttcccgtggttttttttctgttgtggatatcgtcatccgcgtgtagcgcttcttttcatttcatccggcgtccccggcgacggaagctcccggcgcacctcgctcccgccccggcccagcgcctccatcccgatattacctccggcgccgggagaagccgatcttccatgcgcccggcgtcttccgccgttccgcatccccggtgccttgtctctagccctagcctgttctcccccttatccgacctcccacagcttctgtcttccccaaaccacggcggcgagggttgatggttttggagtctaaacatggtttatatcgtataaagttcgaaacgatgttaatggttttggagtctgaacattcttctttcacggccttctctggaagactggaacgtgggagttgaatggatagtagtcacagaactgttcatacattagttatattggcatataaccatgctaattatacattagttatgctaattatgccgccctgccgctgccacctgccgccgccgggctgcccttgccgctgcgagctgccgcagctgcacgccttcttcccggcgcccttctgtagctccgcctgcccgccgcctcccgcagacagggcgtatgtcattgaactccgagttgaggatggtgtcgaactcaacgacgaagaggtggttggtcgcgttaacgtcgccatgccatcaaagctgagattcgcgccagtgaacccgttgaagacgaactgctcgtggccaccgcctttcgcagcccgccggcgccgcctcccgcaaacctgacgaattggggattttcggaagaactaggttttgggtgaggaaagggggagggaaattgaatcgattcccgatggcagcgacgccggttgtggttgtcgacggcggtgcggcgcggcgtgctcgcagaggcagtcagcgacagtggtcgcccacgcgcggcttcgagaaaaattcgctttgcctgtgcacctaaaggccagatctgactaagtgagaaacacgaatttacaaaattacccccacgcaaatagataaaaaagacaaatatgccccattcaatttatactgcagaataattgggagaaagatcagatgaatttacaccgttagatcaaatatattggtagtatatacttcaagtagaatgtatcttaaaagtcctctaacggcttgtttggttggagggagttttgaataaggaaatgggagtttaggagattgagctttttaatctctagtttgattagaggacttgggaattttagagggactggcatagagaattaatctatccaactcccaccgatcccatccctggggacctgttaattcacgagacttggtgggaattaaacagcagaagtccgaaatacccctctcccgcacactccgccgtccattgccgcgaaaaggaataaaaacgcgcgaaaaatcctgttcactgccgcgaggaggagtaaaaacgcgcgaaaaatccccatctcagcgccactttcctcgcccactccgttggccaccacgagaagcaataaatcctgtgaaatatcaccagcgattctccccattcacacgcgaaaccacagccaaggttaggttctgacgcaagtttgttgtgttcttgaaaactctccctctttctccctctctcctgtacagatcgagaccacagcctcatgaggtctggattctctctttccccatctttctgcagtacatgactgagaaatttgtgtctttctcctgtacagatcgatggaagcagctttgtaaggggaaaaggtggggggggggggggaaaaggtggttctgatctgctgttcgtacttctacgtctgttgttgctcaaggctgatttttttgtagttttgctctgcagtttatcacaccaaaagctgtaggtactgatgttattctgttctctatttttttttcatcagtcgattgccttgtttgattttccaagacagatcaatcagatttggtattttagtattaatggtagtaggcattttcccagtgtatagagtagacctgttcttaatttttttttcatcagtcgattgcctttatagattttccaatatagatcaattcgatttcatattttagtattaatggtagtaggcatttaatctgctatagaatgacacatagtgtattcgtcaatttcatacgtgatacatacagaatggagggggatatgatcagtatcaaaattcatcatgggggatctttttcaaaggagggtcaactttgctatgttggaggccaagtctctatttttcgcaattgtgacagcgaaaggatgtcatacttttgtctagtagacatggctaaagatgtaggtttcaagggtggagatgaactattctatgctatccctggttatagtcttgaaaatggaatcgacaaacttcatgatgatcattcagttcgtaaaatgttgaattttgcaaagaaaggcaagtcaatggaaatttatattaagcatcttgaataaggtgtaagtgctactccaatatttggacaggatgttgaagataatcatgtggaggaggtactgtacttagaaacaacttttcttttccttccgtattttttttctgatgtgctgacgtgtgatactgtgtcatttcgctatgtttttttttgttgtttgtgctgcttgtgcattttttttcctcatgagcatggtaccttgataaagtatagttagtacttgatcttgacctatttaaaatcctaataaatttgcaatataattttgttgacagacatggctcgccctccaaccaatcgagatattgtaatcttttggaacagaatgagaacacgtagagtgaaaatagtgatgacattgtatttattgatccatagcggactgtggagactaactgtggtgttgttcaaggccaccagcatcattgaggcccctggactggcagcggcagcgagaggtctcagcggcctagggtcgagtgaggattgatgtgcatagatgtaaatccaaacgatatcgtttcaatgacaatgtgagaataaaaaataaaataaatagaatatatagattatttgacaaagcagagataaccgttctttcgtttacaactatgccgtaggttgccttcaatatgaaataatcattctagtgctgcgctgttttaaagctaaacaggttgaatagagaattgacaagcataacaagtcataatagtgtcagtaatcagttacaaaaattgtcatatatcatgaactgaacatacaggaagcaaacacattctgtcagttagaaaaaaatgaaaagttatcaaaaaaactttcattgattttcagcctacaaatcataagaactctcattgattttagcgattccagttttcaattgtttcaatcgatctctagatcttgatggtactaacaacccattcaatataacttgattgtttctaggaagggatgatcatggacgtaagtaatacatacacttgattgtgaatcaatgagagtttcttttgttgaacgactgaaaaatttctactgcacttttgagtgaaatgatggcgaaaagaacacagtgaaatcaagaacggcctgctgctcaccgagtcaaggaggatgttggatgccttgaagacgctagatgaccggtgtgtcggcgtagtgaaggaaggcgagccccttcaccgcaccaatggcagtctacatcctcctcatccatggtacaggactatcgagaccttcacacaattacagttcaggtcagcttctacaagtctttccggaattgacacagaggtggtggtgacaaactgacggtgaaggtagcttttgtagcgtgaggttcagaatgaataaatgacattgcagactattaatatactgatggaaaacattgcaagatgtgtctagacaatgaactcaggagataacgataaactccagagcaaaacatggctgtccaaggttatgaaagattacaacgtagcccatattaatttggtaaatgttcagaattaggattataaatttagatacgttatatgaactataatccattgttttccataacagaacaaagatacaagtccaacgtagcccatattaatttggtaaatgttcagaattaggattataaatttagatacattatatgaactataatccattgttttccataacaatacagtaattcacaatccaaaatgcagattcaagtttagtttatggactgaaaaaaataatgtatgacaaggttcagaatcatttaatcaataataaatactgtcaaattttcaaaataatcaattcacgttcagtttcatcaaaacagtacatgtaaaaatgcaacattcaaataatgctgtacaagcatcaattgcatcgttccctcggcctctgccaagtgccaagtgaccaacatggctaaagagatcaatcatacagcattaatgtttcattgttggcctgataccgtaatgatacaacatgaaatattcatgaagtgaaaaatttctcaaaggtataaaataaaaaggaatttagtccatctaaaggcactcttagttttatatgcagagcatgctcaaaaccaggaatgacatggcaagctcgatgtttacataaaaatctctagaaagtttagaatgcgaatatacttaaacaaacttcaaagttttaataccaaaatatattaaatgaagggattttgtgaatctaaaggaaaaggtatcatcaagcagagtagcaagtcatatatatgggattagcatcatttacctctctcctgaaccccagttgttctcttatttgctgctggaccaatgcattccattcattccagttattgcatcaacttctgctacaggatcactaacaaatttcacaattccataaacctattaacacacccttaactgaaaggcaatggaccctaaatgcctcttgtagcatgtagtctgcaatatctgcagccagatcccaactacaatggcccaattcaatcgaaagaccatctcaacattcagcatcatttgtgcagtgtccactatatgtctgatgaagaacttgatcagcagctgcctgcaacgcttgtaatctcaacaaagtcataaccctgaagttgtccactttgtttatcccagataagcttcacagattgaacctgcaaatcaatgcaaacatcacaatatggtcaggcaaaaacacaaagttgacagcagtagttgttgtcattcatccattatcactggagcaaaaaaaccaagtcacatatagcagctatgtaactgttatatggtctgcaaacttttttttttttttgaacggaaaaaacagcacagtagtgctttttcattgaatatagaaggagaaaatacaacccctaggggtaaaacaaaaagatctttagactatacactatacagagtgcgggatgagctcgcgcaatcttttagccccagctaaagcccacaagctggcctcctctttgatttttgctaggagaacacctgtctgcaaacttagcacccatgtggaaacatgtggaaacaatagataagtagaaacaatcaaacaaaaccttccaaagcccataaattagaggaagtaacctgttcatatttcatgggcacagctctagaaaaaaataatcagagatcagattgaacaaatatctgctgctgctaacaggtcaacatctatctagccaaaagcaaaagggttgcaattaaagtaagtggaacctgtatcataaagattatttattcttcgttaagcaaaatataaaatgcaa

SEQ ID NO: 17108 - DNA, 1179 bp, Oryza sativa
  unsure (1)..(1179): unsure at all n locations
ttttgaatccgacagatttggttttttaatttttttttagctctttttttaccacgtccacgcggattcgtttttctctggccgatcttttttttcacctggtttttttcaccctttttttaggaatcggacatattccttttttatttctttcgccttttttttaccgtggaatgggattcgtttttcttttcccttttttcgcccgttttttgatcggacattcttttctttttttcgcccggttttttttcattcggtttttttcccgttttgttttggatctgacagatttttttcgcctggttttattgacggacgatggaagcacctcttattttttaatttatatatatatataagtagtagagatagagaagatagagatatatagtaccgtgtcaaatataatatgattcgatttttttttaccgcgtcacatataatttttttttattccgacagatttgtttttttaattttttttgctctttttttaccacgtccacgcggattcgtttttttctcgccgatcttttttgtcacctgtttttttttcgcccgttttttaggaatcggacagattccttttttatttctttcgccttttttttaccgtggaatcggattccttttttttttccctttttttttgccccttttttgatcggacgttcttttcttttttttcccccttttttgatcggacgttcttttctttttatgcccggttattttcgttcggtttttttcccgttttgttttggatcggacagattttttttcgcccggtttttttcgacagacgacagaagcaactcttattttttaagtagtagagaatagagattaatatcaatataaaaaaaactacatactacatctcatccatttggcatagacccaaactgattcgatgtaagctgcataaatcatctattcaccgatttcactcgtttgacaggtgccaaattctggtgcctggaatatgatgcagagaagtgtgctcactgctctgttttatcgtcaaggtaggtagcaagttattaaatctgtcaaatcccctttgaacattatatgaatatagtatatcaagttatcaaatgtacattacatcaaaattgttagtggagaaaaaaannnnnnnnnnnnnnnnnnnnnnnnnnnnnnnnnnnnnnn

SEQ ID NO: 17109 - DNA, 3932 bp, Oryza sativa
  unsure (1)..(3932): unsure at all n locations
nnnnnnnnnnnnnnnnnnnnnnnnnnnnnnnnnnnnnnnnnnnnnnnnntttttttaccacgtccacgcggattcgtttttttctcgccgatcttttttgtcacctgtttttttttcgcccgttttttaggaatcggacagattccttttttatttctttcgccttttttttaccgtggaatcggattccttttttttttccctttttttttgccccttttttgatcggacgttcttttcttttttttcccccttttttgatcggacgttcttttctttttatgcccggttattttcgttcggtttttttcccgttttgttttggatcggacagattttttttcgcccggtttttttcgacagacgacagaagcaactcttattttttaagtagtagagaatagagattaatatcaatataaaaaaaactacatactacatctcatccatttggcatagacccaaactgattcgatgtaagctgcataaatcatctattcaccgatttcactcgtttgacaggtgccaaattctggtgcctggaatatgatgcagagaagtgtgctcactgctctgttttatcgtcaaggtaggtagcaagttattaaatctgtcaaatcccctttgaacattatatgaatatagtatatcaagttatcaaatgtacattacatcaaaattgttagtggagaaaaaaatacagcagggctggtctgctagcagtaacaggtaactgggtcctcttatttgtcaaaaaaaaaaaaaactcctaatattgccgtgtcacaggtatagcggttcttttccactggatctttcattagaaaatcaaacaatcctaggacaagttgattgaaaagatttatgggtaccgcacgatgcctctagtagtctagtagttaattggttagatgcgaccaacgtgcacaggtttctataactttcagcttatatggtttcatttcacatgttgtaaagaactactttcagattctttggagatatcgaaatacatttatcaataaaaatgttacttatgtgtatcctcttgaactcccatggtatgattcctcctctccacagaccactttaccattgtacacctaacatagtaagttgattagaaaatacacccatgactgtacattgatgtgatttgctaaattgttctcagcaaacctgtagcaccaaaataatttccagatgtgaatgtttgattggatcgcttgaacgttcaaactttagctattagggaaaaaaagattgctttaaaattcaaactttagctatgacaaaaaagaataaactgaaatagatggggttggcaattttttcttattagccaattaaaaccttataattgacaacatgctggagaacaagccagattaactaaaagtaaaagtagcacagtagtatcagattcagaaatgccacacaatcatgtcttggttgctcctttgatgtgaataaatcaaacgttgagaacaacaggaaaatattatggtccccttaatcaagatcaaccactcatcccccctaatcaaacgccatacaccaccaacagcaggtaaaatttggttagagaagaggaggaaacaggaggggaaccaccacacctggactcctagagacgagaaaatggacatttcgccatgttcaaaacgcggtttcgctagaatgccatctcaaaaacatgattcgataaaatgccaatatagagcgtgcgtctaccgccactttgccatttttgccattttattcattttcgaaaagattttctctcctctactaggtgatgagacaaaattgccccttatcaactcagagaacacggtgaaagatgagacagaataggcaaggagacagagagaaggggcggcgacgccgttgctgcccacaactactctaccggccggtgcgccacctctccccattcctcaacctcgccgctccccgccacaccccacgccgccaccacctgtgctcgccgccaactgaacagccaccccgccgacaactgccaccaactgtcatcgtcgtcggtcgcgccgggacctgcggcagcggcggcgaggaccgcatcagcaacctcccggacgaccagttgtgtctcgtcctacgctggctcgacacccacactgcggtcgccacgggggcgcttctcttttcttctcctcttcccctcggtttctcttcctgttccccttttctctcttccttcttagctagcgaggaggcgcagctggtgcagtggcgaggctgggtgcggcggcacggccgacgacccgaccaaggcgatggcggttggcccagcgcggcggcggcctaagggcggccaggcggcgtcgggtggatggggagagaaggccggtgcggcgaggaggtgccggggcggcaccggttagagaaggcagaggtggaggtgctgggtggtcacggaggcagaggcggcgcgcaaggaggcggtgctccacacggcgcggcggtgtcccagcgcccatgaagacggccatgggggcgctcgcgttgctcggccggcaagctcggtcttgccccatctcacaccaccgtcgacgccctcgtcagcaacggtgaccacctcgccatgctcgatctcgatcccctttcaaccgacaaggaggggcaatttagtctcatcaagccgaattccagtgaaaatggatttgaaaatgacaaaaatggagaaaatggtaaagtgactgtgatcacgcgcttcatattggcattttagcgaaacatgttttcggaatagcattccggcgaaatcgctttttgaaagtggccaaatgtccatttctccctggagacggcaaggtcatccattgtgtagatgaagtcaaagccctggatcttctatcggtcggcactgtcaccacgaggagagcgggcggggccatgggggcgtccaagcagcgcaccgccactgctgcccttgcgttcacgcgaatcaccagcacctcctacacccgatgcagcggcgcgcaccgtgggagtcgagctcaatggcggtgcttgaggtgccgaggggtggccctggttcctcctcctgatgcgacgcgcaacgtgggggtggctgcgactgcagctgtgcaccgaaaccggtcctctccaccgtcggctcggctgcctccctaagcagtccgtcgccacgtttttcctgatgtccgccatcgccggagctccatccctccgtggctgtcaacgaatgtggctggacacggtcacagagaaggggaaccgaagatgggaggccgccctgggatgggagtggtgggaggacgggatttagggggtggatggagacgggaggtgaggcggtggatcggcggcgagggtgaggtggcgtgggagggcgaggtcgggcacgacgattggggcgaacacgtgatggacgaggagcgggagtgcgggcacgatgacgttctggcgggggagatcgtcggcaacgtgtgaaacgacgagagggagagaggattagggtggcgtggaggtggaggagacgcagggcggggtggtggggttgagatctgagcgaagggcgtggggcggtgggcggaggagcgaggccatgaggggcgtgaagggatcgatgtggaggactggatgtcgcgatcgtatcattaatatcacgcgtgtctatcacgttagtgtcaccaataccattataaattttttaagtagtaataactaatatctctatttctatctctatctctatctctactactccctccgtctacttttaataggcatatttcatcttagcacaatgaccaagaataagtaattctacttatcatccatttaaacatgctactctctccgtctacttttgatagacatatttctaaatctaaaaaaaatatttttgatagacatatttcaattgaaccacttatcatcttaat

SEQ ID NO: 17110 - DNA, 1083 bp, Oryza sativa
ggcttcgcacattataaagtacagactaataataaatcaagtgctttgaataatgcaccatcttcacgattttccaggcacaaatataaccacatcttctgtgtcactgatatggaagattggtatgataaactttcccaatcttttagggatactgcaaaggaagtattggcaaagacagatattgatccaaatgttaggtgcttcccaaaaagacagatgaagcgcatcaccaacaactacagcactaccctgggaagaggagggttttctgtggtgtacaagggtaggctcgacgatggtcgttcagtggcagtgaaacaatataattggagaacacagaaggagttcacaaaagaggtgatcatacagtctcagtgtagccataagaacattgttaggctattgggctgttgtgtagaggccgctgctccgatattggtcaccgagtttgtccccaacggaaacctttctgaccttctacacggcaacagtggactgcttcctgtcacattagagacacgcttacagattgcgctggatgtagcagaagcacttgtatatatgcattgctcccaaagttatccaatccttcatggagatgtcaaaccgtcaaacattcttctgggtgacaagggtgtagcgaaactgtgtgactttggaatatcaaggctgctctctatggatagtgatgaatacacaggatttgttatcggaagtaaaggttatgtagatcctgttttctgccagactgggcgattaagccaaaaatgcgatgtctacagcttttgggtggttcttttagaactcatcaccaaaaagaaaggaattgatgacatgaaagtgtgtcttgcagaaatttttgcttgttccagtagaaaaggtgatgaacataaactatttgacatggacattgtaaccaatgagaatatggagtttcttcaaggaattggcagggtcgcactcgaatgtataaagtttgaagtagaggagcggccagaaatgaggctagttttagagcagcttttgagtctcaaaagatcccgagataagagcattcatgagatgcaggttgtacgtaaa

SEQ ID NO: 17111 - DNA, 575 bp, Oryza sativa
  unsure (1)..(575): unsure at all n locations
acatatatcattttctccaccttgacaccattgtatccaaatgcaagctattgtatttcaaatggcccaaaatacccattttacatctcttctctcccacctcactgacatttgggccccacacatcatcccctacctctttttttctctcgttacctctctcgtggtctctccttttccatatgcctgaggaaacatggcatcgtggaggactaggtggctagagggggaggggtctcaccgccttgaagataccaacattgggttgtgtgcatctgaacaggttgtcatggggaccttttctcgtcggaagtggaggacgggcttggagtgtgcaaagtggaactaggctggtggagggcagcgacagtgggtttaggttttaggttcagcgttggacaatgatgacgccatggaagcagaagagggtggaggagatgttgtccaagaacctggtggcggagctatgcctctccaggctctactccatcgtgccaaagatnnnnnnnnnnnnnnnnnnnnnnnnnnnnnnnnnnnnnnnnnnnnnnnnnnnnnnnnnnnnnnnnnnnnnnnnn

SEQ ID NO: 17112 - DNA, 642 bp, Oryza sativa
atttctaattttaggtacccatacttgcttgggtcctctcatgttagtaacaagtgtcttaggcacccaaagtactctcttgatagaaatattcttgccccttgggcctacatacttagcaacaacacgacaactagcattcttcctaagaacataagatgcatcaaaagaacaatgtgaagcataatcattaggaaggatacttttggccttaacaaaattgctaagaccttggggcctcctgatcagcacactcttgtccaccttttcttttggtggaggaacatacccaagaccctgatggtagaagttgtccctttgatagcctaggtactcctttagggccttactatccatatggcacttaagtaagccattgtgaaggagtcccataagcttctcattttgcttttgcaaagcactcaaggaaatagagttagtagcacaagcttcaatatcaatatctttgcatctcacacatggttcattgcttgggacaattttagaacaagatggctcgctagggagagagacactattctttaaggttttgaacttctcttaagagtgaggtatgctttgttcaagccattcactctcttttgaaagtgagcggtcgccacctcaagaatagcatgagac

SEQ ID NO: 17113 - DNA, 1042 bp, Oryza sativa
tatacaaagtgttagtcttaaaatatgtgcgcgccttatattgtgggatagtgggagtatattttcttttacaaaattaaaagatggtttaaagaatgttgattggatattttaaatttttttattatatatcttaattttactacatatttatatttgtgaagtaatatattttatttttatattataaaaaataaaatggaccgttaatttttttcctccgggcagcagaaggaaagcttcgttttaaacagtaatgtacgtactcaaatttttgtttccaatcatacgtacgtacctacgtaggggacagcagtcatgtttgtatcatatatacggtcggaggaagttattattttttaataataaatttaatctaatggtgtaaaataatgggtccacaaattaagcgaaaatcaacggtacggttaggacgggtccaccaatttaagtgaaaatcaacggtgagattagatagtgccatgtgacggcttaagaacgtttataggagtgacacatggcagcgttagagcgtttgtaagaagtttaatggacttttagtatataatagaagatagatagatatagttgcttactgtattattaatatctagtcctacctatcatatgcacattatgttttggagctggctataaatttgtagcctgttgctgctctatctctttctttatttttttaaaatatgtttatagctggcttatagtttttattgtacctgtatgtaaagatgctcaagcacgagctgcagcgcaggtggtctgtgagaagtagcagcagatgaggagcgggccctacgttatctcggagcgtggacacgactacgccacgtcggatagcacatcatgatcggcagctaacccaacgtagccgcaggctggagctgtgttggaaagggagagtgatgaatccatgaacgaaccattagcagctagctaggtcgcgggctgagggctgactaatcatggagcaagcagcgaaggccaccatctcactgtcgccgccgagttacgctggatgttg

SEQ ID NO: 17114 - DNA, 1216 bp, Oryza sativa
  unsure (1)..(1216): unsure at all n locations
tttttattttttaaagtatgataatctaatggtctaaaatattgggtcggtcaatttaactaaaaataaatacatttttcttagaatatctatgattttctctaattcattggtgtgtcatgtagtgatataggtgcgtttatggaataccgcgtgacggattggtggcgtttgtagaaggtttaataaacttttaatttataatagatagatagattataagctgttagttatttaatgtttgattttatttaatcttaaacttataatataatatgttagttatataatgtttgattttatttaatcttaaattttgctgggtagaaacaaaaagatggaaagagtaatcgatgataggagataggagacagagggagggacggacgcacgaatgttaagtaggtgatgacggggagaggatgccaaggaggtggtgggttaggggtgggattggatttatggatgggttgatagatctaatgatgaaaatttcttcgacttctctatttagtagaacatttgtaaaaagtataatggatttttttatataatagatttaaaaaatacaacaggatcacaaattagatactctctctatcccataatataaatcgtggtgaaagttggcatggtcatcaaaactaagttttagcttataatttttcatatactataaggttaatagtaacaaaattataaccatatgaaagtaattttaaatttcaatctaatgatatatttttaacaaataaaatttattttatattatacaaagtgttagtcttaaaatatgtgcgcgccttatattgtgggatagtgggagtatattttcttttacaaaattaaaagatggtttaaagaatgttgattggatattttaaatttttttattatatatcttaattttactacatatttatatttgtgaagtaatatattttatttttatattataaaaaataaaatggaccgttaatttttttcctccgggcagcagaaggaaagcttcgttttaaacagtaatgtacgtactcaaatttttgtttccaatcatacgtacgtacctacgtaggggacagcagtcatgtttgtatcatatatacggtcggaggaagttattattttttaataataaatttnnnnnnnnnnnnnnnnnnnnnnnnnnnnnnnnnnnnnnnnnnnnnnnnnnnnnnnnnnnnnnnnnnnnnnnnnn

SEQ ID NO: 17115 - DNA, 8244 bp, Oryza sativa
ctcgctccatctcctccctccggcatgccccttctgctcgtgtttacgccgcagccgcagccgcagccacgccggagtccaagtcgacgaaagagaatgacctcgtcttcatcgcgggagccaccggaaaggtgggatcccgagctgtaaggtacacctcctcctcctcgatccgttcgtcctccaggccggctagccagtcatccctcgatcgatctgtccctggaaaaatatactccagtatgttaattactgcagagacacgtacgcttgtatgcgcttgcagggagttcatcaagcttggcttccgtgtccgcgccggcgttagaagtgcacagagagcatcgtcccttgtgcaggtaacaataatccatgaatcttgctaccagctacacctatgtaaatgttggagtacagtacttttcatttatacatcttgaccatacatacgatcgacatttcaatttcagagtgttgagcaactgaaagtcgatgacgatgcaacttcgcgtgagtcgtcggcatagatatattaattcgagtttccggttaactgtttgtgtctgaactggatcaataatctctagaccagccgcagaaaggctcgagatcgtagaatgcgacctggagaagcaggcgcagtcagacatcgtgtcggccattggcaacgcggcgattgtggtgtgctccatcggcgccagcgagaaggacatcctggatgtaacgggcccctaccgtatcgactacatggccaccaacaacctcgtgcaggctggtatgtatatataatatactctagctagcttaattagctttaatttgttcatcattaatattactctataagcagaaacaattaataattgaaactcattaactacgtacatcattgacgtacgtgcgccagcaactgctgcaaaggttgagcacttcatcctggttacatccctgggcacaaacaggattggcttccctgcttttcttctcaagtaagctagatcgatgtgtaattaattaatttccttgttcgatataattattggccctgttttagtttgaggaagaaaaaaagagatcgatatgtatgcatatatatgtagacagcccagccctttaggacgtacaaaaacgaaatgaaatttatgatgcatatgcacgcatggttacagcttgttttggggggttctgtgctggaaaaggcgagctgaagaagcgctcatcggcagcggccttccttacacggtacgctttctttaagataataaaaatggtttgcatcttcagcttctaccaatgagtttaggtgtattgtcaggtatatatacactatatatatgcaattaattaatgggttaattagatccatgctattaaaaatatgctgattttgaaatataccattagtattcaagtattttgaaccatgccattataattttatacatatttgatatatgccactatttatcacttagatgcatttaaaaaaaaattggacaaaattgcccttcttcttccttcctccacttcttctcccttcttcctgttcgacggcagcggtggagcggcccggcggcaagtggcggcggcaggagcggcggtgcggcgggcggcggcgagcggtggcggcgacggcagcagcaggcagcggcgcgacgacaagcggcctcttcaccgtcaatcttgccggcctcttgaaaccagccacgcaccatgacagtgtcaccatccccggcgttcaactgctcccaattccccacctcacacactgctgaaagacgcggcggcggatggacttggggtcgtcgtcccaggggtagtcgtgttcgagctggaggatggacttggcggagcggcccggcggcaagcggcggcagcagcaaggagcggcggtgatgacagcagcagcgagcagcggcgcggcggcgagtggccgcagcagcagcggcggagcaagaagcaacaagaagagggggtagaagatgagggtaatttcgtccaataaatacaaaatacgtatcttaatggcatcgttacaaatatgtaaatattaatggtatattttaaaaccagtaaaattttaatagcatagatctaattaattactatataatttctcatcagatcgtccgacctggtggcatggagaggccaacggacgctttcaaggagacgcacaacctggtggtggcagttgaggacacctacgtcggtggactcgtttccaaccttcaggtggcggagctcatcgcgtgcatcgccagcaacaggagaacggcctactgcaaggtggtcgaagcgatcgcagagaccaccgcgccattgctgcccacggaggatcagctcgccaacataccttcaaagcgggtatacccatgcctattattagcatttaatttctccatttcatattataatttgatatttttcacagtcaatattttttattttaagctcaatcaactttattagaaaaatatagcaacattttcgataaaaaatcatatattatcggaatataatttaatgttagtttcgacgaaactaaggctgcattttttcgcttagatttgagagagatttttcaatgcacgcaaaacgagaaagattattagtatatgattaattaagtaaataattataaacttgaaaaatagatttatttaatttttttaaacaacttttgtatataatttttttttgcaaaaaaacaccattgaacagtttgaaaaatgtgctaacaaaaaaaataagcaagttaaagtttggagttgatgaaaataataatcctaagttgatgttgctatttttttaaaaaaaaatttagttaactcaagtaagtttaacttaaaaaaattaaaccgacttataatatttttattatatacatatgaaataatgtgttaaattgatggcatatgtatacccatatgtgcagcaacctccgcccgaacctgaggtagttcagcagggagagacccctccaaaaccgatccagcaaagccaacgaccactctcaccctacacggcgtaagtataacgtgcacctacatatacagtacattctactccctaaattaatcctattttttctataaaaaaactagtgtagaaactttttcccttttagagatggttgccaagagcatgctcataatcaggactgaaacaaaatatctatctatctatctatctatctatctattatctattatctatcttctattatataagtccattaactttctacaaatgctcctaaatcgccacgtgacactttaaaatttaaaaaaattctttaaaattctgaaaaaaaaacatctaaccattgatttttattaaatctggtggacccattatttataaccattagatttatctttgagaaaaaaaacatctcctaacccgggtccacctggcatgtaggtacgtacattcctgtacgtacgtctccccatgttccctcaaaccttggttcctcctcttttttatcacaaaatataacctgagaagttaggcttaaccagtgacacatgtgtgagggaagtactactatacatgcatggcttttttgctattagacatgcatgtcttttttctctcttcttataaagttttctcacaaattacttgtccgatcaacaattagattacaccatcgtattcgttgcaattaaatctttacatcaaagatcttacacgattatattacgatgaaaaaatatttatgtttgtaaattaattttattatatacgtaagttacttttatcatatatataaattacttttagatttgactaaattacttcttatacattcataatactctaaattgattatttttattattgttttaagttaatttaataatttatggactttaaatttaatttttacatagaccatatttttctctctacagcaaatttacttctaatgttgtaacaacttattttcattttgtgctaagttatttttatgattgatgtaaattacttttagactttattaaatttatttttagactttattaaatttactttcataaatgcatttacttaaaaatattctctacgctttacttgtgaatttactctacttactgtttcatttcaactcagtcacaaatgtaattacttctactacaaaaagttactcctgttagatagctaagttatttctacaatttcaatgaattgcttttaaattaataaattgtttgaatatattcaacgtgcatcttgttttctcacatgttttatatagagtacaatgatgcaaatagatcttgaaaacaatatgtgatttaaaatatataagttattaaagaggttaaatctaaaagtaatttatatatatgataaacgtaacctacatatatattaaaattaatttacaatatagatatttttttcagaatataatcatgtaaaatcttattgtaaagatttaattataacaacacaacggtataatcgaattatggatcggataagtaatttgagagaaaattctataagaagaaaaagaaaagcatgcactattgagtctagtagtagcaactaaagtgaggtcgcagaatattatgcctaactagcgatggttttgtcatagtcacgtcccttttttttatctaatcattctcttatttttatgccttactctctccgtttcaggttataagatgttttgactttggtcaaaattaaactgcttcaaatttgacaaagtttatagacaaatatagtaatatttacattaccaaattagttttcttaaattaataattaaatatattttataataactttatcttggttcgaaaatattactattcttttctataaatttgattaaacttaaagcagtttgactttgactaaagtcaaaacatcttataagttgaaatgtagggagtattagttagaaaaccaaaaattttgcgattttgctaaatatttatttacagatttttttttggctaaaaatcactcggtattttttaccgtccgattcattgatgatttctgtgcttcgttattagccgcacagtttctttgcgtgtcctctttccttttccctgtgttgtatgcacatatttattcgttcactacccgtgattggttggctatcgtttgagagatagaagatgcatattctctatttactagctgctatatgactatgcgaatggcttctgctgttcttttgtgagactagcatactacttttatatatatatatatatatatatatatatatatatatatatatatatatatatatatataaagttacatatcagttacactataattatattatatttctaccttagttgcatttgtatgattttagtggaaaaatctgtcgagcgatacatagatagaccaaaaattttgtgttaaataattgagcaactataacatataaatcataaaactaatttttatctacttacatctttaaattatttatgaataaatttagacttgaagaccaaacttcactataattcaactttgaatgtcattttgggttatactttttgatttttgagtgccatcaagcaattattaaaaaaataaaatataataataataacaatatagatttcattatcgtaaacaacttcataatagtcaaattagatctataatcattaaagtaaaatgataactatgagtaatgttcccaaagtatattagttagaaatcataagttatggctggaaataagcaactataacatctaaaccatacaactgatattttatatcatctaaatcatacatataatatttgatccacttatgtctttagattattttacgttcaaagactcatatccagtgtaatttaactttgaaaagaattatgtcactttcgggaggtgtattttctgaattctgtgtgccattcaaacaatttaaaattataaaaagatagtgatttagattttatcatcctacataactttataattattaaattagacctatagtgataaaatttgaattaacctaactctgagtaataatgaaaaattactcccaaattctaacattataataagtcaaaataatattattagatttgtagtgttcatattttgaatatctactatgaatatgaatataccataagaatagatgagtaaaaacttttattctatttttatttaataaagtaatagcaactaagatactattacccgtgaaaaaaatataattatctgcaagcgtacattctccccttcggctctctcttcctctcctctctcattcaattcctccgtgttctaatttttaactaattaataaaagctatcaatatttagaaagaaaaatgattataattcttaagtgatatcctatttttattttgtgaattattgttttatttatagttaagtaaataatttaagatccacattaccacttatttctgcataaaataaaaacacgtcatttgaacatagacacctatgcttttgcatggtaaccaaatagcaaaaagaacataacattatcacaagtacatgctctgtagcgcacttaaaatgtcacgtttccgtcttaaacaaaaataaaatcatagatattgtaaagaaaaaatcatctgccttgtgttatgtcttaaaaattaaaaaaaagatattagaaatgtgagaaaaaagttggatcatcggttttcacttaatatcatttagagaaaaaaaccacccctccgcttcagcctcccccacacatggacacaatacaatactacatgtctcctccctgtccttttatagtttgcaataataaaaaatattaaaatatgcataatttttaagatactcatatgatttctaatctaactattgttgtattcacaattaaaccaacgatatgaagatccataacgcctaaattttgaactggtataaaataaaataggaaacaaaaaatgtcaataaggactaaattgaactatttggagaaaatttaataagttcgtaaaagcatttgtgcttaatttttactaaaattggaccaaccattgcatgtcccatttttataacaatttgtaaatgcttagtttctcgatatactattgcatatataagccacgctaaggttgttgtatatagtttgttgaaaagttatatttcttactattaaatttaattttttggattcatgttaacaaggtattttctttgaaaaagagaaagtatataccgcaaatatcacaaggaaggaggtatacgacatctctttgttaatttatatgcatgtatgtaacaacttgtgtcaatctgaaccaactaagtaggactagcttacaaataatacacattattaacaataatagttctttagggttttaaaaaaagcccctatgaatttaattaaacaagataaaacaccttagttttaagtgcatttacacttagtttgttagacacgtttatcaaatgttatatattttaaatgctaacaaatagtttggaaaaattatctaagcaataccaatgaagaaaattcatagagaaataatacttttgaaatatggcatcttacaatgggttgatattccgcctatataaatttttcaaacacaatcaataatatacatgtccgcacgaatgcacgggctatcttcctagttgcaattaatagttaaaaaaatgttttttacaaaacatatttagggtgaaacattgtctgacttttaatataattttgattgaaccattattatgaatgtttgcatgcgggtgattttttttcttgaaatattctttgattctactctaaacctgtttctgtcaataatttatttgggattgttttcatagtggttatgattttcttctaattacccttctaacatataaattgtaaagtagaaatacttgaaatcgtacagtcctgaatttatgagaatttattgtagtggaataatggagtttctaaactttaaatactatttgttttttttgtatatatagtattttctctgttttttaatatataacaccattgattttttagactattcatcttattaaacacaattaactaatgctatgagagagtatatgtatgaagagtgccgccatttatagatggatttgttcggtttgtttggtttgtttgcacatatgtggattaatttagttttgaatatttgtaaagttgtatatttgatttcataatatatacgaagatttttagaaatttctaaggttgtttg

SEQ ID NO: 17116 - DNA, 6427 bp, Oryza sativa
gtaagatcatttatggatttttggtgtgcatatgtacgcatatagatcattcacaactgtgtggctatctaactagcataaaaaacgatgcatgatttgcttggagagagttgggcatgtacgggaggcagtcaggaggcggtacgtacagactcatacatatataatatactaggtgaaacccagcgcattgctgcgggaatttagtataataacaataaaaaaaataatatgtaaaatagctagataatattagattaagtaaattaatgtggtttatgataatttaaatttaaatagtatgtagaatggtgattcaaacgtaaaaagtaaggtagaatgactttatggaagaagaaaaataggaagatagtttggaccgtagattaatcatctaaagactaaaaacaattgatataatatgacttaattagagggaaaaaggagaaagataatttgtaccatagattaatcatttaagcactaacaagtaaggatgaactatataagtatataggatatcataaaacataataaagatatactttgaaacattatgtgaattatgttggatgataatttaacatgtttgtatttgaaaagctcttaaattataaaaactataaagatatagcatgtttacatgatgtttaaatgtgatgattgttagtggatgatgatgtgacatcttgttaattagtggactagtggatgatatgcgatatctttgcatgttaagcttaaggagttagtggaggataacttagtaagataggatacctacaggaggcagggtttaaggaatttattttttaagattgatctaatggttgatactaatgggtccaccgatttaaatgaaaatcaatggttagattctttagttgccacatgacagtttgagagtgttttgaggagtaccatgtgacggcttgagagcgtttttaggaagtttaatggatttttagtatataataataggtagattggggtgctaatagatagatagatatattaattatattatactctctctccactgttcacagagaaaacgttcgatcgcttcaatatcgaaatcctaactcattagctttgtactgattttgccataacttcagattacctgttggcaatatatagctttgtgctgatgattttggccggtctggcatggctacagatttgtggacctgaagcctccaagctcgccatcgccgtgcccaccatcagcagcagctcctgctcctacttctacagataccgctgcggcaggttcatcgtcaacgttgaactccagcgccaccggcacccccatcagcgtggatcaaccgaagcagcagcagaggcctctttcaccgtacactaggtactatatatacttaagactaattgattaattgatgccatttcatttttggtgttgtctattaatgaattggttaattaatttgttgaatgcacggtgcaccgtggatgtaatgatttgttctaagatatgaggagctgaagccacccagctcgccgtcaccgacgccgccatcagcagcttcatcggcttctgtttctgcttctcctgatacacctcctgcagcagcagcttcatcggcggcgttggactccagcgccaacggcactcccatcaccggcgatcaactgaatcagcagcagagtcctctttcaccatacacaaggtgcgtactgtacgactatatatgtatatacatgcttgtccattcttgtactaattcgatctttttgtgaatgcattattcaaggtacgaggaactcaagcctccaagctcgccaaccccatctacccccaaactatagaagcaagatagttagcatataaggctatattcgttttttgccttggccaatcatcactcaagatccagttatccactactagttaattaccttcatccaggaaaagcgacttgtatttttcatgtccaaattcaaaaaaaacaaagagtagtattggaattggaagtcaacaaattaattctctctaagtcttacaatgtttgtgcaccaagacccaggaataatttaaacggcatcaatcaatatgacatgcacaatatgcacacattatcccacaatgcatgcatcaatttaaaacacaatgcacaattacacccttagcatgcacatattttcccatgctgtattaatttaattgtactccgatgaaatccttgtccatgcagttatatgatgatcaaattgagaaaatttggttttcaatatatgatgatcaatttgggcaagagtgagtaagtcttaaccataaatactccatccatcccattttaaacatcacataagcaaagaacacaaagatcatggacaactaaacctttatcattctgtaattaattctcatcagttataagagcatctccaatagcctctccaaatcggactctccaaacacccatatagccaactctccatcttatttggctagtcaaactacttactcgctccaacagcctctccatctacccactctattttaagtctatcacagtgggtccccacatgtcagtcgctgcttcttcttcctcctctcccctccttcctctttctcccgcaggtatcaccgagcgcctcttcggcgacggcgaaggtggaactgtgcgcacgcgaggcaaaggcatcggaggcggcaagggggaagggggtgggagaaatccgtgtgcgcgaggtgggctcgtgcagcaagtagacgacgacgatgaaaggggagaagcaggcggcggcaaatccgtgcacatgcgagtcgacggcgacggcgagggatgacgaagactacggcgacggcgaaaggggaagccggccccactgccgcctcatttcctatctcgctagcgccaccactcccttcacgccgccttgtctcccttctcccacctcgacaccgtcgtcaggctgcgaggtgacaggttgcagcgagtggcggggcggccggaggcggggtaacggctgcggtgagcggaggcggcgggctgtagcgagcggaggccggcggctgcggcggcagggcggccagaggatgatgctatggcaggctgcggcgagcggcggggcgggcaccgtcttcacctgccatagcagtgctcctccccgtgctcctcgcctggttgcctgtgctcgaggggtgggaaagagacggatgcgagagagagagagggggggtatggaggagactgtcagtgtggggcccaccattggccagccaaatttagccagtgaggaggagggtttggcggccagtgagttggagaggctgttggagcatgttttttgggtagaatagccaaaatttaacttggagagtcaatgggagaggctgttggagatgttgtactacgttgtttcgtatcccatggattacatcaagttttaaatattgcatgtagttgaccaatagaaattaatcttggttggttgcatgcggcgtattcaatgatgctcatttactctttttgcacaaataaataaagatgtgtttgttagaggatgatcattttgggaagatctcaagaaccttacgtgctgatcaaattaggatagagggagtaccaaatttcaggaaccaaaaggctttcttcttccatgcatcaaattcagatatacatttccagtcctagttcagctacaacgctcttcgcgggagcgattcctcggacagcggggagtggagaccccttcccaggtgtgaagattggaccaggggtttgtggtgcaaggcataggaaggtatctaggcaagatcggatctgcggggcctgagctccccgctgagcaaaagatacatgaatttatacccacccggaggtgtaataccctactcctgtgttggtttcgttgtcttcccaagataaggtaagtacaagggaggcctttccaggcaacaatgtgaaatgtactgatctaaagaatccaacccttcatccgtagcttgtcccctcccttttatagtccaaggaggggctcacattattacaaatatactctttgtcttgtcttatcagccgtcttgtcgttgtcggctagttctctaacacaatcttcaagaaacccattgagatttgaaacctgcattatattaccccgggtacctgggcttctgttcgacacagctgggttgcgacaactagcccaccacgtggcaagtggtgggcctggaggaacccgggctgcctgaaacagcgccacggttcctcttctgcccgtttggccaaattaggtggtgtgaggcatgttcgacacgcatcaaagacgccaccagttctaatgactcagcgctggtatcttgtccacgtcctttcagctccagactggctggggctccccataaacatgtttcatttatggtggagaggtccacttcacaacagtccatggagtgcgcccatctccccagccggtcctgatgttgcgcccttgcgctttttgtgatgataattcatctattcttaggcgagcttctcgaagatgtcgttgatcagtagataatgtgcttattttgtatgtttagacgctcttctttgcagatgaacttggaaactataaggactaaggtgagctcggggcccaggacaaggccgggcctaaggcagacctgagtctacttcttaagatgtagatcttgtatgtctctacgctcctcttattgagtagcataggacttacaaagactaaggtgagttcgggacccaggacaagaccaggtctgaggcaaaccttaggttacattcctcttcatagagcagtgtgtaacctagacgtgctaaggtgaacctgggacccgagacaggactgggtttgaggcaaaccttaggctacattcttatccccgaagacaaacaaaggactcaccaaggtggggcccctagccctatcaccctaggagtagctttttatttttaagaatgatttaagcatgtcatttattttacttctaactattttgttagagaaatgggtaccttggtttccatttcactgaaagtagcccccagcctcgggctgggctagagagatgaacgaggccgggcctggggcttctctccgaaggaaaaccgaagtcaaggtctcgggtccaacttgtcagggttcaacgagcgtgacaacactctgtcatgtcgcacgtctcatcattctgtgggtcagctgcgggagttaagccacgttcacacgccgccttaacttcccactaccatcccgtttttcgaggcgtcgtgggcgtggagaccgaaatgtctactcggggtttcttcttttaaaacctccctttcatccccattcgatctttccacgccctagcgctcttaccctcgattcaatcttgccgccaccgatcttcactaactccggtcatctttccccgccaccttctttctctccttttgcctgcaccatgctgttgtccaaccgcaacacactgtcggtgccggttgaatagaaaactaagtccatttgaaaatcattaaaatagttagaaataagtagaatgcattaaatatatgtttggaacttttaattttttaaaataattaaaataaggataatacatggaaaattatatttacaattattcgagacatataaaatttatatataattaaccatatctccgattaagtccatttaaaactcattaaaatcgttagaaatcagaagaatacattaaaaatgtgtaccatcggtttttagtttaattttgatgttttaaattattatatgattatttaatttttttcactttcgtggacttcctttacatttgttatcttctgatgtagatgaatcggcaatggatgttgtcatggttatggataccacatacttaatagtagttgactaaacttgccagggcccaccgcataccatgtcttatacggaaacaaacctcgtatatagaaggagttccggataatgaaggataaatagagttctatatggaaacggcaaggactactcggattgtatccatatttatctccctagtcttacttggacaagagggcatatatgagtataaatacaagccccccaggaggagaggggtcacgccacaacgcctcaaagccacaagccaacacacgtcgccagatatcaacatcagatataagtctagacataccccatccgactcctacggaggctggcaagagggatctagcaccatctctgatctcgccgagtacggattcgaggaggaagactaccctgttgtcgactacgggttggttatctagcccgctagtcgacgacggctagatgagttatcccaattattggacttgtgtgattcagatgaataaaggagcaacaccagctgccgcccacaagatgtagggctattacctggcagataaggggcccaaacctgtattaaaatccctgt

SEQ ID NO: 17117 - DNA, 8571 bp, Oryza sativa
  unsure (1)..(8571): unsure at all n locations
ggggattttggtgctccaaggttttgacaagatgggttaaggaatgaattctccgacaacaaaatactcgatgacttcgcctatagaaagatctaccccgaccggagtatgtcccccgcagagatcaatgactttaccagaaagcctccgttcgagtcgactgcccgggaagtgacatcgtcaattaattttgattctgttgggacctggattatcctcacccctaacacatagtgagaacgtccatcccgacaagtcgtggcgaggagaccgaatacatcattattcaagaccatcacgtactatttgctcctgacatgtgcacctacatatgcatggactcaatacatgcctaggtgtgcattgatttgacgacatgtacatgcacagaagacaattcagatcggctaccaaggctaattaaggtaattagtagattaattaaattgatctactaattccgtagatatattcggcatgtatctacaaaggtacgcaatattttatatacaatttatcgtacctattttccgatctatacaatattgttagataaataatttattatgtttacctagagcatgttttctatacaatatttattgtgcaagtgtttccggtgttaggccgactacggtttaatgctgggggctcgctctattttcttctgtataaatcatgtttgtttatggtttacataatgtccgatatttaatctgttcattatatcctgataatactagaagatccatgcagtcttttgagtatatactcgatattctctgctatacatcttgtcttctagaaaatatttttcaggaacgattgagcactcgagtaggatgtggtcgagtacaccgcattatcgagaacattctcgaaaaatgttgagttgtcgcacccaacctaccaacgaatattgacaacttatctcatgtatagcatcggctacagctagactatttgagaaaatgttgttaatggataattcctcgcgaacattgtcggcttgatcacccgacatgattgcgaatagacatccggatatgctatatgttgggtatgtgagtcatactggccacatgagatgcacatgtaatcaccaactctagcgcctctccaggtgatcgagatacgcctacacctagtcctcgaccagtagatcgtagtgatctctcactacctaaaaattcgttcgagacacgtctacacctagtccttggctagtagatcatagcgatctctcaccacctaaaaatttatcttcaggtgatcgagatatgcctacccctggtccttgactagtcggttgagcaatctctcgacatctaacgcgacaatcaacattgtcgtgatagcgacaaccaagaccgactagatcatcgttgtcaccaggacgacaacgtccaggactaacgacatcaggacgacatcagacaaggttaacgacatcatgacatcacacgacgacgacgaaactcgagatccccagacttctagagggcccgaggatgaggtagtaggtataggagccgaacctccgactacgataattcctcattgtcttcgtcttcatcaagaggctattctcgcagttcacgagaatgtcgtccatatattactctggattccttacaaatggtcgaggtaccactacgattggtcttcaatcgacaacgtagcgatcctcgtaccacaacttccactggttgaggtacgactacgactggttttcagccagcaacgtagcaatcctcgcaccacgacttctaatggtcgaggtacgactacgaatggttttccaccagcagcgtagcggtcctcgtatcatgacttccaaaggtcgagttacgacttcgactggtcctcgaccagtagcgtagcagtcctcgcacctcaatttcaaacagttgagagactcctactcctggttctcgaactagtaggtcgtagtgatctctcatacctccacttcaagtggtcgagttatgactacaactggtcttctgccagcgatgtagcgattctgccactacctatgcgatttgttgtgcacaactatacagttggtctttgcccagtgtggtggtcgtctgatcatctacgtcaaatttatgtaagtgcttgtatgtgcaatatttgtccagagatccattaccacgataacacctattgaccctttacgccgttccgacaagcctccaagagacctacgagaatttcagctagggacgcccatagtggataaggtcttgtcagactctgagagccgaacgaccatgtaagacctggtcatgtaagagtgctcaaaaggtgtattaactaagccgtgtaatcagaaattgatttttccaacttcacggctgggggctaggtaaatcgcattttcagctaggcaagttacaggtcgttgagccttctcctccgagaacgtgcttcttcgaggacaaggctgggggctaggaggagtaccgaactccgtttgctgagggcaactctagcgagagtactcttttattgtcaaacgcagattcaatttattttcaatttttcatacatattatatcatgttaccctttgagcgttcgcttcggggctatttctatttaatattctgttctgagtattgatttcaggaaagtaagccatcagaatagtcaagtcagattttcaaggctttgtcgctgaatttacacccccttgattactcaagaacgattgatggagctcgacaaggaatatggaatgaagcgatggtgtacccgccgagatgaaatttcttgacttcaatccaaattctcgattacagcaagacgggagacttagtcgcatgatccataccttctcggtcaacatcaggacctagacaaacccagtatggtgcctgcggaggctgataaggggtatctagcattatctctgatctcaccgagaacggtcaaatgagcacgacaatagtttttcaaagtcttcggtcgagaacatgaacatgttcatttgcattgaagtcaggggctactgtcgtggttacctaatagtagttgactaaactcgctagggcctaccacataccatgtcttatacggaaacaaacctcgtatatagaaggagttccggataaggaaggttaaatagagttctatatgaaaacgacaaggactagtcgtattgtatccatatttatctctgaaagtgcatctaggcccctaatgattttggtgattaattacaatgcgattagaaaggactaacatttttatttaagcaaatgtgaaggttgttatgtcctcaatgagttagcgtaatacatatcccgccgaatatgttgatgtgatgtgatgcggcaaatgagcaaatggtattttgtacgttttcgtttccttgagttaataggaaagccgcactattaagagggatgacgcattgacatacgaggagtgatcaaagtgctcaaaatctatttttaaaaagtgtttctcctcagtttggtgtgttctggatttttttggagttttccgaaactcattttcagactttccgaaaacacacaaaaccagatttttgcttctggaaattttcggatatgtccgaaagtgattttcggactttccaaaaatgactgcgagggcaaaagtggttttgtatattttcggacttgtccgaaactgatttttggattttccgaaaatcatcagtagagtcaatttcgcttctgtatattttcggacttgtccgaaagttattttcggacttttccaagaacatccagaacgatgttgttggtactggaaattttcggacttgtccgaaaagttttcgaaatgtccgaaaaatccttcgttgactttgctgttggtgctgagctggaattttcggacatgtccgaaaatctttcggaatatccgaaaatctcaattattgtgcataacgggcagaatctgggctgtggctataaatagccccctcccctcacttgtgagggctgctggttccattccaatcatttgtgcccttggcttgctctctctcactagcacttttgagccttactttcttgtttcccctctcactggtgttcgatttggatttggtgtgtgtgtgagagttgtggattcgagtttgtgtgagtgcttattgttgacttcgtgaagatttgtgagcacttgcatcatctccaggagttttttgcttcatttgttactcttggaggttgaggactcctaggcggctaggtgtcgctcccgagccaccgatctacttgtggttggccgggagaagtttgtgaaggtcagatctcacctccgaataggaagagatacccttagtggaaggaggagtgcttagtgcaatctcttgaggaaagggttagctaagacccggctcttagtgagctcctcaacggagagtagaatcccctcaaggattcaaacttcgagaacaacctcgtgagcttcatctttggtgactttacttcctacctctccactagctttgcttgttcgagccactataggtctagttgctgtttgtgctagcatattcttgttgtaggcaactatttctaggatttactttgctatttgtgctgactccaaaaattttcggatatatccaaaaatttcggaaatatccgaaaattactgcttccacttttaattgatttttgaattagcctattcacccctcctctaggcctaattgacactttcaattggtatcagagcctaatctcctaattaggcttaaccgcttggagagatcatgtcgggccaagcgggggatgggaacgatggtggtaagggagctaatatcccttatgactatccctctacatctatatcttatgtgagtacctatagcggcaaagctccgtacttcaatggtacggactatgccgcttggaagcataagatgaagatgcatttgaagtctattaacccatctatttggagaatagtcgaaaaaggctatgttttgtagaatcccgaagatcccaccaaggaggacgacgagaacaagcacaagaacgctcaagccgctaatgcaatacttagcgccttgagtggaagtgagttcaaccgtgtgatggcattgagagtgccaaagtgatttgggacacgcttcggaacttgcatgaaggcacggatagtgttcgtgagtccaagatggagatcctcaaggggcaatttgagagatttgtgatgttagatggtgagagcccaagcgacatgtacgaccggttgagcaagatcgtcaatgagatcaagggacttggctccaaggacatgaccgatgaggttgtggtcaagaagatggttcgagcaatcactccaaggaactttaccttggtgaccatcattcgtgagcgtccggactacaagactctcacacctcatgatttgctcggacgcatccttgcccatgacatgctcgtgcaagagtccaaggatgtcattcaatacatcaaccaaagctcaaccgcaagcatcaagaaggaagacttggctttgaaggcaaaggaagaagaagaagagaaccgcaagagcaagagcaaggcggagatcgatgatgaagagatggctctcttcgtcaagaagttcggcaaattcatgaggcgaagcggcttcttcaagggaggatcttccaagcactactctaacaagtcaagtggaagacactctgcaagagtgtgctacgtgtgcaaagagcccgggcacttcattgcggattgcccccacctcaaggatggttcccacatcaaggaagataagaagaaggatgagaagaaggagaagcacaagcatagcaagagcgaacattatggccaagctcaccttgggatgatctttggctccgactccaagtcaagctcaagtgatgaagaaggagttgccacgttcgccgtcaagccctcatcaccaccgagactcttcaactactcaagtgatgagaatgctaaggtaccttctcctcttaagtcatttaatgttgatcttgttagtgatgaggaggatgaggttgaggatgaggttatggatgacgaattgttcaagtccataactaaggaatccctaccacacttgagtgagttgcttgggagaattgaggaccaatatgtaactcttgagaggcaagagactttgctcattcatgagaaagagcggtctcatgaactcaagagtgagcttgctaaggagagagagaaaaatgaggcattggtacggctttacaagcaaaccaaagagtctcatgctaatcttgaggtggcgaacgctcaacttcaagagagagtggatggcttggacaaagcatacctcactcttgaagagaagttcaaaaccttaaagaatagtgtctctctccctagcgagccatcttgttctaaaattgtcccaagcaatgaaccatgtgtgagatgcaaagatattgatattgaagcttgtgctactaactctatttccttgagtgctttgcaaaagcaaaatgagaagcttatgggactccttcacaatggcttacttaagtgccatatggatagtaaggccctaaaggagtacctaggctatcaaagggacaacttctaccatcagggtcttgggtatgttcctccaccaaaagaaaaggtggacaagagtgtgctgatcaggaggccccaaggtcttagcaattttgttaaggccaaaagtatccttcctaatgattatgcttcacattgttcttttgatgcatcttatgttcttaggaagaatgctagttgtcgtgttgttgctaagtatgtaggcccaaggggcaagaatatttctatcaagagagtactttgggtgcctaagacacttgttactaacatgagaggacccaagcaagtatgggtacctaaaattagaaattgatctcttgtaggaatatgtctccggtggaagaagttgggtgattgataatggatgcacaaatcacatgatcggagaagaatcaatgttttcaactcttgatccaaatggcacttaacaagataacatagttttcggggacgatggaaagggaaaggttatgggattgggtaagattgcaatctctaatgatctttccattgccaacgttctcttggtaaaatctctaaactacaatcttttgtccgtttctcaattatgttctatgggttacaattgtctttttaccgatgttgatgtgaccgtctatagaaggaatgattcctcggtagtctttaaggatgtcctcaagggaaagctttaccttgtagatttttcctcaagtaaagccaaacatgagacatgcttagtggctaagtccaatacggggtggctttggcatcggaggctagcccatgttggtatgaggaatcttcacaagcttctaaagcacgatcacatccttggacaaacaaatgttcaatttgagaaagatagggtgtgtagcgcatatcaagccggcaaacaaattggagcacatcaccccgtcaagaatgtgatgaccactacaagaccattggagcttctccacatggacctcttcggaccaattgcttatctaagcattggaggtaacaaatatggtcttgttattgttgatgacttttcacgcttcacgtgggtgttctttttgcatgacaagagtgagacacaagctatcttcaagaagtttgcaagaagagcacaaaacgagttcgacctcaagatcaagaacattcgaagcgacaacggcaaggaatttaagaacacgtgcatcgagagtttccttgatgaagaaggaatcaagcacgagttctcggctccatattcacctcaataaaatggagtagccgagaggaagaataggactctcattgagatggcgaggaccatgttggatgagtacaagacatcggacggtttttgggccgaagccgtcaacaccgcatgccatgccatcaactgcctttatcttcaccgccttcttaagaagactccctatgagcttcttaccggtaacaaaccaaatgtctcttactttcgtgttttcggtagtaagtgttacattcttaataagaaggctagatcctctaagttcgctcctaaagtggatgagggattcttgcttgggtatgggtcaaatgaatgcgcttaccgcgttttcaacaaaacctccggtattgttgagatcgcgcgtgatgtgacatttgaagaaactaatggctctcaagtagagcaagttgattctcatgtgttaggtgaagaggaggatccgagcgaagcaatcaaaagattggctcttggggacgtacgtcctagggagccacaacaaggagtctcttcctcaacacaagtggagccacctacatcaacccaagccaacgatccctctatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17118 - DNA, 758 bp, Oryza sativa
  unsure (1)..(758): unsure at all n locations
gtatgacttgctgagtacagtgggtagtagtcagtcttgctctgtctcccatcccatagttggagtatgcgtcagatggtggctactcggaggagcaggctttgtccgttccatcaaggatgcgtgtggaatggtgttgccccgctgttagcatcaagatctagaataagctcgcttttattttccgttgcatttatgtaagacttttatatgtgtgtaagacgtggatctgtatatcaactttgtcgtttgtgtaccctggctggtcctggacaggggtttaatgcacatcttactcggaattatattcgggaatttctggacgtagcatatgtgtaagtaggcttgcccgtcggatgggctggctatgcggttctgtagggaggactgttacaaatggtatcagagctgaccctcgtggttgcacatacgggtcaatgtgtgggcatatgaagcatggcacctgtgggctctgtgtgaggcacatggcatggcgtatggcgccggcactagacatacagacatgcgctaaagagggggtgtgttcctggacatttgcctatatacctgtgtagctacatgggtaagttgggccatggggacgtcgggtcctttgagggagggtgtatgtgacatcctggcccaattaggatttggcctgtgtggcccatgaatttagcaaggttgaaaccaatttatnnnnnnnnnnnnnnnnnnnnnnnnnnnnnnnnnnnnnnnnnnnnnnnnnnnnnnnnnnn

SEQ ID NO: 17119 - DNA, 1128 bp, Oryza sativa
acgggcccgacaggtgggccccacctgtcggcgaccccgagagaggagggaggcgggacggcctggatgggcctcggcctgcggccggcccaacagggaggagggggaggaaaggagagaatgggccgacggcccattcgaaaaaaaaggaaaaagagagggaaaaaaaaagaaaaaggaaaaaggattttccctggaattaaaatattgcttgctcaattttaattggttaaaattatttttaaagctctgaaaattccactaaaaatcctgttagtgaatttcgacatgtagaactcaagaaaaattccacatgccaaatccgattattatttgcatactttcttagggtttactcttgctttgcacctgtattttcttggggtcatttataaattaaatttaggcttgggaggagaacttcggggtgtgacaggacactacacaagtcggcccataggtcccatatttcctttcggcccaataacgcccaaaagttactgttcttcttttccacacactttttttttgcgaggattcttctccatgcacttgcattcacgaagaaaaatttgcgtcgttctgctgctgctcggggaggaagaatgatgcctcaggaaaatagggatggggatatttgtgatgccgcgcagctatggcaaccacctcatgcgaggcccacatgtcggtctctcttctctcccttcttcttcctcccttctttctctcatccgtggcaccgtagagcttgaagcggtaggtacatggcagttacggatgactttctgactttccagagaatatgaagaacgatgtggtagcagaatgaggaggtcccatttttgccactttcggcggagaactgcatggttgagggctttctatgaggtgggaagcgaggaaatggggaaggagtaggcggcctatatgcaagggcaaggggcagatgacgggatgaggagcggcaccgcacgactaaggtcgcagtggctggcggaggaggtcgatcacgatagatgaaagagagcatgcgacgtgaatgaggatgagcgatgcgctacttgagctgagcaacgatctgtacattatgggtgggcattgtttgtggggtggggggggggcagatct

SEQ ID NO: 17120 - DNA, 5285 bp, Oryza sativa
  unsure (1)..(5285): unsure at all n locations
gcgcggggttggcatgagattagcaagagaggcgcgcaacaccgagtccggaccaaaattgttgtgcgctggcggaattgatttgatggcgggacgaggcggacgaaacctagatccgacgaacagaaaattacagattttttaagtaggttagatttgtaacaagtgcagagtttaaaagaggcgtcatagtggaacagtcgtactctgcggtttttcctttctcttcgggggcgcaggtcccggctagcgtccctctcgacagtataatgtcgatcgtgtaaaagttgtaataccctctttcttcttaataaaatttggcgactcatccttcggccgtcctggcaaaaataaaggaattaatgcaagtgctaccaggaagaggcatcgatgataaacagattgaaggctgcagcctacttctccctactccgacctcttcctccttcctgctgatttcttctctccaactatgttctttgatttcccgttctctacttctcttcctaatctacttgcttgttccccttaattgtattcaatacttgagcagtactctctggatcggttattggtgcttctccttctggtgttgattttttgaggatgaattgagaacataacactaggcagctgacgtgttagatccacgtgggtttcatgctgactcaatcgattcaacctcatcacattagttgaaaccgggcatagtagtgcactagtgcttagatcttcgtgcatcttttggtattgtaagttgatggacgcgttatatctggtaatacgttttaagaaactcaacgttcaaatggcggacctaaagtgaacttattcctgtgtaatactctgtagcaagaattgggcccgatttgattgtgcaagtagaagggaaggcccaaagatagttggctttgtgatatatgaagtgacgacgctaagattgggatggttgttgttgtgatgtgcatgggatggaatctgctagcgtggctgtggatgcgtgcgatatgatgcagcagggagggaaggagggagcgagcattggtggaggcagctgagccaagcgcagcccatccatattcctgctttttcccctatcgatgacacacatacatgtccatctaacaagtagacgtactagctagtagtaggaacgtgaggaacgtagccgtcgtcccagtcacacgaacacgcacacgcacactttcattcgtgtgtgtgtgtggctctgcttgcttctcgttagtattgtccatcggatcggtatatatatataagttgctgaggaagaagctagctagtaattaagaagaggcggagctggatcgatctatcgttgagttgttattgccacacaaacacaaacactgacgcccatggcctccgacggcaccgatgtcgtggcgctctacggcggcgccaatggcctctcgcacaagtccggtagcttctccgtcaaggtgggcctcgcccagatgctgcggggcggcgtcatcatggacgtggtcacccccgaacaggcgcgcatcgccgaggaggccggcgcctgcgctgtgatggcgctggagcgcgtccccgccgacatccgcgcccagggcggcgtcgcccgcatgtccgaccctggcctcatccgcgacatcaagcgctccgtcaccatcccggtcatggccaaggcccgcatcgggcacttggtggaggcccagatcctggaggccatcggcgtggactacgtggacgagagcgaggtgctcaccctcgccgacgacgcccaccacatcaacaagaacaacttccgcgtccccttcgtgtgcggctgtcgcgacctcggcgaggcgctccgccgcatccgggagggcgccgccatgatccgcaccaagggcgaggccggcacgggcaacgtcgtggaggccgtccgccacgtgcgctccgtgatgggcgacatccgcgcgctccgcagcatggacgacgacgaggtcttctcctacgccaagcgcatcgcggcgccctacgacctggtcatgcagaccaagcagctggggcgtctccccgtcgtgcagttcgcggcaggtggggtggccacccccgccgacgctgccctcatgatgcagctcggctgcgacggcgtcttcgtcggctccggcatcttcaagagcggcgaccccgcgctgcgcgcccgtgccatcgtgcaggctgtcacccactacagcgatcccaagattctggcggaggtcagcagtgggctcggcgaggccatggttggcatcaacctctccgaccccaagatacatgtcgagcgcttcgccgcccgctccgactagctagcaacgtagagtgccatccttcctttccgtcccctgccaccactgccaccaattccttcctcataattactgccatatctgtgatcgatggttgtcatatattgaaaataaacaacaaacatagtgtatatatagtactatatactccctcctttccacaatgtaaacggctgtaattaatatgcccctaacatcactaaaggaccatgcacatctatctatctatttatctattatattattaaaacagccttaaaagaagacaccacgtttactgtggggattagaaattcccacattaatcggataaaaggataaatatttacaccgttagatcgtagttgtactagattttagtggtatagattattcatgacaatattgagtctaaatagaaagcaactttgatctaataggaaatatgggagtcggacatgttgaatgaatagaagtcggacatgttgattgattaggagtcggacaggttgtctgagtatggatgctatggtcttatggacagtaatcagacaaattacattaatctatgtttagatggtaattagagtgcaaattgaactatagtgatctacgtttcatatgtggctggaaaatatacgtgccatacatacatggccattgatagtaaagagggagaacactgcatgcatgtcatgccgtatgcacatgccaagatagcagagacattgggcggagatagcccacaatcgatctagaagcaaaacaagtatgctacgaagaaatcaacatagatatacattattttataggacgagactaccgatcgggcgccccatccaagcatgaaaaaatcggacgctaacgtcagcataacgtcagagccatgcatgcgtgcaaaaccactttaaactattttttctcttaaattatttatccaaatcatgatccgattacatcattaaattcgttgcaattaaatattcaaaacaagaccacacatggatatattccggcgaaatttttttagcttattattaaatcgggcgttatttcaccttatataaaaataatactttagcaaatagcggaagaatgtttcagttcactgcaacattagatctatacatagtaaaacattgtgagtacacttggtggaacattttttgtggaacataaaaacgaattcccttaatagagaattttcaaaatatgtgggtgatttgttgcaaaagaagtttcgtttactgcaacattagatctatacgtagtgaaacattgtgagtacactaggtgaaacatttttagtggaacaaaaaaataaaacgactttccttaatagagggtttttaaaatatgtaggtgatttattgtaaaataatattttaattcactgcaacattagatctgtgaaatattatgagtacattaagtgaaatattttttgagacacgtggtggggccaggggaacgtgcgcacggggagggggggagcgctcgatcctgctccacccccgtcggtcgccctggcctaagcatatttgtattttataagacatggcaaataaaatttaaggtacaatatcttcgccagtatgatctatgcatgtacaagaccatctaaaacatttgacgagataaattaagtagcaggcctacaaaggagtagagtggtggcagttaatacgacatataaaaactgttaataaaacaccaaatcgaatcctaatgacgattaaaaggagggacgacaggcaggccgtgaagcaaataggcaaagcggttgccgggacttatagaaagtaaaaaaataaaccccattgataaccatattcgttttttaaattttcaatgataataaaaagtagaagcagcggacagggtgtatatgagtatagttacagagctgccaacggttggtgggacttctagaaaataaaaagtaaattctaacgatagttttgttcgatttttagaatcccaatgacaataaatagtaggtggcaaataggccttagaggagtatagtggcatcgtttgatgggacttctaaaaactataaaaaatgaaacccaataagacaataagctctaaaaactaccaatttttaaggttcgtaacttctaaaaagtaaaaaaaacaatgataatcatggtcgattttaaaatctcaatgacaataaagaagggaggcagcggacgagccatagaggagtacaatagcaaagcccctgacggtttggtaggacttctagaaagtaaaaaaatgaacccgaacggtaattatgttcaatttttaaaattccaatgacattaaagagaaaagacagtggacgggccgtagaagagcataatgacaacgtttgacgggacttctagaaattataaaaacgaaactataagatccaatttttaaaggtttcaaggagaatgaatagaaatagtggtagatcgagcaagcaaataaagaagtatatgacagaagtaagaggtagcagctggtctgacttttaagaactatatagttggaaatacggagatgataagatttggtcttttaaagtcttatgataacaagatagctatttaataaattttaatatatagttggaaatacggagatgataagatttggtcttttaaagtcttacgacaacaagatagctatttaataaattttaagcaaaattataccgaaaaatttataattgtgtttaggtgctaagcgcgcaattgcgtggtccacccagctagttatagaaatgctatactgtttatcccgcccgaccacacgcccacgggttgccattttcatcaatgtgcctcaaaggtgatggtttttaatgggaaccagcaccaataataaaagtgccgaatattttaacaaaccaacacctgtgcatgagataaaagtgttggttttataaaannnnnnnnnnnnnnnnnnnnnnnnnnnnnnnnnnnnnnnnnnnnnnnnnnnnnnnnntta

SEQ ID NO: 17121 - DNA, 13328 bp, Oryza sativa
aagttagtggtgccgagcagcccacatgcaagcccgcaaacttctggcggtcttgcccacctgttcactggttctactttgtccagattaaaagaacatgcatgatcagataatcagcttactatttgtgtgctagtgttgggaagtagtagtaaaccacagtggcatcaattacaagaaatgtttgagaagaattcagactatgcactcaatcccaaacaacgatatttcctccaagattttgaagatggcaaatagaatgacagaagtcacagaaccgttgcattgctcactgaatttacaatattgatatgagtggaataataggacattatgaatatcctaatgaagatcaaactaacgattgtatcaataacacaagactgtgctctacttcaatgcctgatggtgttgaagcttgcaaatcttcagattctggatattgacaaatcatgattatatatgagtttttcatcaggaagcactacttcgtgaatatttgaaagaacaaaggatgcatgttgcttgcactagttcagtcgaaaatatggccagcaaaaaaaacaagatcccaggatattagcaagcaacctactaaccataaagaatcagaagaatctgcaggcaccaaagagagaaaacaacctgcaatttctacataattgagttctgcataggaagtttagaatggtataatcaaaacttggtaaaaaaatgtgggcaattcatggcaaagaatataattttcttacgctggcaaagaatataaaataaatcaacattcagacaatttggaggctgcattcagcacataacctcaatgttcagactttctccaggaacttctcaggaacccctgcatatactgacagaattgcataacatcgaattccatgaaaatataatccacttaacgcaaagaaagaaatacaccaccatctgtctgtcagtaaaggtgtgaatacatcaccatctgtctgtcagtaaaggtgtgctcccgtctaagcaaaatgtaagcacacagtcatatgcacatctccaaactgtcttctgtcataaaaaggaatttgacagccaagcgactgcattatataattgacatagcttaaaatctagggggctctaaaactcatgaacaaaacagataattattttagtgctgaaacttagttatccaaggctaatcttgtgtgttcaaagtgagcgccgaaagtagttacacagtcaaaaaaaaaaagaagaagcagttacatgtaaattatttttttaacttgttttcatgtgtgaaaaaaaagcagtgtgtaagtaacgagtttatacataataatgctgaacaggaatcgaacagcaaatagaacagtctattcatataactcaaaacaaagtcagaaagatataagattaatgtacaagattcaatgatgtttctcaaacaggcatatcacatatttacatcccaggtgaccatcaagcatgttatgtaaaggcaagccatcaaaactgcacattgttatgcacgaaagcaactaatcacaaacaagcaggagctaaataatcttctttttttagtgaagtgatgcgtacatccttacaaaattaaatatggtttgaatctgaaaattacatccttgctttctggattcatcctactcagattcactgcatctgcatctccctttcactgcatccacatcagggaaaaaaaattcaagaactcacatgcatagaggtcgacaggattgaagcagaagctggtctagcaccacccacagaaattgacaaaacaggtggagtgggtgcgatgagctacgatgagtgcgccgccatgagcccatgaccggcgatgaccacgaaggtcccttggaggacgcattggaagcggcggtgctggaggaagtctgcaagatcactaggaatggcggcggaggtggagatggcagcaaaggcggcggaggaggaggcggtggaggcgtcatcaaatccatggcggcagcggctagggttcaagccgcaacagcgacgaacttgttcgttcccctcctctttctgatgctccctcgatgtgggttgtggtggcgccgccggacgtggtgggcttgccgcatcagcccacttactcctaagtggttaggcctaagtgggtaagtggtgcgggcctgcccagcagctgcatcagcccacgcacgccactgccagccttaggcatatctccccagcgcagcagcgggtcagcagctcctcgagaccttgacatggcggcggcggccaacggcacagcggggccgtgtctcaccggcgcagcagcggtcactggcacgatgggggactgggggctgtgcctccccagcgtgacggcggagacggccgtgtcttcctcctccgtcctactcgcccctccctctcctctcatgtcctatgaaaatgcgtggaattcatattttttttaaaaaaaagttatatcccaataggtcctaccaatatcatactatttataggattttttattatttatctattgaaatttaaattaggatgaaacttatcgaatttctagacagcaacaacatttgagcaacgtccgaacattggtttttttttttttggaatctaaccgtatttcatgaaccctagtcctgtcccgtgaggcggacaagaaggcgtgggggcctgatctggcccctgagcttgggacctccatagcggcgaggaggaggtctggtgaggagtagcggcggcctcctgctcgcccctccctctcctcttaaattagagaaaaatcttaaaaatttcgggaaaaaaattcctaccattggttttgacttaaattggacacgttattttcaatctattttttcttaaaaagaacacccaagtcctccttccctccctccttctcctcccctttgtggtatatgatgcatctgacacattattttaggtcgttagattagttatttagaaaaaaaacatcccaaacctccctccctccctgccccgtgtgcaacgtgtgtcattcttttctctctatgttttatctccttgataattaaaattaaaattatctatatgggaaaataacagaaacatacctccatctattacttatatcacattaggcatttaacgactttctaccaacctaattaatttctcttaacatgcatattggcgctatgtacctatacaaattgttcttgatacttttaaaatgatctttttaggagataaataaatgttcttgagaaagatgatcatagcatccaaattacacatatgatccatgaagtcactaataaattagagaaaaaatgtaagtgatatatcattttcttaataataacatgtactcatgtagcattatagacaacatattgaaaataaaggtgtggtctgttaaacatcataccgataagcatatgggttgcacctagaaatcttaacaatgaaacaaccttagtaatatatcaagtcgattccatataggaattaaagaccatatcctttctttttaaaacttgctaacgtacattgtaaattctttgatgtggaacaatctagaaatgtatatttgttataagacaatccagtttagtgataattagctaaaaacacaatgaccattacttcaatatttcatgagagaaaagttagaacgtattgcaaatatcaaagcatttcatggatgattcatagaatagaaatcttcaaaaagaattaaaaaatggacttgaaataaattgaaaattgaacaaatgttgatgtatttaaaacccattcaaaatagaaaaaatcaaacaatttacaaggacttttagaatgaatatatatatatatatatatatatatatatataaataatagaatagaataaaattttaatattattggatttgttttggggttgtaaaatatccttatggggagtcaaaatactctaaattttttcagaggaatttcatttcgatacaatattttgttttagaatttatatattgcaaaggtaattatcagaaaataaactagctttcaaaggacacaaaataagtttaattttagtttagaatatagtaaaaaaatattttaatgaaaattcacctgtacataaatatttataataaaaattcacacacattatataaggtgtgcatattatctttgtgctttatacatcggctctggcttacaacattgatggagtctttgtgctttatacatcggctctgtcttacaacattggtggatcacttgttttgaattggcactgtggccgagatcaagaacttatcttgccttaagagcagtacaatagcagactataagacagctataaacatatttcgagaatataaaacaggagagagaagagtagcgggctacaaatttatagccagctgcggcacagacttcaagatgcaaatgtaaatgacaggtgggaccaactatgacttgtgtagtatatatttataggtaactattatataaatcagcattaaattgactatagataatttggagcccgtaattggctatactattaaacttgctctaaccctccaccagttcactgatcccttggaaagtcactgaacgtcgtaccttctttcatcttctcaagaagacacaaggtaatgatcaatgacgtttttagtgacgtagtgtgcacaaaggtcaatgagatgagaccacaaagaaattatcaaccagtgcataagagcagttaaagattttcaagacgtactcagtccacatctccatgttgaccgtggaagattatcagaaaagctctcatgcgagcacacatttccttttcgtttaacccggacatcatcttaggaaaatacaatttaatttatctgcgacgttttaggcaatggccagtctagacaaaaacgaacattgccataataaaactcataattaaagtactcttaggatcctaccagaccagacctcaggtatgatctccaaatatgactttcattatgttgggcgtggtttctattgtttttcttttcatatatccctgatttgggaaagattgttgtgcatgcacttgtcagatatgttttcattcagtaacatacagtaatcaacatttatagaaaaaattagtatcatctacaacaccaaaatgtcttgttaatctaacattgaatatatttgttttgtgttaaaaatgtaactatgttttctataaatttgattgaactttaactgataaaaaaatcaaagcatcttacataagtaaagaaacggagggggtagtttgtcaaccccatgacaactgctacttagaccaaacgggcaactagcaagatactccgactgccctgaacatagctcctaactcactctatatgtacagtgacatttgctcgatacatgaaacttgaaatatttactctattattatttcgttacatcatgcatgtgctactaacaaacagactgactatgaaataaacaatgtgtacatacaaaatccagatccttggggaaaatcagaaaggagttgatctctgagagagccagtcatggatggcaaaacgaagggcgtggttgggggtgattggagggccattgtccatcaactcggaaatggcgcgcccttcgtacgtcaacccgtccgcccccacctggggatcatgcatcacttcctgcacaaattagaatgaaaaaaaaaacacattactaccgcattattattagtagatattttgggttacttatgggcttctgccctatcgatgttcttaggtttcgttcttgccttgaggatcgggcacaggaagaaggagggcacttgtctattatccctcatcaggtggagctgttccagatctcgcacagtttctggagtcagcagctctggacttgctgcctcactgcacttgagccccaactctgctaaccttcgagccacctccagaggccactctccagctgttggatctaacaatgaccatagctttccactggacattgcacgccttacttcgctgggaaggcctgcagcctgcttcccagttagtaactggagtatcacaatcccaaaggagtatatgtcagatttgggtgtcaatggtttgcttctccggtattccgggtctgcgtccttggcatcttccatgaataattgagaaataccacaatcagctatcttgcagtgcaggttggcatctaaaaggatgttttcaagcttcaagtcaccgtggacaatcatctgaggtttacaggaatgcaagaagaatagagcacttgagatttcagcaacaatacgtgcacggattttccatggcaactgaggaatgccgcacttgctccaaaggcggtcgtgaaggctcccgtttggcacgtattcatagacaagacacaatgcatccgggcatgccccaatcaaagtcaccaggtgagggtgcctcaccttgctaatgaggtggacctgccaaaaacaatgtgaaataactaccttctgctaaataactgctattgctatatgctcctaggtttttataaacacttagcacgataagttatgtgataaacaagacaagcaagcatatacttggaatgattggcccacatcatctcctgcttggtcatagtgcaaagagataatttttggtttttattatgacaaatgacacaacaagtaatctatctagataaatagaagaaaaaaaacaaatcctacataattcaacaagccccatagagtttcaagtgatatgtggagctgcaaaataacttttagcagtttcattgagctatgtatcactaatatatcaaccagcatgataaacagggtaacagagagtacctcttgctggaactgcatcgaactctgaatgatacacgagtgcaacttataaatcattacacttctgttcataatctctcctttataaacacatccaagacctcgtggcagtacttttaagctgtctgagaacttgcatgttgcagctttaatatctgacaaagtcaattctctaaagttgtacaagtcatcagcacaaacagttgaactgcaatttggtaacataatgtggttatatgcacacctttcaacctggtcagtatgtacaagttctagcttctctcttttgggaatttcctgattgagtgttcctatggaagattgaatcaatttcagctctgccacagcttcattcatccgaaaagctatgcttttagcacgtgcatctaggatggctagttttctcatcgaagagtccaacccttctgtagccttttctttattttctgcaagatcttcatgctgcttttttgtggctgtcaacaaagcttcaagttcctcccgcattttcatttcttgtttttgagcgaactcagaagcttttgcctgctcaagaagcacaagccagatcaacaaaggaatgcatatgtaattttcaccacattattcaaaatcaatgttaaagaatctaaaacttccgtttggtttcccaataatgttatactgcagaggaaccgtgcagtttaaaatacaagataggataagtggtttgcataccctggcaataacaccggctactcttgactctgtatctttgcgcttgagaagctcaacaaaagcatccttccttgatctctctgcttctagaatgacctgcttgaaatttttatccaagatttcctgacagataataccatcagtatttaaattgaaaaaaaggatcatcctttaattacaaaattatcaatgaacatgtcaatgtagcaggagagcacctgaggatataacactaatgattccatgtctacagaagaaccaggctggaatgttgagttaaatgcagactgtgcattttgcaaatttggtacaataatattgcagaaatggttggcatcaacaagagattcataatcattcggttgaccattatctgaaatggtgatttcataacgatcagcaggtgtttgtgcctcgtatgaaatgtatccttcatcaagtatggattcagcattgttactagtagagctgaacctgattcttttcctgatcataacatcatcttcattgtaaactgagatattgttgccaatggctgcagctgcttctctggtccaaatgtgtcttcctctccaaacaaaccagatttcacaaaatgatggggcattccttgccataaaagatgctttgccatagctcgctttcaacttgaagcaactgcattacaggtagagagagttcaaattttcagggacacccaccccgaaataaaacaaaagaaagggaatatagtggtcactatgggatgtcaatatcctagtacatatcataggatcccacaaacactacggaaccatctgcatacatatcattacagttagatgatctatttcttgggatcattataaccatacattccgaacaaaattgtaagattacgttagatgatactcatatcaacaagttgatgtgacatgtaattgacaatgggtttaattgtattcaagtttgctcactttttactgaaattatgtggattcatgaggcatggttaaacaaataatgatggatctaggtgagtgagcacgggaatacttgacataaggtggttgaggacagggttttcaattttgatttcatccgaaatttcgctcattttggttctaccgaaattcctgaaaatcaggatttttggcactttttggaccgatttttttttaaattttagcataatttaactgaatttgattaaattttgaccaaattcacagaaatttgagaaaaacaaaaaaaaaacggccgatataatcacttgccgcgtgggggggggtccggaattaccaaaatttcgatccgaaattgcaatcctaggtgaggagcatgtggtgcattgtccagttgatgttggttgcaagattttggtgctacatcaagttggggcagacaatgttaacatcaagttgggagatcaaagtttcaaaaccatcgaggtgctgttggaagatgccagtgctggaaattgttactaagaatggttacgagcaatgaagggtgtagaatacacacaaaaaatatctagtctatcgagcacctgagatcaagtttttttgtttcttgttttccttcatgctccataagttgataaagagagtattagattaatttgagttattagtattatttccaatttctgttatgttcttgggctgaacttttctagcttgaagtagatacttggggactagactacctagttttccaatactgatagctgctttgttcagtattgaaattttgatgaagaatacacatgacaaccacaagaacagcaagttagaacgggtattagtaacaacgtaattggacccagaggcggattcacctcccgggcagcaggggcggatgcccaggcttcacagcgatgaacccatattatctagcgctaatccttggctgaaacagattaattcctgggaaagatttgcatgttattaattaaatacggcaagccatgctgcaggaggcgattgggccttgggcctcagctgcctatggcctgcctgcccccacaagtactagactcactgtcgttatcaaatcacacggacatttacttgtattgaacatgtccatgtagacacaatataggtgtattagtgggtacgtttctctgaatatgaatagtatttgttattttcttccatgttccattgatattgataaaagcttttacctagtaaatttatatttcagcgtattagtgaatcatcgaattaagcttggacgttctcgtcgtagtatcctttcatccataaacatatttacaagtattttgggtcacatttctataaaaaaaaatggtagaaaattttaatggtgatatatggaaaatgaacatgttttgagtgtaatagtttcagttagacccgccttggcttcacaaaactcttggcgccgccactgattggaccatcagctaggggccaaagatgaaacttcaaatcatggtagtaggacctgctgttagccatatgcccgtgaccattaataaagaatgcataacatgacagcatgtggggactgaaaacggctggtttgaagcaggtttgtaagaacaggatacacgaattttagcagcgatatatttgaactaacagtagaattccttgtgtagaacagagagtttgaattgttttatagagatggcactatcaagaagggtgttttgttagcacgcaattgatgaaaattgaagtagtacatacgtatcaggtgtagaacccatgacaagctttgtaatcccatgatctttgaccaaagtgataataccatcatggatttgttcattctccgtgacaagaagacttgcctgaacctgtggcagagcaaaagcccgattaattagcgtcgcacacccataaaaattgaatctgtgatgtttctcctagataaaaaaaaggttggagaagaaggtgagtagcacttacctgtgccctgtgacagaaagtgaggtaggtgaggaggatcttgttcatttcgtccttctcggatttgcgatgcgacagcacgagctcttcggtggcttgagcggcaggaatcttgcctactgaagaagaagaagaagaagaagaagaagaagaagaagaagatgtgatgggtgagccgtgagcggcggagaaggaagaatcgagaaattaactcataaataaataaatactccaagaaagaaagaaagaaagaaggaattgaaacactagaatcgtacagagggtagggatgagcggagaaggttggtggacgtgcacgaggacgacttgggcgcaggcgaagcggcggaaggcccatcgcagcaggcccaacgtcttctccggcgacctcccgacggcgacatggacccgcgcgtcgacgttgtcgcggcgggggaaatgccagccggcacctctgtggatgaaggaatccatggcggagccggaggcggaggcggaggcggaggcggggccggggctgggcggcggcgacgggctaagtatctccatggatggatggatcgattggctgggcaatttgggtcaattttctcggtggggattgcaattgctaatgggagctttcctcctcaattaattgcagcatgtcaaagacttgcgcgccggcaaggcacgcaaatggcataaacacatggatattccacagcatccacagtgcttgccgttgactagttcatggtcaactcctgctctttcctctccactctgacacgactctcagattcagatgagtcatttcttcctctattttccctttttaatcccgatcgatcttttttttctttatgcgacgctatgcaaagttgcaaacccaaccccaacccaaccaatctactggtggagtaaagttctccctaaatttaacatctacacacgaaatagaaaactatgatcgattttaaaaaagatctgaattgccaacacgagaccgatctgaccgtcgccatagggctggtctaatcagcagcatgtggctggtcaaaccgactgactccaactctaaatctaattttaaccagtctcaggttttcttatttgggttaagtttttcgaattctaattgatttctatccgagtaatccatgaaagggttttatagaagacaagatcaacctctttataagattcatgactggttcaattgaggcaacaatagacttcaacacaattaaccaattgaatcgctcttttgatttcgcatctactttttgtctagtttttagctagtttgttcatcttcatcagtttgtgctataagccgtgcgtactcgttgcgagaacgcgaatgttcatcaaactagctcagtgccacttgtattttgtaaaatttagactggccattatatacggctaggatgttcttggactagtatctttttgcatactatatagcttaaagaggcatagttctgccaaaagtaaaccttatcttcctcttcccccgccccctacccaaatgcccctagcccttatcttcatctgtccatctacttgcaacacaatcactttcatcagaggcaatcttgcaagtgaagaaggaaaaggaaactttgctaatctttggcacgatggagtagagcctggagaggcatagctccgccaccaggttcttggacaacatctcctccaccctcttctgcttccatggcgtcatcattgtccaacgctgaacctaaaacctaaacccactgtcgctgccctccaccagcctagttccactttgcacactccaagcccgtcctccacttccgacgagaaaaggtcccccatgacaacctgttcagatgcacacaacccaatgttggtatcttcaaggcggtgagacccctccccctctagccacctagtcctccacgatgccatgtttcctcaggcatatggaaaaggagagaccacgagagaggtaacgagagaaagaaagaggtaggggatgatgtgtggggcccaaatgtcagtgaggtgggagagaagagatgtagaatgggtattttgggcaatttgaaatacaatagcttgcatttggatacaatggtgtccagggtgtagaaaatgatatatgtatgtaagagagaattgtaatggtatgatccaaataagtgaatagtaatgttccaaataggtgaatagtaatggtagatctttaaattgtggaattcgtagtggcaccgattaaattaaccatagataatacttgggagaagtttagtggcaaggaataatctccttagagaagatgccaaattagaatccttccttagagaagcatgtaaaattggaatccggatccagaggttacccatcaactcatcaccgatcatacagaacttgatcgaattaatgtttgatggcgacaattcaatctccttggtggtggaaagagaaaagtacatatacttaaaattattcacttctcaactatcaggtttgtctaaaatttacccctcaactataaattcgggataggaaacactcctcaactattataattatccactttatcctccctaatatccaagctgggagagttttcacttatgtgcacctacatgacaatctagtcggtgaaaagattaataaaatagtggccctgtatgtcgtcatcctcccgctctcccttgccctactctctctcattacttaccctctgttgtcactgcgagctcaacctcctaggggatatatacctctgcagcctcgaccaagatctccacctctatgagatcttcgcgtccgctagtgtcctcctctaccacaatctccaagattcattgtggtggtggctccagtcaagcttaggagaaaat

SEQ ID NO: 17122 - DNA, 798 bp, Oryza sativa
  unsure (1)..(798): unsure at all n locations
ttttgagcgaactcagaagttttgcctgctcaagaagcacagccagatcacaaaggaatgcatatgtattttccccacattaatcaaatcaaatgtaaagattctaaacttcgtttgggtttcccaataatgttatctgcagaggaaccgtgcagttaaaatacaagatagnataagtggttgcataccctgcaatacaccgggctactttgactctgatctttgcgcttgagaagctcacaaaagcatcctccttgatctctctgcttctagaatgacctgcttgaaatttttatccaagatttcctgacagataataccatcagtatttaaattgaaaaaaaggatcatcctttaattacaaaattatcaatgaacatgtcaatgtagcaggagagcacctgaggatataacactaatgattccatgtctacagaagaaccaggctggaatgttgagttaaatgcagactgtgcattttgcaaatttggtacaataatattgcagaaatggttggcatcaacaagagattcataatcattcggttgaccattatctgaaatggtgatttcataacgatcagcaggtgtttgtgcctcgtatgaaatgtatccttcatcaagtatggattcagcattgttactagtagagctgaacctgattcttttcctgatcataacatcatcttcattgtaaactgagatattgttgccaatggctgcagctgctgggtaccgagctcgaattcgccctatnnnnnnnnnnnnnnnnnnnnnnnnnnnnnnnnnnnnnnnnnnn

SEQ ID NO: 17123 - DNA, 1327 bp, Oryza sativa
gaaaataggtacgataaattgtatataaaatattgcgtacctttgtagatacatgccgaatatatctacggaattagtagatcaatttaattaatctactaattaccttaattagccttggtagccgatctgaattgtcttctgtgcatgtacatgtcgtcaaatcaatgcacacctaggcatgtattgagtccatgcatatgtaggtgcacatgtcaggagcaaatagtacgtgatggtcttgaataatgatgtattcggtctcctcgccacgacttgtcgggatggacgttctcactatgtgttaggggtgaggataatccaggtcccaacagaatcaaaattaattgacgatgtcacttcccgggcagtcgactcgaacggaggcttcctggtcaagtcattgatctctgcgggggacatactccggtcgggttagatcttcctatagccgaagtcatcgagtattttgttgtcggagaatccatccctcgaacccatctcgtcaaaaccttgaagcaccaaaatccccctacctagcacgccactgttaacgtttgatattgcgactacgttatttagatggtatggggatcgttggtaccagggtatatgccagattgaggtaaaagagatggagacagggatttttatacaggtttgggccccttatctgacaggtaatagccctacatcctgttggccgcagctggtgttgctcctttattcatctgaatcacaccagtacaatatttagggtagcctatctaactattgtagacttggcggtctgaaattctaactcgtatcgacaacagggtagtcttcctcctcgaatccgtgcccggcgagatcagagatagcgctttcgtctctcctgacagtatccggagacaccgtaggggactagccgtgcttatccctgaagccgctttcgtctctcctgacagtatccggagacaccgtaggggactagccgtgcttatccctgaagccgctttcgtctctcctgacagtatccggagacaccgtaggggactagccgtgcttatccctgaagtcgatatccggcgtcttgtcttggcttatgttggcttgtatgttgtggcttctgttgttccgtctccactctcctcttaggaggtcttatatttatacccataggtgtccccttgtccaagtagaactagggaaaccaatatggatacaatccgagtagtccttgtcgttttcatgtggaactctattcatccttccttatgcggaactcctcttatatatgaaggttgtttccgtataagagtatgtggtgggtcctgtcgagatt

SEQ ID NO: 17124 - DNA, 17995 bp, Oryza sativa
  unsure (1)..(17995): unsure at all n locations
nnnnnnnnnnnnnnnnnnnnnnnnnnnnnnnnnnnnnnnnnnnnnnnnnnnnnnnatctatttgtaaaataagattttgaaaagtacacaaatgtaaaaattcagcatcgaattcagatgcatcgatccgtctccacacctaacagagttaataagctagcaattaattaaggtgagtagcaaaagtatagctagctagctatctgccaaaggaacgtgacgaatgagatgaagtagccgacacagaaataacaagcggctacgagatgactttattagctagacttttgtcatgttgtaggtactcaccgatatgtgtttcttccttgttgaattgtctatgtctagctcgtgggagaatttgaatgtgctcgtgttttacttttacaatcttcattccaaaataaaatatgaaatattttaattaagtataagtacaggtattaagaaaagagataagattaaataagagaggattttcattgctcgagaaaacaaaatagatgaaaaatttaaatagcgatgaaactgttatatatattatgagataaatttttaatattaaatgttgttatattttggaaagagttgagaagcatgctgggcatgtgtcccgatcgagaggagatatagttgtacagtagctaatagcttacagtaggtaggtagattcgtgtacgtgtggtgcagctagctagggtgaagttagatgacggcaatgcgtcgcagcctctcatatgatatcgatcagctggagagctggcctggtactcttgcgcagtagggaaaggaaacggacggagtagctcacgcaatcgctgaccgcatatatgcaccccgggtcactagctacctttacctttttcgatctcttctcttcatctccagtgtaaagcttttttgactgcttttttttttgtgtgtggggggagtgcttgtaaacaagtccatcgatctcgttaataaaattcgtgaagaaatcaattaatttaattattgtcccacagggccgggcggcatgcacagtaaataaattaaattaagaaatggacaagagcatggtagccagacaaagacggacggacggacggacggaggacctttatttaagaaagaaaagggggcccctgctgccctggctcatgcatttgctagctagctcatcgtcgataccaatggcgactaccagggccacatcgacgctgctgctgctgctgctgctggtttcggcaacatgggcggcatcggcgccgacgacgagtcgggcgaggaacgtgataacacacgtgaaggggttccaagggaggctgccgttccacctggagacggggtatgtggaggtggacaacaccaataccgttgagctcttctactacttcatccagtcggagcgcagccccgccgatgaccccctcatcctctggatcaccggcggccccggttgctccgccctctccggcctcctcttcgagattggtacccagctctatcttaattatttcttcattcattttcgatcgcccaataaattaaccactgatataggagttttcatcaatctactctagctagctagcttgtcacacgtacgattaactatgcaaagcatcattgattaaagcaccccgcccggtatatgcatggtggtgaagcgccgtacatataattaattaattccacccttgcactaggattcaatcccaatatatactatcaacgaatatttcatacatatcaactagctaggatattcattttagtgagactaagtattggccgttagtcttcgtttctctctctaaatacgtacgtattaatcaggagactgttaatttctcaggtgtgtgtacctatggtggcatgcatgtcttcagtgtaataaaagaactactaatatatatatatccaactatatatatctaacaagcttatctgcgaacagcaaaaggttaattaagtatatatgtaagacttggcctttatataattatatatacatatatatctgccggccagtactgccaccatgcaacatagtagtttacaaaagttcaaattaacttgcaatataatattgctggtctacggaaatgacaaagcaattgagttagaataatactacataatataattaatcgatcttctcaatacaacttggggctcgcggcgttatcaacaacggcttttctttcgttggaaatatctcccctgtccacatcatacaagcatggcacattgtatatagatggttgccgaagaaaaactgacgatgagtcaagtctttatttggcctcaaatttgttgaatgctccttccactattaattaaagttgaaacctgccaagttaatagactccttccactgtatatatctatccgttctgagaggtctttcacaatattgtggatattttgccgtgtaggtattcccttgctgtattgccagtgacctatcttcttagaaaaattctactccctccttttcacactataattcactttgtttttatcctaagtcaaccctctttaagttaaccaagtttaataaaaagatatggcaacatctataataccaaataagtttcattaaatccaacatttaatactttatagtataattatttggtattggtaatattatcctattttcctatacacttagtcaaacttgaagagatttgacatggaacaaactaaagtaacttataatatgaaacagaggaagtacaccttaggctgcactcgaacgagtagtttcggaactcatctcttatgcacggaaaacaaggtaatttattagtgcatgattaattaaatattagctaaaagaacttgaaaagtgaattaatatgtttttaaagaaattttcctatagtatttttttaaaaaaacatcgtttaaccgtttggaaaatgcacttacgaaaaacgagggaacattgaacacaaccttagtattcacactcctatatacttctataaaagttggagcattcccaattaggctgtgttcaggaggtgaggttggaaactcacctcccgcgcacgcaaaacggagcaatgtattttcttatgattaattatttttttgaaaaatggattggtatggtttttaaagcaacttttgtatagaaacattttgcaaaaaaaacatatcgtttagcagtttgaaaagcgtgcgcggaacacgatagagatgagttaggaaaggtggggaaagaacaagccttaatatattccccctacccaccctggccccaataaaataattaattcctatatatgagtctctgtgtcctaaacagaatcgatttctggctatgaacattttttaggtgaaggaaatataccagaagttagagtagcttgtcaatgacattcaagaagggatttggttttcctgaatggttttatttaaattaatacagaacgaatatgcccaagattgggaacatcctgaaattaaggccgtgtttagtttccctccaccaacttcaaacttccaacttcccatcacatcaaaaacttttctacacacataaacttttaatttttttcaaattaccaactttcttcaaacttcccactctttccaccaactaaacacagcctaaattgaattgactaagcctcatttaactttccaattgctcaaaataaagtagagcagaagccattagctagctgggctagctgctaatacatcacaactatttgtctacgttcatttcagcttatggactatacatatataattacaagcggtaaagcgatatagcattttacaatataaaattcgagggttggtttaaaacgggtggaataaaattttattcacttttgactttaaaatatttaagggcttaggtaaggttatgaaagaacctatgtgccttagacctattaccacccatatgtactatgcatggttcttaagtactaatataattgctcgaaaagcattacatatataacaataattgattacatgggcttgtcttagctgagctatttttagttttatattatactatgtctagatttaaatgttgctatattttagaacgaaggtatatagtatgatattaatttcatactatgaacttggccactctcgaaacatgaacaacacctatccattgagtggcctgctatactgacttagaccgatcagccggtcttggtgataggtggataaaaagagagagaaaagaggtgattgtatgataatttaatttgaagacaccattcattgaatatatagtttctacacatagtgtctatatgacatggcaagtatggaaactacttgataatttctgggttgggaatggccttaatgcatgacgcactagtgtgataacactagtaagtactctgtctaagactaaatccaacaattaataaatcctttggaaaatgcagatctagggaagataaaatgaaattaatgcttttgcaaggtcactcagagctcgtacgtgatcgctcggccccagctaggatagcacaagcggcaaccagcactatcgccatccctagccgtcgtcccctccgcctcgccaccgccgcctgagctatcgtgggcaaagccgggggagggggcacaaggacaacggcagcaagctctcttattcttctcacggttgcgatagtccgaggcactgccaagatcgaagggaaggctgtcagtggcggtatcagcggccaaaccggcatcgttgggtctcggctctagtcctcttctgatctgccgccccagcagtcggtgatggggaggatgcacgacgaaccagcaaggaggagaggagaaactagattgcgcaagggtggaggcacgacttacaagggcgaggcctaggtggtagcgcctgcaggtggccagtgcggcaagcacacaacgaggaggctgacaaagcgtgaggaggtggccagcgactcgtgaggaggaggctggcagcacgcagacccacgacacgtgtggccatggccgggaagatagcagagcaaggcggttgttggtgctatgaggaggtggcagggggcgtgcgaggagatcggcgatgcgtgatgggagcatgaggtgaaggccggtggtgcacaaggccatggccgaggaggaggccgacaccatgacgaggtggttggcagaactggtagcgttgaatgtggctggccagcaaaggattgctagcgtggcggagaccggttgagtggtggagtgctaggttgctggtgacaaatttggagagggatctacatgcaaaagccatgcttggagttctctgggccaacaaccacgtctagggttgttcccccctttagggcattttcgagctaacgcctcctcccctggtaagattattcgggtgaaaatgaagcccttttgacagatgatagtggtattttcagcatcatgacctcgttggaggcatcatcctcaagatctcgtcttcctattgacgcggacttctctcagtttggttttcaatgttttctcagttgtcatcgccgggtaggtgtgaggaacaagcggatcttcttttgtctcgccctttccctctccaacccttctccatgaggatgactgggagcccgctgatgatgttttgttttggagaaggtgttcggtggcgcatttccagcccatgtagactagcagcaatcggtcctgcatatcggcgctggcttcgtcctagttcttttttccaggagtgtatttggaattgttagcacggggtggtggtgtgtttttgtttaactttttccttattatagcctgtatattttttctgctatatccaatgaaattggcacaatcatgtgccggttcgtttgaagaaaaaaagaattgcttttacaagtgaattagtgaaaaggatttcaattagctagccagacaaaaaggccagtgcgtatatatgcctaccacagatggttgctgaaattagctcgtgatcctgtcggttatataattaataggagtataattttttttgttaggaaaatgattttcaaaggtaatgagtacacgtgcatatatacaggccctctcaagtttgacgtagctgggtacacggaagggttccctcaattgttctacttccaagattcctggaccaaggtactagctaatgaatcaagtatgtggaatatattttgcctaaaaaaataaattgcatgaataatgaagagtgatatatgtttgatgttaggtgagcaacgtgatatttctggacgcgccggtggggacggggttctcctacgcccgtgaggaacaagggtacaacgtcaccctcacacagacgggacagcagctggtggtgttcctcaccaaatggctgggcgatcacccagagttcgcctcgaaccctctctacatcggcggcgactcctactccggctacaccgtcccagtgacggcgctccagatcgccaacgacgacgacgcccgggcgcggctgaacctcaagggctacctggtgggcaacgctgccacggacgtcaagtacgacagtgggggcaaggtgcccttcatgcacggcatggggctcatctccgacgagatgtacgaggccgcgcggagcagctgccgtggcgactacgtgtccaccccgaccaacgccgactgcgccaacgcgctgcaggccatcagcatggcaaccttcgccatcaacccggtgcacatcctggagcccatatgcggattcgcgctgcgcgggcgcgcgatgcctgagacgacgatggaccagcgcctgcgcctgggcctccccgtggagtgcagggacaacggctaccggctgtcgtacctgtgggcggacgacccggaggtgcgcgccacgctgggcatccacgagggctccatcgcctcctggagccgctgcacggcgctgccgctcttccggcacgacgtggacagcgccatcccctaccacgcggagctcacgcagcgcggctacagggcgctggtgtacaacggcgaccacgacctggacatgacgttcgttggcacgcagcagtggatccggacgctgggctacaacgtggtgaccgcctggaggccgtggtactccaaccgccaggttgccggcttcaccaccgtctacgaccacaacctcaccttcgccaccgtcaagggcggtggccacaccgccccggagtaccgccccaaggagtgcctcgacatgctcgacagatggacctctccggccggcgagctctgaattactttactatactaattcatcaccgtccgtatatatgtccgtttatgggaaatcttacccccttcataatttatctacttatcttttatcatgtcttatctttctcttttcttagcctatactacacacacttacttacaaaattcggagcatttgtgtggtctgtcgttcttttcccactcggtttccatttcgagagtgacgaggccctcctttttttcctgcacggcaaatttcttggatttgtccctcacgcacgtgtagctcttcacgcgtctgattccattctatttccatacggaaccaaactcattgtgatggacgcgcgtcttcttaatccctagaacatgcacccactttccatgtttcattttctccccaatttactgttaaaaacttgaatgggccttatagggacgattcggtccagaccaggttgcaagctcaagcctcatttttttctcaaacaaaccaagaaaggatataaaaagaggaggagctcgttccaagcaaatcgaacataatctttaggctgtaacagcagtggcgagctggtggtcacttggtaccttgtcaatcttattcctacctacctactctttccgtcctgaaaagagatgatttctagcgagaagagtttgtcccgtaaaaaggcgacttctacacaaaaacaagaagcattcaaccgctgctgattacgaagtgactgctcaatcggctcattaattagcatcgatgggtgagaaaaaaataaagacaactacgttcacacttgttcacacttgctggatgctagtactactccagagcactagtactacttgcagagaatcttggtttgattttacataactgtcaattaatggcagtactttacgagggtatttgggtctttagctacttgtgctaattttgccttggccttccaggagtcgcttctttctgagacggagggagtacttgttgatatgcgggcgtagtataagatctattatgtagtagatgagttcttagatgatcagaacatgagatggaccgataggcacatgggttgatgagatcaatcggtatatgtgctggtgacttcactggaatgtctggtactcaccatggccgagcgcgattgtgttcatcggatagtccgatgtccattggaaccgcacgccaatgagaaaagacaagccaatgagattgcctcggtttcggcataatttgattacgctgttaaggttttcacatggcgaatcgtagataagatctatgtaccccgtgacctttttagggcgctgccctaaaaaccgcggggggcggctccccctcgacccttagatgagatctattctggttgatcgccataaccacgggcacgactattcgaatagttttactctgatcataaataatcgtgcccgcgattatgggcgatcaaacagattcaccatgattagactcgtctataataatttgacttaatggaactggtttaatttaggtggttggttgggccttatcgcaacgtggtgtagcgttggacagtgatgattaatattgcttaattaactacaaaagttttacttaactacaaaagttttactgctttcaacttatgcttttaaatgctagctttatgcaaatgaacccctctagctctccttggttatatcctgcatcatactctcttccggtatgacttgctgagtacagtgggtagtagtcagtcttgctctgtctcccatcccatagttggagtatgcgtcagatggtggctactcggaggagcaggctttgtccgttccatcaaggatgcgtgtggaatggtgttgccccgctgttagcatcaagatctagaataagctcgcttttattttccgttgcatttatgtaagacttttatatgtgtgtaagacgtggatctgtatatcaactttgtcgtttgtgtaccctggctggtcctggacaggggtttaatgcacatcttactcggaattatattcgggaatttctggacgtagcatatgtgtaagtaggcttgcccgtcggatgggctggctatgcggttctgtagggaggactgttacaaatggtatcagagctgaccctcgtggttgcacatacgggtcaatgtgtgggcatatgaagcatggcacctgtgggctctgtgtgagcaacatggcatggcgtatgccgcgccactagacatacagacatgcgctaaaaaggggtgtgtcctgacattgccctatatacctgtgagctacatggtaagtggccaatgggacgtcgggtccttgaggaagggtgtatgtgacatcctggcnaaattagaatttggcctgtgtggcccatgaatttagcaaggttgaaaccaatttataaggcatcttccctccaaccatgtcactctcaggttaacccttttacaggaagcgagaacgcaagtgtaagtggagtggtatatctgtcggatgaactgactacgtggttctggaggaagggctgttacaattgggccttcaatatactgtgtatcttgtagggagggattttacaattggggtttcaatatactgggtatcctgcgatacttgagagatacagtgattctaattggatctctaatgtggatgggatcaaaatcactagtggatatgtcttcaaaaaagctagtgctgttgtttcatagtggtcttgcaaacaaactattttgacgaggtcaaccatggaagcagagctgacagcactagatactgctactgttgaggtagaatggctgcgtgatctattgatggatctgcctatggttgaaaaagtgatgtattaattgatctgtctgtggttgaaaaaccgtgccagctattcttatgaactgtgacaatcaaacggtaattgtgaaagtgaacagttataaggataacatgaaatcatctaaacatgtgaaaagacaattgtagtctgtcaggaatttgagaaactccggggttataacattgaattacactgaaatagctagaaacctggcaaatccatctacgaagtaactatcacgaaatgtgatagacaatgcatcgaaggagatgagtttgaaacccatgtgagttatactatggcggtaacccaatctatatgatcggagatcccgtgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctaggaagcttactaagagaccaatgagtatgacttatacactctacccgaggagcagtctactgacggtctagtaccagataagactctgtgtgaaacttgcttgcacaagacttgcaattcaaggcatagtccattgttcaagttgtgagtaagtgtagcttgaagttctaggtggatgttcaatcttaatcggtctccatcaacagttggtatataaacagtacattggaaaaaggcaaatctcagtaggattttgagatttggtggggaattattagaattaatagatgggtcttaacccattcgaagattaattctttggaaaatcacaaaagcccacctgggatggcatgcacggggactttagtaccacctttcatattctagaagaggaagacctccttataagggaggatactcgcctagccacttgaggcatgtgaggtggagagaacggggggaacacacacgcgctcgctcgcctggcctagcatggcggcacccgtgcacaacgtacgcgtcgaatggtccccaaaattggttcctcacccttgcacagatacgatctcctttcgcagttttgttttgctgcagaaatttcgaattcgttttttggaaacccttcgaataatccgatgcgtgaaacgacgtggagtccggataagttacacgagacttatccggttcggttacgcggagtgaagattgtgcaggtgccctgatcaagcgtcctaatatttctatataagttgagcggctgcctccacgcaatatacgtgaaatcaatctagggtttgcctcctcctctgtactgcgccgtcgctcatagtctactccatcctgctcgctgacgtgcaccggcaatcgggagagcaggtctccggaaccttcgccttcgatgtcttgcactgggagaaggcggcaataaggtttttggaaaatgctttgcgcgactgctccctgtttgtccacaatggctcatcttcctcttcgctggcgtgttgcgcgccatcgtcaatgcacggtaccctgagtccttcctgctgagcagccagttttccaaaaccctcggtatgcattcgacatattccgcatattcaatctgttcatactttactgtctagtttacatgtgtagatcgtatgatgtgattatgtcatttgcaatgtcatgatttatttatggaataaatgaaataattatgtgctaatattttcaacaatccaaaaaccttattataggcattgtggttttactatgactagtttttcccatgctctaaggccggataaattcatcggtgtgcacttcaagagatggaagatcagggttactctgtggttgatggctatgaaatgcttctagattaataatggcaaacctgaaggagttctcattgctgaaaagcagaaagaattcgagaagaccactactctctttgtgggatggattcgtagcgttcttatcgatcgtctagtcgaggtgtatatgcacatgactgacgctaaggagttgtgggatgcactgccaaattcggtgctactgatgctagcaatgatctgtacgtcatggagcagtttcatgactacaggatggttgacaaacgttttgtacttgagcaggctcatgaaatacatgccatggctaaggaactcgaactccttaagtgtgtcttactcgataaaattgtggccgggtgcattattgataaactacctccatcttagagaagttttggtactgcacttaaacacaagagacaggaatactccgttgagggatttatagcgtctcttgatgttgaggagaaagctcaggaaaaagacgtcgcgtctaagggcaatgatgggcagtctaatgccaatgttgtgcacaaggcccaaaacaagaacaaagagaaatataaacctcagcagaccatcaacttcaagcatcagaagaagaagaatataacaacaatctgaactagcatgagagaacttattttgtgctttttttacttcaaacattaacaacatgacctaaatactaacctacctatgccttaacctgctccaaccgagcacaagcccagctggtctaaccccatactcagagctatcgggttgcagcaaaagcagagccactagctttcactgattaccctaagtagttttgaacagtaacatggtcttcaaaacacaactttaacttcttgtttttataaaaatatttattaaaaagtaatatatgtatacttttataaaagtatttttcaagacaaatctatttatataacttttacattttcaaactcaacaacttgagagttattcatgatttatattcccaaggtttgaattaaacattgtcctaaacgacttcctttacgagtacggagcgagaactaaccaatatgcatatgacaaggaaaaatattatctgctcggtttcaaaaaaatatattatctgctatatgaaaaatataaatcaatatattatacgctatattgtttaaatgatttttttaaaaaagagttaaataaatatttttagacttcgatacggtcttcaacatgctactttgaccatttttcctgaaaagttataaaaaatgtctgcgtttagtttgttgctaaatttggtaaatatataaaaaaaatcctgtcaaaattttggtaatattactgacttactaaaattttggttttatccaaatttaatgaggtttattttgactgtctgaacagacctttaattataagagtgcgggctgcggcgtctactgtgctgggcaagcttaattaattagtggcatcgaacgatgctacgtcacgttcccactcccaccaagtcaaggatatatactctttttctcgtttcttttagaaacatgcaagggaggaaaagacaaataaatttctgagattcagaatttttattaattttgtaccttaaaaaattgataaaaagttaaatagcaaaacccaaaaaaataataatgccctcgtgatcgtacacatcccatccatctacccacggcctgtttagttggagggagtttttagaagggattgggagtttagagggatgagactattaagtgttttgtttggttgggagatatgggaactttggtgggatggggatgaggaattgaggaaggaactccctcctttttaatacctgggtaggggcaggtaattgggagggaattcctcctctattttatctaagcaaatctcagccatccgtttttattaatgatataatctctaactaaactccctatcaattttcatcacctctaccaaacaatgtattggaattaaaaatcgaattcctatcttaatctcatcatcaatttcctcgtataaacttccaatcccttttcatcaagttaccaaacaagccgccatatcaatctgatttgggtcaacgatgcaacaataattagcaagtggaagacaagtaattaaggaggcaggagcagcatggaaaaagaagaatagaagattactagatattgtactgctgagcgaagaggacagacaggtaagctagctaggcaatcaatcatattcgctctccaaaatgaagggatcgatcatctcacaaacaaaaacgtgagggatgaaggacaaggacaagaaataggtgaagctatctacttctcgatgcatctatgtacggaggcggcggtaacacggcggcggctgctgctgcttcttcttctcctggtcacctgcagctgcctgtctgcgagagagagaagcaatagcagcagcagcagcagcaggagagtggtgaggcatctcccggggttcgatggggcgctccccttcgagctggagaccgggtacgtggaggtggaccgcatcgccggcgtgcgcctcttctactacttcatccgctcggagagcaggccggccgacgatcccctcttgctctggctcaccggcgggccaggctgctcggacttctccggcctcgtctacgaggtcggacccctcaccttcgatgtccatggccatggacatggacaactgccaaggctcttgtacaagccggagtcgtggaccaaacgtaccaacgtcatcttcctcgactcccctgtcggaactggcttttcctacgctgacaccgacgccggattccgcaccggcgataccattgctgtccaccacattctcgtcttcctcaacaactggtttcaggaggtgcaccccgatttcctctccaatcctctatacatcgccggcgactcctactctgggatgattgtgccggctgtcaccttcggaatcgccacttcatcacccaaaccatctctcaatctcaaggtactagctacttttaaagatacaaataggagtacaacttactgaaactgataccctgccacatcgtcatcttcagggctaccttttgggcaatccagtcactgatcacaacttcgatgctccatccaaaattccatttgcccatgggatgggtctcatatctgaccaactgtatcaggtaattggcatccatatatcctacttcacgacggatttttaccagcatcttactatatactacgtacgtatataatcatgtatgatttctaggcatacaagaagagctgcagtgtcaagcacaacacccagcagcaaagcgttcagtgcacaaatactcttgatgccatagatgaggcatgtacttagtaggattacttactctgctttgttgttcagtttcagtgatgctgaccactaataatcaatggtctgtctcttgaattaattgtgcagtgtgtcaaggacatatacggaaatcacattctggagccttactgcacttttgcaagcccgcataatccgcgcatcgataagccattcacttcaggggtacggcagatactccaactccaagactttcacttgtctgagatttcttcagaatgcagagtcagtggaccctaattattttctttatcaaatcttcttcgagtactagctacccctcccgtcccaaaaaatctgaacagccttgtactaatatatcctatctaattaaaatatatcctccgtcccataatatacactcaaaatatcttataatatgggactgtgagagtatatgttagtgggtagtattggttagccgaccaaatcttaccatttggtatttcttcatgtcatgcagacggcagaatatacaatgtccagaatatgggccaacaatgatacagtaagagaggcccttggaattcaccaggtatatacacatctcttcatcatcattcaattgaacagtaatttgcatgcaggttcgatcattctgtcacacagcataacacaacacaatgcaatgatccactgtattcattctgcaatgcagggaacagttccttcgtggcaaagatgcaactacgacattctgtacacttatgacatcaaaagttcagtaagataccatctggatttgacaactagaggctacagaagcctaatttacagtggtgatcatgacatgattatccctttcatcggcacgcaagcctggattagatctctgaatttctctgtcgtggatgagtggagaccatggtttgtggatggacaagttgcagggtgaggacacacagtattcatcgataccatcaaattaattgagtacgtgtgcgagtactgtgtctgtctctgaccagatatattatccgtctgtcttatgtgcagatatataaggtcatactccaataacctcacattcgcaactgtcaaggtatgtgccagcgttttagcttccttcaagggatgcaacacattaatatcttggtacgcatgatctagggtctgtttagattgtagccaaaataaatattatcaagttttggcaatactaaaattctggtaagatggcaatattgtcaaaattttggcagaatttcttatgtattgaccaaatttggcaacaaactaaacgtagatattttttttataactttaaaaaaataatatggttgaaaatggcatcaaagtgaacaggccctcagtaactaaaaagagtattttggtgttaatttgtgtagggtggtggacatactgctccagaatacatgccaaagcaatgccttgctatgcttgcaaggtgggtttctggcaatcctctttgacgatggtgcatatatgtgtaagagaaaattccaggatggagatattacatcacaagaaatttatgattttgctaaaattgtggcgacatttttttccccatcacggttgaatgcttttctcttgggttgcggcggagactatactcgcgcgtgtattatatatgtctgtttcttcacgaagtgcatgaagatttgtcccatgtgtaagatctggagagtgagaacaaaacatggttcaatacagtgcaaatgatggatcgaagagcatactcctacacgtcaatgtaaatagacatgtaacattttattacgccgtcagtgtggcccccagttttgtacaccggaaatccaatgtgttttacgatatcattctctgaatcatcagtacttatttgtataaagctagatttcataattcattttacaaccctatgacttagcagttttaactgaaaacaatgttaagttgaaatcctcgattatcaacgagggttcatccaccttccctaagcttcacttcatccggtttacccttgcatccagttttccgtattcttcaccattccaaccttcccgcacattaggcagggtcacacaatccctcccaacactattcaaagcaagattaaaatttataaggctattcaagagtaatacaagtcccgacgcttaatcgcgagcatgactattcgaatatatttgtttactcacattgcaagggatgtacgcttttaatcccgcactccgtgacgcacacaacacatgagacttgtcacaaccctatttttcagtcacccttgcattgcgacacccactgcaaggactcctggtatttcgaggtactaggaggattacacaatatatatacttaggtgccttttagatttttgtcatggcatttgatcaatcgaacacatcttccatcacaaacagtaacaactgcagaactaccatgacaggtgctgccccactcaggttacctaatgcatcaggtctatacccactcaagcaatggaatcatactctgattgtttcctgcgtagcttcttgactcggtcctttacttactacaatcgatggcttgttgtttcatagaaccacacatattgtatccatgtcgtcccagtcgaaattattttgttttattaagtttttggtatttgcaaaagtcttatgttgcgggtgatgctcatgtctccacccgtctttcaacaatcactcacatcgactgaccaacacattcacatccatat

SEQ ID NO: 17125 - DNA, 9439 bp, Oryza sativa
  unsure (1)..(9439): unsure at all n locations
ggaatatgaataataattttaaggtggctcagaatcaagtttaggtacgaactttataactactccctccgttgcatgttataagactttctagcattgcctatattcatatatatgctaatgaatctagacacacatatatgtctagattcattagcatatatatgatgtgggaaatcctagaaagtcttataatatgaaacagatgaagtagcatgcaactttatttgcaatcaatacatctattaacttattaaaggaatagaaaaaggagcctccacgttcgctctcacgatctagaaattctcatattaatcggagaaaaagaaaaatagagttcatatagaaatacaatttagaaataattgaaattcgaaggaatattggaagagaagactagagtccatatagaaatacaattaagaaataatggaaatttggaattaaaaataaggaatattagaagtagagtatagagtccatatagaaatacaattaagaaataatagaaattcggaattaaaaatgcggaatattaaaagtagagtatagagtccatgtagaaagccattaagaaataatagaaattcggaattaaagataaggaatattagaagtagagtatagagtccatatagaaatttaaaactaactcaaattccaaataaacataataaaattaacgtagagtttagagttcatataaaactacaatttgcaaataaccaaaattcgaaattaaaagaaaatatgggaagaagagtctaaagtcaatataggaatacaatttagaaataactgaaattcgaaattaaaaattaaagaatattgaaagatgagtttagagttcacatagaaatacaattagaaataataaaaattcagaattaaaaataaataatataggaagaagagcctagagtctatatagaaatacaattgacaaataacgaaaatttggaattcaaaaaagaaatattgaaagacgagtctagagtcgaatataatttacaaataactaaaatttaatattaaaaataattaataactaacacgtatataaaatacaatataaaaattacacattagtagtttcataaagttaatacaaaatttaaaattatgttgtcattttaatatatttgaataatacattgagaaaacatgtatgttattatatgagagaaaatataatgattttagctgcacaatctgcgcaggtcaacatactagtttataaaaatatgatcaacatgctaaatgaggggagcgtagagactttgaagtttgaacagctcttcgtcgattactgcggcttcgtctacgcaaacgtaaaacctgtttggcgaacaacgggtcaaaacccggttttcctattttaaagcaaaggggcaaaatcctagaaaaaggagtaaattttacaaaattacaaatactttgatcaaattatcgcaaaactacagatttaacaagatgtatcacaagactacagatttaacactaattttatcacaaaactacagatttaaggtaaaatatcacaaaactacagatttagtaataaagttatcacaaacatatatgtttaatgtcaatttaatcacaaaacttggatatttataactcaaacattacattagtgcaaaggatttaaatcctaaaatttatagttttgtgataattttattctaaattatgtagttttgtgataaatttgttgctaaatatgtagttctatgatatatgaccttaaatatgtagttttatgataatttagtcaaagtatatgtagttttatgaaatttactaataaaaaaaaggtaaatatatgtcatgatatctgcgctgagcctacgagagagatgccgacgaatttgatggtgcgtatcattttgaagcgtaatccactcatcatgtacatttgccttgctcagttgctgtcgtgagcccagcaggcaaatcagacaacgcaggatatgcagtgctctgctctgatctgatctgaactagtactagtataataaataagaaagataatttgtgtgtctctcgtggcaagaagtggagtactcctaggagagatcagtcgtcctggacgcagaagatggtgggcttgacgggctcggtgatctcgacggtgccctcgagcatcttggcgaccttgcccatggagggcctcatgtcggcgcggtcctgaaggcaccacatggccgtcttgaccatgcgctcgacggtggcgaggctggcggggtcgtcgtcgtaggcctcggcctggacgatgcgagggtcgatgatgtcgtcgatgcggcgctcgacgtagaccttctcgaaggcccacttggggaagtaccagtcctcgctgccgacggagtcctggcggaagccgtagttgcggcggccggagacgatctcaagcagaaccatgccgaagctgtagacgtcggccttggcggtgatgggctcgcggtggatgacccactcgggggccatgtacccgcgggtgccacggatgcgggacatggtcaccttctccttcttgctggtgagcttggacagcccgaagtcggacaccttggggcagaagtcgtcctccagaaggatgttctcaggcttgatgtcgcagtgcagaacccactcgaggcactcctcgtgaaggtacgcgatggcgcgcgccacgcccagagcgatgcggtagcgggtgtgcaggtcaagcagaggccgcttgttgctctcttcttcgtctccttgggtgccggtgcctggagcgaacaggtacttgtccagcgatccgtttggcacatactcgtacaccagcatcctctgctccttgtccgcgcagaacccccacatccgcaccaggttgaggtggtgcatccgcgcgatgatggtcacctccgcccagaactccgcctctcccccgcccaccccgtccagctgcttcactgccaccgcccgccggtccggcagctccccgcggtacaccttcccgtacgccccgcgccccaccaagtccgagaactccttggtcgccgccttcagctccgcgtacgagaaccgccgcggcccgccggcggggaggtactccagccccagcgtccgcgccatctccctgtactgcgagtacttgcgcaggaacgcccagaacgacagcacccccgccagcagctccaccgcgaacagcgccgtgatgatggcgatgttccggatcgtcgtccgcccctgcttcggcggcaccggcagcgccagccgcaccgggcacaccgtgtcgatcatcgtcgtcatccccgtgaagttgttcgggtcgttgttcgactccaccacccgcaggtaggtcgacatctccgtcgccggcgaccaatagccgtccaccagccgcgtgtagtgcaggcacgtccggtccccgcccaacttgtagccgaaggccacgcaagaggcgttggcccggcacttgctctggcagtccgccaggttctgcggcgtcaggctggtcatgtacttgccggggacggacactccggtgtcggcgccaccggagaaggaaacgaaatccatccgcacgaacttgtcgtcgttgcccttgccgctgtagttaagcttgggggcgcagcccaggccctgcgggcggtaccccggcgggcagacgcaggtggtgttgtcggcgccttgggggacgcagatgttggcctccccttggcaggcgccccggatggtgcagagctcctgcaccagctgccataccacccgccactgccctttcttggactgcaggctgtagaggcgcaggttgccgtcgtcgtcgagggtgaggcggcgcaggcggcgagtggagccctggtcggaggcgatgagctgggagggattgccaccagcgagttgcagcgtgccgtcggcggtgaggttgcgcagggcggtgttgccggtgatgttggcgtaggcggaggagccgtgctgcagggtgagggcgttgaacagctggaatctgccgttctgggactgcagggtgatgctggtggtggtggtggtgccgttgctaatgctggggatggcctgcgacgccatcagcgtgtccgtcggctccccgaagctggaccaggcgccgtggtcgaggctccccgagtcgttcagagacaaaggggcactcgtggagttgaagttgcgggaccaaagggtggtgctgttgccgttgtcgctccacgacagcttccccgccgcgtcgatggagagcacggaattggcgtcgccctccacggcggagtggtcgtcgttgtgggcgtaccatatgacgaccggcctggactcgttggcgttggcgctcacccagacggcgaaccagaacttggctggggaggagggggagggccggaatccggcggcgaagtccccgttgttggagacgagggtgcggttgctctcggcggggctccaattggtgtcgttggcggagaaggtccgcatctgctgggcctgggcctgggcggcggcgagggccggtaggaggaggaggaggaggacagcggccgccatggttgtgcttgctggattggggaagggaattggatttcttgcttttggatttgggatcgaaccgacgactctcctcacctcgagtctagtcaacaacactgtagccaatttgcccatcatgtaaattgaatattcattgccttgactgtggactggaatttcttcttcaatcgcgcgcgtaatccatgtgcctttcctgttgcccacggcggctaatcacaatcaatattaacgctttctcaaatactccctccgtttcaacatatttgacaccgttgactttttaatatatgtttaactatatgtatacataaaagtatatttagcaatgaatcacatgatacgaaaagaataactaattactttaatttttttttgaataagacgaatggtcaaacacgtactaaaaagtcaacggtgttaaatattttgaaacggagggaatataattactggagtactactaaacatttgtaatacaggtaaacagcgatatagtaatatattaactgcatctgcatgctttcgtccatccgtctgacttgcttccaaattcatgctactataactaacttaaacctctgttactctccatttttactgcaaaataattgccactcgctactccggtttggtggttacattattgagagagatgctctccgtggacttgtcatatagtactagtatgtgtgctgtgctgtgctgtgctgtgcgtggtctggtggtggcgatgaggacaatgctgcaggaagctagatttagacttggacacgaaaccgttgactttgatcggaccagtcagcattgctaagagcacccgcaatggtaaagtaaggtgctatctataaaacatgtacatctcagcaatagactagattaataagtaaaccatctcaatagtatgtctacataggtatctatagctctctaatacattgtctcgtttttctctatagactatctccaggttagtagatagctttgctctctctcttcatttaatctcttccaagtaggaaaatatgctgacatggatatcttatagagagcctatagataaccattgtgggtgccctaagcagccaacctgaccgctgtttcctgcctccttgcgtgatctcaatcatttcccctttgttaacactacatgtacgcttacattttacggttacccaaatttaccggtgaaataaaatcccaacaattctgaatgtttgggataggaagattagacagcatacgctcagagaaattagatgggtggtccgcgcaattacgctgctagcatatatataaaattatatatttttaatatgattttacttaaaatttattaaatagttgtctcattgtcttaagattttgaaagaccaaaacttagcatacttgtgtttctaattttatagtttttaaaagtcacaccagttactagcccttacttctgttatattattatttatttacttgctcgatcaaccactgtttctattcattctccttgaaacctttaaaatttggatataaaaacttatagtttttagagtttattgtcatgttgggcttcttttttataatttctagaagtttcgtcaaacgctaccattataatcctctacgaccgtccactgcatcttctctttattgtcattactattttaatagtctaacataattatcgtttacgttcatttttttactttctataagttccgccaaaacgtcagcgactttgttattgtcctcccctacgattcacacgttgccgcccttctttaatgtcattgagattttaaaattaaacatgattatcattggtttttttttactttttagaagcccaaacctttaaaaatggaccttatagtttttacagttttttgtctcgttgggtttctttttttttacaatatttaaagcccgaacctttaaaaaatcctatcaaacgctaccactatactcttctacgacccgttcgccgcatactctttattatcattgggattataaaaatcgaacataactattgttggaattcatattttaatttcaagaagacccaccaactattggtggctctgccattgtactcctatacgacccgcccgctgcctcatattttaattgagattttaaaaataaaatatgattatcattggggtttattttttttactttctagaagtcccgccaaccgccttgaccgattgcttcatgacctgtccatcgtccttccttttaatcgtcatttggaatttctatttggtgttttattaatagtttttagatgtcccatcaaccgccaccactctgctcctgtataggcttgctacttaattaatctcatcatgtgtttcagatggtcttttctttcaataatctttattttttatcactaattttagttataaattgtatccctagttgaaatctttttttctttttctcattttagaatttagtttatttacatattgtgttcttttgatatttttatttttttatttttaatttcagttgttttaaaattgtattcctactttaactctctttttaatttgcctaattttggatttcattttatttttttattccgaattttaattaatctactattgggttcttatacatactcttattttaatattgcttatatttaattccgaatttcagctaattttaaattgtactcctactttaactcttcttttcttttccttttttctaattttgattttttttatttttatttcgaattttaattaatctcgtattggattcttttatggactcttctttcaatatttcttttttaattccaaattttagttatttttaaattgtattcctacttggactctttttttttctaatttcggattttattttatttttattgctaattttgattaatctcgtattactttcctatttagactttttattcaatattgcttacttttaatttcgaatctcagctacttttagattatatttctacttggactcttcttttctttttctcgaattaatgttggaatttctagcctccacagcgaacgttgtgcctcctttcaaggtttgctaatttcagattttattttatttttattccgaattttgattaatctcgtattactttcctatttggactcttttttcaatattgcttacttttaattccgaatttcagctatttttagattatatttttacttggacttttcttttctttttctccaattaacatgggaatttctagcccgcacagcgaacttagtgcctcctttcaaggctgttttaataatataatagatagataaaaatagagagcagaccaaatgagcctaaatcgaattgcgtgaaaaaaacgaagaggaagtccaactcagcagataaggcctggcttagtttcctaaaaatatcacaacgaatctttgacacatgcatagagcattaaatatagattaaaaaactaattgtatagttagaggggaaatcatgagacgaattttttttatcctaattagtccataattagccataagtgctacagtaacccacatatgctaatgacggattaattaggctaaaaagattcgtctcgcggtttccagacgagttatgaaattagtttttttaatcgtgtccaaaaaccccttctaatatccggtcaaacatgtgtgtaacacaaaagtattcttttcgtgaactaaatgggccctaaaaacatcatttcttgtatatggcccaaaaaaagatgattaagagtttttcttacaacgcacgggtaaatataatttgtagcatgcatcgaagtataaccaatcaatcgaccacggcagcgtaaggatacacagaagaaaaaggtaagccgatggatcgagataattaataaagaaaggctaataatgactattttcagtttttccaccacacaaaagcgttgttacgggtgaaatcaattttaatctttcctattaatccactcaaatgtgtcattaggagaaatgtgtgggccccatcgggagaagaaatatctcctccggctcggctcggctcgattctaaaggtgccggtttttctgaaaaccagcccctttaattaatataggtgtcatttcattaaaaaaccgacatctataattaattaatggtgtcgttttactttaaaaaatcgacacctttagtataggtggttttttttacagaatcgacacctataataaaggtgtcggttttttatattttcggaccgtagaggtgggaaaatgcttataggtaccggttttaacacttccggtatctattgtgctaacatctatttgatattttgtagcaatggtacaaagagccatagaatgagtggggcctaacaattgtagcccacagtcatataacagagcaatcaaagatttcaagacacgtacgcacgtagttagtaattagtagttggacgataagttagaataaaagaaagccaaatctatatctctactattataaaaattaaagatgtttttgccggcactttggtacgttatccgtgtaagagtcggtttttaagttcgttcgcttttggaaatacggatatctatttgagtcaggtttctagattgttcgctttgggaaatacataaggagtcgtataagaaatctctttaaaaaaaactcgtatactaacttgagatgattggactcctaattgtagttcatgattttctagaaaaatacatatccaagcgaattctcacagtaaatttcacattaactaaaccgtataacaataataaaatttaaataaccttcacccgttgcaacgcatgggtattctttatagtctatctaactaaaaaatacgnnnnnnnnnnnnnnnnnnnnnnnnnnnnnnnnnnnnnnnnnnnnnnnnnnnnnnn

SEQ ID NO: 17126 - DNA, 3119 bp, Oryza sativa
tttttcctcagaataaaaagtataatgtaaaaaatgtttttacccgttgcaacaaatggacattttttctaggtacttactaattaagcattgatttttcttttgatttttcgcaattttgttttctaatttttcaagccttgacgaggcattgaacctcccggtcccagcccgacgccagggctaccggccgctcccagatctcatttgaagcattgagcagttaggtctaaccacacggaactttccccgatgtgaagaggattggaaaaataggaagagggcagcctccagcgacaggaagttcactttagatctcttaaatcgtcgcctggtttttgtccttattcgaaaaaccagatacaactcatcacttaacttacaaaaccgtgcaaacgagattcctcgatattattgtctctggttttgactaacgtggcgtctttaaccatgtcttcatcacacgtggtattgacgtggcgcttacgtggctatttgatgaaaaaaaaataaaaggaacaaaataaaaatttggaaataaaacaaaatatacggacgcacatgtcagaataaaaaatagtgagacccacctcctacacctcaccctcttcccctctcttccaatcctctgcctccatcctccatcctcccggcgacaagcacggcggtacctagctgtcgtccgcgctgagatcgtgcatgagctctcctcctccgcttcgtcctctcccccgttactccaatcctaggtaccaactccaccgccacatctcgccgccgcttgcagcctcgcccccaaatccagcgccactcactccccactcacacgctcctcatgttcttcttctatcgctagagagcaacagcaaggacctctccatccatcggtggctttttacccataggaggggagaggggaggcctggccattgacgctgtcgcgatggagcgcatggccaagcactgctgggatctgtgggacgcaggcagcgacgccggcgttagatccagctggccggtagctcatgccagtggcggaggggtcaagccgtcgtgggaggaacaggtgttctcgcaggacgcagcggagcacctcggcggctgcttgtggccgccgtgctcctacatgtgcagcttctgccggtgggagttccggttagcaggcgcttggtaggcacatgaacgtgcattgctatgaccgtgctcccctccggcagtgcgacgacgacatcgacccgattcaaccaccaatcggcagcatctgcgagccgcctactcttttaccgtcaacggtagtagcagcagcagagtatcctttttagataatggaagtttttatttaactcagtcaattacatcgagatgatacaattatcctaagaacactctcggcctatgcatatctcctgctacaaatatccagccctaaatccacaactgctcatcatcatcatcataatcagcagctgcagggcactaattcttcgtctctgaattcctgcataacaaccatcatcaagaagagcaggaacaagacaagatgaagagaggggagattggaagagctgaggaagatgaggaggggagtaagaatgacatgtggccccaccattttaaattactatctttttgtaactaacgtgtgggtccatgactattatttttcaaatcgaattgtcatgtaagcgccacgtcaatgccacatgggacgaagatctagtcaaattagtcacataggcgccacatcagccaaaaccgccgtccaaaccaccgagggacctcatctgcactggttttgatagttgagggacccgttatatctggttttgcggttgaaggacgaaaatcggattcgttgacaagttaagggacctcaaatgaacttattccctagggacatgtcacgcccagaaattcccgaatagaatttcaagcagaatgtgcattaaaatccccgtccaggaccagccggggtacacaaacgacaatgttgacattcagatccacgtcttacaaacatcataaaagtcttacataaatgcagcggaaagaaagagagacaacaggagctaagccttgactagaaccgcagcgggatcaccactccacaggcatcctcgacggcacggacgaagcctactcctcggagaaaccttcatctgacacatactcgaactctggggttgggaaaagtagagcaagactgagtactacccactgtactcagcaagtcataccggaatagaggcatgatgcagggaatcatcaaagaagagctaaagtggttcatttgcataaagcgagcatttataaacagaagttgaaagattaaacagttgtaataattaattaatattaactatccactgtccaacgctatcccacgttgcaacaggcccaaccatccacctaaactatccagtttcaaaagattacactagggtgagactaatcacggtgaatctggttgaccgcccataaccgcgggcacggctattcgaatagttttactctgatcagaggtgtacaactgtacccacaagacacagccccacaacacgtttccgtgcgccgacatgccaccacggcatatcagaaagaggccgtgacaggacccttcgcataaccccctctagccaagcacaccacacctcaggtttcacacccactcctcgcaaggcagcgggcagtcccctctcgtgcctaggtgaatccggaagcgacagaggccgtcgcagggcccgccccgctccatcacgcccacccttgcctggatgcgtcgactagaggaaagctatactacaagcccagccgttgcccacgctggcttgtggtaagtacgataagttcttccagggcatcccgcgaaccggtccttaactgccatgggtgcgaccagcaaaaccatgcacccacagcccaccatgtggtttattttaattaaccaacaccaaagcggtgtcactaatccaacaaaaccattagaaccaacagtctaaacgttaataggattttccccaatgtgaactagttgaactaagcatggctaagcaatccctagtcctaactctaatcatgttagaaccccaagttgacaaagaaacaaggtacaacaatag

SEQ ID NO: 17127 - DNA, 850 bp, Oryza sativa
tacaagaaaaaccttaaattatttattgcgcaatatattccagggctgacgtcatcaaggcggggcggagccaacaagcggggcccactggtcagcggctcaggggagagcggttcaccgggaccgggaccacgcgggtggtccaccgccggtccacgggaccgacggcccagatcgccctcgggccgatcggacgggcggcggtggaggcagccgccgggctcggctcggcatcaaagccgaccggccgacccggggctaacggcggcggcacgcgcgcgtcgcgttgccagcgacggcatccggcggcggaggcgacggcgcaaaagcgacgcgaaagcggcatcagtggacggcggcaacgaccaaaggcgacggcgagcgcgggcggcggcgacgcacggggaaatcgaggaagtaaaggaaaggggaaggagtcctcaccgaaggggacgacggcgtccggcgacgaggagcgacggagggaagtcgacacgcggcggacggcgaccgggacgacctaaagaacgaaacgaaagagattagagaggaagagaggggccataggaggcggggatgtcggccgaaggcggcggacatggcgaccctcaccgtcgcacgacgggaacggctctccggcgacggacctcgacgaaagaggggtggacggggtggatctcggccacgcgaacccgacggcggcgacgacgcggtgcggcggcgagcctagcggcggccggagtagcggaaacggcggcggcgggtggttgcacggcgcgggagcaatggggagcacgagggagttcggcgagaaaaggaaaaagcgagagggagcgacgggaaagcttaa

SEQ ID NO: 17128 - DNA, 821 bp, Oryza sativa
ttttcaattttgatttcatccgaaatttcgctcattttggttctaccgaaattcctgaaaatcaggatttttggcactttttggaccgatttttttttaaattttagcataatttaactgaatttgattaaattttgaccaaattcacagaaatttgagaaaaacaaaaaaaaaacggccgatataatcacttgccgcgtgggggggggtccggaattaccaaaatttcgatccgaaattgcaatcctaggtgaggagcatgtggtgcattgtccagttgatgttggttgcaagattttggtgctacatcaagttggggcagacaatgttaacatcaagttgggagatcaaagtttcaaaaccatcgaggtgctgttggaagatgccagtgctggaaattgttactaagaatggttacgagcaatgaagggtgtagaatacacacaaaaaatatctagtctatcgagcacctgagatcaagtttttttgtttcttgttttccttcatgctccataagttgataaagagagtattagattaatttgagttattagtattatttccaatttctgttatgttcttgggctgaacttttctagcttgaagtagatacttggggactagactacctagttttccaatactgatagctgctttgttcagtattgaaattttgatgaagaatacacatgacaaccacaagaacagcaagttagaacgggtattagtaacaacgtaattggacccagaggcggattcacctcccgggcagcaggggcggatgcccaggcttcacagcgatgaacccatattatctagcg

SEQ ID NO: 17129 - DNA, 426 bp, Oryza sativa
  unsure (1)..(426): unsure at all n locations
cgaattcgagctcggtacccatttgtcttaatatgatgtgagtggtccaggagcatggttgggtagactaagaaggaataatgcccaacagacgttgttcattgttttccctagctcaaggcgagaaacaaaagaggagggaaggtgagcgtcggtgctccggcgaccaaacgacagtaaggaaagtggtagtacgtatcccacgatgtgactcgttcataaatggtggaggttggcaatgaaaaaaccggaacaagagggatgtaggggggcaacgaggtagtcccgtgatagattgagaaatgacaatgatgagctctagtggtgaacacgaccaggtgagtgtgtcaaaactcgttcctaaacgagagnnnnnnnnnnnnnnnnnnnnnnnnnnnnnnnnnnnnnnnnnnnnnnnnnnnnnnn

SEQ ID NO: 17130 - DNA, 677 bp, Oryza sativa
agtatttgtaattttgtaaaatttactcctttttctaggattttgcccctttgctttaaaataggaaaaccgggttttgacccgttgttcgccaaacaggttttacgtttgcgtagacgaagccgcagtaatcgacgaagagctgttcaaacttcaaagtctctacgctcccctcatttagcatgttgatcatatttttataaactagtatgttgacctgcgcagattgtgcagctaaaatcattatattttctctcatataataacatacatgttttctcaatgtattattcaaatatattaaaatgacaacataattttaaattttgtattaactttatgaaactactaatgtgtaatttttatattgtattttatatacgtgttagttattaattatttttaatattaaattttagttatttgtaaattatattcgactctagactcgtctttcaatatttcttttttgaattccaaattttcgttatttgtcaattgtatttctatatagactctaggctcttcttcctatattatttatttttaattctgaatttttattatttctaatcgtatttctatgtgaactctaaactcatctttcaatattctttaatttttaatttcgaatttcaagtatttctagtattgtattcctatattgactttagact

SEQ ID NO: 17131 - DNA, 613 bp, Oryza sativa
tccccctccccccctctttccctctctcccgtgtgcgccgccgtcctccgcgcgcgcaccgtcgtcttcggccgccgccgccgctttttgcgccgtctgccgtcgccgtccgcgccaccggttgccgtcgccagcgaccgcgcgtgccgccgtcgctcgccacgcttggcctgccggctttgaagccgagccgagccaccagacgcgcccctcccgccttgtgccactgccagtggggcccacatgccggcgcccctccctctctctcttgagccgctgactcatggggcccgcatgccggcgcctccccttccttgctgacgtcagccctggggcaatattgcgcaataaatacattaaggcttttctttaatagtaaaaacacaaagaatcttctaaaaatcataactaattcatccgagctccgtttaagcccattcaagtctcagtaaattcataaaaatgtatagaatccattaaaaatggttttggttcctgtttcagtagtcttatagcatgttttgcttgtgtgctttgtttggcgcgtagatttcgcccgtttcgtcgattcgtggtttctcgaagacgttgctgtggttccatcagtgcgaga

SEQ ID NO: 17132 - DNA, 11479 bp, Oryza sativa
  unsure (1)..(11479): unsure at all n locations
nnnnnnnnnnnnnnnnnnnnnnnnnnnnnnnnnnnnnnnnnnnnnnnnnnnnnnnnnnnnnnnnncatgccggcgcctccccttccttgctgacgtcagccctggggcaatattgcgcaataaatacattaaggcttttctttaatagtaaaaacacaaagaatcttctaaaaatcataactaattcatccgagctccgtttaagcccattcaagtctcagtaaattcataaaaatgtatagaatccattaaaaatggctttgtttcctgtttcagtagtcttatagcatgttttgcttgtgtgctttgtttgtcgcgtagatttcgcccgtttcgtcgattcgtggtttctcgaagacgttgctgtggttccatcagtgcgagagcaaggcaagtcatacattgcaattgatcatattgtacccaatttacaaatgtcccgcatttctattaaatattgcactgttttacaatatcatgtgggatgggtcctattactcagctatatgttgtttcccttacgccattgataacttgggtatcaaaatgactagatgttggtttaggagatgcttaaccatgcttagttcaactaatgcacaaaaggggatcacactaaagcatagactttgattattggcaatagctttggattagtgccaccgcaatggtgttggttaattaaagtacactacatggtgggctgtgggtgcatggttttgctggtcgcacccatggcagttaaggaccggttcgcgggatgccctggaagaacttatcgtacttaccacaagccagcgtgggcaacggctgggcttgtagtgtagcttttctctagccgacgtacccaggcgagggtgggcgtgatggagttgggtcggccggggtgtccggttgatcggcttccggattcaccgcggcaccaaagggggggctgcccgttgcctgctggggacgggggcgaaccctaaggtgtggtgcgatcggttagagagggttatgcgaagggtcctgtcacagcctctttccggtatgtcgtggtggcatgtcggcgcacgggaacgtgtcgtggggctgtgtcttgtgggtatagttgtacacctctgatcagagtaaaactattcgaatagccgtgcccgcggttatgggcggtcgaccagattcaccgtaattagtctcacccctagtttagcttaatgaactggtgtagttcaggtggttggttgggcctgttgcaatgtggcgtagcgttggacagtgactggttaatattgcttaattactacaactgtttttactgttttcaactactggttttaaatgcctgctctatgcaaatgaaccccgtagcctcttttggttatatcctgcatcatacctcctcatccggtatgacttgctgagtacagtgggtagtactcagtcttgctcttttcccccacaccagagttgaagttcttctcagttgaagatgtctcgaagaggttggtttcgtcgctgccgtcaaggatgcctgtggaatggagtcgcccgctgcaggagtcaagtcttcaggcttagctcgcttttacctttttcgctgcatttgtaatctttcatatttttgtaagacgtggatctgtatgtcaacaattgtcgtttgtgtaccctggctggtcctggacaggggtttaatacacattcagcttagaaattctggttcgtgaatttctgggcgtgacaataagccaaatcatattcaatcaaagcatatgcccacttgccaattctcccacttagaattggcctttgcatcatatgtttaataacatcggcttgccaattctcccacttagaattggcctttgcatcatatgtttaataacatcggcttgacaagcaactatgcatctactagataacaagtaatgccgcaatttggtacaagcatagtaaaggcataaacaaagtctctctatgaagacatacctcgtttcagcatccaaaagacggcgggtcaaatatgtaatgatatactccttgccatcttcctcttgtgtcaaaacggcaccaatgaccttgtcttcggaggcaatatctaaccgaaacggcattccggctttaggcgctcgcaccacgggtggagtatacaaatactacttcaacccctcaaacgcctcttgttgttttgccccccaagtaaaatcggcttcttttttcaagcgaagtataggaacaaaagcatcgatttttacccgctaggttagaaataaatctactcaaataattcaccatacctaacaacttttgaacttctttcttgcatgtcggtgctttgaaatcacgaatcttttctatcttcttaggatcaatctcaactcctctttcatgcaccataaaccctaagaacttccccaccgacacaccaaaagcacacttgagtggattcatcttcaaaccataccggcgcatcctctcaaaagctaacctcaaatcggctatatgtccctccataccatctgatttgacaacaatatcatcaacatagatttctaagataatacctagcaaatcatggaagatcaaattcattgtcctttgatatgttgcaccggcgttcttcaatccaaaagtcatgacaacccactgaaataaaccaataaatcccgggcacctaaacgccgtcttgtacatatcctcctccgccataaagatttgattgtagccggcattaccatccaagaaacaaatcactttatgacccgaggcatcattaatcatcatgtcggctataggcataggatattcatcttttggagtagctttatttaaatctctaaagtctatgcaaactctaatcttaccactcctcttcttctccaccgggacaatactagatacccactctgcataacgacataacctaataaaccccgccttcaataaccgatcaatctcctctttgacccggtcatatagcaaaggattaaaacgacgaggtagctatttataaggcctaaaacccggtttaattagaaaccgatgtataacaagttcacggctaagatctggcatctcatgatactctcatgcgaagcaatcaacatactccttaagtagctcgattattttaaccttataatcggctctcatttttttgtttacaaaagtcggccttggtttagttccatcacctatgtctacttcctccaacggatcggccgatgtaaacccttgaccaagcttttctactttatcaaaatcttcaatagtttcaccaatatcgttttttgtagaccgatatttttgcaccctcttttgcaaccactctaaattagcttatttactcattgcacaaagtgatatggcctagccgtgtgtaacaacccaaaaattagccgtctgctaattttgcatcatgctgattcttatgttcttaataaccttctaaacctaggaaaatataattagcgggacctcctaaaaatgacttgtacgaaagcctctatggtatttaatctcttttgtgtttttcatttaaaaatatgttttggttaaattgaggtatttcttgatttcgttcaaaaccttcttttgactaaaattccttttagtcaattttgcttgaaaacccctttttattatttttatgaattgtggtccaagaaaccttcccaattttgcccttgaacctaaaccaaaataattccaatctcattagaattatttgttaatccatcctttgattttaaacctatcctttgattctcaatccaaatatccaaattcctcctttttgatctagccactaatttaatttctgtggtttgatttccttctcggcacaagaataaaattattacgaatattgtgaataattgctcttgtgctaagaaaatagattatatctttgtcatccaaatttactattagcctcaaacaattctctgaaacccatgccatatattttgaggctaaaaccctatttatccttctccaattatctttttcccaccttcctatttacatattaaattttattcatatatctctcaccctttcatttgagtgcaccaaataaattccattatatactacttctaaaatattgcactcaaataattaggaaatctctctttgaaattatctccaaaataaattcatctcaaaggttagccacttaaatttcttccaaatattaatttggattcaaactccatccgtcaattccctacacaaattagaaagcctttctattcatttgggccgaattctccctctcttccttcggcccagaccggcccaattcagccgagccgccttcctccaggtgcgcgtgccgtgcacggcgcacgccgccgccaaccgtcgtcgctaagaaatcggcgacgtgcttgtcttctccacgtcgccgcagccgtgtcttcgtcgaccttctcctccgaaccgcctctctccaccgccttcgatccctataaatagacggcaaacctttccttttctcccccacaaaccaagctctctctctcttctaccatggcagccaccaccggctattgccgatctccctcaccggagcattgccggacaaaccctcgcgccaccgggcttgccttgatgaggtgaacccatttttctagtttcccctctcccttagccgtcctataagccactatagccacttcttttaccggccggagcaagcttttgccgccgccgttccggcttcatatctcacttccactgccgacctctgccgtccccggatgcgcgtcgacggggaacatgttatgttgccgacgtcgccgcgtttcggccaccggagggcgggcgccccgctcgtcctctcttctccctctctcgctgccaacggaagaggagaagaaagaagacgggaggaaggagaagaaaaagaaaaagaaacactgacaggtgggcccctgcacagttcactttcataattttcctatttaattcaaaacccaatctttagaagctcatatctcctaaaccgtagatccgaatctagtgaaacttggacctaaattcatctaaattcaaaccctatattttgataccaaatttgctattttataattttatttgaatttattcaaataccgtttgaatttataattgccttttcaaatatttccttttaatccaaaataccctttagccactaaaaagccgctggttgaaactttacgcctttcatggagacgtttgcggtcacctaggccccgacgtcgaaccattggctgtaaagcccggcaaaactcaaacccaaggtcgaagtgctgctcctagcaccctacgccttgatgcgtataatgatcggagcttcactatcccctcgacctccacagcacgccgcacagttagctctctggctctgtgtgatcctagccgctccgccgccactcacggttgtcggagtaacacttccaccccactaaacctacacaaatctcctattcctctagtcgttatcctttttgttgacaccggctagaaaagataccaaatctagctgttatactgcccgactctagcaatgactagcaaacaaccaaaccctagccgatgccttcctaattaaattccagtcatcatccaaattccatacccacccatcgagcatactctctgcctaccagaacctatacataaactatagagcctagttgatacgctatcctattccataatcaacttaactataaccaaaccctagatattatactacctaaacctaccaccagccaatactagccacatactcacttaaccagttatatcctttattctccaagcaaccaaaacccacacatgaaatatagcgacattagttgcttgatcccttctctaccttagcctccaaccctcgagaacctccacacaaaatattagcccaataatccctatacccaataaaaaggagatatttacacccccaaacccagcctttctcgctctttattgttttcttgctatttcatgatttttattgaatttggttcttcgtctttcttagtagagtctattttattttggatggcaacctgtattatttcgaggatcggataatcaggttgcctatcacggatttatttgcattggagcaaggcaagttattattcctctcctttgaacataaatgccctatattctatacctttattctatgcattagtcattcatgatttcgaatgcataaactgaatatagcaaaccagatatgctagcttttgcttagccatgccagttagactgcataaaatataatgaacttagattggaacagtacggtaaaaaatggttgatttccgggtggctagtactattccaaccgacataagactgcccaagtacttgtgaagaacgaacgagtacgaccgcagcttctagaatggggacagacctagatattatgttaattaacaatgtggtacctctgtacagtggttccttttgtaagtcctcgcgcaggaggcaaatttacgccgcgaagggcgattgtaatatttactgaggcgcaggtaaatatttgagataaattatgatgactagtctgtttgtgaaccctgattgcgatgacatggtgtcatacgatcagttctctctaaagaccccgggaacgccagaactcctctcgctgctgataacgttacgttcagagcgcatggggactagagttcatggaacaagtgccacaattgttaataacctaataataggccatgactaacctaatgaattggcaagtcgtggactgcgggtaaagcgtacatctactgcagtagaatattcatgaaactattcgaatagtcgtgctcacggaattgagtaccgggactcatatggtatttgattagaaacctaattcaagattttactaaatactgttgcattaaagtcattacaggctttcttcttctacatcctctgctttctgcaattaaatctagccctacttaaatgctactatttcatacattcatattgaatataatagcttgctgagtacgttgtactcacccttgcttcaaccccacctttttcagagtcattttggagttcttgccaaagctgggagttcaatcacataagttagtttcattctaacttaattctcaagtctagattagatagatggtttaggtctatagccaaacattagagttaagtcattctatagcttttgctgtattagttagccacaagtttttaaatacccatatattttgtaataatatatcctttggagtcttattcaaacgtatgcaatgaagatccagattgttgaacatgtaccaatttactaatccagggcttgatacagtttaaacatgtcggtttccgaatcattagtttcaggacctgacaccgtgctacactagctggctttacagagataggtacaaatttgccatcgaaaatactaataaaatcatagctagaaagatccatccccgataagcattgaatattcccatgacgccactctaatgtcgcattggccattgcaactttggccgacatatccgcttgaacaatttcaatatcatcaccgtcccatcgaattaaacattgatgcaaggtagaaggcacacaacaattggcatggatccaacaatgacccaaaataacattgtagttaccttgcacatcgacgatgaagaaagcggttggcaacgtcttgtttcacacggtaagctccatcaaaaagatacctttcgcctccgtaggttcaccattgaaaccattgagaatcatgttagtcttcttcaactcatcatctccatgtcccaacttcttgaacaatgagtacggcatcaaattcacggcggcacctccatccaccaacatcctagagaccggcttcccatcaatatgatctttgagataaagaggcttcatatgacgatttgattcatcgggcttctcaaaaaccgcatctttaggacctactaaaaattgagcaacttcggctttatccatagcacaaaactccatatgcaacatacacaccatgtcaacgtccatgtcgtcctttggagatgattcgtccttagtaaccggttgttcttccttccccatttgcacaacaaccaattcttctccccctatggatttacgcctccacacctttgtaggcggtggtcgcaactcattgaatcttctatctctttgctcttcggcctctctctctctctcttttaattcttgggcccaaagacattgcaaccttcttttttgagtagccgttaaatccttaggcatctaccttggtttcggctttgttccaggagagaaataatgccccctgttgattctacctgaagacgatgaagcccccgagctatcctttgtaaacctctcatcaaaccggcgctggagcccggtcagaccggacgtaggccgtcagtcagaccagccagagacgccaatcaaaccggcatgtggccggcggtcagaccggccgtagggctgtggtcaaaccggccgactgcgatgaactgatcccggcttcggatttgttacttgaagactcccaacctcatctccagaacgtattggcacattatgagaccctactttgatagtaatcacctccgaagtccttgtctccaccttaacatgctttcattccctctttccttcatcaacgaggtttttagcacaaaaccggccattatttggtgaagacaaatgctcatgagctggcctccttggtcctccctatccttgattgtattgcattggaggcatatgattgaacattagtggtgttgcccccatggcatgtaataaggaaagggataacccggcggtggcattggataagaccctcatgacatgtcttgagaacaatgatatgtaggtgatcccgactgtcttggtgaatgaccaaatcgctccctaggaggtgatcttggtctttttcctttattgcgagctttctcaccaccttgcttctcatgcttatccaaaagcatatcgaaggtcaccgccgctgtaggtgccgccgatgcagctcgttgcctgctgcctcccatcttgccaccgctgactgtgcctctgccaggacgccgcccaaccgccgagacgagagagagagagagacgagacgagaagcaagagagaggaggcgagaaaagacgagaggcaagagagagagatagagataaagactcggcgatattgactcatataggctgacgcgtcagcctggatcggctcggctcggcttggataggtgctggtttttttaaaaaaaaacgatacctatagtttattattggtgccggttctaaagaagaaccgacacctataatatcgttgtcggtttttctttagaaaactggtacctatattatattataggtgtcggttcttctttagaatcagcacctatagttgtttaaaggtgtcggttttatgtgttttcagtccacggaggagataaaagcattataggtgccggctttagctgatccggcacctatagtgccgatctctatgagcttttttgtagtagtgcattctcattggtgtgggttcgtcacttaatgtgcaattgaatgctctagtactaggactctagataatgaaggaagttcatgcgtaaggctagagtagtaactaataacttagacgtagtgtctaggttagaaattaccttcgtttgttgtgtgctccatggaaagtgaggtaggcagcaggtggtgacagctctatttgtccttcgtattcctccacattcgggtacatcatagagcttaaggcaggacacaacttggcagaccagggaagagtcggttcctgaagcattcgaatagaacaatatgtgttacccaaaagtttcgcaacgtgactaacagtactgaagtacagtacgcatctgaaagttttacattttggtcctttttgaaaacttattttataaatagacccctagaaaaacttaatccaggaatagtcctttttggtgcaccagagaggctggcgccgttaccgtgccacctcgggagaagggcaaacctggctgggctgacgtggcgaaggggggcgtcagccacactggcgtcgtcccacataccatggcgccagcatggttggtgcactctccctgggtgggccgcgcctttaacccgcgcggggcctacccctttctcctcccccactcattttcgcccagtgctagccccaagcccgagtgcagttcttctccctctctctctctctctctctgccccctcacctctccatctcaaatccactcaatttgaaggtgtttttcacgggatttttttggaaatcaacgagaaaggtatactcctccatcccccccctctttttttggttttaatcagttgaatttgtagatcgaagggtaatcccagaacccctttttaaccaaatttgtgattttcaatattttttcttgggatttgcttattatagtgatacatgtgtgcaatgtattcggtagtgccatgattttttgaattatatatgtggtaatgtgaatttttagatggtttggttggacagatggatgaaaaaataaacttgaggcaacgttgaattattaatttgatggaccagaggctttaggttaaatttgtaggtatgaattatatgaatgggagccgaattcggtagcattatagaaatttattattgttaattagaagttggttgggttgtatgacggagtatttgtaatattttgatgtttaatgcactagttaacttgttggtacttttggatgtggattaaatacttttcgtgaagtagtagctttgggacaatttaagttatgcattggttataatatgtcagtttggactacgtttaggaaggaagatgtgattttagttataaagtcacaattttttttggtgtagatggatagacttgttcgtgtttagtacagtggtagagtggtggaaccttacgttggtgcacatgttgagtttgagatatgtcattcaagaccattttgtttcccgcccgcccaactctagatgaactaaggtcacaagtgaaagaagctcttgaatggaccgaggataatgtggagattcgtttttatgggcgatacgatgttggtaaagggcataagtatatattgaatgtgctaggtcagttggaatgggaaatttactttgatttggtaaaagagtctcagtttggatccctataggtgctatttgatttccctcgcttcgttttgtaattgttttgttaattggtttttcaaatgtatgtacactctaggctggcaggctcttcggtgtcaatgcaagaagtaatttctacgaagttcaactatttctcatgtgttaacttgtttaatggacctgtggacttgtgaacttatggactatgtgatggacttgtggacttatttgtcaacttagttaacctgtggactacgtgatgtttgatgtggaacttgttttgccttgcatgtttactgtgaaatgg

SEQ ID NO: 17133 - DNA, 1003 bp, Oryza sativa
  unsure (1)..(1003): unsure at all n locations
nnnnnnnnnnnnnnnnnnnnnnnnnnnnnnnnnnnnnnnnnnnnnnnnnnnaatgcttcaaatgagatctgggagcggccggtagccctggcgtcgggctgggaccgggaggttcaatgcctcgtcaaggcttgaaaaattagaaaacaaaattgcgaaaaatcaaaagaaaaatcaatgcttaattagtaagtacctagaaaaaatgtccatttgttgcaacgggtaaaaacattttttacattatactttttattctgaggaaaaactcatttccttttcagtcccagtctaacctgttacctccgtctgtttggcttgcctctctttggctagcctacaagtaaagccgtaagcctagctcgcctaatcgactgatgtcttcaatctctggaagacaatctcgtgtccaaaccatcctagaaccgatcctccccatcaatatgtgactgtcgtcttcaatctctgaaagacagatcctccccatcaatatgcgactgccgtcttcaatctctagaaagatattttcgtcaccatacaatgttagaaccgatcctccccagattgaatttttctcgatctcccaaaattgattgtggacttatgatacactcgtactattttcgtttttatcaaaatcgaaacgaatccataaaattcaggataaaaatgaacttttaatggagattacatggtgacttttaaatggagattagatctggtaaattaaagcggaattgaaagaaacaatagtggggaaaataatgagggagtagtgaagaatcttttttcagtcaattggaggagggaatgtatggggaggaacctaaaccctgaacccagattaacgtggcagcgacgctaggggttagataaaaaacgaacgaaaaaagagcggatgaaaatgaggcagaaaaaaagccggatggaaaaaagaaacgaagnnnnnnnnnnnnnnnnnnnnnnnnnnnnnnnnnnnnnnnnnnnnnnnnnnnnnnnnnnn

SEQ ID NO: 17134 - DNA, 664 bp, Oryza sativa
gatccatcaatagatcacgcagccattctacctcaacagtaccagtatctagtgctgtcagctctgcttccatggttgacctcgtcaaaatagtttgtttgcaagaccactataaacacaagcactagctttttgaagacatatccactagtgattttgatcccatccacattagagatccaattagaatcactgtatctctcaagtatcgcaggatacccagtatattgaaaccccaattgtaaaatccctccctacaagatacacagtatattgaaggcccaattgtaacagcccttcctccagaaccacgtagtcagttcatccgacagatataccactccacttacacttgcgttctcgcttcctgtaaaagggttaacctgagagtgacatggttggagggaagatgccttataaattggtttcaaccttgctaaattcatgggccacacaggccaaatcctaattgggccaggatgtcacatacaccctccctcaaaggacccgacgtccccatggcccaacttacccatgtagctacacaggtatataggcaaatgtccaggaacacaccccctctttagcgcatgtctgtatgtctagtgccggcgccatacgccatgccatgtgcctcacacagagcccacaggtgccatgcttc

SEQ ID NO: 17135 - DNA, 697 bp, Oryza sativa
actatagggcgaattcgagctcggtaccccaagaaacaaaaaaacttgatctcaggtgctcgatagactagatattttttgtgtgtattctacacccttcattgctcgtaaccattcttagtaacaatttccagcactggcatcttccaacagcacctcgatggttttgaaactttgatctcccaacttgatgttaacattgtctgccccaacttgatgtagcaccaaaatcttgcaaccaacatcaactggacaatgcaccacatgctcctcacctaggattgcaatttcggatcgaaattttggtaattccggacccccccccacgcggcaagtgattatatcggccgttttttttttgtttttctcaaatttctgtgaatttggtcaaaatttaatcaaattcagttaaattatgctaaaatttaaaaaaaaatcggtccaaaaagtgccaaaaatccttattttcaggaatttcggtagaaccaaaatgagcgaaatttcggatgaaatcaaaattgaaaaccctgtcctcaaccaccttatgtcaagtattcccgtgctcactcacctagatccatcattatttgtttaaccatgcctcatgaatccacataatttcagtaaaaagtgagcaaacttgaatacaattaaaacccaaagtcaattacatgtcacatcaacttgttgatatgag

SEQ ID NO: 17136 - DNA, 740 bp, Oryza sativa
  unsure (1)..(740): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccctgtgttcattctttgtaagccttctgaattataatgatgactacaacaactctacaagcccacatgaagaaggggggtggcattagccattttactgctaaaggttataactttgcaggattaccaagcgcatatacaagacaggggataactcagagaggatcctcctgtttgatttcggtgtcatcttctattttcccaactttagttggaaagtgagataggaccaaatgcccctcggaatacccattcatcaggagctttcctatctttgtcttccaatctgtgccagatctctcgttccacctgtcatgaactacccggtcacggtaattgagcattgtgccaagcccagaatttggtacccaaccatattcttccaaaacccgcgcctctccttccgtcaaatcttcaccaatctgtaaaaaatagattagttcaatgtcatacaaactccttttactcatgaaagannnnnnnnnnnnnnnnnnnnnnnnnnnnnnnnnnnnnnnnnnnnnnnnnnnnnnnnnn

SEQ ID NO: 17137 - DNA, 611 bp, Oryza sativa
  unsure (1)..(611): unsure at all n locations
nnnnnnnnnnnnnnnnnnnnnnnnnnnnnnnnnnnnnnnnnnnnnnnnnnnnnnnnnnnnnnnnccagctattcttatgaactgtgacaatcaaacggtaattgtgaaagtgaacagttataaggataacatgaaatcatctaaacatgtgaaaagacaattgtagtctgtcaggaatttgagaaactccggggttataacattgaattacactgaaatagctagaaacctggcaaatccatctacgaagtaactatcacgaaatgtgatagacaatgcatcgaaggagatgagtttgaaacccatgtgagttatactatggcggtaacccaatctatatgatcggagatcccgtgaattagaacctgtgaagaacaagccattagtcaactggaggagagtaccaatctaaatcctctttaagtgaagatgcatgtactctcatgagctgcaaggcaggttggctatatgccttaatgagttctattagctttaattagcaaagatgctatcctgtagagcattcttaaaagaacacacctttgtgagcttgactattggttgtactcttgatattttaggtgaatcttctaggaagcttactaagagac

SEQ ID NO: 17138 - DNA, 748 bp, Oryza sativa
  unsure (1)..(748): unsure at all n locations
nnnnnnnnnnnnnnnnnnnnnnnnnnnnnnnnnnnnnnnnnnnnnnnnnnnnnnnnaccgttcgggttcatttttttactttctagaagtcctaccaaaccgtcaggggctttgctattgtactcctctatggctcgtccgctgcctcccttctttattgtcattgagattttaaaatcgaccatgattatcattgttttttttactttttagaagttacgaaccttaaaaattggtagtttttagagcttattgtcttattgggtttcattttttatagtttttagaagtcccatcaaacgatgccactatactcctctaaggcctatttgccacctactatttattgtcattgggattctaaaaatcgaacaaaactatcgttagaatttactttttattttctagaagtcccaccaaccgttggcagctctgtaactatactcatatacaccctgtccgctgcttctactttttattatcattgaaaatttaaaaaacgaatatggttatcaatggggtttatttttttactttctataagtcccggcaaccgctttgcctatttgcttcacggcctgcctgtcgtccctccttttaatcgtcattaggattcgatttggtgttttattaacagtttttatatgtcgtattaactgccaccactctactcatttgtaggccatgctacttaatttatctcgtcaaatgttttagatggtcttgtacatgcatagatcatactggc

SEQ ID NO: 17139 - DNA, 701 bp, Oryza sativa
  unsure (1)..(701): unsure at all n locations
nnnnnnnnnnnnnnnnnnnnnnnnnnnnnnnnnnnnnnnnnnnnnnnnnnnnnnnttaggcgactcatccttcggccgtcctggcaaaaataaaggaattaatgcaagtgctaccaggaagaggcatcgatgataaacagattgaaggctgcaccctacttctccctactccgacctcttcctccttcctgctgatttcttctctccaactatgttctttgatttcccgttctctacttctcttcctaatctacttgcttgatccccttaattgtattcaatacttgagcagtactctctggatcgggtattggtgcttctccttctggtgttgattttttgaggatgaattgagaacataacactaggcagctgacgtgttagatccacgtgggtttcatgctgactcaatcgattcaacctcatcacattagttgaaaccgggcatagtagtgcactagtgcttaaatcttcgtgcatcttttggtattgtaagttgatggacgcgttatatctggtaatacgttttaagaaactcaacgttcaaatggcggacctaaagtgaacttattcctgtgtaatactctgtagcaagaattgggcccgaattgattgtgcaagtagaatggaaggcccaaacatagatggctttgtgatatatgaagtgaccacgctcatattgggatggttgttgttgtgat

SEQ ID NO: 17140 - DNA, 706 bp, Oryza sativa
  unsure (1)..(706): unsure at all n locations
ccaggtcccctcctggatctgcttcagctcagtggacggcaagaacctgtgctcagaagagagctttgcagagtgcctccaattcctcaacgccagcgacaaggtgaccatcgtgggtgtcaactgcacgccccctcagttcatcgagggcatcatacgcgagctcagaagggtntgcaccacttctttcagcaccatngactcattcttgcacacaccccaacatttcttttctgcacgggtctgcaatcgtctgaaactctgaatgtgtttctgacagcaaaccaagaaggcgatcgcggtgtacccgaacagcggcgagatttgggctggcagagcgaatagatggctggtgagcacgacctgttacacttaatctgttctcatcgctggcacgccaagaaagattagcacagatctgttctcatcactggcacgccaagaaagattagcacatttccgtgcgaattcttggtcgtcttgatcatcaaactgactggtttttttgatgcgtcgcatgcacagccggcacagtgctttgggcacaagagcttcgacgcgctcgctaaaaggtggcaggaggccggcgcgagcttagtcggcggatgctgccggacgacgccgtcgacgatccggaccgtctccaaggtcctcaagggcaagacgtcctattcagcaactcagatttgagaccgactactgggta

SEQ ID NO: 17141 - DNA, 685 bp, Oryza sativa
agattggaccgttgaagctaatgtcctatgtgaacatatatctggtgctaaaattttctaaaacgagaaatatattcttcggaggtatattatgaacgatatcacaaacttagtttcatcagaaagaaatatagaaaaagagtcgagtgcatgaatgtatgaatgtatccagcttcaaaactagtaactgcgtattctgatagaggatcctagaaacaattgtcaactggaaaagaaactaagaaaggctataacacagtttattaatggttaatgggtagttgtgtacttgtgttcataagcaaggatagaagacattatgaaaagctatgctggtaacaggtaaactgaccagttactgtaatgtttcaagtctattccagtttaccttttaaaaaaaaaatcttacaatatatttttcctcaaatgtaaccttttacaatcaccagcttcaagattacatacaacacatcaaacttcgtataattttacccttgtactggctttatcatatctattggtcacagacgatataccagtaaccagcatcaatagagctgattttttttcctcctctgatcataagtcgataatagggccttttactttgaccacatttctacgtacgttgacagtcaaaaagtgcagcacaacactgggaaaatgcaggggaaaaaaataccaa

SEQ ID NO: 17142 - DNA, 659 bp, Oryza sativa
  unsure (1)..(659): unsure at all n locations
cgctccacgtacgttcatcccatcttcgatccgcgtgatgtgtatatgtgcatggcaagacaaaactccggccggcgaaggaactcggccatggagatcgaggaggaagacgtgcacaagttggaggatgcgtcgagagagagagaggagaaggaaagtgccttgcgtttggggaggaggaatcgaagatgtaatagccggccataaatatgatatatatggagccggcctcacaataaagaagatgagaagtgggccgatctggcggcgcggaagacgtcgtcacaaatctaccggctctacgcctctaccggcgacgtttccgcgcggtccttcaaccaaaaaaaccagatgcaacaggtccctcaactattaaaactgatgtagataagatctctcgacggtttagatggtggttttggctgacgtggcgcctacgtcgcaaattcgacttggtcttcatctgacgtggcgcttacgtggcaatttgatccgaaaaaataataaaccatgtgggacccacatgtctgtttcacatacaaaataataaaaatggtgggacccacgtgggccccacatgtcatcctcctaannnnnnnnnnnnnnnnnnnnnnnnnnnnnnnnnnnnnnnnnnnnnnnnnnnnnnnnnnnnnnnnnnn

SEQ ID NO: 17143 - DNA, 703 bp, Oryza sativa
cccctagcactgctgatcgtatgatgcgacagcttgtgtagtttcctttaggaggatcaattttgcaacaagtgaatggcatttattctttcgccacgtatatgcgcatgacatgtggtccctggacctgattgtcatgtactcgggccgtggccacaaataagcaaatgcgactcaactatataaagggtacaagagcacatttccttttcgaaaatggcacgatacgtaatgtagaatgatttcctgaaaccaaaggaaggtatttgtgccaacactcaattgccctgagtatttagggcagtcctagtggtggtggagctagaaaatttttcatggttatttatgtagatttggatggatttatatgaaaatttaagagtctaaggatgaatgcgaaaaggctatggagtcagctcacacatggcagcgcccccaatacatatattactaatcaaatgtgctaatttaatatcacatctcttacatcatgttttcgatactccaggtctcatgccaaacataatttcatcatttttttctcatttagtatggagccttcgatgtgcatactccatgtagttgggttcccaaacggggaaaaattctccacgcgtgcatcacttctctttgccatggtgctcacttgtcatattgtgttttgtgacacgctgaggtgctgataaaccttcttttgtgacgc

SEQ ID NO: 17144 - DNA, 370 bp, Oryza sativa
cttgccccctgctgaaatttcagaaatacgaccaggtgttcccacaacaataagtggcttgttctttttcaatgcttcttcctgcctcgaacgattagccccaccaacaagttgttggacaagcctcttatcattagggcccaaaatcttctccacttctcgcactatctgcattcctaattctctggaaggagcaacaataactgcctctacacctgatctcttatcagaaccatcttgttctgtaggcctctttagggggcctatttcagaaagaatagggagaaggtaagcgagtgtcttccctgagcccgtatatgactggataactgcatcatgcttttgtgaaatgataggaatagcagcagac

SEQ ID NO: 17145 - DNA, 1235 bp, Oryza sativa
atgttactactgtttagctaactaactaatcaggtgagccattaacgagcgacatggacggacacgcgcaggtgcatcccaactcgaacgcgctggtggtgtcgacggagatcatcacaccaaacttctactggggaacccggcgggacatgatgctgcccaactgcctgttccggatgggcgcggcggcgatcctgctgtcgaacaggaggagggaggcgaggagggccaagtacaggctgatgcacgtggtccgcacgcacaagggcgccgacgaccgcgcgtaccggtgcgtgtacgaggaggaggacgagcaggggcactcggggatctcgctgtccaaggagctgatggccatcgccggcgacgcgctcaagtcgaacatcaccaccatcgggcccgtggtgctgcccatgtcggagcagctgctcttcttattccggctcgtcggccgcaagctcatcaacaagaagtggaagccgtacatcccggacttcaagctggcgttcgagcacttctgcattcacgccggggacgcgcccgtgatcgacgagctgcagaagaacctggacctgtccgcgcagcacgtggaggcgtcccgcatgacgctgcaccggtttggcaacacgtcgagcagctcgctctggtacgagctcgcctacatcgaggccaaggggcgcatgcgccgcggcgaccgcgtctggcagatcggcttcggcagcggattcaagtgcaacagcgccgtctggaagtgcctccgcacagtcaagacgcccgccgacgggccgtgggacgactgcatccaccgctaccccgtcgacatcccggaggtcgtcaagctgtgatcgaatccatggtagcctcagcctcgccctcgccggcggccgtcgcgccgccgccgcattacctcccctacacctgtacgtcacccgcgaagcgtgcgtcctcaaactttggagcttcttaatttgtggtgttttcttctttcctcctttcccctccctcgcttcttaattttttttcttgtcttccttttatttttatttttttcgctataaacacggattaaatcgatatactttgtctgatgtgtcacataaggaatgatcattcacaggagattaattattatatatttttttaattttccaatttagcgtggccgtggttgttcgattgttcgtgtcaggatccatgaagagggagagggattggggaattgaggggcgtgatcg

SEQ ID NO: 17146 - DNA, 491 bp, Oryza sativa
attcctctcttaagctagaattccatttctgttataaattctgacaacgacgtgggtttacttacatgcccgatctgctatggttgacaattagaggactagctgagaataactccaacttttaaatttaactctaatagttaggtttgaaataaaattgtggagtagcctaaacccaatactaaacccaatacagtctcggtgggagcgcttaagcggtctagcccgcttcacttcggaggagctgaaagccaaacatgcccttgcccctagatgtacaataatccaaaattgtctgattatccctttcttaccctttgtcgaatttccaatatccctctgtttatacggctgtaacacgtaaataaatgcagtcgccgtgccgacatgttttccgggacaggctcttccttgaatagagaagacggctttcttcctcagtttccgttccgcctcaaaacatcaatcatgctccggtgtggaggacgtta

SEQ ID NO: 17147 - DNA, 688 bp, Oryza sativa
cagcaacagtggaaaaaaggcgatcctagcggggcttcagctccactccacaggcaaaactcaactggggtctgagccttggtcttctaactccgtcttcagctcagaagcactacacttctgaaaagggggaataatagcaaggctgagtacaaccaccgtactcagcaagccacaccaacgatgcagacgtgcaaggggaatacaaggatggtttgaggctatttgcataaaaggcggttgtaaaacgttttattgagcaaaacagtaacactgttgagtaattaaagtagcattaaatctccactgatcaacgctacaccacgttgaacaggcccaaccaaaacacctgaactacagtgcattgagtcgatttattaaggtgggactaatcacggtgaatctggtcgaccgcccataaccgcgggcacggctattcgaatagttttactctgatcagaggtgtacaactgcccacaagacacagccccacgacatgttaccgtgcgctgacatgccaccacgacataccggaaagaggccatgacaggacctttcgcataaccccctctaaccaagcacaccacaccttaggtttcaaccccactcctcgcaaggcagcgggcagtcccctctcgtgcctaggtgaatccggaagctgcataggccgtcgcagggcccatccaaa

SEQ ID NO: 17148 - DNA, 744 bp, Oryza sativa
  unsure (1)..(744): unsure at all n locations
aattgcgtatgcagtgatctgcgtagcaatagtgcaactgtacaattggtgaaaatctccctaaaaaatggctaaatatatggcctcctattgtcccggagccaatgacagtgtggtcctttggctgcagccctggcagcagcattaacgtagtagtgagtgtccagtgcgcagtgatccaatcaaaattcgagacaagatcctccgggaagcatcaagcatcttcgcgtacgagtcgtgagacgatctgtccatgcctctgaagaaaaggaaaaccacggattgttcttcttcccctcgcgctgatacgagtgaaagtgcagccgaagcagctgtcgtagtggccgcgtgaaatgctgaagttgacgggtctgaatatgtgatcggtctggaggacgaatggacgatgggccgacatgggatggagttgggggttgggagaaagcgtggcgaaacgcgctgtgtttgctcgtcatcgatcgaccagaggaagggcagagactcacattaataaagcttagctgcaaccatacatccgccgcaggtgtgcaagggcaatcctgttcggttcacgtctctcttgcccttgtttcgcacgagcgaattccgtctcttcgttttggacctgtccctcatgtactacgacgaacggcacttaggggatcgacatcttcgtgggacaggattnnnnnnnnnnnnnnnnnnnnnnnnnnnnnnnnnnnnnnnnnnnnnnnnnnnnnnnnn

SEQ ID NO: 17149 - DNA, 694 bp, Oryza sativa
aaggtaagcttattttggatgaactggtagttgctgacatgaacagttgaacatttccgccgggcatgctttattgaattattgacggtcaaaatagctgttgctagtccgtttgtctttcccttggtcaaaatttgattgtccagatttgctgtattttttaaattgctggcaaagatgcttatattgataagtgtccatcttgtgggtggaattaaacatggtggtattacttagtataaacacgagttagcaaatactccctccatctcgatttgtatgatgccacaagccaatggagtgaacaatctaaaatgagtcaaaatgtatgatgccacatggagtgaacaatgttccaccatctttcccttctccttaaaccatggcctgatggcgtgatgcggagccgtttgcatttgcatgtcgctgccgtgattcctgaggccacctcgaaccgccttatgctcatggctcctcgccaccgtggtggcagtggttgacggcctcattggtatcatgtgatgtagccgccgtcctcgttgtacacgatagagttaagctggtgctatgtttgagagaggccatgctactgttgcacttgcatcgcttgtgccgccgtcgagaaaaaatcgtgcgcgttggcggcggctccccaatgttgtgttgggacttgggacagtgggcttttgaaggg

SEQ ID NO: 17150 - DNA, 1017 bp, Oryza sativa
gaattcgagctcggtacccttgcaggtctctacaccatccccattcaacaggacaatcacgaaactgaagatagcgggactacaagagataaaggtgtataaaacactaaaattgaaagcctcgtacaagtgagaaaataaaaatagcaaatgttgtctagatgtggataaatacctgctcgatgagagaaattaaacaggtcaagcagtatatagccttttcccccttctcatgcctaagtgcagatttcaacagggatgttctttgcggaaacaactgtgtattgaacaaataaaacatgtcagtaaactataacatacataaccaccccatgccatttgctcttcacaattagcccataatactaaagatgcagatgtagtccctcaaccttggggaaattaggccaataacctctaagtcatctgtatttacagacataacacaattcacactgaacttcctggtgacatgaccaacaaatgaaatcatgtaaaccaaatcatagctgctgtattgctgggggggagggtgattatatttttcagttgggaaggggaaggaaaacgcaaggtaactaacaaacatgcaaatgtttcctcttctgttgttgctgagtatggaaaattcaacattctaactactcggagagttaggaacagtaccaaggagaagcaagaacgagtccactaatacaacatggtcccagtggcagtggaatgcttctgaaaagatgatacattatccttttccttttcttcggcgttgcttgtcacatatgaagctggagcacttaaggtgtctttgtgaaagttttgcagtggtgttcgctacatcatgacaatggggaaccacccgtaggggtttactgcacaaggatcacaagggccctgcagaggaaaggcttgacccaggctagtagaataacctctacccgctaaaaatagcgggagtggtatgataccatccgaaaaaggtaagcaagtgaggcatatcagatgttatgcagattctca

SEQ ID NO: 17151 - DNA, 424 bp, Oryza sativa
tatcattgatttattctggtgtgtaccattgctgctgtgggcagcagtttgctggttactggcagaagaaacctcataaccttgtttgcctatgtgctcaatgatgtatagttgacaccatcctccctgccgtctccacgcgtgccaccgcgccgcccccagtctccgcatagccaactgcttcctctcctctgcgcgtcatcaattgcctccactccacctcgtcaacagcctccgcacgcccactggtcccggcctcttcaacaacgtctcctgcatcaacctgattcaccggaaggtacaaatatcatcctccttccccctccccccctctctctctctttattcccatctgaaagaatcaaccaaaataaaacaacgagatgcatcattcatgtatttgatcattttacgttttcatttt

SEQ ID NO: 17152 - DNA, 515 bp, Oryza sativa
cccgaacaacaaacagagacgcagctcagctggcacatacacattccatcgcggcggtgcaacaacgtgagcaatccatggcgccatgacaacgacgagacagcaagatgcatcatgcagcatgtggcgcaagcgtggcatgagctgacgagcactacgcatgcaggcacacgcgcgacggcccggtcggtgaactacggggagagaagaaaagaagattagttacctccttgatgaggtgcggcttggtgatgaggcaggcggcgctccagagcgggtcgttgatgtcggcgccgagcgcctccagctgcgtggcgaatccgccgtcgatcacggcgcacccgccggccctcctgacgatctcctccaccgccacggccatcgctcgatcgatcaatctatcaaccaaccaatcacttgtcgcaccaccacccccaacacgcagcagcagcagcagctagccgcgcgcaagtagatcggactaagagatcgatcgatcgacgagctgaagccac

SEQ ID NO: 17153 - DNA, 677 bp, Oryza sativa
gcacacgtgtagggtgcagatcgtgggtgcatatgaacccaggtgcagattatccaactcctataaataattactgcctcatgttataagttaaattttaactgcatgctatgtacctggtggggagcaaggtgagtgggttagaggctgtatcaggtgttatttaatacgtagcaccttataacttataagatgaggcagtaattattttactcagccttcactaggagtggtgtacaggcaaattagaggagagatgatccagtgatttttttacttgccgtacaatttttttactcattaagcgttcacatcaccagacgagtaactttttaactcgggacaaatgggatgggaaaagcctttgcaggcggtggtagtagtaaaagcggtccatgaggatgcggcacatgagaaaggcgagaaatccgaagttggacccagaaaaaactaaaagccaggaaggcgagcgctgagaggcgcgctacttccttcgtagcgccaccatgtgcgcgcgcatatatatatatatatatatatatatatatatataaaatatttacaaatagggagagaaatagaatttacaaagttattacatcaccgtgtatatccatgatttccaaataagtctttctactttcaaataggcccaaactatctcaatatttttcttc

SEQ ID NO: 17154 - DNA, 611 bp, Oryza sativa
aaattgggtgcggtgcggttcgggtcaagattcattcagaggggaagcagagcgacagcggcgcaggaggctgcccgacaccgggcgccgcgctgcgctttgcccgggtggtgctctgatgggtccggcctgccgtggctgctgccatgtccgccgccgtggccgtggccggctccggcatggccgctgccgtgaccaccacctcctccttccctaacggtgaccgaccacagagccacagctgctgcgtgcgtcgtcatctggccgacgagatcgacgcgacgatgaacacggaggatggcgccgggaaatgttatccactgacatgtgagcccagcttgtcaatcagttaaaattggtgataatactacctaggatctcggttgatccggttttgtaaattgaaagacctgctatacctgtcattttagtttagggatgaatttcagactgagagataaattgaggtacctaaagtgaacttgctcaatttcacgtcctcgtactcaatttcacatggtacgtactatgctaccacgttaccaggctaccagcacatgaagttgtgccctcaaatatgtacataaaagccgtgagtttattttagatgt

SEQ ID NO: 17155 - DNA, 745 bp, Oryza sativa
  unsure (1)..(745): unsure at all n locations
nnnnnnnnnnnnnnnnnnnnnnnnnnnnnnnnnnnnnnnnnnnnnnnnnnnnnnnnnnnnagttcgagaaccaggagtaggagtctctcaactgtttgaaattgaggtgcgaggactgctacgctactggtcgaggaccagtcgaagtcgtaactcgacctttggaagtcatgatacgaggaccgctacgctgctggtggaaaaccattcgtagtcgtacctcgaccattagaagtcgtggtgcgaggattgctacgttgctggctgaaaaccagtcgtagtcgtacctcaaccagtggaagttgtggtacgaggatcgctacgttgtcgattgaagaccaatcgtagtggtacctcgaccatttgtaaggaatccagagtaatatatggacgacattctcgtgaactgcgagaatagcctcttgatgaagacgaagacaatgaggaattatcgtagtcggaggttcggctcctatacctactacctcatcctcgggccctctagaagtctggggatctcgagtttcgtcgtcgtcgtgtgatgtcatgatgtcgttaaccttgtctgatgtcgtcctgatgtcgttagtcctggacgttgtcgtcctggtgacaacgatgatctagtcggtcttggttgtcgctatcacgacaatgttgattgtcgcgttagatgtcgagagattgctcaaccgactagtcaaggaccaggggtaggcatatctcgatcacctgaagataaatt

SEQ ID NO: 17156 - DNA, 707 bp, Oryza sativa
  unsure (1)..(707): unsure at all n locations
nnnnnnnnnnnnnnnnnnnnnnnnnnnnnnnnnnnnnnnnnnnnnnnnnnnnnnnnnnnttcacaaacagactagtcatcataatttatctcaaatatttacctgcgcctcagtaaatattacaatcgcccttcgcggcgtaaatttgcctcctgcgcgaggacttacaaaaggaaccactgtacagaggtaccacattgttaattaacataatatctaggtctgtccccattctagaagctgcggtcgtactcgttcgttcttcacaagtacttgggcagtcttatgtcggttggaatagtactagccacccggaaatcaaccattttttaccgtactgttccaatctaagttcattatattttatgcagtctaactggcatggctaagcaaaagctagcatatctggtttgctatattcagtttatgcattcgaaatcatgaatgactaatgcatagaataaaggtatagaatatagggcatttatgttcaaaggagaggaataataacttgccttgctccaatgcaaataaatccgtgataggcaacctgattatccgatcctcgaaataatacaggttgccatccaaaataaaatagactctactaagaaagacgaagaaccaaattcaataaaaatcatgaaatagcaagaaaacaataaagagcgagaaaggctgggtttgggggtgtaaatatctccttt

SEQ ID NO: 17157 - DNA, 1307 bp, Oryza sativa
aaatacttgaaatcgtacagacctgaatttatgagaatttattgtagtggaataatgggagtttctaaactttaaatactatttgttttttttgtatatatagtattttctctgttttttaatatataacaccattgattttttagactattcatcttattaaacacaattaactaatgctatgagagagtatatgtatgaagagtgccgccatttatagatggatttgttcggtttgtttggtttgtttgcacatatgtggattaatttagttttgaatatttgtaaagttgtatatttgatttcataatatatacgaagatttttagaaatttctaaggttgtttggatcacgtgtaaatgatgtaaatgaggtagatatttgaactaatgacataattgtaagcacatattattttacatgtaagaacatataattggatcatgccactacaaatatgccattttagataaataccattactattcacaatatcggctcatggcactgaaacatggggaaattggaatagtgccactccatcatgttttccgtcaaaaatttccgttagccctaactgcacattggacctagctagctgtcagttccatcttcccctcactcccctctcttctctttcccccttcctctctcttcaccaccgtcgtcgaccaccactgtcgcaaccaccatcatcgactacctctgctgtgggaggcctcgggagccgccacaaccaccaccacggtccttgatgccatccgcgacaggaggcttgggagcagccatcctcgaccccatccatgcaggagggctcgggagctgccaccgccatcatcgtcgttgtcctcgtagtagttgcggggatgcatggaggaagagatagggaagaaagaagagggaggatggtggaagatggaagtgatatgtgctccccacgtctaggggtctgacggaaaacatgatggagtggcactgttccaattttccccaatttcactggcatgtagccgatatcgtgaatagtagtgtcatttatctaaaataacatatttgtagcggcatgatccaattaaccctagtcaatatatggatgtaaaaactattaatttaattgtgaagctagactacaaccattcaaatggatcttatcaaggtgtttaaaagtgtgcatacaaattatattagccgttttttgacttgaagtccagcaaaggaaaaacaggctaagtgccctagctagattacttaacattttctatcatcaatcataccatcaaccctcttatggcctctaaatatagga

SEQ ID NO: 17158 - DNA, 401 bp, Oryza sativa
ttcagtctgcttcggactcatgtattcatatttctttaattcctgcagtttcagtacacaccacaacacttggttagattgctacagattattgtggatggaaattgtgatatggctgtagacagttcgcaagcattcatttcaagaattttgttgcgaagaattggtcacctactgatcctggtatgaaaaggttactatttgagcaataattccttgtgtctcgttgacttacaattcgtccttctttagaagaaaaacatataattccagaaagtgacaagtccatggtccgtgagaatatattgggttttgttactcaattacctccattgctaaggtatttctcactgtccacctacccttttcttaatgaacaacatttttgcgcctctctccaa

SEQ ID NO: 17159 - DNA, 602 bp, Oryza sativa
gcagtcagaccgacggcggcgacaggcggcagaagctgatctcggcggtcagaccgaagatacaatctcagtcaaaacgacggcaaccaggcggtcagaccggcgcatctacttcggtcagaccgcgatccattgaatttgagggtaatttttattttccgctaaaagtttcggtttttgggtataccaaccattcacttttgggtataccaaccattcaccccccctctggttggcttagttgttgtgattcgatcctacatataagacgatgacgtgcatggaggaggaggttaagatgtacgggagcatagctgaccatagccggtccaaaatgatttgggatattttgggagattttgatgtctacagtagcaatagggggtaagtacaaaattagtagcacgttgagatatggagggggctggatgtaagatgttgcctacgtgaagcaccacataggcggtcagctctgatcaaacgcgttttggaccggctatcactactagagaaaccctcatctcttttggtttgcaagccccttaagtccggtttagcatccgggagagagaatctaggacaaagatggcgatctttagtcc

SEQ ID NO: 17160 - DNA, 643 bp, Oryza sativa
agttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcataaaggccagccgtgcaggcggaaacaccagtcggcggcggcgaaggcaagccggtcggtgaagacgtagacgcccaacaacggcggcataataagtcagccgtgcaggcggaaacaccagtcggcggcggcgaaagcaagccggtcggtgaagacgtagacgcccaacaacggcggcataataagccagccgtgcaggcggaagcaccagtcggcggcggcgaaggcaagccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcagccggtcggtgaagtcgttaacgcccaacaacggcggcataataa

SEQ ID NO: 17161 - DNA, 7155 bp, Oryza sativa
  unsure (1)..(7155): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcctcgtccacagccttttcggccgcaacttccgcctccccttcgtcctccccttcctcttcgccgtcatggtcttcgacattatcttcctcatcggcatcaaagtcggaggaggcgggggccagcttcacttgcccgcgcatatgcttcctggacgtcccctcgtcgccatcggccttgaagggttttgcccggggtggaagatcaccatcatacacccgattcgcccaaccggccacctgccgcgtgagcagttggctgtactcagtgaccgacacatcgccgatcatcctacgggcttcggtgtcggcctgagcaagagtcagcactgcgaaaacaaaacgtgtcaaaacatcaggcgtcgaacagataaaaaagggggggggggggcgaaacacaagtgcatttagagaaaatctgctattgtttgctaaagacttgtctgtgttatattattttcataagaaaacatatagcaaatcttctcttatcacatattttatacttattactgttttgctctaggttgctgaagtttctgtagagattaggatgaaaaatgctaggaacagaaagttttcaacctgcttccatatttttttcaaactcaaaacgaaattatgacatcagccactaaattattgcatatttttttcatgattgagtcttgtcgtttgtttttctttcctttccctcgtcgttttttttgataatcttatatctgatgttcgccctcttcgtcccctctattttttgaactagattcttgcggctcattgttcgacagagcgaaccatgcgggctcgccttgacggattcaagaactgtcttcgagccaaggatgacgaactgggccgcaagagcttggagatcgagggcctcgttaacaccctcaaagaaacgaattctgaaaataagcggctccaagccgagctggagaaggggagcgaggcgaaggccgagatcgaatgactcaaggctgagctccaaaaggagaaggatcaatccgccaccttgactgagtactataatcttactgagccgaagatggaggctcttcgccagaaggccctcaaggcagaggcgagcgctgaaaaagaggcggaacggttcacgcaagggatggtgaaagccaccgagtccaccaaaaccgcatgccgtacgcttcgccttgccctcaatgatatgggggagagggtacaaggagtccctagagaagatgcctccatctttgacttctcggagtggactcagcaggccggcagggcggtctcggattgcgccaccgcgtacggcgattgctgtgcgcgtgtgtcggcggccttcaccatgggcttgctgcagcagttcgggtgcgaacacgtcgccgaattccctaactttgcgaagggggattgggaggtcagctgtcaagatgtttccctcgcgctttgtgcctggcgcaagcagttctggcaaaaggatggccgatccactaccaaggcgcgtctgcttgaacaattggcgaaggcagaggcggcaaaccagggcgaagaggcagcggccggagagggtggaggagatgcccaagatcacccagaggtgtgaggccctccgcccgctctttagattttgtagttttcttttggcatttgccgtggagggcgaacaatgtaaatttggccaatggccctccctctttcgtattgtagccgaataaaacggcctttctacaaatagatcataaatctctactacataaaaaattgaagatgtttcccttgtccgtttaattagaaaaaagtgcaaaaaaacatataaaaagaaaaaaaaaggaaagtccgattcgtgataaaaaacataaaaaaggaaaagaaggaaactccgattcaatgatcgctcccatgcgcagttgcgcccaatcccgagtccgattacatgaaaatgtaaaagtcaaagcctcttatttctatttctaaagccacaattaaaattttccgacaaaattccccaaattcgaagaaccctaatttcgggtaagaaccctaagactcaaaatctaaatcaattaagctaagggtttggattacttaccagacttgaagcccctatgctcaccggagcggcaccgccacaccttcaccttcttgcagtcgcgtcgggttcaccgtgcgtgcgcgcgcgtgcgcgttcctctctcccgccgctgacgaggtccgggccactcggcgctcgccgtttgcgcgcctgcctcgccggactaccatgacgtggcatggcttggcggcgcccttaggtgcccccctcccccagccggcgaagcagtatccgctcggcggtcgtcactgcacgcgcgcaccagctcgccgaaccgctgtcgccaccttcgctgtcgttctgcttgctcgtcgccggagagaaagggattgggagaacatttgggagctagggttttgcccctctctcctcatcggcgcttcatccggcgcgtggacaatcggagccgtccatcagatcgttacacaacatgaaagcttgtatagaagattcatgttttttatggtatatttaatttttagaaaaaatatttttatgtggtatataagagaggatttgcttaaacaagagataatagcataaaaataaatatcttatgtagtgtaggaaagatcatttgcattaaaaataacaataaaatagtatattatatagcatataacatataagttatatcttttttaaaaatagaaaagtaaaaaaacttgaaacttttatacaaattttccaggttgtgtaagagatcacataaaatttttcatatttttatgaaatttctaatgagataaaacaattattaatcttgtatgttcgtaatggtatttggggtgttttttaaaagaaagcccaacccaataacgtatcataaaaaactaataaagttgtcagctattatagaaaaagataatatcgatgacagattattaaactctgctatatgatatagaataaattctctcctccctttttctctctctcccggggctcctccttcccggatggcccaagccacgctaggcccgcgcctcgctcggcctcgtggcctactcgcctccccgcgcgtgggccgccacctcgcccagccagcccacgccgctcgcccacacggcctgctcccgctcatcgcttgggccgctttctccctgctgggccaccctgcggctccccgcgcctcggcctgggccgcttcgcccagccggcccgtttcacacgcgcgacgcctacgatagcccgccctgcagccctgctgccgattcgtagtctcgtagatgccgattgtcgagtccagccgtaaggaacaacctcgctggtgataatcaaatttagcatgtcattgtgatttaggtcgaaattatagaagtacggggttgatcagctatatttggctaatactactagttaattagcttaattagcattaaacgtataggaataaggaagaaatcggctgccaagatcaagctggcagtcatacttgattatccttaatcaagtataattaattagcggcaagattagtatttctttctatgcagggtttgcatgcatgaagatggcaagtttattcctttttttgataaattgatcctggtagaaaacttatttcgaaacttgtccctataaaaaactatatccaggaataggctgtcggctcaacgccactttggcgctgatgttgttcctatcagcgccaacgggatcggcgctgacatcgcgccaacgtggcgggcgagacgtgacgtggcagggcctcagcgccaatgcacttagcactgacaccttgtacacgctaaatagactgatgtgcagcaatgaattaatggtgtcgctagtggtgcaaccggtagtttctttcctggtgtacgttaggactagggtttgaatcccaggtcagccattttcctttttttaaaaatcatcaatctacgtgcgtgcatattaaatcatcaatctccattttcgtttttttgtcttcaaatcttcaatgtacttttttttgtttaaattaatttttattaaaaagaaatatcacatttagtacaaatttaaaaagtagaagaatggattaaaaaattttagagtcaacttttaaaagaaatatcacttttttataaaaaagaaataagaagaatggatttaaaaaaactaagtaaaaaaaagtttagtaaaaacataaaaggagagggttctaaccatggtcactgtaacgaccccattcaagtacctaccactgagctaagccaaacctcattgttacatttgcttttgcttttacttctatttactcagtataaaggccagcgccgctgtagaccatattctgatgtgatgttgcgatctttttttccaccatgtatatatctataactaatataaatattcatatttttccggtcgtcacatctaattttcgtccatacacacaatccgatttggttagcaatagcaatagccatagaaaaaattgtaaaaaaaaaaaaaaatcagcggccgccgacaccaccaccgccgccggactgagaagagtcagatccaaaaacaaaaacaaaattcatccactctttgccccaaaaaaatcaatctcaatcatcacaaaatcacaacataatcatgcaagaacaacatacatacatcatgcctgccgccggatccgccctcaaccattgccaccggcgccgacgccaccgccaccgccggagggagccgccactaccggatcaacccgcggtcgccgccaccgccggcggatccacccgcagacaccgcgacgctgccaccgcttccggatccgacgttggggccaccaccgccgccggagggagccgccactgccagatccgcccgcggatgccgccaccgtcggagggacgctaccaccgccgtcggatccgccgttgggaggaagggacagccgtcgaggccgacgggaagagggagacggggagggacggccgtcgccgtcggctccgccacaccccgttgtcgccgcgccgtgccggcgagacgggagggagagggggagaaggagcggcgccgccggaggggagaggggtggaaagcggcgccgctagaggggagaggggagaggggagagccagcgccaatagggaaagggagagggagaggcagcgttgggcgagggaggcggccggcagtgggagggaggatgggggacgggcggacagctgagccgatgggggtaggggagagttagggttagggttttgattcatttggaatcgatctgaaccgttcctcaaaacaaacggctcagatcgatcaagtgttgggctggcctcccacacttatgggccgatggaaggccagcgggtccaacaaacgtaattaaaggaggattttgaggaggtaaattagactttatttatcaaaattagcaattaagacctgtaaattccaagaaaatttcaaagggtgtaatcaatatggagaatttaataaaaattaaatccaattatatacctacctacttaaaaaatacccaaatatttcagaagagttgtatttcatttagttagaatttaatatgttttaattcaattttctcttttttctttccgttgcaacgcacgaccacttttgctataatttcaaagagtgtaattaatattgcagaaaaattatatttcattaaattacaattcattttcttcatataaatagttcaaatcaaatttcagtcaccatatcattatccggtgcaacgcacggacattttgctagtatatatatatatatatcaaaaacagagagcatcattaatcatttatatgtactaatgtacgcacgtagattgaacatttgaagaaaaaaaaaagaacgaaaaatgctgccgtgatggggattcgaaccctggtgctagggtacacaagcaaatgatcataccattgcaccacaattgcatttcttattcttttaattaccctgtacagggggttagcgcgatgtcagcgccagttccattggcgctgataggaataacctcagcgccaacctctttggcgctgagccaacggtctatttctggctatagtttttggtagagactagtttcaaaataagttttctacaaggatcaatttatcaaaaaaaaaaaaacgaagtttatttgatgtttgcacttgcacacaacgcagatgggagccctgctgcctagctagcggccggcaagattagaccaaggtgggtgatgagctacgtaaaccaagacgaactgggagtctgggagctgatcaaatgcatatttccatgggcatatgcgcgctggatgtgttgatgagctgaacttgacatattgccaggcgcatggacgcatggttgcttacactactacagaaagcgtttttgcatacgggcggaatcgatcttcacatgcggttggccggcccgcatgcgcgaaatggtctgcaaagatcaccatttgcgcatgcggccgtcgcatgcggtcacttaagacggccgcatgtgaaaatagatcttcgcatgcggtccatataagaagccgcatgcgaagatatattttcctatgcggtcgacctaagaagaccgcatgcgaagatctattttcgcatgcgggcgtcttaagtagaccgcatgcgaaattcaatttccgaatagctaaaataatatttattctagcattttggtgattcgtaattaatattaaattattgagggatttattatcgtatttcggagtagtaagcatataagataagacaagtgccgcagtaacaaacatgtaatacataaccattaattcaatcgtaatt

SEQ ID NO: 17162 - DNA, 2419 bp, Oryza sativa
atcgtaatttacatacaaatatataatacaagtggcacagttttttcatcatatgtataattagtgtacatgttattacatatgttctttctcccactctctgagaggtttaaatttgtcgtccattgcgagttcactctggttgtcgtagaagagacctcttgcgttgcagacatcgcgacggatgaatcggcagaggtcagcggccacgttcaagatagtagtgtggttgaatcgttgtgcaatatatgggatttcggggatctgcacacataaaggaaaataaaacggtactcagtgagaagtgtgtgcgagatgggtttctttgtagagaagagttcgatgacctactcggttactggttgttttgtacctcccatttactctgagcatctcgcacacgtaataaccacacaagttggttcctggtggttgtttgtagcactgcgatataattatggggaccgatctcagtagatatatttagtatatatgtactgttcgataattagttgtattggtataaatttgatagtaccggccagccagtcctgacggataacttcttctgggatggaatatgtactggtccacctcttttgtggtagtacttgtgtgctatgtttgaaggaaacaattgttttattagtagttagaagactggtgatcgacctaaacaatttatagtaatgaaatgtttatcacttacaaattcaaaatagtgaggaattccataaatgtctccttgtcatagtgtgcggggtctaatgatatgatcaattggtctttcggatatacaaggaataatatgcagtggtctctacatataagataggcttattggagacagaaaattccgaagaagataaattaattaaacaaaaagaagagagagcttacgtgaattggtaggggaccattaagacatctttgtcggcgtgcgccaacattgcttttgccaagtatgttgctacttatagcttcttcctcttgtgcaatgtcttcacatattcttccttttcttccggggtcttgccaaccaattgctcgcagtcctgtctcagctctacggtgtgttgtgttttgcatattcttgttggatcgacgtatccaacctttgctccagttctatcagtttcgtggaattgcatactgtacaatgaataaagaagaaatgagatttgttttatttgtttcgaatgaaacgtgcaacatgtaataaagagttcagacttacagacagaaagccgcaacgagattaacgtccattttatctagcttgtagagggcgtaaaggtcttggaaagagataaaaaatatcccattaggaccactcatgaaagcgcctttcctagatgccttcatataccattcgtgcattaccctcatttcccatggtagcttgttcataagataagttggcaagaatggcttgccatactcataagtttcaggcacatcggcagataaccaggattgcacttcatcttgggccgccagtactgacttctgggagtctgacaagacgtgagcaagttcttttctcttctcagaattcctgaaagctgaaaacatgaacttctccttatccttgtcaatctcctttgggtcgtatgtcgatatcaactttggaattatacgacgaggttccaaagtattagacttcggttcggatgtagtaccatctggtatgtgcacttgttctaccagagcagattggggtgtaggtggagaggtttgaactgagggcggagccgggggagcatgctttttagctggggaggtgggagaggcttgaactggttgcggggccgggagaggcggttgttgaaaaggggagggtggtggtgtaggttgccaagccggtacctaagcggtggtggtgacggcggatgtcgaggtgacggtggttcaggaggcgacggtggtgcaggagcggcagctgaggatggggttgaagatcctgctgcaagaacggccgcgctcaggattatgtctctgcggtgccacaagataaactgattcactgcatcaccgagaagttcaatcccctcaggtgcaggtatgtctagttccaaggaaacgtggtcgctatggaccttggcgacctgtacccttgcgtaatcctcagggattgccgtgttgtggaattgacgtccgggtatcgctaaacccgttgcaacctccttagtctttccagcgcggccgattggtacgacgagactgcacggagttggtccagttatactatccacagggaaggtacttgtctgcactgagcctacactgctgggtacattagttgtttgctgtgcggattgtgtgggttgctggctatcagggaataaccttggaaatgctgtcgggttttcagctgccaacgagtagaagtgttccttcacttgcgcatagatcttgt

SEQ ID NO: 17163 - DNA, 12659 bp, Oryza sativa
  unsure (1)..(12659): unsure at all n locations
agagcgagcggcgagcggcgaaaacggaagagcgaagcacggggatcgaataaatagcacgggaggggaagagcgcgaccgggaaaaaggaatcgcgcgcgaagatctcgcccgccattgaagacgccggcgacgattgcgggatgaatccggacgaatccgagggagagagagagggaaaagagggggaatcggagagggaaacgcggggagtaattcgcccctctttatggcgcgcgggaaagccggaatgcggcggattcggcggcgccggcggcgctagggcacggccgcggccgggtccggcgcgagaaggtaaataacaggtgggacccacccgtcagcgagggcggcgggcgggcccgcctgtcagcggcgcgcgcgcgcggggaagccctatggccgcgggggaagagagagagagagggagggaacgggccgagccggcccaagaggggaggggggggggaaaaggagacttcttttagggtttttctttttataaacctttttaactttgttcatttcttttcaattattatttgtgctctgaaaattccactaaaatttgagggctccttttagaccaaggagaatttaacaaaaattctccgggccacatttgaatttttcttgcacgtattttagtgtttgccaatttcttttcgaattttaattaattctattattccttttagcgaatgatttttatttcgggatgaatttatcaggacgtgacaaatccaccccccttacaagaatctcgtccccgagattcgaggaggctagcaagaagataggttgggcggtcttctcttcttgtctgacttcttccgttgcgtcttgacgaacttccagcaaaactttaccactcggaactgcttggcttgacctcctgttgcggatggaatcttctcttcacctgacttggaccagggtgcaccttttggctgactcagactaggttgcggtagttcaatgatgcttccgttccagaacttctcatgattcatatcttcggagtcaacctcggacaagttatcaacttcatgtcatgcgtcgatatcagcttgtcattactagggtaccatgcttgttatcatgagaatatcatgcttgtcatttacttctaacttaccactattcacttcatgttgtcctcagttagcattcaacgtattcctgtgcaccttcagccttgatgtgttctttcccattggatcatctcccaagacatggcgtcgcctggtaaccggggcttgcacttttcactccgtgtagcatctgataccgagttgaagatttcactccttgccttcatagaaacacttttacctaggtcatcttgcttacttaatgacaaggtgactgttgtgggggaggcaattactatcaggggtcttccttgagcgatgcagagcatgtttctgtttatcaatcacctttcggcctacttctttcatgcttgagaacatctttgccaatctcttttatcaatcatctttcggcttatctctaacaggtggtattctttaatgtggattgcggacgcttctggggacgatgaggtcctttggcttgctgcctttcagtgaaaccttgaagtgtttcaccaaaagctatactgactgtctttgcctttgatccgaaaaagacacatctgaaactcttagtccaaataaatgtctctttggttaatcgcttgattttcttttccatcatcaggttggttattaactcgaggttagaatatagttcctctggcacgagaccctaggtctcctttgtcagtaaacaattatacacaggatcacatatccgcatcttccaaaagaatcctcttagaacttgtttttattacaaatctctcccatagtacatgaatacaaggcactgtcttaagcaaaaagggaaggtgcttaacatcggtacattgtttccactatgggttagaattaacatgaggcctcacaggtacggcgtttgctccagtgaccacaaggcgagtgacttgtcttcttcttgcataatggccggagtgatgacgcaggttacgcttcggctgtggacaatctctggagaaatgacctggttctttgcagttgtaacaaatcaatgccctttttactgagttgtccgtctgagaacgatcattctgacccggtgttggaattggtggttggaaatccttgctaacattggcatcagtggtaccatagttgctatcaccattggagtctttctcagagtcaaaattgctaaggttgtcattctgggttccaacattgatactatcgttgacatcttggtgaatgctactgacattgcacgctttattcgagtggccactaatggggcaagatccatggttgttggtggtatcatcatcattagtattgctagtgttgttgtctgcattgcgtccatcttcttggggcggaaactcttgatgcgcaacagaagatccggtgatctgaagtggctcagtgcgctgtctttggttaccacctggaaatactggcatgttgacaatccttctcttgcagttcgtcatccgattatgctcactttcgagttgcatggctttgtccacaagtttctcgaaatcttcataatcctctagaagtagttgcactgcaagctcatcttttaacccctgaagaaacttctcttgtttgtcttcatccgtttccacatcttctggtgcatagtgagccaaacgatagaactcgtgtaggtactctgtgacggtcaaatctccttgcttcaggtagcgaaactctcgttttcttagtgtgatcattcctgcgggaacatgtgatctcttgaatacagatgaaaactcgttccaggtgatggtatgtccttctggccgtgatgcttcgtagctatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggctcagttttgagaaattctgataatttgcactgttgctggactgtaggcacttgaacgttggttgcccctgctgggttgttccaattctgtaatagttgaaaggttgttgccaacatgttggtttggttaaccacaacttggattagctctggtgaggtttcgttgatgcttttctcattcccattggcttgggttcttgagtcatcggatccatcattcccgtagcctttgttaccagtgttatccatctgtcacaaggtagaggttgagaggggaagcatacaaggaaagaatagaccagaactagggacaagaccttaaaggaactaactctttttgttgatgtgttgtttgttttgcttattctgcaagttgattaagcaaacaacctagcatggttacatcacaacccactgatgcaaaccacgcgctacacacacaagcaaggaacacacgactaacaacactaccctatagggtggcttaggttcagcgacaggttctccaagatcttcactcctgcttcacagctggcttcactgcttcctccacttcgctagcggatcctgcagtctttcggagcttcggcaaacaactgacgacatcttcttcttcacaaagctaaccaactagtactagttgaaatctgaagaaggaagaagagggtaaaccttttgcaaatagcattaggggaaggagaaaaagaggaactttcacaaatagttttatttataaaatatgtccttaggttttatccacttggcttatcctacagtcgagatggctctgataccagcttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacaatcaaaaataaacagcagcggactagcgggcctacggctccatcttcacaggcgctcaactggggtataagccaggactccacctaagacatcttctccaaagcttctcttactgaagaggggaaggattgagcaagaatgagtacaaccacagtactcagcaagccacaccggcggatgcataattaatgcaagggaggtacaagggaataataatatagggattaagttttgcagtaaacagcatttaaaagacacttagttgcccaaagccattttgtaaagacgatcctagagctacacagtattattaaacaaggccgtgaaccctcacgaacctgccttaacccaaggcctacgatgattcggaccgaactggcaacccgacctgggtcccagctcgtcccaagccaacccaggccaaccattccatattttagttgttgagcaaattttaagaattaaaacactgacttgggtacattgctaggcttgcccatatccgagggctcggctattcgaatagatttactctgatcagaggtgtacatctttacccacaggacacatcttcctcacgtgcaaacacgtgccacataccaccacggtatacggacggaagacgtgacatagttcccaacccatcctagccataaacaagagtaccgacccaatcccacctacggccgggatacccgggacaggcaggcagaactgagcccctagcagcagggcaccaaccctctgccatatgacatctcgactaccgggccgcagctcgtgtagccttcatttgtcctggagaatgtccatcgacacccgacttcatccatctccaatccgtgtacttttgtttatgactagactgagccacaaactaagccttacccattagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccataaatagagtgtccactagttagggttttatttattctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacaccggcttcaacttccacgaagagcggatcttccgaagctgcagcgtctacacgaccaacggaaaagaaaaaggcttttactctaataaactccaaataacaagcaggaacaaagcacaaaaatgggttctttacatcttaaggaaaaattagagacttgaacggtccaattccgagttcaaatggccaagatatggccatttgaagtttatatgctctttaaatggatatttgcgaatttcttcatttaaattttaatttaaaatcgaattattgcgtcagccgaggggagagggcgcgcggaccgggtccacgggagtggggcccacgcgtcagcctctcggtccacggtggaccgggagcacgcggctggcggcggtcggcgccgtgggtcccgcgcgtcagccgcacccgcgggcgcgggcggctgacggccgggcccacctggcagccgcgagggcgcgccgaaggcggcctcgccggcacggccgacgggaggaggacgcgcacccgcgccccgatggtcgccgccggcgaccaacggcgcggcggagtggcacccgagagagaggagggaagggggaagcgaacggaacggtcttcggctcaccccggtcgacggcgacgacgggaacggcggccgaagcggaagaagacggcggcgcggctcgggatgaccagggcgacggtgctccggcgatgttcgggcgaggaggaggcgcggacggagtcggcggcaacacggcgaagcggacggaggtgtcgccgagtaaggaggaagtccggagcggcggcggcggcggaacggagctcggcggcgacggcggagagagaggagcacggcgcgagcacgaatccgacggcgagagcgagcggcgagcggcggaaacggaagagcgaagcacggggatcgaataaatagcaacgggagggggagagcgcggccggggagagaggaatcgcgcgcggagatctcggccgccattgaagacgccggcgacgattgcgggatgaatccggacgaatccgagggagagagagagggaaaagagggggaatcgggagagggaaacgcggggagtaattcgcccctctttatggcgcgcggggaaggcgggatgcggcggattcggcggcggcggcggcgctagggcacgggcggcggcgggtgcggcgcgaggagggagatgacaggtgggacccacccgtcagcgagggcggcgggcgggcccgcctgtcagcggcgcgcgcgcgcgggggaggccgatgggccgcgggggaagagagagagagagggagggaacgggccgagccggcccaagaggggaggggggggggaaaaggagacttcttttagggtttttctttttataaacctttttaactttgttcatttcttttcaattattatttgtgctctgaaaattccactaaaatttgagggctccttttagaccaaggagaatttaacaaaaattctccgggccacatttgaatttttcttgcacgtattttagtgtttgccaatttcttttcgaattttaattaattctattattccttttagcgaatgatttttatttcgggatgaatttatcaggacgtgacaaatagtatgtctccctcatccgagacttgacctgtgctgcgcgcccaaacccagttcttgctacgttcaaccatggggtctaccagcaggggcttaccggccgcggcaaatctttgctcgatctcccgccattgatcgacgtgaccagcgtatccgctcgaccccaatctatggggatatctgttcttcttcgcgagctcggacatttttttcctcaaagccattgcttcagttgttgtacgatccgcaacaaacgtgtcccagtcagcctgcgatatatgtccataatccgtaaacggtgggagattcttctgaacataatcccgatttagatcggacttccactgtcgccatcgatctcccatctttttaagtgcgtaatctctccccctgacctctgatccaggagggaacacaaaatacttctgcaactcattccagagaagtgtcttgatgttgtcgtccactgtttcccacaacttgacattaatgggacaacgcgtcctgactagagtgccacaggcgttgctgaacttggaccgcactatcggtggctcgacgggctttccatcctgatcgagagcaatcacgttgtaagtttccttgggtaatttatttttgcttctctcaccacgtctttttttcccactcccgcctgcacttgtagatgtctccgtacgttcaggtgcagacgtagcggtgtccatctcaacttcttgctctgtcctgttcctcccggctttacgtttcgagcggcgtcggactaccatctgcacagaataggtaactctatacaccattaggttcatgtcacatcatagttagggaataatacatggctaacgattttcagcacttacggcctgttcgataggtatgtagtccggatcatcatcgcggggggcgacttgtgttatttccattggaaacgggtcacttggtgtgcgccacgtttcttcactagaagcgtctggctgcttattgctaccggaattttgaggagcgttaccttcttgaggcgctattggtgcgttcgatggaaccttttcgttcgacatcttccaacttgacgtaaaaaaatttgacataagtcccaattttacgtaagtcccaatttaacgcaatttcacataagtctcaatttgacataagtcccaatttaacataagtcccaattatacataaatctcaatttaacataagtcccaattatacataaatctcaatttaacataagtcccaattatacataaatctcaaattaacataggtcacaatttaacttattttcacataagtcccaataacttaatttcacataagtcccaatttaacataggtcccaatttagcatcagtgacaattaaacagaaatctccatttgacataggtgccaatttaacaaaagtcccaattatacatagatctcagtttaacaaaaatcacaattatacataaatcccaatataacataaatctcaacttaaacataagtcacaatttaacataggtgccaatttaacaaaagtcccaattatacataaatctcaatttaacaaaagtcccaattatacataaatcccaatttaacataagtcccaatttaaacataagtcccaatttaaacataaatctccatttaacaatccacaattaaacctttctcaaaattaaacaatccacaattgcacatatcacaatccacgatgcacaattaaacaatccacaatccacaattgcacatttcacatttctttttttaaaagtaaatgttatcgagcgacggcggggacgacctggcggcgacgatggcaacggcgaggggggagaggtccgtgcggcggcgacggcgacctggcggtggcgacggcgacgacaaggggggagaggtcctggcagtggcgtcggcgacggcgaggggcggggcgacttcggggaggagccagctgtagcggggacgacttggcggcggggacgacctggcggcggcgatggcaacggcgaggcggtagagttccgtgcggtggcgacggcgacggcgaggggggagaggtcctggcggcggcgacggcaacggcgaggggggagaggtcctggtggcggcgacggcaacggcgaggggggagaggtcctgacggcggcggcggcgacggcgtggggcggggcgactttggggaggagccgacggtggcggggacgacggcgacgacgacttgggaaattttggcagcctggcggctagggtttcgcgggagccgggacttagaaaattttggctccccgcgctccctatatataggcgcagatcatcgtatgcgggcggcttaagggaccgcatggaaaaatatctttccatgcggtcgacataagccggccgcatgcgaaaaagatctttccatgcgggctgttaagccggccgcatgcgaaaaagatctttccatgcgggctgttaagccggccgcatgcgaaaaagatctttccatgcgggctattaagccggcatgcgagccagccgcatagaaagatctttttaccaaaaaaactcatatttttttttctctaagtaaactgtccatatatatttttttcccaatatttcgccacaattatacattccaaatgtttttggcactaagaaaactcatgaaaattgctcaaaactcgtaatcaaatgttacatgctaatgattacaacataagggggacctaaattcatgcacgtacatttggaatacaatgagaactaaaggttacaaaataactatgacttaataaccttggcaacaccatctgctcgaacgtacgacatatttgcttcatcgattgttctctcaaccttcttaattcgcataggaagatcagtaaacaatggtacatcgtcgaactggttgtaatcattggggtcttcgatgttgtcgatgccgacgatctgttgctttccggatatgacaatagtttttctttcatctgaagggtccttcacataaaacacttgagccatacgctctgctaaaacccatggatcatccttgtggcctgttttactgtgatcgactatcgttagcccgtagtcatcaacggaaacccctattgtgtctttaacccattcacaacggagcacagggatctggatgtttaggccatagtccagttcccatatttcttgaatggtcccataatacgacctcttttctccactcgtgtcaatcgcttcgacacggatcccactattttgtgcggtgcttttcatgtccttcgtagtcgtactcaaggtaaatccattgatgtcgtaaccttgccatgaattgacaatacttgaaggcccacatgccagtctttgtaaagtaagttcctccacagaatcaccaactggcaggtttagatctttcaaccacagaggaaagcgacgcttgtgctctcttgatatccaatcattggaccgccctgggaagcaggctttgatttcttctaggtgtcgctcaatgaatggctcaacgatagcgagctgttgaagaacgctgttgtgtgccgcggacacctttttgtaatcattatcgaagaactgcttcctaccaacagtaccccttccagacaatctaccttcatgtcgatgaacaggaatgccaatggcattagcatcctttatgtagtccatacaacactcgactgcctcttcagttgtgtatccctctatcattgatccttccgggtgagcgcgattgcgtacatagcctttgaggatcgacatgtaacgcttataggcccacatctgatgtaagtataatggaccaagttcaataatctgagggacgatgtgaacgatcaaatgctccatcatatctaaaaatgatggtgggaaatacatctcaagctggcatacagtctcgacggcaaatgtctgaagcggacctaattccaaaggatcaaataccttctgcgaaattcgattgaaaaagtagcacaactttgttataaccacctttgtatggactggtttgactgcccttatagcaattggtaggaacaccgttagcaacctatgacagtcatgcgtattgtatcccgaaatggacaaatccttcattgatactagcttcctgatgttcgatgcgaaaccagtaggcactctaaccccttgtaaacatttacagaaggcttttttctcttcaagtgtcaacaagtaacaagcaggaggaatctcggtcttcccatttggcagcactactgggtgaaggtcatgccgtatggacaaatctacaaggtcgttacgtgacttcaatccattcttcgttttactcgggatgtccagcaatgtgccaacggtgctatcaaacacgttcttctcgaggtgcataacatcaattgcatgtcgaatctctaggtccttccagtaatctaagtatttaaagaaaattgaatgcttcttgaaaggcgacgcagtaccgttgtcaccatcagctttcttcctctttactgtcttcttctttccctttccatatacaaccttaatctttctntgttatctcatacacgtatgtaccacctcttgctactggggcagtgtcattctccactgtattatcgaacatcatagccatcttacggtacctatgtctttgtggtaggaaccgtcgatgtcgcatgtacactgtcttcaaagacgacgtcaggtatttgtatgaagttttctccagacatattagacatccagtcttccctttaatctgcccagataatgaaaagtttgcaggtaggtcattgatggtaacaaatatgatcgcacgtagattgaagtctcccgcttaaactcatcccatagtcgtaacccctctttccaaagctcctccatgtcctccatcaaaggctcaaggaaaacatctatgtcgattccaggttggtttggaccttgtatgaggatagtgagtagaatgtactttcgtttctgacatatccatgttggaagattatacattgtgagaaggactgaacatgtgctgtgcgagctgcttaagtcaccaaacgggttcattccatcagtgctcaatgcaaaccttacattcctaggatccttagcaaattctaggtgttntgcatcaaatgtcttccactggcgagcgtcggcgggatgtcgaatcataccatctatttttcggctctcttgatgccatctcatcaactcagcatcagtcgggtttgagtacagatgcttcaggcggtccttaattggtaggtaccacatcaccattgaaggaatcttcccgcgcttacccttatcagaatctggatcggtacactctgaatctacgggcccattccccgttttataccgacttgtgccacacgttgggcaacattccaattccgcatattctttacggtataatatgcagtgattcttacaagcatgaatcttttctacaccaagagataaaggacatatgagtttcttcgcttgatacgtgttcgatgatacaaagttaggcttaggaagcaacacacggaacaaactcatcagatcattaaaacttgtgtccgaccatccatgtttagccttcaatctcagaagttcaagcactgaacgcaagactgtgaaatccttatcacatcccttcgtttcatcgtaaagaagatccttcgatgcct

SEQ ID NO: 17164 - DNA, 14021 bp, Oryza sativa
  unsure (1)..(14021): unsure at all n locations
cgatccatctaattatataaaggcaaaaaatttacagataaaaaaatagaccgcaggtatttcatacaaaagtttaaatgcatttgtctcccaaaaaaatacaacaatacatgtaactagtatgtacaattgtttacatgcaaaatttgcccatcaaaacatatattttgaagctagattttgcaaaaaatagttagaacaaaccttgtcaaaatattaaaaaaactccactttccaccaacgaaatataacaaaaatggagccaaatgaagcaggatagagagttcttcacctttcgtatagagttcaagtaaaaatttcgagttgaaaacctccccccctaattggtgcttgctttacgagagagaaagcttcgttttcaaatggtcaagctcgggcctgaaggagcatatatggccgatcttcgcatgcggctaatcaacccgcccccgggggggcggtttttgcaggcgccgccacaagcggcccgcatggaacctaccgaccccctcgtacagaaaaacgattttttgtagtagtgttaattgcgggctggcgcaagaggacaaatttaggctgtgtgatatgcgaacgtcgtcgaagcagattttttttttttgacaatggaatagaatatcccggcctttgctcaaaacgagctacaaacaattattacaaagttacacttaaaaaagagtgtagtccaacaaaacattgagaacacgcacttaaaataaaaaataacccatctaagataaggagaacacgttattgaagtctacttgtgaatctccaaccataattggcaaaaagttgcataactgtcgtctcaagcctacggcatgcaaccttcataaactcgccatcttcatcacacctttgtagctgagcccaacaccggagccaatatgttgccctgaaaattacctgcatatatgtaatagatggtgatttgtcaaaaaccaaatcattcctgcttaaccacagagcccaacatattgcagaggctcccacaagtataagcttactccttttcttgtccacccccaaaagccaaccataaaaaatatgtgatatactactaggagggcatagaccaaaagaatattgtattgctctccatataaagtttgtataatggcaattcatgaaaagatattgaatattctcatttttcattaaaaaacaacatcttaaactacctttccaatttcgtcttgctaaattgtctttggttaacacaacccctttaagtaagtaccacatgaagatcttaatcttaagcggcattttaagtttccaaatcattttatttctctcaatatagccattattaatcaaagcaagatacattgacctaaccgagaaccttccattctgattaaaggtccatctaaaacaatcagaagaatgattcaactggatatgtacaatagaggcacacaactcatacaaaaaaataagattctgaccaactaaagctctcctaaaagaaacattaagtggaacagatctcataacactagcaattgaagaacctttccttcggacaatggcatataaagagggatacttatctttaaaggctaagttatctaaccatttatcttcccaaaatctagttgttccccactattcacaatccaggaacccatgtttaagaaagtatcctaaactttcatgagacctgactaaaactgaccaaaaatgagagtcaccttgcttcttatcaacttcagtaatagacttattatgaagatatgttctncctaataaagccttgcgaaacccntngttcattaattaacttaaacaaccatttgctcaaaaggcatttattttgtatttccaaattatgaacccctaaaccaccctgatctttgggctggcaaatgatatcccatctagtaagtttgtactttttcttatgatcatctccttgaaaaaaaacgagatctataataatcaattttttgaagtacccctttcggtatctcaaaaaaggaaatcataaacatagctaaacttgaaagtacagaattaatcaacaccaatctaccacccacagacatatacttacctttccaactactaagttttttttcaattctttgttcaataaccttccagtctttgttacccagctttctaaaatgcattggaataccaagatattcgacaggaagagagcctaacttacaaccaaagatattagaatattgatcgtaatgatccttcgtttgaccgaagcaaaataattcacttttgtgaaaataattttaagaccagagagcttttcaaatacggataaaatcaattttagattctttgcttgctgtaaatcatgctctagaaaaatgatagtatcatctgcatactgcaatatagataaaccatcatctaccaaatagaaattacaccatttatagaaccaacatctttagccctcttaataagtaaagcaagcgtatcagccactatattaaaaagaattggagataaaggatccccttgcctaagacctttatgggtttgaaaattattactaatttgatcattaactttaataccaacatgacccccttgaataaaggaagctatccactgacaccatttaggggagaaacctttcattcttagcgtcttttgaacaaatgaccatttgaatttgtcataagctttttcaaaatcaatcttaaagattacaccgcttttattcttgcgatgtaattcatgtatagtctcatgcaaaataaccacaccttacataatgttcctccccggtataaaagcagtttgagtaggactaatgaccttctaggcaacactcataattctattcgtagcaactttggtaaaaatcttgaaactaacattaagtagacatataggcctatatagctgaattttcatggcctcaacacacttgggtagtagaataattgtaccaaagttaaaagagaatagaggtaaagtaccgttatgaaaatcattaaagagatccattaaatcatgtttaataacattccaaaaaacttgatagaactcagcaggaaatccatcaggacccggtgctttattatgttccatttggaaaatagcctccttaatctctttctcattaaattgttgcgttaaagcttcgttttcaaaatgagaaacttgaggaggttttttttatcagatcgtcttttaatagactgagatattgcaaacgtatcatgtagaatatgtacgtcaaaagaccagggcatagcgtatatgtatctataggtatactagcaaaatacccgtgcttcgctacagtgtattaaaactaaaaatatttatttttagccaaagttattttcacactgtttggtacttttgcttgataggaaaagtctcaaatgataggtgacgccgctttttttttcttttttttgggattatcgttcggtttttatgttgtgatttgtactccgttcacgattaggattttgtatcatctttgatttttttcaagaaaaagtgcccgcgcgttgcaacgggaagaaaagatgagaaaattgaggaggagttaagaaagatttacttaattaactaaaatacaaatttctggaatacttggattttttaagtattttttaagtaggtaggtgtttaaattaattgaaaagtaaagttagtgtaggaaataaaattgatatggctagatttaattttaattaaattctctatagttaattacactttctggaattttcttggaattttcagagcttaattgctatttttaataatacaaatatcatttcagcatttatttaaatagtaatctaaataaaatcctcattacacctgggccattttcagcccatggccaccctcagtccacagccgagccggcccgctttcattccttattctcccctcctcctcggcccgcggacacgcgtccgacccagcaagcaacgaaaaactaattaccctccctatctcactgtcgtgtgggcccatcactacagtgtcatcccctacctccgtcaagttcctcatcttcccgacgcctcccgatgtcaccgccttcataaaactcggccgcatcctttaagataatatgaaattagttgaggggtttcaatccttatattctcctctttccgttttcccaaaaatcaaatcaaatctgcttcatatctagctgagaataaagccctatccaaaccctatttttcctactgtattacgatgcaacccatgttatttttccgcgctaactattggagacgggcaacgcacacacgcgcgagagggggaagagggaatcgcacgattgatggacgaaaataagtgtgacgaacggaaatttatgaatctttatattagttaagatatggtcgattgggaaggcacccaacatccaacaattgaattatctgctgtttactttgttctatttataccttctatttctttgcttttttgctcagaaagtaatctttcgtcgtcatgtaagtacgatagttatcttcttttatctaaaaatattctttacaaatgtaaattagtttttgattccatgaaagtgaattgattgctttcattaaccggttttgatcttaattttaacgactctattaattataccgtaagccgttaggtaatcttttgttgaaaaaaaaagcgtcaatacttctcaactcgagagaccagcactccatcttcactaatcataaattcacaattcctaatctctgttgttcgtgtagtagcagcaagaagcaatttccgatataattgtaaatgatgttttagagaatattaagtatggttgtcgaagtgacaactgcgtacgtcgaaggacgtggatactcaatagtcactggaaacggtgaagtgtattatctttcttttattttttctggatccccgttacatggccctaggagcctatttataaccctattactagttcccctattggggtttaggtttaacaggggaatttacatggttgcccttatgaaagggacatttacatgggtatatagtgtaattaaggtatatgggcccctaatgggccgactggcgaacgctggcccagtggcctccgggcttgatcggctgagatggcctcttgggcctccttgaagttggacttgctacggcaaagtcatccgccttcgccatacactcttcgccatatagtcttcgcccaacatgccttcaaccttgtgggataccggtgcgattcttcacccttcgccatctttgcttcatagtcttcgccatgggggcttcacctcaacagactcgacgtcttgggcttgaacccacccctggttgcatggtttcggcaggtccggtcgaagggtctcatgacataccgccaacaagcccctcacgggcaagagtgagataggagcttcggctgagaccgtgcaaaccatgtggtatggtatggggcgccccctttggaccgacgctcctgccgaaacctattctggagtcctgcagagaaagtgtgcattatgtgtacgtgtacttttatggttagtaacgttttctaggtttcgcgtcttgcgaacggcgaaaccgtttttaattttctctaggccaaaatgaacagtgatgggctttccctcttacgattgggtggggagacgaaccgtcgcctgggtgggctatatattcccccttcccctttttcaccgccgcactctcgtcattttcaccgcgagcgctctctctttctccattctttcctttcacgacgccctttgatttcctagatctttcgcttgttctcccttttcgccaccgcgcacacctttcaccatggctcctcgcaagccgaacccagcttccgcgacaagccctaatccaggccgaatcgacgacgacaccaccgcctttctaggggcttcgcttgtggacgacgacgagctggcaaagcttgtcagcgccagcctgctggtggaggggaaggccttcgctccgggaaaggccgtggtgccgaaacacggcgacaaccggacgatggtatttgccgtgttttttgaggtggggcttcagtttccatgcaacgttttgttgccggagatccttcgtcttttccaggtggagcttccccagctgagcccatcggcacttgtccgagtcaccatcttcgactgggcgtgccggaccgccaggttcgaaccgagcgccgagcttttcggcgccgtgttctatggcaccgtgaactcgaagacagtggtcaccccagccgggacaaagaaaacggcgttcgggagcgtgaactttaatgttcgccccgagcgctccgatctatggccggtgaacgccgccatgtcgaagtgggatcgccattagatggcgaagtggttctaccactccatccccttcgaggccggttccgacgcggcgaaggccctccgttggcggcgcagggcaatttcgccgaacaggaagcccaaggtcgccatcgatggcaccatggaggctcggttcaccctgcttcgcaaggtctgctctcggcttagctgccgcgatctggtggaggaattttgcatgcttcggattttccccctctcccaatcgtggcatgttgtggtgaatgaagacgaggaagttcacggcttgtcaaagctcgtcatgcccgagggggcgaacagtgagcctctgcatttcccttacgtacttgtgactcgctctttttgttcaacgcttgatgtggcgatttttcgactttctgcagtgttgacccttgctcaggttgacactgaagcccggaagatgatcggcgacgtgtcgattactgagttcagccagctgcttacgcggctggcggccggtcgggcgaaccgggtatatgtcggtgaactgcctccccggacgaagtccttcaaggccgatggcgatgaggggccatctagaaagtggctgcggggcaggtgaagttggccccccggaagtgcagggcccctgcctccaccgactctgatgctgatgacaaagacactgtcatagatcacgacgacaaagaggaaggggaggatgtgggggaaacggaggttgtggccgaaaaggccacggacgaggccgccggcaaccgcgccaagacgcccagctacactccgactccgagccccgagcacgttgggaccggggtggagtcgaacttctccctcctccgccaaatggatatggagggggtgaaggcgctggttgcgatcgccgcaaccaaggtgacgaaggggggttcgatcaagaaggcccccaaaaagaaagggctcgttgatgtcgctcgcatttttagcgacgacgagtcttcggacgagacccctacttcgcccactggtcggagcttgggtctttcgaccgctctcagcgccatggttgatgcaggtggagctcggggggagtgtggccgctgggctttggcctttgctgaccggattgtcagggtcgttgctagggtctttggcagtcctgtgcggaggactgtggttttcgccgcttgtcattgagaaggggaagaagacggtcgtcgagacgtctgcttcagagtattctttggtggccccccactgcgcccctgctgacttcgagactggcgcggaccttatccccttcgtcgagggggtaagtaatctcgtgtctctggctggcagcccgagcctattcaccgagctgaacgagttcgacgaaggctattctgccatcaagcgtttggcggttcgggtatgttgttctcctttttgtttactttcagttgtccgtcttcgacggcttatgttaacgcttgtcctcttcgccctctctttttcttttgatctagattctcgcggcccattgttcaaccgaacggactatgcgggcttgccttgacgggttcaagaaccgtcttcgagccaaggacgacgaactgggccgcaagagcttggagatggagggcctcgccaataccctcaaggaggcgaaggctgagaataagcggctccaagctgaattggagaaggggagcgaggcgaaggctgagatagagcgcctcaaggctgagctcaaaaaggagcaagcacattctaccgctctaaccgattactacaatctcatcgagccgaagatttaggctcttcgcctagaggtcagcaaagcggaggcgaacaccgaacccaaaggaggcggcggtgaagcttggtgatgatggaagtgttgggatacgcgtaggctacgatagcataaatcaaaattttctatcgcgtaaaccaggaaccatgcaagtattagatcatagatcgttaccactcgacgcgctgcacagcggaagaagacgctgagaagtcgaaggaactctcgcgaagtagcgcgcgtcgatgtagaggaagtagtcgatcgcaccggctcgaccttctcctcctcgtgctttctcctcgccgtattcccacgccgatcagcaccgcaaaccagcggcgtctctaccggtatccacacgtacagggacggaacgccacgcgcagatgtgcttgcacccgcgcgtggctagggttttgctcggggagggaagtgatggctagggtttctcacgtattgcaatacctccgccggtcacacccctcacgaatatataggatccatcactcgggcctccaaggcccataggactcctattcggatccctatccgaattaagcttatattggatccctatcaaatccccttattccggcccattaagcatgcgaccctgtatgttcatatatactcggctgtaatctgaaaactccttttcggtccacgcgtcaacagcggcccctagcagaacgtattgacccaccgggcatacataaagatcatatcggttgaacctctagtgtatacttgtataaacccctttgcctcacgatatcgattaagctcaaggctagatatgtggcatcctctaatagctaatcattcactcgaacctgttgatagattatataacttgtgattgacccctcaatcacctttggcatggctatgcacttccataatctacaacatcgaggggcctagagatatctctccataggaggggcaaatcccatcttgattatacatatcccactacatatttcatagcatacccgaaaactacttttatagctacccatttacggagtagcatttagcagttcttaagtaagctactacacatgttgagaaccatgataatctcaggtctaaggattcaacaccaacactaaatgagatcactgatgacacaacacatatggctcttgcagtgtctcatgttgggtctatccaataacatgttcaccaacatgtgtccacattattaatttggtatctctataccatgatccatgagacatgatcatcaattaaaacatgtgctgatcatataaacatatttgttccacatatgatatttgattagggatcctttagaaatagtaacaaacaacataaagagtctcatgaaagaatcacatattcattaaccaataaggagttatctatttcaaggaacaatgtcggataaatatgtaaacaaagtatgtgatacaatcatctctatgattgcctctagggcatatcactaacaggaaggagcagcagggcctcgctggagatcaaaacgcggcggcgagctcggtcttcatggcgacgaagtgcttcccggggtcttcggctttggggagatggctgctgagcttgctattgaccttgcggagccgagagaggtggcggcgctgactggcgacggccgaagcgacggcgcacggcggctggagcggcggccgaaggtagagagagaaggggctcccggggagagcaattccggcgacggcggaagacaggacttgagggagaggtagaggacaacgagggggtcctttatataggcacgggagctcgggtccaggcccaaatcgacggaaaaactacgggaaattctagggatcttcgccggaaaaaggaaagattgatccgcgaaattggaaaggatttccgtagaaacttttggggatttcttggggaaaaggaagaggagattaagaggattccattcccagaactaatttggaaataggagcaacggggaggtcggatttggaaggaggaggcggcggcagtgcatgcgcacggcggacagtcggctcttcctgagctggaagatgaacagtggcgcaggaaggcaaaccagacttttggctgggcttctattgcacagcccgatagaaggaggaatgcaaaccagactttgggaagggataaggccggccgaatagaaggaagaatgggcgaggactaaaggtgaactggtgtgattatggtgaataagagcaataccggcttcggccaacaggatgtagggctattacttgacaattcaggggcccgaaactatataaaaatccctgtctccatctcttttaccttagtctcgcgtatatcctagtaccaacgatcatcatactatgcaaataccggaatcgcgacataaaacgtcgacagtggcgcgccaggtagggcgatttttggtgcttcaaggtttcgatgagatgggtttacgagatggattctccaacaacaagctactcggcgacttcggctgtgggaaaatctaacctgatcggagcatatcttccgacgagattgggactaccgccgccgcggagaaccatgatgtcggaagcagcctaaccctcgacgcgtgcgacatcaactggtgcaaggcatcggccggccgagtccaagccgaacccgacaccgattcctaccaaccaagcaagtgtgtcgaggagccaaaaatcaactgccagagtagtgctaccatgttctgactaggacccgatttttagtcagttgacacgggcgtcaactcatcacggccggcgtcaagtccaaccaatttggataacgtccatatgtgcatgcatcagatcaattaacagcaagtgcatgtgtttactgcattcatgcggctgtacacctggagaagtaagattgcatcgatctaatctactccgaatacacatgtcagaaatgtaattagtaggttaattaatttaattgatctactaatttcgtagatatatccggcatatatctacacaggtacgcattattttatataaaattttccataccaatattcagatcatacaacattgtcggatttataatttattatgtttacctagagcatgttttttatacaatatctgttgcgcgggtgtccctgatgttaaatcgactacgatctaacgctggggactcgctctgtcttcttctgtataaatcatgcttgtttacagtttacataatgccctgatatttaatctgctcgttatatcctgataatgctagaagattcatgcagttttttgagtacatactcgatattatctgctatatatcttgtcttctagaaaatatttttcaggaacaattgagcactcgagtaggttgtggtcaagtacaccgcattatcgagaacgatctcgacaaatgcagagtcgtcgcgcccaacctaccaacgaaaactgacaacctatctcatagcaccggctgtggctggactatttgagaaaaggttgttaacggataattcctcgtgaacgttgtcggctttattacctgacatgattgtgaacggacatccggatatgctacaagttgggtgtgtgagtcatgctagccacatgagatgcgcatgtaataaaccaattccagcgcctccataggtgttcgagagtcgaggtacgactacagcaataacgcagcggtcctcgtactacgacttcaaatgatcgagagacacctactcactggtcctcaaccagtcaattgtagcgatctctcgtacatttaattctagtggttgagttacgactactacctggttctgaccagaggtgtagtgattctcccattacctctacttcaacaaagttgatatcaggtgcacaatatcgccaagtgttttacccagagatcccttaccacaaaagacacctagcgttgaaacctatcctaatgtccctttacgccgtcttgacaaagcctctgaggaacctaaggaaacttcggctggggacgcccagagcggataaggctttgtcggatcctttagagacgaaagaccatgtaagatctggtcgtgtaagagttctcgccgtgcgtattaaccaagccgtgtaatcgaaaatggattttccaacttcacggctgggggctaggatcagtgcttgttcaaccgaggcaggtgaaaggtccaagagccttatcctccaagaacaattcgccgacaataaggctaggggctagggagagtgtataactcaacaaactgactgatcgaagtcggtaaaagagtagacgctcatatacaaaacattggtctgtaagtttaatgcattttcggttttccatacatattataacatgttaccctttgagcgttcgctcgggggctatttctatctaatattcttttctgagtattgattttaggaaaattctattcgacattatcgaaggctccatgtctctatggttctacaccaagatcgactaaggcgagtacgacaaaattcgacaaggcttcgtcgctgattctacgccttctcgatcactcgagaacagttggtggatctcgacaaggaatacggaatgaagaaatggtgtacccaccgagataaaatttcttgacttcaatccaaattctcgattacagcaagacgggagacttagtcgtatgctttgaactttcttggttgacgtcagagattgactcagacacaccctttaggtgcccgcacgaggctgataaaggaagtctaacgttatctctgaattcaccaagaacggtcacatgagctcgataacaattactctaaggtctgcgcgcggttgagaatatgaatttgttcatttgcatcgaagtctggggctactgtcagggttatggataccacatacctaatagtagttgactaaatctcggcaggacccaccatataccatgtcctatacggaaagaacctgtggatatgggaagagttccggataaggaaagacaactagagttctacatggaaacgacaaggactactcggattgtatccatatttgttcccctagttctacttgcacaaggggatacctatgggtataaatacaaggccccctaggaggagaggggacacacccaccatagaagacacagacaacatagacgccacaaagctacaagccaatacaagccaacatgcgccaagacaagccgccggatatcgacatcagagatacgcctggatcgaccctatccggtacgtactgaggctagccgtagggatctagcgctgtctctgacctcgccgggcacgaactcgaggaagaagactaccctgttgtcgactacgagtcagacctacagaccgcaaagtcgacaacagttagataggctaccccaaatattgtacttggtgtgattatggtgaataagagcaataccggcttcggccaacaggatgtagggctattacctgacaattcaggggcccgaacctgtataaaaatccttgtctccatctcttttacctcagtctcgcgtatatcctagtaccaacgatctccatactatgcaaataccggaatcgcgacatcaaacgtcgacaacttgggcaccctaagtatttaacaaaattgaaaccagctcatttaatgattaatttaatatgtgaataattactgaaatagtccttgtattattaaaattaggaattgagctccgaaaaatccaagaaaatttcagagagtacaattaatcatggagaatttaataaaaataaaatccagccatgctttatatttaggaaattttatttcccacatttaacttcacttgtaatttaaggaacatttaatataaattctattaatattttattaaatactttataaatcctgaaacgaaaattcaggctgtgacaaaggcgaacgatgtaaatttggccaatggc

SEQ ID NO: 17165 - DNA, 15244 bp, Oryza sativa
  unsure (1)..(15244): unsure at all n locations
actatagccaagaacggtctttttgatatatggaatggatgatccaagtttagccaattattatgcttgatgcctttggcatatatgcttgcgtcattttcgcattatttttgcatactagagagtgcttactctttttgcccacttttacgtttcttgtggagtcttaactttgcacttcgtcatttgccctttctgcactgttttagcagggtgtttgccgaaaattgtgtgttcggtccccctttgggaattggcgaaacaagaacgagaagttcgtggcggcgaagggtttgccaaaggtgcgatgcccgtttcggcctgtttactgcgagatgataataaacggcaacagctacaaggttttgaaggttgccggctgaatgcgggcgcaccccgggagaaccctggaagactacgaccgtatccatacagaacgtctggaggacatggttcgcttttggcgaaaccatcagaaaacagatcgtcaggaggcgatctcccaatgtcgttatagtctagtctgtgtttcgcccccttccctcttagggtcgtgtataatattagtagtgatgacgaacctgattcgccaaatcattccttagggagtgaggattgttgtgggggcgaatgtgtaatttatctgtaagctaggctgtaaagccgttgctttctttgtctataccatgttgtaagacttgtattcttcgattgttttttcgaagttgataaagatgtgttttacttccttttcgctattctttgcattgtcacttttcgtgctttcgttaggtcggaacgtgttggcccatttgcgtatattagcgaaataggtctgctgacttttcagctttcggcttccgttttcgatctgtagtattctgcgctgataggagcgcttgtgttttcatattgatcgagtgtaacggtgttcggttagttgtttcccgaaacaagtcgtcggagtacgtcacccaaggttgtttcgacaggctcggattaaagggtgaatgccggtgtccattcggccacgaagtcagctaggacttcagacttgatggcagtgcgggcgaggaaatgtaggttgaagggagataactccgccacccacttgctgagccggctagtaatttccttgccccggagctcttagcccaaaggatactgtgatggcactgtaactttgtgggcttgaaagtagtgtttaagctcgcgcgaagccatcactagggcgtaagcaagcttctccatttcaatgtatcgtatcttcgccccttgcaaggcttcggagacaaaatacactggtttctggcctgactctgtttcttggacgagggccgcactgaccgccaccggcgaggctgctaggtagagtagcagttcgcttcctagtgctgggctgaccaaagcaggtggactctgcagatattgcttcaactcgtcgaacgctgcttggcattcgggtgtccaggtaaacttttccgcgccccggagagtcttgaagaaacgcaagcctctttcggccgcttttgagaggaatcgactgagtgccgcaattcggcccgcgagcttttgtatttcgcgtacgctcgacgggggcttcatttgctgaatggcatcaattttctcggggttcgcctcgatatccctttcagaaacgagaaaacccaacaaattgcccatgcgaacaccaaaaacacacttctcaggatttagtttcatacccgccgcgcgtaagttgtcgaaggtcccctgtaagtcggacgcatggtcgaaagccttgtggcttttcgcaacgatgtcatcaacataagcctccacatttcaccccaactgcttgtaaatgaccttgtacactagcctagcgaaggttgcctcggcgttcctcaggccgaaaggcatcctgaggtagcaaaaggtgtcgaatggtgtgatgaaggctgtcttagagatgtcggctggattcatgtggatctggtggtagccggagtacgcatccaaaaagctcatgagttcgcagctagttgtcgaatccacgagctagtcgatccgcggtagggggaaatggtcttttgggcacgccttgttaagttctgtgaaattgacacacatgcgccctttgccgtttgatttccgcaccagtatcgaattcgccaaccactcggggtgatcgatctcctggatcaccccagatttgagcagcttttgcacttcggctttcgctgcttcttggcgattagcagacatcttgcgcagcttctatttccttggcttggcattcggcctgaccgccagatgatgcatgatgagatatggcgaaacacctaccacctcgtcggggccccaggcgcagatatcaatgtttttcttgagcacctccagaatgttctcaacttctcttttcgcccatgtcgcccccagcgatacaagtcttgtgggattggcatcatcgacctgcaccttgatcaccctgccatgaggggcgcgcttcggcgtgtgcttcgcccggtcatgcggttcggcctcatcattgtggactgctctgttgattacggccaaatcgccctttgatgtagccgaaggttgaagcccattgaccacgatcactcttgcagggccaggcatcttgagcttgagataattgtggcgggagatggcttcgaacttgttcaaggttgcgcgactgaagatggcattatagttgtatgggatgtcgacaacgtcaaacagtatttgctctttgcgcctcttttcacttgtgccgaaggctaccaccaattgtacttggcctaggacttgaactgcttctccgtcaaaaccgcgaagcgaggccggtgcttgggtgagggctagggttggcatccccatcctggcatatgcttcggcgaagatgacgtcggtcgaacttcctccgtcgactatgattcgccggacttcgaagccaactacctcggccgagatcaccagggggtcttgatgcgggaacagcactccttcggcatattttggcccgaaggaaatctactgattcaagtatcacggggcctcttcgcttgccgaagtgatgttgtgcgccattcgcagctgcatcttcttttgctgttttgacagttgattcggcgggtcaacctttgtaatcacttggattactctgcgctgcacatcttggcgctgttcggccgggggtgcttgctcttgaacagcttcgtgaggtgcttcaacagctactccttgttgcggttttggatcttgcgcgttgccatgctgtcgaatgtttcggcattgatcggtggtgtgcgaacagcgtccatggaaggcgcagtaaaggtcttttctgaccttcttgcgaacgggctgttgatggctacttgcttgctgggcgtcgaactccttgcggagggcttgaacttcttcaacaaccatcacggccttgcgtggatggtcggttctgaatttcctccaagtcatgggagcttgacctggccttggcggttgtcacaccccaaagttctcctcccaagcctaaaatttaatttataaatgaccctaagaaaatgcaggtgcaaatcaagagaaaaccctaagaaggtaatgcaaataataatcagatttgacatgtggaatttttcttgagttctacatgtcgaaattcattaacaggatttttagtggaattttcagagctctagaaataattttaaccaattaaaattgagcaagcaatattttaattccagggaaaatccttttttttcctttttctttttcttttttcctctctttttcctcctttttttcgaatgggccgtcggcccattctctcctttccttccccctcctccttgctaggccggccgcaggccgaggcccagccaggccgtcccgccgccctcctctccggggtcaccgacaggtggggcccacctgtcgggtccttcccccacctcccgccgatctcgctcgcgccgccgcgcccgcaaccgccgccgcacccacgtctccgcctcctccgggccacgtcgaccacgcccgcgcgtgcgccgggtatcccgcgcccactcctctctttctcccgctcgcgcccgcgcccgagatggccgggattcgattttcgaatcccgcctctctctcctccgccaccccccacgtcggccggcgattcccgcctctcccgggcacgtccggtcccctcttcccctatttaagcatcgccgtcggcccctctcactttttccccattccggcgtactcttttgaggcctccatcggtcccgcgccgtgcaaccctttgccgncgccttttccgctactccggccgccgctagccgccgttagggtcgccgccaggccgcgccgtcgccgccgtcgggttcgcgtggccgagatccaccccgtccacccctcctccgtcgaggttcgtcgccggagccctcgttccctcgcactcgggtgagcaccacctccaccgccgccttcggccatggtttccggttgccgtggtccatcttcctctctctaatccctctcttctccttccttagggcaccccgaagctcgtccgcccgccgacgtcgtcctcccgtggcttgccgtcgctgttcgccatcgtcttcctccgcgccggccaccctcggtgaggcacccccctcccctcttttcccctccctctccctcctagccgccgctttagcgccgccgccggttagtcgtcgctttagcatcaccgcccttcggcgccgcctttgcgtcgccgtctccgccgccggatgccgtcgccggcaacgcgacgcgcgcgtgccaccgccgtcagccccgggtcggccggtcggctttgatgccgagccgagcccggcggctgcctccaccgccgcccgtccgatcggcccgagggcgatctgggccgtcggtcccgtggaccggcggtggaccacccgcgtggtcctggtccacggtgaaccgctcctcctgagccgctgaccggtggggcccgcttgccggcgccgcacccccctctgtgctgacgtcagccctgggatttattgcgcaataaatgatttaaggtttttcttgtatagtaataaacacagtgaatcttctaaaattcataactaattcatccgagctccgtttaagcccattcaagtctcagtaaatcaagaaaaatgtgtagaatccattaaaaatggttttgttctctgtttcagtagtcttatagcctgtttgcaatgtttgccttgtatgtcgctagattccgtttcttccgacgctcccgtgtacttcgaaatagtcgccgaggtttctccagcagcagagcaaggcaagtcatgcttgtcacttgaacatgttgatcctatattgcaaatgctctattgttttctttcaaatattgcattgttttataatattactatgggatggttacctatggttaccagttcgcgggatgccctggaagaacttatcgtacttaccacaagccagcgtgggcaacggctgggcttgtagtgtagctttcctctagtcgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggcctctttctgatatgtcgtggtggcatgtgggcgcacggaaacgtgtcgtggggctgtgtcttgtgggtacagttgtacagctctgatcagagtaaaactattcgaatagccgtgcccgcggttacgggcggtcaaccagattcaccgtgattagtctcaccttagtgtaatcttttgaatttggataatttaggtggatggttgggcctgtcgcaacgtgggttagcgctggacagaggatgtttaattaataattacaactgtttgaatctttcagcttctgtttataaatgctcgctttatgcaaatgaacctgcttagctatcccttgttgaatccttgcatcatacccctattcctgtatgacttgctgagtaatattgacaaataaaagttccacaagatgctatcgaacaagtggttttttcttccccttttaccatcactattagcctacccttaactatactccattgcaccacacataaagtgtatttttgcatatattattctaagtgtgaaatggacttttcacatagtttatgggagactaacggtgatacaatgaaaggtaggggtgaaaatggatcggattatatccgatctgatccgttccaaatccgtcctaaacgaggatggtatggaattttagaaatcggcggatatggatgcgaatgcggatagtaaggtgcggattctgattcggatgtggtatctctaaaaaccgataaatgcggattatctggtatttctatcggattatcccataggtcgtttgccggataatccgaaaatatcaacccatgtaaccactctatctgggcatataacatgagtcggcccatccaatgacctaatttatcaattaacctaaacttccttgtttgaggcttttgccgtctcatcttacacttaagtttatgaaaggtcgtttaatgattattgtattgctgtcccttgcattgataactcaatgttgtattgattgtataaacatctaacatctgataaatttaatttgtttcccgaaccgagtctgcaccgactccgcaccatttccaacatccgaaacaatccgctctgcatgcgcacatatccgcacccgcttcgaatctgcttaaaaaatggtttagaatatggttgttgatgtgaaaacacggtggcctgggagatttgcttaactccagtgcaggtccaaaggttgatgagatgcgggtgtgccaatcagtttgatcctgcaactcacaagatatacaatagcagatcaaatagccgatcggctgataagctgatggagtagttccagtcgatgccgatactagccgatgtcaatagggttttgatcaaacggctatatgtccaatgtagataacgatataaagacaatcggctgatggtaatgtaatccagtagaaaccaatcggctaataatgatatgagagcataaacactaatccgaaggttaaagcttacatcggctgaaagtccgatgtcattaaatccaaacgattagataaacaatgaaacctttattgcgatcggctaaaaccaacttgtatgtaatccttgtaagccgatgcaacgcccatgtaactcattggctgaaaccccgatgaaacccttattagcaatcaagaagcaggctagagatcatggttctaaatacgacttagtagatcgaatgtactaatgcatcactaagtatgaaaagaaacacaatatctagacaatcaagcttttgactaatttttagggtggtggataccttagctaatccaatctagtaaatcgatttagccgataccggcataaacccttaagcgagaatcagctgatatgactaaatcgatatactaaaactagattaactaagatatatgataaataggtaggcaaaaatatcaaccgaaccagagcgatccaagaggtcgaagcgatgcagccttgaacaacaccattatagccgatacaattgccaggactggcggaacgtaggacttacccccttcgccgaagatcgaaagccgatgcaaccccgcgtcaagtgctaaggtttcgccggatgataaataaaaacctcgggaaagagggtggctatacgccaagagtagctgtattgatctatgagataaattaaaattaccacatatgtacatatttatacccatgggtagatactagtccttgttggacaagaaagaaacttttcgaaagataaaaagaaaacataaaatccttatgggacactaaacacactttcctaaagataaaaggaaacacaaactcttcctaattaatagataaactgccatgccacatcttccttgaacacggtctcttctagataagctttctttaattgattaattttcttaatctgattactagcgacttgatgactctcatcggctgattccagaactctgaagccaatactaactctaggccgatcaggacttcggggcttaccaaatttcactgttaacaatggtgtgaccactatccgtccgaatccgatccgtttccacccctaacgacaggatgtcgttttagattagtggtactaggttataatattctaggaaagagggagttatatttacatatattaatgatttaagatttgatggtttaactgtacacattttaaaatgtcatatatattcgagaagctagtagatagtaatgctttgttctgcatctgaccgtatgtgtctgttgtgatgaaatgactacaaatcgggtgcccgatttttcctaaaaatcaggcattattttaccccttatgaaagagtgtttcagcactaagtgaaagaatgttttagttcttgaaaaaagtgaaacgcaatcggatcgccagatgaaacaatttggttcaataaataaaactaatgatttaaagccattgaaagatcaacaagttccgagtgaaatcgaagacaaaaattgaaacaccataaaaaaatccaagtgaaacactttgatctgactaatgaaacaaccatatacatagaatgaaaacattgaaacaatcacccgaaaaaagaccagctaaatccacttcaagttagccggatcatcgacggtagatgctgcccaagccacggaggagacgtggctaatgatggcgtgcagctgccgaagatgatgatttggctgatgatgccctacaaaccaccaccaccacccactcgtacagtcactcaggacatagccattgccgccgttgttgcatagactcagctaagtctacattgccgccactgcagctgcctgccaccgtcacccctattagccaccgcttgtcctgccgatatcttgccttatgtttctgcctgtcactaccttgcctccacctttgccttctcacagatcaaaggggatagagaggagagaaatggtgaagagagagataaggaggggaatagatgagaccgagagagaaaggagggatgtggggcgcagggcgcccgatattttccttcccaccaggcacccgagccaaatgctaccatatataactttcaatctagttagtaatagttagtaatgaaagagaattaccatttctaatatatacaccctctggaaagtcctccgggattgccccttctatccgcaatatatttgttatttgaccaatttcttcaactggtgcaaaattactctgcatggatatatagatccaccacatacgtaagttattagcaatggaaattgaactgattctccaatttagttttagaggaaaattgtttctccaagggaaattaatgtatttctctccaattcattgcttagaccccaaaataagtgctacttgctcttctaacttgtttagcataaatcaatgcttgagaaggaaacaactatgatgtatgataggaggatgcatgattaggagtaggatgggacaaagttttgaatataacatgtacttcctccgtttcatattataagactttctagcattgcccatatttatatatatgttaatgaatctagacatatatgtgttcctagatttattaacatctatatgaatatgagcaatgctaaaaaatcttataacctgaaacggaggtagtagtacttagaagaatactcttttcagacaaatttttaatcctaaaaagcattcatttttacaggacggaagaaaatttatattataggaagttcaaagcaataaattgctgctgcattttgtgtaacgtatatgcaatcatgcttgcctgccctacctcggtgggacgtaaagattgatgactgaatgtgaagatagagtccacaaacgcatccagcaatttcttggaagcactgcttcctgcagcagatgcctccctaagtttggttttcaatacttgctgaagctccttgaaacgaggtggctgtatgtatcaaatgaacgtattaaaatggaatcatatgatcatctcattgtacatatgcaatgcaacagtaaaatatacatttttttttggcccaaacagtaaaatatacaatctcaatctcgttgttgcatgcttatagcagtagagctagctagctctggaataattgatcagttcagttgttatatgcagagagacagaaaggagactagagaggctaactacggagggaggtgtggtttagtactgtgcgtacgatgtgcgcagaggaatcatgagtcgccaaaggcttagtcctggtgatcttggctggccttcctccggtgctgcacaggcgtggttgaagagagaagccatacatatgcatggatgctatggtcgccattgttgcaagcttgttgctcctaacaactcctccttttataaggctattccaagagatagatatagtactcgccttctgtcccagtatgacgttgttgactttcacgtaatgtttaaccattcattttatttaaaaagttatataaatattatttattttattatgacttattttatcaccaaaaaaactaaaatcctagcctgtacttttacatatttatactacatttataataaaacgaatagtcaaatgctatgcgaaaagtgaacgatgtgatctattttagctgggttttcgcaacagaacaaggacaatcctccaacataaggattctgacatattcacgtgtaaaaatatctagatatttatccaccctaagcttgggtatgttattattgcatatttattaattagagatgcatactactactccctccgttgtttataaccgatagtttggatagttccaaaatataagtattcgtggattgtttgggcgtttagcagagataagaaaaaagaactttgatatccttcattaaataagactttattaggttagattggtaattctatatattaaaaaataaaaagagaggtgattgattacacgggtataaagtaatacgaatagcacttaaattacttagatttcggtacaaatttcaattgttagaaccatttatattgtataaccgaccaagcaagcatattatattcaaaatagtggtactatagtacttcctctgttagtagaattacgtgaacaatgctataaagttttttttataatataaaacgttccatctccactctactcacatgaactacaataggcctagctaacaggtaccactggaccaagcagattgattggctcaacgaaattgccacgtgaatttttgtaccgtctggacgatgctttcaccaactttcactggccatctctctcactcaagagtcacggtcggcacatgctagaggccgagatcctggctaggagtctgtttcaggagttttttccaaacagtttaattaacttttcattcagattttgagaagctataattatagaattcagaaaattaattagaaaatataattaagttgagaaacttagtttctcagaagctgactaccaaccggctgtttcttaaaactttaaactacccaaacataccgtacgaccgaccaaggtttgaaatttcagtaatttcgaccccatcggcaaacacaaatctccccaaaagttccatttttttatcaaatatttctaaatctgttcaaattcagtcaaaatacgttacaaattcaaatcacttcggtctgaaaaatccagaaatcacgacatttccaaatttcggtaaccaccgaaatttcggtggggaccaaaattgaaaccttgagagtgacccggcctgacttgcgcacggggtaacatcgtcggatcgaacgacacgccaccacacaggatggataagctagcgtgcggcggcctcaaatatcatccgcgtcaacgtcgtcctcttcctcttcctcttcctctcggtgcctcaaatttcttccgcgactctcattagtcctcggatgccggccggtgtcgatcgatcggcaagctatagatagacagatgtggcacggtcgatcgacaagcaagcgggcgtcgctgtcgggctcgtgtcttttgtcacctggtaatattgtaccgatcgacgatcgagcttgctgccgaagtcgatgggcatttgaggggacgctctcttgtctccttgctctctctctctctcattccatgtacagggtaaacgatgaattggatggacactaatagttgccttatcgtacagcttccactgatgcagcttgatcctctgacctttctcctcacttaattaatgggtctgtctcctaaaataagtaataacaatttgtagagttaggtacagacattaaggaaatagttggaattaaatataggagaatatcgtgattttctattaaagaagacacggcaaaggaggtccccgttgttattgcatgctttatttaatatataaagaaaaatgtaattacaatagaaatattaaaaaacactgatccaatacatggctacatctttatctctctctctctctctgctagcttgaaaaggagtagaagatctccttttaagagacacctccaagacgacatggaaactggcttgctttcaaaaataaaaccatttctcactttccaaacttttcaagtcaccattaaaattttctcgataaagcatctttctcggtagcgaagatagacaccaaacattatattctccaaattgtctgatgttttccagaaaatcctaacaacggcccagcaaatcttgaaaaggggcactcaaaatttagatgcaacatggtctccacaattccatgtccacataaaacacacccgcggtcacaatcaggaggtgcatattttttatgatctagcatgtatcttttattcagtggatcctttaatgaaagccagccaaaagcttttatgttagacatacatttactcttcaagattcagcagcaaaaccatccacaacttatggatgtgcacaactcatgttctcactcgcaaaaaaggactagttcacagctacacatcttcaaagagaagattaattatgtacatgaacactacacgcattcagaagagaagaacaaagaaacatacaagagctcctggccgccgcgcacacgccgcggcgctgttcgtctccgccgtcgcgcggactgggcccggcgttcctcccttgagccgaggacgagtacgccgactccgacggtgacccggccgcctctcacccgtcggcggcagccgcctcccacccgctgccgacgccgtcgacggagaggggaaggggaggtggggaagagaggggaggtcgctgccgccgctcgccaccccaatactacataaacgatttttgtgtacgagacccttggtaggttgcaaacggaccataacttacagcatctggaaaaatcgagcggcattttcgcatatggctccttaagacgcctgtatggaaaaatttacatacgggcatcttaaggagccgtatgcgaaaatcgatttttccacaacaaaggtttctctttttaatctttgactaaaacttgtactagtgtttttccctcatactaacttcaaatgtgttgattctttcctaaatgtttctaaaatcatgctctattatgttattgtgttcctactgctattagtttggccaacttttcatgtgactttgttttatcaattaaaaatttgaatttcaaaaaatggcactttcaaataatattttgatgcagtaaatattttcagctgaaaaagtcatgaacataaaagttgtagaactcaattttttaaaaaaaagttgtagaactcatcaagatatacaacttttcttttagtcattttttcatccgataaagtgatagtaacattgttcacacaatttacatatctctcttacagtttataaaaccatatgagagatatgtgaaattcgtgaacaacattacttatctttttgttgatgaagaaatgataaaagtaaaagttatagatcttagtgagttatacaactttttcagttgaaatcatttagtttttgaaaattttgtttgaagttgtcatattttgatgtttaaattcaaactgttcaaacaaaatcatgtagaaaaatgattagaacaaaagttgtagatctttatgcgtttcacaaatttgttgttgacaatttttccagttgaaatcatttactaccataaaattatttgaatttcttatattttaaaatttaaattttatgtagttaaatcaaactcagatagagaaatgacgaaaataaaattggtagatctcaacaagttccacaactttgtttttgacaacgttttcacatgagtttatttagtatcacaaaattcgatttgaaattctcatattttcgcatgtggccccttaagaggtccgtatgcaaaaatagatttttgcatgcggacttcttaagtggttccatgcaaaaataccaccccttcacatatttttttcatctccctccactcttttttccctcccaccacgtcaatttttttcaacccatctcctctctctctcccctcacctctcctactattatttactttcctctctctctctttttctctccctttctctcctctcccctctctctctctcttctctcctctccctctcagagcgggcacaggcggcctggagtaggggtggtgatggcgtcggtgggcggtggatccggcagcgctgccctagggagcggctgcagctgcggcggcgacagcgagcggcggatccggcggagcggagtattttctcacgtgggtcactaaagaggcccgtatatgaaaataggtttattttcagatgcaggctttttaagaggcccacatgtgaaaattcatttgcatgttaaggttacagttcgcgcctgcaacctacagggtcttcgtcccgaaaaatcttttctatagtagtgtcctccctccattgtttatagcaaatagtttggatagttctaaaatataagcatttgtaatttgtttaactgtttagctgagataaggttaaggataaaagattttgatgtctttcattaaacaagagattgttagtacaaatttcaattgttagatgtattcatattttagaactgagagagtgtatgtttgaattatataatag

SEQ ID NO: 17166 - DNA, 12138 bp, Oryza sativa
tgtaaaataacttaaacaacataagtttatataaacataagtttatataaattgatgtaatttaaatttaaatagtatatacaatgatgactcaaatataaaagtaagatggtgtggccttatgagagaataaaagaaggaagataatttagactatacatataagggctaaaaaagttgagatgatatggcttaatgagagaagaaaaggatagagataatttgaaccacggattaatcgcataagcacaattcatctgatacgacttaacgagagaaaagaaaaatataatgacctaagtgaggatgaactatacataggtatatagtgtattataaaaaaatgatggagagatatattgaaatattatgtaaattatgtgggatgatttaacattattacattttaaatctttaaaatttaataaattattaaattatagataatatagcatgtttgcatgatacttaaatgtaatacttgttagtagatgatgatgtggtatttttacactttagaaattagtgtactttaactttatatatagtatatagtaagagaggattggttgttgtccacaccagtttaattggtgtggtaacctcgtgcaacaatgctaaactttatggcgtgacgacttcgtcgtgcatgcatgcatgtatttgtagacaatgtatatgtttactagatgaataccccattgtgttgctgcggagaattaagttgcataatatatacaaataaaatataatttgattatcaaaacgaaaacaatttgatataattttgagcctgaaaataaatgagattgcatgttttatgagagaagaaagaatagacaatttagaccatagatcttttatccaaaggctagaaataattgaggtggtgtggtttaataagagaagagagaaatatcatgaactacatttagtggggatgaactatataagtatatataagtatatatatatatatgattaccttggttattctaatttgcaaagaagaaccttgctttcacataattaacaacaatttgtcataatataattatttagataactttcaatatatgtactgtttttggtaaaaatatactgatatgtctttatatatagttgagttcgatataatgctgaatgttattggtgctcgtctatgttgacaccccgttcatgttgaataccacgttgattatattgcgtggatttttttttggtataggtgctcgtctatgttgacactccattcgtgttggcgtgacattagttaaataccatgttaattatattgcgtggattttttagagaagaatattttttacccgatcggatatatgcaatcttttaaattgggacttagcttctcaaacaatctaatctgaaattcgctcctataaagatgtgaagtcagtactactcaagtcactacaattaataggctatatgtccttttgctatattgcgtggatatgaggttccgttttgaaaatagaattttatatggtctgtcaataatatattattttagaaatgttgagaaaacaaagcgaaattcttcacaggctttttttgtcactgatcgatccagtagctgtcggtgggcggtggctacggctggtggccagttactatgatcctgattgaccatgagcaaatcgtgcaacacgcgtagggtaacgagagacgctagctccgcagcctcatcatcccccctctccatcgtgcgccacggatgtgtgctgctctgctcgggatcttcatctaccgtgtgcgggcgtagctaggtggtagtttcctgatatactcgaaactactcgctccgtttcacaatgtaaaattttctagcattacctacatatatatagatgttaataaatctaaacacatacacatatctaagattcattaacatctaaatggatacagacaatgctagaaagttttatagtgtgaaacggaggaagtaccaccgattttggcccaaggacccctacctcctaaattctgtctcaagagtaagcacaagaaatgaaaagaagccagcccaagaaagagaaagagaaaacatagcagaagccctaggctgatcggctgggacgcgaccctccactccttgcacgcccgtgagagagccgcaccaccactattctctggctctcgcctctctccactcctcacctcgccgcgccgccgttttcctgtatcgatttgcagagggtagaggagggcagacgggcgacgtggcataggcaaggaacttgctccccgcccagcgcccagctggcttccccctcatggtgccatggcgcccccaccggccccctgaggccctacttgatatctctctctaccaagtcctatcatcctatgctgtctggttgtttgttgttcgatcttggagcgtgcaatggaggaaaattttgatcttggaagagtgaaacaaaacaatgtagtttagctctgagtaatctgcgttcttgggttggtacaactggagaaggttcaaattttctcaacatatagaagatcatgtcttgattaattaccgatattcttcatcgctaacaggcctagtagtccggcctgattgagatataggatgtaatctcaatcgggcctaagggagagcccgacactgatgaatgtcatcggtgatgggctataggtatatacacctctattatgtctatataagtacatctacaacgatgttaatttaggcccgattgagatggcttcattttaacggcccatgttgcctaggcatatgagcggatttgtactagtggctcattttgcttcacttgttctgtgtggagatcagattctatcaacctaatcagctgtttgagagcaacagagctgagcgggagcaccatcagcatgaccgaaaaccagctactcaccttgattaggccaaacctggttcatctaatttgtcacattggaaaatatatggatcgtctgaaataaatgttactcatgtttctttatttgtaccatattctcaacgtattactacttgtatatatcattttaggtgtttgaaaattttgatgtgtaatatgaacttgtgaagtaggactacctatcgaaaaatttctaactacaccagccactctggctcattccggttctggcagcatgctaacctagctagcttagggcaccagcaatgtacaaggagagagagagagggggggggggacattggccatcacggacgggaatggagccaacgacgggggttgcggcagcatgtgcggtcatatgtggcagcatcgacggtgatcgttggttgatctcgcggcggcaacagtgatagcagttgcgaacgcgcgcacgggcgaattcgacggcggtcctggctggatctctggcggtgtcggcgacggtcgaggttggatgcagcgtcagcgatggtggtcgcgggcagatcccgcgacggtgcgaacgagcggatccagcggcggtcgtgggcagatcttcgacggtcgcgggtggatctccggttgcgaagatggcagtcgcagggggatttctagtgatatccatgcaggtgcacccatgctctctcactctcccacggcggactacttgctgcttctcctcccttacgggggcaaccaaaagatttggagagagacaaagttggagcagagaagattgaattttttattctttatgagtggtccttttgtataatgcttacttaagtaaagaatagctataaggatcatctccacatacaacgtataagtagatatcataagcataatgccctttccgattttcatattgtggatgccctaactattgagttcggtgtgcgtcgtcctcaggcgtacgtgcgtgccgctgtcgggctcgtgccgcgtcacccggtaatgtgtgacactgatgagttagccgccgaagacgtacgactcgatcgatcgacactgagcggacactctcttgtccccttgtctccttgttctctcctgcacgcggaaacaatgatgaattggatggactataatagtagccgtacaatgttttaattatagtactttgtctaatgcagcttgatacttcgtggtggtactatatatccgttttaaaatatggcaatacagtatcagatggaacatatctcactaatataaataatatggcaatacagtatcagatggaacatatctcactaatataaattttggacagaccctttgtacagattaataatactaggatgcatctcatccgatgctatattgctatattttggaccgatgtagttcaatcaaagcatgcatctaaactattttacgattagaaaaatatctgaattacccactgaactatcacgacattatgaattgtcctctaaatcccaaaatcagacttttaaaccccgaactatttataccagacaaaataacccccgcgaatcaatccgatgcagttttgtcctacattacgtacgtacgcgtggcaatccagttagcatttttctttttaaaaataagtggggtggagcagttagactctcacctctctctttactctcttccccgaccattaacgacattgacgacggcgccgtcgtcgccactccctcttcctttcttcctcgctatcgaccacggtaggtgacggcattagcaggggagaggtgcttgcctgtttccgccgtgtcggtgatatgggcccgggggtacctatgctgaggggaagggatcctttcccgtcagccacgtggccgcgtggcccaggccccacatcggggggttggacgcacggacggtgaatagcccaggagcgtccgcgctcccccagggggctcggggtatctcgccatatccctcggccccgaggggctgccttacctcgaggccctcgctcggcgccacgtggtgaccgcgagggggatcgagcaggcgggaacgcggggactgccaggcgcatttatgggcagcgccccaaccgcccaccggaagacgtgcgtcaagcagccttgaccggtctgcgaccggcgtgcgatcggtgacagacggatgtgacaggcggcagcgcacccacgccctaccctgtatcaggcgacgtgggggcaggtataccccgtcccatcgacagcaggggatcgacgtgcaggtcggtgcaccccacgcgcgtgaacccacgaagtctccaaaaatgtatgagggaatgataggggatgtcccccgtgtcaggcgaaggacttcgctagggaccacctgaggacgagcgcacacttcacttccggccaaaggattgggaagctgttcaacccagaccgatgtgggcccctctccaaggtagggaccgtagcggcggtgtatgtggtatctccttgaactataaatggaggaccttgcccagcgagcaaaggacgactcttaagaactctagctctaggaagagactagaaaaaccctagttgttttccctgagatttggattccttgtaacttctcgaagatcaacccatatataggagtagggtattacgcttcatagcaacccaaacctggataatctctcgtccccgtctggattaccatccactttgcgagcttagccccgagcgaatccgattcgctaagtagagatagcgctcctgatcatcacgcctaatcctctggccgaactcacaaagggggggtctcacgtcctcccgctagagatggtcactcctcgacagctggcgcgcaaggtaggggaaatcccgcgcgtttgtgaaggagccgtttttcttccgccccaagtttccttccatcctcaacgaccatggtcgaggtagtggaggaagaagtggtggtgtacactcccactccgtccggaagtgaggacggtagcgggagtcgtaatccccgccaccaccgccgggactctccgacccctcctcgcgaagccccagacggcggaaggaccccaaccggttaggaggttcggccctttccctgccggctgatgggggaagggcgcgccgcgccggggtacaccgccgcctcacctacgacgacggcggcacgccccaaggcgcgctccaggccgtggaggctctcctacggcaccctcccgtcgttctagagccgaagaccccggtccagcggtggctggatgatgtggccaacttggtcgtagccgcacagcggcagctggccactaacggctggcccttaactgctggtacctcacgtacctctactgccctctcctcatcggcgaggaggagggcttgtcggtcagccatgatctcacggcgatcgacaaccccgacgtcgtcgaggccctcgaaaagccgagggcgttacgatagtctttacggggaacaggacgcccgaatcaacatcaagcgtcacagggatgagcgccgcgctccctgcgcgggggaaggcgcctccttatcaggagtgtcgcgccaccccgcgcgaggcggccggccccccacgcccccgtccggtggggctgggtgcaaggcctttgtggcgagtctccgaaacgtccggtggcccccgaagttccgccccaacctcaccgaggagggaggaggagggaggcaaagtagacttcgtgggccgagggcgtgggccgagggagagaggacagcccgaaaggaaggaggaaaggagggagggggaaacaagccaaggagagagagggagggatttgggccggtaggggcccaaaggaaggaggggaaatttaattggtttttcatttaatttaattgattaattgaattttgtgactttaaaaatttacttcttgagctccgaaaattcacgggaaatttcagagaatatattagggcacagagaatattacaaaaatatttccggccatgatttttaaggaaatttttttaattcccttaataattcacttgattaaattactttaacttttatttaacttctagaaaatgtactattaattgatttgtaatgccgaacgaaaatcggggtgttataaggacttccctaaaaaggaaaacaactgcggcaccgttctaggaaaggaaaggaaacggtcccgcgaacaaaaacggacacggttgatcatgcaaaatgaaaccgcggactgagaaggcagtgaattgggcacaattcatgaccaaaggcaaaaggaagaattattattaatgtgatcttgacatttttaaacttagcaacattacctccggtgctctatgaattccgctttaagtccggttagtcatttttagagcaaatagaatttgaaaaaaaatttcctctggcaattccgattattaaatatattgttaattagggttttctcctggttaaccaaagtaatttctatagactatttattagtgaattggaacctaaggaaagggaaaactctgggtgtgacattaacctgggaactagcttcacatgagtatgtgtttagagcatttgcgatgttgtagaactctagcttattttttcatgtctcttgagatgtgtaacctggtcgccaccttcgtgtggtttgacggttgactagcacgttgagtcctagtagtcctagtaatatctcctatgctctgtacttgaggcttcgggtttcataacgtgttagctttttgatttgatagggcatcgatgaagttggatggttaccattttatttagattttatcgagaccccatccaactaaatatttcacgatgtcatttgaaataagcttacataatatttaactcggggtgttatctatatttttttaaaaaaaatataatcatttcgttgaacaaaatgaggggatgttcattcgggtgattaaaagagtttgccattgttccaagtgctatcagccatcagtatcaggaaactcaggtggtcacgtacgacacaagggtttagaatcaacattcttgccccatgcatcaccagtgaagttgcttctgccatgccaagaccagttgactgataccttagtaacaacctaagtctgtgtggcctttaatcagtttaagaagcaaaaccaatttcaggcaagctagcatctgtcttgtgatagctaggtatgctcggcaatttacatccttaagctgtaactgtggtggtcttcgttttgtagttaattaagatttaagaacatacatcatgtagccttcacatgaagatttaagttgctgatcgaatcctacaaggcacatagagttaatttccaaatcctttttcctggcactgaaccggaagagctgctcctagctagcctcctagggctcatggaaaaaaagcgtgaaatttgcagttttgcactcgaacgacgtaagcattcaccacgctctgcacattattcctggcatttttcgtttctttatctaaggagtgtatctgtactttgcagagagtagtaatccaagaggctgtctcgttttatgtttaccactgcgttaaattgcattcgtttgaaatgctaatatgctaattaattaaaaacaaaagaacaacaaaaatatatagcgaaaaggagccgtaaggatgatagtgccgtcacgaattattgacttaaaataatcacagttgttgtatcttcgccggaccggctgaaagccggccagaatgtattaagacgcgggagcttacaattcttgtaccgtacatgtcacctcggcagtaaatatattatacaattcttatttatttcttgatatatgaatgttccatgaaaaccgtaggatactctttatgataatgttatctttaccaatttagtaaattgtgaaatctgtgcgcatcaaatatacttagggctcctttaaatcataggattgaaaaaatgtaggaacaaaaaaaaactcaggaatagtataggaaatcataggtaaaactaatggttgaaaaacatgggaaaattataggaacgatcgtttgattgatacaaaggaaaaacataggaatgttaagtattaagttaatagccatcaaaatttgaatggttttatgagggtaaacattgtctttcaatagtgttttgcctcgatcctactcataggaaaagaaaaatgagctcaaggtggatgttaattttcctatggaattcccttaaaatcatggtcataggaaattttcccatgcatttcctatattcaattcctacaaatcaaagggatgaacagtaccaaatcccataggattattgatcctatgtttttcctccattttttcctatgaatcgatggaggccttaatgtgctgaggccgtgggcgggtagcgcgctggctttgcttgcctgaatagcattgcgacgacgagcatgtgggcatgggtgcgaagcatcggcggcgagcgtggcggcgcgcagggcgtatgatgatcagatgacgctcggcccatgacatcgcgctgggatgacacgcgcgcagcgtgtgacgggcgcgcatggagcgcagctgcgctgccgtgtcgcgctttgcattggcgcgacgccgacgaagcgacgagctgcggagacgcgcgcgcgcgcgggccggcaggacagcgcgccgcgcggcgcggctccttgggaagacgtcgcgcgaggaaccaatcacagagcaggaatcatatcacaagtaaaaaaattattttcgcagagaatccttttactgcacatatgctacggtccataaggaaatctgccattgcagtaagtcaggagggacctgcatcacgaaaccaccggtggaacttacttttagaggcggtagtcgtaatccagacacctttgaaatttgtctgttttcacagtgcactaagattgttactgatattaggaagggtgtaatcctaatttattgcgtacaaagctacaaaacacttacagatgtagtaataaaggacacaagattaatcacagtatttgtaatatcataagccatatcgaattgtcagaaaatgtgcctataggtatggattatcgccaaaagtttggcagtaatttatatgcttatacaagagtcatgtcttcttgtatgtagttcttgggatgaatgtgccatgaaagccatagggtactctttgtggcaatgttatcttagcaattggtccattttcaaatctctgagcatcaatgacatgtgcctgtaaagttaaagaatcacagtttaatcattaataatatatacccgctgatgggttataagttattcttttaattttcttatcaagctttccggtttgtgagttggtgtcgtcggttgtcaaatctgacacctatgaaggattgccaatcggcatttactaggggttttgtactggtgagtagggagtaaaaatgattatatatgggaataacatgcattgtaatgtaatgtcaagaatataaagaatgttgtaattaacatgctagttcgaatatcaaaagtaattttgaattttattttatctaattttctagacagaacagtcacgatagtttagcacatataatagaagaaagatgattctagagagctcgcctgtgaagtgtttatttcctcgtcatgtacaaaggaaattatccatccatcatcttcatttgctccattgacctttggaacaaaagttgctcccgagcaaaactgatttttaccaagatgatgatactccacatttattagatctccaccaaactatctcaagagttgcaaaccatgatgttataagatatttcaaaaaagaaagcagcaagacaaagacattgttttcttatatatatatatatatatactaccttgttgttatcttgaagatgtagttttgcgaaacctccaaattttggtcgcactacataaaacgaaagtaaagttagcacatgatgaatagttgaatatatccttcttggtcagtttttttaatatacccttagatatggtagatccgacatgatatgcaatatttaggttatgcggcagaaatgttattgtacattttcattatattttccttgttgaaattttttatcctaatcagcaaataaactgtttaacttaattttgtcagttcaacttagtgctgaatatatttaagacaaatgcaatctttgctgagaaaatacctgttccacagccaccttccaggctcccttggacatcaatcacttgtgcatatgcatacttgtgatgcaggccagcatatttgttattgatcactgggaattccagagcaacatctgtcccagttaagtatttacctgtgacagccctgcttttcatgtttaatctccactcatataagcgaggaaaagatttctcactgggtccttgataagcgggctcttcatagccgtgtgctcaagtgttatgccagtaattatggaacccggcactcgaaatcctctgatgaccacctaataataaaaaattaaacaacgccaaattatattttgaaagtgtttgcacatttactctacatggatttgatcttgaccaaatcattcaaacacttcagcaatttgattgtttcttcactgagtgtgacaaaaaggctcttgatttttaatgtgtattatgataaaaaaaaacataccacaaccacttgtttactgacaaaatggcctctatgatctaatcatccaattcaaataactgctaatctcttggagcatacattttagtgtagcagttcaattgtgcaacacagcttcatgtcgatagaaaaagcactatacaacaaccacttgatacgctacctcatgatcttcctcaaagcaattgatgagatgcaatgtgcaaaatggttctacatcgaaccatattactgaatctgcatctccatgacggggcatgactccaattcttgcataactttctgtttcaaaatcaatcaacctatagaatgttatataattaatatgttagaaacatggaagattgttgtctcaacaatagtatgtctaacataggtactcacggagctcctcttagaatcctagtaaggtccactgtaagaggcatatccatgataatattgtacctacatatggaagaacggattaatcatacttttgatgcaaatgtagttatcttattttgcatttccaaattgtttctacattgtattgtattggattatgttgtattatattgtattgtattgtattgtattgtattgtattgcattgtattgtattgtatttgcagccactg

SEQ ID NO: 17167 - DNA, 532 bp, Oryza sativa
cttcaccgtcggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgattggtgcctccgcctacacggctggcctattatgccgccgctgttgggcgtctacgacttcaccgccggcgtgcctccgtcgccgccgagtggtgcctccgcctacacggctggcctattatgccgccgctgttgggcgtctacgacttcaccgccggcctgcctccgtcgccgccgagtggtgcctccgcctacacggctgacctattatgccgccgctgttgggcgtctacgacttcaccgccggcctgcctacgtcgccgccgagcggtgccttcgcctacacggctggcctattatgccgccgctgttgggcgtctac

SEQ ID NO: 17168 - DNA, 1355 bp, Oryza sativa
aatcctttgtcttcgcatccatccacttttaggtctcgtgcgctacccccttttattattgccgaattcatgtttcgacaccctgacatctctggaatcttgagaattattctcagtgaagttagcgccgaaccttatggcaacactgaatcaggggacatacaacaactcattagaaaaatcactacttcccttaagaacaaaaggtatgcaaaattctaaccttcaatcatatattcttatctccaaaatatatggtgtgtgtattataaggccagaccttcaagattttaagcctttagttcattctttgccggtccaacttgctaagtagtccgtgttttcttttacttgcattcagctctcttatgtgcataccattctgcttttcagattttatttacaaatataggtttgaaccatagcaaaaggttgagcaaaaatcattcgaggacatagtcttgccaaacatgaaaactgctcactttcattatgattttttaataaagtatccataagggacacatttcacctaacaaaaatattgtttttgacaagagggaccagattcttggctgttgaatgaattatggtttagctgattcattagtggatggagtctgagaactacccgccttgttacatttctttaatcaaatatccatgtgctataagtgttacaaccatagctacaatcatgcaaaatcagtaacaatggggacacatttcacctaactgagacatgatttagagaagcgagaccagatttgtgttaatttaacaagtcagctttagttgaattattctaggacgacatgagaccgaaatgggaaaaatatcccctttctaacatttatttgatcaaatatttctactgatgcttataataaaaaaattggcaggtatcttattgtgattgatgacttatggaatatagaaagttggaaaattattagatgtgctttttcaagaagtattactggcagccgaatcatcacaaccacacgtataaatgaagtagctgaatcttgctgcttcccacatgtgcatcgggtatataaattaaggcctcttcattttgttgattcaaaaaggttgtttctgaagagaatttttggtctggaggaatgtccatcacacctgactgaagtttgttgtaacatattggcaaaatgtgatggtttacccttggcaactattgcaatatccagtttattggctacaaaagcaccgacagaagatcaatggaatcaagtggaaaagtcaattggttatgcattggaaagaaacgaggatgtcaatggaatgataaggatactgtcgcttagttactttgatcttcctcataacttgcg

SEQ ID NO: 17169 - DNA, 3459 bp, Oryza sativa
  unsure (1)..(3459): unsure at all n locations
cggcagaaagatacaagggtcatatgaaagcaatgatctcttccatatgtaagctaggcagagacaaccttcattgtctaacaattcatatttcatccgtatcagcagatgacttcatccaggaaccatggtgccctcctccattgagtcttcaagaacttgtcatcaatcaggcgccaatgtctagggttccaagatggattggctcacttgtcaacctccaacgattaggtttatatctgaaggaactctcgcaagaagatgtcagtacactgggaggactgccagccctgctctctctcattctctatgtggaagaagtaattacagaggagggaggaaggcttaggatcagcagcagttatggattcccatccttggaacgtatccgaatcggtggggaaagttgcaggcttgagttgacttttgaaattgggtgcttgccgaagctacaacaactgaacctcgaatgcatggtagcagaagaaaaccacaccagcagcagtaatgttgtgtttggcatagagcatctgtcccgcctcacaaccatatattgctgtattcattacaagtatgaaaccagactggccaaggtggctatgctggctgcattggagagatcaatcatcagccatcccaaccaacccacatttacaaaggaggaatatggtgattttgtagatgagtcctgttgaaggcaaaatttttaatgtggatcagttcaaaggcgtagctcttgctaaggataatcatgttacagcaaaatggaaagttggtaggtaatgtgattttttgcaatatggatgaggcaatacattatttgtttcactgcccttctttttctatggcggtccctttacattttttctaatttttctaccttcaatagtcaatactgtcagtaacatatttggaattcgatgcagaagctcaacagaaggctcaatcatgcatgttttaaacaggtacagaatgttctaatttatgttggtcagttaggctttattgtaataatgctgttcttatagaaaaggattgctattttgtcacagttattatacaagtatacaaattggctccatttgtggtctattatgcattgctgtgtaaggaagcccagcatttgtttgcaagtcgtggtctcgagccacatatttgaagtcgatcactgggaaactcttatcctaatctgggttgcacaaaagtccaataaaagattaccattgacgtaggcaacttcccctgtttatagatgttttctagttcttgctgaccaaatggttgctagctagaagctcttttcctgatttggatggctcaatagtccaataaaatattatcatttgcataggtaattcccttgtttacagatgttctagtactctttcttaccaaaggttcacgaggcttgtcgcggcccttggagatgctctctttaggttcactcacatggtatagggtctggaggattagtatctgatttattggtgtagagaactttgttcaggaggaggttatgacgatgatcaacaaagttataagagggctctggaggtatcccatgtgcccatatgcatcatccaagcaagcttcaggaccaattcttattctcaaacaaatcagtttttttttagcttcaaccacacattcttattactgggtagattcagtgagatcacgaatcaccaaaacatttacaaaatctgtgagggggtctacccaaagagtgacctgggtcccaactcacacctagctgggcaagattatgaacaacgctattacgagagcgatggggcaaacgagaccttggagctagcaaagtgaagttgcagaagcagttttatttccgttaagattgttgcaaaagcagtgttgacctgatagttccctcttgcattcactcacatcatctctcttgatgttttttcctcctctttttgtgcatgaatttaagcagggaactggctcctgcaatttcattgtttttatcattggactggtcaatctttctttgtttattcaccctgattgtgtttgctgaagcacttttggtggatatttctgaaaaatttcggataataattagtcaagactatcttttggtttcttgcctctgataaaacaatgggaagtttggtgatctggaaagtgttggtatgcacagtgtgtttaaaactacactaatatgtttttatcatctgtactttttacagctttccctaagaaggcagtaacagaattcaatggcgcctgttgagccaagcaacagaattgcagcaaatggatctccaccctggagctttaaaagcagccaatttgaccttttctttttgggttattataagaaattcagggtgcacacaaacacaatggacgtaaatagtcggtgctttatttatgatttatgtattgtatttaaaccctggcaagaattgctgtcaaagcctttcaatgctctatagtgcacgtgttctctgacctgtgaataaaaaaaactccaacgaataaataaaccaactcgagtattttcacggaaatctattatatccgcnnnnnnnnnnnnnnnnnnnnnnnnnnnnnnnnngttctttgctgaagttaattcgcaaatcaaattttcattgtgtaaaaattaaatcatgagaattatattgtgattgtggttgaaacgctcaagcttgctgtcatttttaaataattcaatctcttactgtcaattttaaatactaggagagctcaggttaggccatctactttcaacctattcaccggatgtggttcgaaacgctcaagcttgctgtcatttttaataattcaatttattgcccgcaattttcaattctagcggagcttaaagccatcccgggccaaatgggtgccgttggcgaggagccttgttcacgccgatcggctcgccatcgcttttggagccggagccatctagtgcgctccctagtagagggacgtgccttcctgtgctcctcggctccttttcatcgagccatggagctaggctctgtgttgggcgatgtcatgcctagcctcatactcatggacactgctcccgcaccagagatttcttcttctaccctcggccttgtcgctaggagtaggaacacggcggtgggaaggagtcagaggcggtgagatgatggaggagctgtcggcggtcctggtgaagatggatctgtgatacggccgaccagatctggcctcctgaccagccgctcgtcgtcgaccaccgcgtcctgcgccccgctcgatgtcgggcatcctgccctgcgtgttgcttgccgtgcggagggagagagaggcggcgacgggcggagggtgagggacaacgtgggagaggggatcctgttaccgacgtggtggatggcgacgagcggcgggagagagagagggagagcgaggcgacgagaaaagatgaggccacatggggtggctggctggcgggcg

SEQ ID NO: 17170 - DNA, 1234 bp, Oryza sativa
cccctccccttccttccctccccagatccgccggaggggaggggtgtcgacggcggtggagtatagtaaaaattaaagactatccttaatgataaaatattctaataattatttccttttctatattctcgtacaacaaagtttcattttataaacgttaagtgtcgatgtaaaggcgttatcaacataacaactatccatgtttctctttctttctcgcttttttttccctgtcagcaaacttacctcgtcaacaactctgtgtccactcttagttgccgttgtacatgcccttacggaagtatctcaggtaactcagacgatccaatgtctcagatccaatgtctcagatggattcaacgggcacgaaaatttagtccccgtgtttcacaaatccatctctaaatacattcactgtttcagcacaacagccgcctagctaagctactatatataataaatatccgactctcagcatggtactgaagggctcatcaattcttgcaactactctcaacttgttgcatgattgttggatcgttatggttttcttacaatgtttattttttaaacgaacaacacaggaccatgcgagtttcatatttatataggagtaaaatatatggccggttcttaaacttgagtgaagatgtcacttaagtccgtaaatttaaaaattatacattgcagtccacgatcttgttttattgaatcatatacaactggagaaaccatcttttgtgggttgcgcaaaaaccacaatagccctagttcatccaaaaaccgggactaaaaaccatttttagtcccggttggtcatctttagtccctgttcattcattgtcaggtcgtggtagataccctagtatttttagtcccggttagtgttaacaaccgtgactaaagatcagtactttactttagtcccggttatttataccaaccaggattaaagattaaaaaaagcacgcgcggaagggagaggagaaaaagcacgcatggaagggagagagacatttgcgcgcgggggagagaacaaaaaaaatctctatctctctttctccccctcaatcttattttcttctactagaactcatcattatcatcttatcctcttatcctcctcctcccctaggccctcccctctcctcccctcccctcttcgtcggctgcggccggcgggcggcgggatgcgggatgcggcaggatgaggtgggtagcgggtcgcgggatg

SEQ ID NO: 17171 - DNA, 13355 bp, Oryza sativa
  unsure (1)..(13355): unsure at all n locations
ctgaatctgaatgtgttgctgctgctagttgttgttcccatattctttggctttaatctactttgaaagattatggtcttacttttgagaaagtacctctcttttgtgataatactagtactataaatattgctaagaattatgttcaacattcacgcacaaagcacattgatattcgtattcactttttgagggatcatgttgacaagggagatgttgaattctagtttttggacacaaagttgcaacttgctgatattttcactaaacctttggattctaatcgttttgcttttcttcgtggtgaattgggaataattcatccttttggcatgatttgagtgggagttttgtatcacatggttttatcaagcaacaatatgacaatgagaaaaattgagaaaagagagctttgatctatacatatggtattttcttgtgcatgctagcaatactttgaaggtttatttgtctctagcatagcttgtatgtattctagtctttttatgagacttagattttgtttttaagggagatgatgcatgacactttaattctatacttgaattaagctaatatgcaatgttgatgctagcatatggtttgatctataaatgctctacttatatgctttattgaattaattgctcgttgtgcaaagagaataaaaaatatgaaaaaaatgaataccgaatccttggaaacagtcttgacgataaggacgtattcgatgtgagcaaaataatgggtaccaaatccctggaaacagtcttgacgacagggacgtaccccgaataaaagagaaaaatatgggcaaaaaggctcaagaaaaagaaaacgttaaaaaaattctcttggttgttttgtgcaaaagctcatctgagaaagtgtgattaatgcaattggtatatgtgtttagtgtttatttttcaacctatgtgcttgttaagatgttgcattataaatcatatgaaatcatgaattttgatagttgattcaagcttaattgtaaaatctttggttcatggttaatgcatgcttgttatattatagatgggttcatcttctctttattgcaacacatgacttgatatgctatatgtatgctaagctcttaaacattaatgaacataattcctatgcttgatgaaatcattgtcaaaagggggagaagcaaggtgaaaatttttggagaagcaaatgagttgagaagagcatgttgtttttggttcgattagaaatttctttcttttcaaaagtgagggaagttttcttttggatttttgagcacgatgtgtacgtttgtatgaagtgtgctttttaccacttttgtttttatttttccaaacaccaaaacatttttgataagtttgccaatgtgtttatcaagggggagattgtaaaatcaaaagtgtttttgattattattctgtgatgaacaattggtattggagattattggttttgtgatttggaatttatttgcgaagtggttttggagatgattctatttcataggtgatctacaggtactgctggatttgggtccggtcaaaccgggcatgggttgccggtcagaccggcgtgtatcacgcggtcagaccggcgcagcccatggtctgaccggccgacgctgtgtcggtttcggtttcgggttgtttatttagatatctgtgattttttcattgttatgacttctagatggatactatgcgtatgtaatactgccgtttgctactaatgagtcatgttggggatagcttggtctcggaatatggtttggtttctttgtttgttctatgtgtaggtgactcgagatgctgggagagtatttgcggtgatggaccgggagtcggcttggggataagacgacgtccgtggtggtcagagatcatgcgggatactaaggttagagttcaatgcacatggttggtgaagattccatatggcatacgatggaggtattgtgtgcgtatgggatgcggagtcgaatttggaaggagtccaaatttggtatgattggttatgtaaagtttgtttcttgtactagagggtttcctagggtgattaggacttctagcatgagtttggttcgtggctttaggctgcctacctcgggtataaatagagggggagcgtgaggcttcccggtatcgcttttgagagcaattgagttgatagttgagttagggtttcgagtttagtcgaaatttttgtaatgagtgctattggtgcactttgtaaacacagagagaatcaataaaattgtcatccactttaagagttcttcgatttatgtttcaccgggtttcggtggtctaaccagtggcgcaccggcggtcagaccggcggcatcatggcggtaagaccggcgggcacaaggcggtcacaccgggcggcagcgacagggagcggcagacgatctcagcggttcgaccggagttcgatctcggtcagaccggcgtgttccaggcggttagaccggtggaactacttcggtcagaccgcgatccgtcgaatttgagggtaacttttatttccactaaaagttttggtttttaggcatatcaaccattcacccccttctggttggcttagttgttgtgattcgatcctacattatatgtcacatcctgatttttgtttcaggatttataaattatttaataaattattattagaatttatattaaatgttcattaatttacaagtgaaattaaatgtgggagataaaatttcctaaagcatggatggatttaatttttattaaattctccatggttaattatactctctggaatattctcggatttttcggagctcaattcctaatttttaatcatacaaagagcatttcagtaattacccacatattaaattaaccattaaatggtctaattataattttgttaagtactttgagtgtcccagtattttcaggatttttcttgaaattatttgagcattggaagtatttttaacaattcaaagatcatttaagtgattattttaattggaaaagtaataaaattctcctcccttgtcttaggctgaatcggcccattcctttccttcctctctcttccgccggcccaacccgagcctgcatcctctcttcttctctcagccaaagtccggttttgctccctcttctaatcaggctgagaaaagaaaagcccggcaagaagtctactttccttccctgcactactgttcatcttccaactcaggcagagcccgagccagccgtgccgtgcacagtgccgccgcctcctccttccaaatctcgcctccccgttgctcctttttccaatttagttgaggggaaatattcctcttatcctcctctatctttaccccaaaaatcggagctaatcgttgagtatcttatccgaatcgaactcgttttcgagtttatctccaaaaccgagtttttgatttcccggatcgatttcttgcgggaggagtccgatctcttcaatccaaggctataaataggaccccctagtcctcctctttcgtttgccccactcccgtggtctcccgtgccccgtagcctctccgccgccgccgccaagttcgccgccgccgccggccgaacttcggccgtgtcgcgccgtcgcctccgccgttgccgccggtcgccgtcaccgccgtaaggtgcgccgaggtgtgggcaagctcggccgctccctcctcgctgtcgccggtcaccggagccccgtcgccgccgtcgaccgaagccgcgccgccgctagacctcgtcgccggccgtcgttgttcgtcgtttggttcgagggtgagtaccgttgggttcgtctcgtcgtcctctacgtgtacatgtcctccaaagtcgcatccgaccatccaatctccggcgaggtcgccatcttggtccggccattgatgaggtcatcatgacgtcatcatcgtttttctttttcctgtttttctaatagattaaatcttcggaaattcataactaaatcatcgtaactcggttttgagtggttcaagttgctaaattcatctaaaatcaaaatcatgatctacatgtttgtttactttatatgtactgtttatgcttgttttttactgtttatttggtttttattagtctttttcttggttttgcgtgttagcctgtcgtttccgtcgttgcgaaggttcgtgagtgcgccggaagtattcaagaagattaattgaagaccgattattgcaaggcaagtcacacagatcctaaacacaatcctttgagcatgttgatcctatatttaaattctctatttatttcaactgtgcatttattttcgaatgtcactgggtggtgtgaatctattcctttgttatggcctgtttgcattgattactctattccttgataccttgggatattataatttgactagttgagctttatatatattggttcaactagatgttagatataattgcttagccatgcttagaaacattagctcactaatgggatgaatcatatatactacattattatttatggttatatttaatggtagctcacgatggttaatcgtgttatgataattaattggtaattaaaatatgattaatggtgggttgtaagcacatggttttgaaggtcgtgctcatggcaatgaaggaccggttcgcgagctactgttgtgaaacattaaccgtgccaaccacaagccagcgtgggcaacggctttaccttttgtatagcatagttcattgcggagcaccagactgagaagtggcggagataagcccacgggggtcgctggggagtccatgccctgttttataagggggtaattatgatccaggaatggtgcactgtggtgagttgtgttgtgcagagggtattgttacagcctctattcgggtactttccagtatcgcgacgcatggtagacatgatgttgaggctgtgtcttgtgggtacagtggtacacctctggccagagtaaaactattcgaatagccgtacccgcggttatgggcgggttgagcaatgtttttcgtgattagtctcacacctctcacaattattatggatgttatacctggtaataatttgcttagctcctggtttggagttagatctgtacagccgggtatggttgttcaggatggttgggcctgtgtagcatgggtgtgttgttcagtgttgattaaaatttctgattaattactccactgttttacttctcttaaatgttttgctaaatgctgcttttgcaaatgagcctatattatgccatcctttggtatccttgtgcacttgcatatttgctgtgtagcttgttgagtatgtcatatgctcattcttgcaataatcaatcaacctcagttgaagaaaaaggatccagaaggagaagacgtttggcttatactcattcttgcaataatcaatcaacctcagttgaagaaaaaggatccagaaggagaagacgtttgacttataccccagttgagctgcctgtgggagtggagctgaagctatcgctagaccgttattccgctgctgttttcttttcttttgtaagtgtgtaacgttattattatgatggatttgtatattaaattgtcagtttgtatacctcggctgatttctggacgaggattttatgcactaataagttcggaaattactagtgaatttccgggcgtgacattatataagcgtacgtgtgccctggtcgtcgccatacgtacgtaggcgccgcctccctgcgcgttgtcttatatacaatcattccatagatcgtcaaatttggttgctgaagggtgaactaatgccagattctacaccaaaaacactactgtggcttccaagatcgaagtcaacattactgtgtggctgctttgattaactcgatcatgagtcaatggaccatgcatgttcgcattgcaaaatcacactgtatatccgatcgaactatatatatatctgacatacacaaagcttagttaatggactcatgaaatttcaaccattaatatttttcaaatacttctcaaaaaaaaaaactttcaaatactgttttaaaatgaaagaatgcatgcataaaatttatctaataaatacatgtgataatatcatagaccgcgtggtcaaatttataagtcctaaaaataccatacaattgattactggggcaaagctgtcttaaatacggcacatgcgcccatgcatggatgcctcatgcctcgacggtagtacttagctactaggttactataaaagtgagcgtctcttgccgaattcctctgacaaatagagtggatgaaacaatagttgtagctgtcacacaaattagatagcaaggaagcgcacaacgtacgtacgatcaatatggtggccgcagcatctccatccatgtatggcggcactctccaaccatggttgtgcagaaggagcagcactactggaacaccaagaccatcaatcacaaggcctaatgcgactgatcatttcaccaaatgtatcacatccaatgtaagaacgacctcccctcctctaatgttgatcctattttaattgcgttgtcgatatatatacttgcagccacatttcaaggagtttcagcagcagcttaccaccaaacttggggaggcatctgcggcagtaaccatggcttccagtctattgctggatgcgtttgtggactccaccttcacattcagtcaccaatctttgcgtcccaccgaggtacatatatatgtgtgtataattattataagtatacgttctttctcctactctctttcaggggcttgaatttgtcttctttgcccagttcgctctgataatcgtagaaattaggtgaatcccgggtattgctacgggaatttactataataacaatgagtcaaaataatgcgtaagatgactagatagtataaacttacataagttgatggggtttatgatattttaaatttaaataatactccctctgtcccaaaatataaacatttttagaatagtgccaagtcaaactttttaaatattgactattaatagcaaaaaaactaaaaagattaatcatataaatttgatgttactatatttatcattaaatgaactatcataatatgcaactctttttatttaaaacattttacttccatagatattgttaatcaaagtagtatctcggagaccgtgtcgagacccaaaaatgtttatattttgggacggaaggagtatacagaatgatgatttaaatgtaaaagtaaagtgatgtggctttatgagagaaaaaaatgagggagatagtttggactgtagattaatcaactaaggctaaaaacaactgaggtgatattacttaatgagagaagagagaaataacattaattaactaagtaaggatgaactatataggtatatatgatattacaaaaatgatgaagagatatattaaaatattatgtgaaatatatgggatgatgctttaacatgcttgcattttaaaactctaaaataaaattaatgatagaattatagataatatagcatgcttgcatgatgtttaaatataataattgttagtggatgatgatgttgtatcttgttattgcatgatgatgtgccatctttacatgttaagtttttaaatttagtgggttataactttatagtaagattattgtataatgttgtgatatctttgtatgttaagatttaggatttagtgggttataattttatggtaagataggattccctaatgcattgcagcagtcacgacatatgaagtggcataggtcagcgcatatgttcgaaattgtttgtttgttgaaccggtttgctacataaggattatttgagggatctgtgaaaaaaaacgaagacaatgaaagtcaggaaatgaaatgtgactaaataatctatgtagagaacaatctccggacttacgttattgttgtttgttgtgcatctcctgttgaccctaagcatcttgcacacttaatatccacataggttagtgcctagggttgcttgaaacacaacaaacatgataataacaccagtcagtttaaaaatagtaatgattacaacaatttgtgtgcatggcacacgccattacataccggccagtccgtcttcacatgaagctttttcctctgcacatcctttactggcctgtgatgtttgacataaaatttacgtgctctgtgccgataaaacatttatttgtgttactttcaaatttcggaacggcaattaggtactgaggtggtatgttactacgttgaaattcgaaatagtgaggaactccatataggctttcttggatagtgtgccagatcaagcgcgacgaccaagtggtccctcggatataccgggaataaaatatagtggtcctgcaaacaagatagatgaattagagatgacatttgctagttatcttgtattacaagaaaaaaaataatcaaatggaagagatgctgcttatataagagcgtaagggaccattatgatgtttttgtctcagtgcatgagaattgcggttcccaagtagcaagctacttcaatcttcttccttgtgcaatttcttgatatatgcttgtgttcctccggtgtcttatctgttagttccgggctattagcaagaagctgtacagtttgttgtgtggcctgcaaatccttgttggctcgatatagccaacgagttgcctcgctctttctgtgtcgtagaactgtgacctatggaatgcagcttgattgaaaaggaagtttctttcacacatttcacttacaacaaactagtgtaaaaacacttacacgcaaaatgcaacaacgagattgatgtccatcttatcgagcttgaagagggcgtgtaggtcccggaaattgatgataaagatctcattggttttactcatgaaatcgtctcgtgggaccttgacactaatgaagcttagggcctttctagataccttgaggtaccattcatgcatcaccctcatctgtcgtggtagattattcataatgtaccatggtaagaatgacttgtcatatttatattcttggggcacatctacagatagccaagattgcaactcatccttggcccatactactgacttctaggaattttacagctcagcaacatcttctttcttcttctttgcccaacctctcccactgaagattgaaaacaggaacctctctttatctcttgacatttccttgtggtcgtacatggaaaccaattttcgtatgagcctgcgatgttcaagggtagtagaaatggggccagattgatttacttggtgaggtgggacttgttgggcgagagcaaattgtggtgtaggaggagattaattggtgaatgggagatggttgttcggtaggtggcgaagggggagggcaagggacttgagcagaaggtgtaggtggagaacgtgaatgatgtggtgacgttaccggaggaatcgaaactggtagggatggtggatggtgtggtgaccttactagaggcaaggaagcttgtggggaaggtgatcctagcggggaggtcggtgcaagagcggcaactgtcattggttgggatggagctagggcagatggtggttgtccggcaaggatgatgtctcgatgatgccacaagacaaactggttcattgcatctcccaaaagttcgatcccctctggtttagggatgtctagctcgaacgtgacatgttcagcgtggaccttagctacctgcacccttgcatggtcgtctagaatgggggtgttgtggaattgtcgtataatcacagtatctggattatcccatgctgcccatcaatcgcccccacgagagtggtttttgcatgcgggagcacttatgggctgcctacaacctattgtgggttttgtatagaaaaaaaatcaaatctgcagtagtggtaccgccaatgaaaatcgattatcgccggctgtcacttaaggggtctacttataaatatagggctatttttacaagcatgtttgttatattcccatcgatggaaaccaattttcgctgatggctgctgaagagcaccgcctgaaaaaagaaatcataatattaaattgttttgaaccttttttttttaatttagaggtatagtagaggggagaacacttcagattccaattaattttcatcacatgcttttgaactccctgtttcttagaaaaccacccatcaactaaaaaaatagatattttacagctttccattaccataaccggatgaaatagaatacaacctgattttaatggtaatattcatgatttgaaatccaaatagtacgataaaaaaaccaagttagacagataggtagaaagtggtttaatataagtcaaaaaatatatattttgttgtgaaaatcatgaaaaccgctactaaaactgggtgtataatatcattacatttatggttgaattttgacttgttttaatagttgaaggcctaggggttataaaatatctgattttgtagttaatggatgtttcttatattattagacaaatccaatagttaaggggtgtagtttggactatcggaaaaatggctgaattgcaagtgctaatttatatgatggatctatccatgagcagagcaatttcgcaccagttgatgaaatcggtggaagaacagagatatggaggatagaagggacgatctcagatgattttcctgagggtgtttatatcagaaatggtaattttctttcaatctttcattagcaactagcaagctagcgaaaactattgtagtttaagcccttaactcttgacttttgtgctacgtcagttatgtgctcagatgctagttcacagtattacttttcacaatgctattattaggttcgcaaagtttgatcttaatttgctctagttctgaatagattaaaactcaaccaatataatgcaggttccaaccctctctttggagccttgcacaaggtgaactcaatcttcggccagtctgaagacatctgggtcgagggagaaggcatgctgcatgccctctactttcaccaagagcagagaagaaacacttggtcagtctcatacaacaaccgctacgtgcaatctgacacttttaatactgaaagggatcgtcagagaccatgcttcctctcagcaatcaagggtgaccctcttgccataatcgcagccagcattttgaacatggtttgtaaataacttgcaccctctgtttttgtcggcaaggaactttttactactcttgtctctatcaaaatataattattactttaagtagctagaatgaatatagagtttacaataaagagaaactccctctatttgaaaatattatgtgtaacagccttttacacggtctccagccttattcttattcttcaactactaattttgtttataatatattattaatagtaacaaaattaacatcggatgaaaatacattcaaatacaaatctaatggcactatatgcatgacacaatacagatatattaattgttagctcaataattagtcaaaattttaattgttgactttatggaaaacaagaatatcccatattttagaacggaggaagtaatacatattagtttgctacacggtatacaatattatagttttaccattggcttctttcataatatattacaaacaagtatggacggagttgacatcataagaaaaatattttcaaatgttgatttctgttttgaaaatagggatgccacagggagtatgagttaaaacttccatgcttctcatacttcttatagatagctgaagtgacatggttagtgagattcttctgataaatgcaggagagaggccatgtaatatccatgtccaaacattgaacatattcaacaaactcatggtgcaagacttcaattttgcaggaagattgaaaaaattacaggtcttataaaaacaaacacggagtattttttatgttgacaaacatttgcaacttcacaatttcaattttgtcctctttgattttcgcccttgatccactaccacacatctctagtgaaccatagtaccctctgggtcataaagatttgataatagcattttcttctgttctagtgtcatatgctaaggcaccgtagttacgtagtgttcaagtgacactgatcattaattgcatatcttgctgtagctgaggtttggcaaggtgtttagaaacatgagtaataccggtgtgtttgagcacgccgagagggttttctcagtggcagagaatgacattccctacgagattgacttggacaatcttggcacactgtgtagctgggtcgtcgatggtcagtggaacatgccattcacagcacaccccaaggttggtccctctgcatatgcctctctgcctcttaaacatgtgaatctgaatacatgaagattatgtatcagtttgttttattcttggttaattgttccatattcaccagcattttctacagaagacttgccttctactatctcttttcagttttgttttgcgttgcttttggctataagtctcaacatctgtttgtcttccattttgatgaaatttacaagcacattactatcttaagagcaggagagaaagaaatttgaaaaaaaaggtagagagataatttaagcttatcaactagtggaaaaaaggtcaatagtgcagcacttgttttttcttgaaaagtgccattcacagattgacctaccttgacaaacatggtaaagaactggcttatagttttgtcaccttttaccattttattaatgctaaattcagcagttcttggagcatttaatatgttaggccaacatctagcataaaatgtatgcttgtgctaagaatatgagtgaccatgggaaacgttgggatgcttaattataattatttgatttgtacattaattctatttcatgttaccttattgcatccaatttttctatgggcgcaggtagccccagggtcagaagagttagtcatatatgggtttaacattgtgaagcccttcctaactattgnagttgtctcaggtttggtagctctgtaatctcaattctttttctgcatatccttttaccaaaaaaaagtactaagtacatttgatcacgccaaacacattctgtagaggatggaaagaaacttgaacggaaggttgatctcaagctagaaagatgtacatattgccatgaaattggggtcactaaaatgtaagttcaatgccactaccaactgtttttcaaacaaaaaaacatgttttcttgttttatctatatcaaaatttggcactagttctatattacaatagttcaccaaacatataaaaaagcatattgaccatcatataccatgatgt

SEQ ID NO: 17172 - DNA, 13871 bp, Oryza sativa
atgacgcatataacatgctcccgagtaataaatcttccgggtaatatagaccaagcgtagctcatatgaatagcttctgatctgagtggttatcccttatgggatactccaaaatagatgtaacaattgaatcccgactggcgcaagtattcagttgataacccttacggggaataataaatagtccagtctttgagcatataaaatagacccatgatcatgaattcatgttgcatgtatccggagcaagtccaaattgaagatataatacttgtatttgagctagtaagcccctgagcacgtagtcacaattgttcattgatggtagctgacgcagttggcatagagacaagacaaccaatatagagagaatattgcccaccagaggtggcaaaaatattggtggtagtgaagatagtgataccaatcaaaagtactgaagtcgcatagccatggaggcgaagaaaccagtcggcggcagtcaggtcagccagcaatgaatatgaaggcgctcagcgataaagttgtgtagttgacgacaacaaacgcaaccgacatgatgaagatgacgatgtcggtgatccagccaatagcagtgtagcaaccaatgaaaatgacaaagacgctcatcagcatttgcatagtaggtcaaccgtgaaggtgaaataataagtcggcgaaaacataatcatccattagcaacagcagagatgtcagggtcgatgaagcagaggtgctggtgatgatgtcagtgacaataatccatcaaattaatgttatagctgttgtagatgcttcacttggaggagagttgatgttgttgtccaactcgtctaaaccgaaatatttgaagttgttgaagtagaatgtctgctccgaagcaaagatgaagataatgactcctggagttgactcgtgggttgatgaattgatttcttcagcttgacataaaatttgtcaaattttgagccttgtatttgtgtagcccccgactctttgattagttgggaaacaactgaacatagagtcgagaactgtagcctcttgtcgtcgaatagttattgcttgattgaagatatgtgttgaagatgttcaagtagaaatcctgaatattggagagcctcttgttgtagtaaaataacatggcatcgcatgccgagatgtcgaggctcacaaagacgtcgtggttggtgaagtagcaaaacttgcgaagtagcatcaatagagtttgccagtgccgaagataataaagatgaagtcgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagttgtataaaccagatgtagaagcgagggcactagtcagcagcagacgagacgaccggcgatgaagatggtaaggccaatcaacactggcagaatcatgcagccatggaagtgaagaaaacagtcggcagccatggcaaatgtaggcagcttgtgttgaagatactgatgcctattagtagtgacagcgatgtagccagccgtgaagaagatagcatcagttggcgttataacaggccagccgtgcaagcggtgacaccagtcagcggcggatgcggcggccggtcggtgaagacgtagacgcctaacaacggcagcataataggccagccgtgcaggcggaaacaccagtcggcggcggtcgaggcggccggtcggtgaagacgtagacgcccaacaacggcggcattaaaggccagccgtgcaggcggaaacaccagtcggcggcggcgaaggcaagccggtcggtgaagtcgtagacgcccaacaacggcggcataataagtcagccgtgcaggcggaagcaccagtcggcggcggcgaaggcaagccggtcggtgaagtcgtagacgcccaacaacggcggcataataagtcagccgtgcaggcggaagcaccagtcggcggcagacgaggcggccggttggtgatgttctgactgatccattcctggagcgtaagagataagcttaaaaccatgaatcccttttatgcatatctggatctggatcctgcagaacaaacatataggatgagtagtatctgatataaatataatactcgagaaaaaatcaagtattttaaaatatttataaatatgtatttctcctcttgtcaattttgatttccccgagcagatgactctgtacgtttaaacactctgtccgactagtcataaccatcaagcaccgggagtcggcctaggcacttcccaaacatgcatatgagtgacatgagttcgtcattaatggaataaagtttcacggatcagaatttactactcgggtacttttgcaattattaagagcagaaaataaatttatctcatctctatgcttttgatttattccgaataatatttagcaccttgcgttactcggtccatccaacgagcccccgggtgctaggaatcggcccaaaggcaaccatccattggcaaaccaaacggaaagcagaggaagatagaactccataactcgataggtacttttgtactcagattatgtcgcaagcaatgaagataaatattataaaaaatatgatataacatctgtagcccccgactcactactcaatggaagaccaattggtgtagtgaggcagagaaaaaggaaaaatatcatataaagaataaaataaatgatgacttagctttgtaatattccccttggtgatggtagaagtggccaatgtgggaacaaagtcgtccatcaataacaatgaagacaccagtcggcggcgacgatggcggtcgattgtgaaagcgaagacgcccaacagcggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcacgccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccgacggtgaagtcgtagacgcctaacagcggcggcataataggccagccgtgtaggcggaggcaccactcggcggcgacggaggcaggccggcggtgaagtcgcagacgcccaacagcggcggcataataggccagccgtgtaggcggaggcaccactcggcggcgacggaggcaggccggcggtgaagtcgtggatgcctatgaacggtggtgcgaccatccaaccgtataggcgagaacaccagtcggcggcaacgaaggctagccgatcggtgaagacgtggacgcccatgaacggtggtgtgaccaaccaaccgtttaggcgaggacaccagttggcggcgacggaggtaggccgacagtgaagtcgtagatgcccaacaacgacggcataataggccagccgtgcaggcggaaacaccaatcggcaacagcagtgccacagcattacatgtaaacaacaggaaataccaagagattaatctgatatttagagatcaatctaataaacaacaataagttgaaaaggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattctcatggaaacaaataaaataaatctgattaatatcagcaaattaaatgtataaatctcagcgattgaatgcatgtatggctggattaattaatccatgcatggcggttgaatcgacacatcctgtacatctccagcgatctcgttatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagattgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaatctcgacgcacccctacctggcgcgccaactgtcgaaacatgaattcggcaataataaaagggggtagcgcacgagacctaaaagtggatggatgcgaagacaaaggatttagacaggttcaggccctctcaatgagaggtaataccctactcctgtttggggatttgaatccgccgagtgtgtattgatctgacgatcaggttgtctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccgagtcatgatctattacatatcccatagatataagttatcccctatgactagtcggataaccatgccgtatgggtatggggtacccataatatccacacagggtttcttgacacagacacaaaagcagaacaatcgaattgctccctcagctcctcaaagatgaggtttgcgatcgttgtcttccctaatcccccaattccaacaatggagatggtccttagatgctcggatgccacatgcccatcatctttcatcaacagatcgatgagctccttcttcggctgatcaaccccaactagagatgacacatcctgaaagatggtaagagctctttggtctacggtcgcattagctgtcctcatcaaactgatcccaccattcatatatcgcgcattcctctcccccacttctttgatttgtgccttgaactcagcaatcatcttggcaatccgacgccgggccatggtcttggtcagcaaattcctgcatttgacgatgaacccatccggattagcggatccgtcgacgacatggagcatgaactcgtcgaggctgtcctcgatgtcgtaggagagctcccgcacctccctcgtccaggccttgtcctgagggtcagcgttcccctcctccgaatccgacatcctgaggaggaacgcgtgcatggcggcgaactcgtcggcgaggaaactgatctggccgcgcaccccttcgaattcgccggccatggcggcgagcttcaccaggacggacttgagtgccccggtggccgcggtcaccagaaacccctccatatgctcctcgaccgtacgcaaagaaagatcctgcgaaacagaagcagaagcagatctagatcagcaggtggggaatcaacacgaaccgcaaaagacggcgggggcgaatgttgattgatggccggagctcaccgccgtgatcctggggaagctcggcggcgagctggaagagttccacgcagcagcagcagagactgatcagtggtcagtggagtggtggtcaactggtcatagacgaagaggacgagaacatgtttgactcgcagcagacggagcaggtggagaagtcgataggccgggcccacagcgagccagcgagttggttgctttgctctctccatttccaaattttactcatcgttttttattttttatttttattttctagcagtgcagaccatgggtttgagatgaaatgaatatactgtgagtagagccctataagggctaattgagtttacgattttctgttagcacgtttttcaaatactatttctgtctcattttaagtatagttatagtttttatgtccaacgtttgatcgtttatcttatgtgaaaaaattataaaaacaattagtcacacataaagtatcatctaataacaacaaaaatactaatcgtaatttttttttcaaaataaaacggacggtcaaacgttaaacataaatacaaaactacagtctatctaggaaagctaaaaacaaagagtatgagttaggaaagctaagtgccaaaatcagccttattgcacctgctctaatacacttgttgatttcggcaatcaaaatgtctttatttgtgggcgagcatacataacaacttcatgctcctctttaagtggacatttcaaaaagcttttgactctataaagtggaactacatcaacatagttttccacaaagatatgatgactgggttgtggggttgttgacaactttcggttttaagatcccgcaaaatagcatccccgcaaatgtgatacatcatgccatggacctatttcaaggagacccactttctatcatcacagcaatagacctatagcaacgactgctatatatccaaagcaacggaccttgggctgattagtaatccttgaggaaggtcggtgcgtttccgaatcttaatatatgcatatgactggcggtcttcatcgacctaaaaacaagaagatgtccaggcattgcaaaactttgggcaggcaactgggttgtgcgccaacatacaaaagtcacaggttgccctattagatgcagtgacatcggcctcgatgagatcctagaaaacatcctagtgaccagacctttgttcccaatgaaatacctcggtctaccattgtccattggaagactgcagaaaatagaccatcaagctttgttccacaagtcaatagggcggatggcgggatggcaaggcaagaacttcggaatggctggctatcacaacccgccctggcaccacctaatagtgacaccaaagagggtgcgccataggaaattggcgtgaactgaattccatggaaccgcattgccaataccagtttcagtacacaattattggtactcgtggtcaaccaagatatgcatcattgcaacttaggataacataaatagataattccaaattgccttaatcgagttttatctctaattggcaatgacggatattccaatctgggcccatatcgaacccaagtcaggccgtatcggccacttgccatatcggcttagtcaaactccgactctgtttctagctgatacgatgcctagacgatgcgcagtccgactccaaatccaactcaattccgcacaaaatccacttcaatcttgttccttcttttccaattctgatgcaaaattccgttgttaacagatggttaatttaaaaccgatacctttcaaaaccgagccgagtcaagtggtggactacaaagtgcacgatgcaataggtcatcgagattctttttctcctcatcctctccgcgatcccctctctctccccctatctcttcttcttcttctcctcctcttacccctctctctctatccactctatctctctggtgatggaggtcggggagtgttgcaggggcggcgtgcttcccacggggaggtggcggcaagcggtggcgccctctcctctgccagatccagcgggaggggaggcggcagcagggtcgccacaggaaggcagcgctgtcgacggtgggtacccgtagaccagatatagagggtattggggtccattggtacgaggatctacatagtacgacaacaagcaaacaaaagacaaggattatactggttcaggctccttggtaagtaatagccataatccagttggtatgggattatatgatgaaaaccacagattataaagggaatagcagaactcgatgataccgacgagaccgtagtcgagttggtcccactagatctcccggtggcttggctcctgcgtgctccggctccgtaggctgtggtgaatgtgttggtggtgatattcgatgccttaggtcctacccagggggtatcttatataccgcgggtcacttgatctccaagtaggactcggagatatcggacccctcacgatatggtaaagacccagtcttgtccgagtagaactccttcaatccgtagataccatccaaacaacgtatttaacaaccccacccctcaaacttccattcttttctaactattccagaaaccaaacacacacagagtggaggagaatttttttttaaaattacacagtacaatgcagacacatcgaatctttaacacatacatggagcattaaatataaataaaataaaaaactagttgtacagtttgcatggaaatcacaagacgaatcttttaagcctaattagtccatgattagccataagtgctacataaacccacatgtgctaatgatggattaattaggcttaataaattcgtatcgcggtttctaggcgagttatgaaattagttcttttattcgtatttgaaaatatcttttaatatccggtcaatgacaaaaataaatttcttttcaccaactaaactgttcgtctccccactaaaatccctaaccccatcgatcccagccaacaatcgaagcaccggcgccgccgcctcgtgaccggccggctgacggcggagagcgaagcgggaccagcgacggtggagagcggctggacaacttttcctgcctcaatgcgccgcctctttgccgcctcgtcctctccttatctcctgtctttcgtggcatctccatggtggtggccatcagcgcttgcgcgacgagttcattgctttgattccgcagccaatcgacctacctgtagtgtttcccggtgagcccttctcttctcacggtaatgtttgtgccttttgttgctactatatagattttagggcatgtttggatcaatgccaaaatatatagtattttttagtttaaatagttagtaatgtggtggcttggtttcaagccaaaggttggtaatgcccatgctcaatttgacacaattctagaactttcttcaccataatataaattttggctcctaattgacatcaatccaaacacattcattttcaatgttaccttaccaaaacattgctattgtaaaaaattacctagattttgattattttttttggtatgatagtaaaccaaacaagcctttataaaggatctggattgggaccaagtctgggtttttatttacacttcttgtgttgttgatttcttttataaaaaaaggcaaatgggggaaaaccacgcaattaatccatgatgatttccaaacacagagaaaagaggctcacagatagaaaccagaaaccaatttcaggcttggatatactagtattctatatgacttcattcctgactgataatacttaccatcttatttatgactttgatgctctttgtgatagatttcttcatggatatcgaaatatggctagcagcaatatagtaaatggcgaggagttgggtgaaccagaaagaagacctctcaacccttctgccaagggtttcattatttccttgggcaagcactctgccatttcccaaggcacgaaggatatagagaaaagcaatactgacacaatgaacaagttcattactcattgtagcgggaatggtgcagaagatgggaggacatcaagcgggaatgtcatttctggttacgaaggtgtttgtgggacaacctttggagtcatagacaacaaagctgatacaacaggagaaattgtggatgttactggttgtgaactgagcagtggagacaaaagagagcttggctgcaggggtaccacagctaattgtttacccaattgaggatggtgtaccccctatggagatactcccatatagcagccattgtgacggttctatatacaggggcacagattgctggaaaaaagagtatcatattgctgaccgtaatgaaagtaagtggtcgatctctttttcttatttttattcattattagggcgttttccaagctatagggtcaactgatatattctctccgtaaatctcgacttaatttttctttcctctgtttacttataatttttgattgcggtgcattggcatatataaatggaaatcttctgaaattaacaactcatggtttcattgcttggtgtgtgcaaaagcacgaggcatctaacgatcatacctttagcagattgcagcctgtgctgacatcgccctgggtgtaggacatcatactcaaggttgtgatctcactagacattgtatctcctatctatccaaagttttctgattgtccagataactccctaagccatttttttgcctggaaatttgttcagttaactccagaatgttattgatcttcttgtttcttataaaagcatgttttattttgaaaatttgtgaagtgatagatgtaatcatgccctgtgctatggcttttcattctttttggtgcacacatgtgcatactaagtgttgaacaggtctagctacaccctactatgcagatagtcatggaaatcacgaaaataattataatatagaatgtgttgtctaccatcgggaaaagatcaacataaaagaggatttctagaaaacgaaaaaagaaaatatatttcattacggggtgaaatgacctgtcttgctagttctgggagtatagtgaactgaggaatagtttagggggttataaaataaatgaaccttttcccttctggggtggttagagattactctcgttttagagttccagtacatttgcatggcatcaagatgaaaataacatcatatatgccaggttttccagagcacattccctctgcatcatttgcagaagaaaagctagatacaaccgtgcagtgcagctcagcacagcaaaaccccccttccagctcatcatcctcgcactgctctgattcttcaggctttcgttgctctccagtgagcaggaactcactgaaaggttcttcactgatttaaaactaatgcctacatggactccgatcttgtcaggttagctatatctgcgttctttctacttttctagtggagacaacacactggaagaacagatgttggataggttccttgcctgtacagaaaaaaaaaaacatgatcaatcccggactcctgatatggctctctttatccttgggatttcctagaagaaaaatttttcaagggagcggatagtttttcatttagatgagaggggaactttccaatgggactatggaatcctcaagaagcatgtttacattttgtatcgccagcatttgtttattgtgttattttaattttaacagaacttgtatttttctgtgaagctcggtgggaggcaatgatgttttcaaagcccacggattgcaacatcgacagcaatggaatttgcatgtcacacggaacttgttgtatgttgcaatttttctcattaaggttggctaaagtacctgcggaccatggtttggtggagttgtatggatacatagcagtgcgggataggctggatacatttcttaattattttgtcaattttagcagggatgatcccattgtcgtggagcaggcgtgcacatttatacatgtatgcaattattttatagttaataagtctgttaacatgttatcatcggagcaggctctggtttaacctagtcttctgacagtagttggatagttagtactgggccgaatatttggccccatgcttatcatgccattacaaaatctggcccatgacaataagccactaccttacaaagtcttatatatattgtgaaatgatgatttacaacaaaaacagatctatactatgaaactaagtatcatgtattccaaacaaaatcaaatagaataattctggactcttggttgctagcaagtaaacctcacaaaactgaatcatttgtttataggcatatgaacatgcatagcatgaatactaagtcttataggcacatgaatatattacatgcttatttgatttagtacctgtgattcagaacaaaatcaatttccctctctaacaccgttatgtattttgtacattctgtttgatacaggacaaagttcttggccatcaataataaaacatgtcttagatattccttactttcatttgattctgtagggtataaaaatattgctacaagtgaaacatcataagggaagcattcagctttagatatttcttactcttatttgattctgtagggttctctcatccacatggctggccctaagcgagggatccaattgatcggcactaatctaatcgaatatgacatgaagatcaagactggtgaatatatatatgaaaatgaagatctacagctgatcgatggtgtatcaatcatagatgacatagacaacatggaattatagctcgtttacatgccgcatccatggttattgtggcgcgattgacatagctgcaatatcacaagtgagtcgaccatagaggttgcaatatcacaagtgcaaagcagttttgctatgcgcctgatcggttgttttaccagtgggttacatgaagaaatccggctctttgatggcactataggtgagttccgtacgtggcttgaagtggcctgtggttgctgtagtgatgggtgctcaaatggatttgaagttcaaggtagccacagactcatgcatccctgctgaacatttgctgttccgtcgaggagatagagactgattttgcattaatcgcagtgaaggtgacttggtcgacttttaatatgaaaagttggctctgtgatgagtgggctaaaagtggggcgggttatgcccctaacccaacgggctggcccgcatcactaaccatgcctgccttgactgatgcgggccaaagcggcagcctgcactaacccaacgggcaatgatgtcgcattgctcaccattccagtccaggggaagtccatatcgctgctagcgagagatgatgcatggctagctcccttcgctcccctcagctaccattgtaagtttgtaagtggatcttgcttggtggtagtaaaaagaatatggccattgcagccatggccgcccgaggaaacgatgacagcatcgatctatatgcattcttcacgaatcagccgggttttttcagtgcttttgcttcaggagttccaagcacaggcggatgcaaaagcatgacctggcgataatggcatggtgttcgaagaacgctagagagcaggaagatgacattttagtgtgataacaaacacaaaaatgtaatgcatgaacggcaaggaatgcatcgaatgcatgtcgcagacagaatcacactgattttgccatgaacttcatcgaacacggaataatacag

SEQ ID NO: 17173 - DNA, 8993 bp, Oryza sativa
  unsure (1)..(8993): unsure at all n locations
gtactacccccatcccatatatttgaaatttttcagaaatatccacccaaagtgctccagcaaacacagccagggaaaaaaaaaagagagaactttgttccgcaaatcaataggcacattatgaactcctaacagggtaaccaagttctcttaagtagactttgaacggatgaaatcaagaatcgtatcatgaactcagcaggatttcacctcaccaaacttgacgttatacctttggttcgatcgaaaatgtattgatcacccataaaggagcaggaaagatgatgtgagcgaattgaagagggagattgatcacccatagaggagcaggaaagatgatgtgagtgaattgcaacgcacgggtgtggagattatgggtaccccatacccacacggcatggttatccgactagttataggaaataacttttatctatgtaatatgtaacagatcatgacttgggtattacgtttccttgtatattacggaacggcctaaagttctggtttgataatattgtaaagtagatttaggaaaccgataccgtattggttaaggtttctatcttgtaatcctgccccccatcctatataaggtgggcaggaggccctctagggggcatataagacaactagatcgtcagatctatatacactcggcggattcaaatccccaaacaggtgtagggtattacctctcattgagagggcctgaatctgtctaaatcctttgtctcggcatccatccacttttaggtctcgtgcgctaccccttttattattgccgaatttatgtttcaacagttggcgcgccaggtagttgtacgccgagtttcctattgaggagtgcgatggaatcaattttatgagtcgccagcttcgcctttgcctcaggagctttgacttcctcgccatcgacaacttcaacaagcctcgctctttgactttgattcaaatcagtcggggaagatctaatctagctaaggaggataacaaccactctaccacggcgagtttaagattcgatctactatggccgccgccagcgtcaccttcgtcagcacgctttttcgcttcagagagaaactttatcgtcaggagaataaccggatactactgttaacaggatcgtcgatagcatgggccgcgtgccttggacgatacacggcatgctacaaagtttgcagtcctgatcttgcaacatatgtggtgtacggttggctacgcacgcgcatcatggtctggctgactacttcgatcgccaaacagtccggccagcatctttcctcgatctcacagcgacataatcaggggcttcgtagcagctctcttattacatgcatctactcatcatcaccatgtattgcatggctgcctgctacaagccaaccaatcaagattccttaatctacaggctgctaccaacaatcgtaggcttgatctactggagcaaatacagatgcatgcttgcacgttcttttatctcctaatcagatatgatttgtatttacatgtccgactatgcgacagccatataacaggcacgttgtttccgatatcactgacacgatcttcatggacatggacttcatcgctgactggtttgttcgtcctcatggccagcctactacgctgctactgatagcaacatcatcttcaccgactggctcgcctccgtcgccgctgccgactggtttctccgcctacacggctggcctattatgccgccgttgttgggcgtttacgacttcaccaccggcctgccttcgtcgccgccgactggtgtcctcgtctatacggttggttggtcacaccaccgttcatgcgtgtccacgtcttcaccgaccggcctgcctccgtcgccgccgactggtgttctcgcctatacggttggttggtcacaccaccgttcatagctgtccacgtcttcaccgaccggcttgcctttgccgtcgccgactggtgtctctgcctacacggctagcctattatgccgccgttagtgggcatcttcgctttcaccgtcgaccgccttcgtcgccgccgactagtgtcttcattgttattgatggacgactttgttcccacattggccacctctgccatcaccaggggaatattacaaagctaagtcatcattaattttttttatatgatatttttttcctctgcctcactacatcaactggttcgccgttgactaatgagtcgggggctacagatgttatatcgtattttttaaacaattttcataatatttatcttgattgcttgcgacataatctgagtacaaaagtacctatcgagttatggagttctatcttcctatgctttccgtttggtttgtcgatggatagttgcctttgggccgattcctagcacccgggggctcgttggatggactgagtaacgcaaggttctaagtattattcagaataaatcaaaagcatagagataagataaatttattttctgctctttacaattgcaaaagtacccgagtagtaaattatgattcgtgaaactttattccattaatgacaaactcatgtcactcatatgcatgtttgggaagtgcctaggctgactcccgatgcttgggggctatgactagtcggacagagtgtttaaacgtacggagtcatctgctcggggaaatcaaaattgacaagaggagaaatacatatttataaatattttaaaatacttaaatttttctcgagtattatatttacatcagatactactcatcctatatgtttgttctgcaggatccagatccagatatgcataatagggattcatggctttcaaagcttatctcctacgcttcagaaatggatcagtcagaacatcaccgaccggcttgccttcgtcgccgccgactggtgtctccgcctacacggctggcctattatgccaccgttgttgggcgtctacgtcttcaccgaccggcttgccttcgccgctgccgactggtgtttctgcctgcacggctggcctattatgccgccgttgttgggcgtctacgtcttcaccgaccggctgccttcatctgctgccgactggtgtctccgcctgcacggctggcctattatgccgccgttgttgggcatctacgtcttcaccgaccggctgccttcgtctgccaccgactggtgtctccgcctgcacggctggcctattatgctgccgttgttgagcgtctacgtcttcaacgaccggcttgccttcgtcgctgccgactggtgtctccgcctgcacggccggcctattatgccgccgttgttgggcatctacgtcttcaccgaccggccgcctcgtctgctgtcgactggtgtctccgcctgcacggctagcctattatgccgccgttgttgggcgtctacgtcttcaccgaccggccgcctcgtccaccgtcgactgatgtttccgcctgcacagctggcttgttatgacgccaactgatgctatcttctttacggctggctacgtcgccgtcaccgctaataggcgtcatcatcttcaacgcaagctgtctacgtctactgccgactagtttcttcacttccatggctgcatgattctgccagtgttgattggccttatcgtcttcatcgccggtcgtctcgtctgctgctgactagtgccctcgcctctacgtctggtttataccgctaccattattgttggtcgccttcatcttcattgctggctgacctgactactgccgattggtttcttcgcctctacggctgtgcaactttgtcaccggcaccgacaaactctattgccgctacttcgctagttttgctacttcaccagccacgacgtctacaagagcttcgttatatcggcatgcgtcaccaaatatgatgccatgttattttactacaacaagtggtattccaatcttcaatatttctactcggatatcttcaacatgcatcttcactcaagcaatgactactcgacgacaagaagctaaagttttcgactctatgttcagttgtttcccaactaactaaagagtcgggggcaacacaaatacacggctcaaaattcgacaggttttatgtcaagatgaagcaatcaactaatcagccaacgagttctatggaatctacttcagcaactcttattatttcaccagtaattttggtttctccacgccgctacaatctactccaaatttctcaattatcaagtttgagatttaatctacatgttcgggagttgtatcagtcttcattatgcacacgctcgcatcaaggaaactacttgagcttcaatatcttctcaatagtttgatggattattgtcactggcatcatcaccagcacctctacttcatcggccctgacgtcttcgccgttgctaaggggtgactacgtctcaccctcggtggcttctgtcatcactagcttcatcgccgacttgttatttcgttttcagggttggcctactacgcaccgccgaggggagacctcatcattatcattaactgctacattgctatcaatgggcaccttcatcatcacatttgatcatctctattgctgccaatcgtcattaccatcggttgcatttgtcgtcgtcgactatttcctgcattttcatgattggaggatttcgccattgtatttgatgcacgtctacgtcttcatcgttggcttgttttcatcgccaccgactgatattctcgccttcacggctggcttattatgtcgccactaatgggcattttcatcttcttcaccagctgtctcgtctgtttctgactgattattttgtcaccatggctacaaaattctgtcgctattgctgggtgccttcatcttcactgctagttgatatgactgcttccgactggtttcttcgcttccatgccgattgcatcagctattaccgatggacaattttgactatgacagaaggacaagctatatgctcaggggcttatcagctcaaacacaagcgcgaggattatatcttcaatttggacttcttccggatacatgcaacatgaattcgtgatcatgggtctattttctatgctcaaagactggactatttattattccccgtaagggttatcaatcgaatacttgcgctagtcgggattcaattattatatctatttaggagtatcccataagggataatcactcagatcagaagctattcatatgagctacacttggtctatatcactcggaagatttattactcgggagcatgttacatgcgtcatccttcaaagggtgtcgaaggcatattttttggcctaggcctaatatgtctgcagcccatattttcaggtgtggcctgtcacgttcttttagggacttaggcatctttttgcttacgcaaaagtgcacgtgattatgtgcccaataccttaaaatccttttataccgcagttactcaactttttaggagttggtacaatgcatcttaaaaggtgtcaaacagtaaagctttatatagctgctccgctgactttttatatagtcatgacactgtttgggttcatcaatccattgattagatacaatatcattgcttttcgccacgtaagtgtgcatttttattgtccaatattatggcttaagctgattatatatcttggccattttccaggcgggtggtaaacacgttatgagttaatttactcggatttcacaccacatatgccatatatttccaggtgtggtgaaaccatgtgtcttttagggacttaagcacatctgttaaagcagtgtgcgcatggcgtatgcccaatacattagaaatttctttattcgcaacatacaagcttctttatagctgttttgctatgtgaattttcaatgatgtagccaactttaggttacattcatcatattttacaaagcagtcggtatatcactcggatcatgttattcagggattcacaccgcatatgctacatattaatatcaagtcgcttggttgactataattatcgaaaccacttggttagttagattatttattccttgactatatgcttagtttgttcagctaaccacatagtcgggggctacacctattaggtgcatctagtcgatgcacctaactttatttttcagccctccacagtcttcatatttggaaaaagtactcgggagatcatggcgaagatgattgaagcactcggctttagagtaatctggttcgagagaagattatcttttcgactgtgaaggtctcaggggctactgtggagattatgggtaccccatacccacacggcatggttatccgactagttataggggataacttatatctatgtaatatgtaacagatcatgatttgggtgttacgtttccttgtatattacggaacggcctaaagtcctggtttgataatattgtaaagtagatttaggaaaccgataccgtattggttaaggtttctatcttgtaatcctgccccccatcctatataaggttggcagaaggccctctaagaggcatatgagacaactagatcgtcagatctatacacactcggcggattcaaatccccaaacaggagtagggtattacctctcattgagagggcctgaacctgtctaaatcctttgtctccgcatccatccacttttaggtctcgtgcgctaccccttttattattgccgaattcatgtttcaacaacgggttagccactagttttttactaatcacaattgcttagagaggtttaatgacatacttgaaaaaacaaatatatgatgtaggttgagtgtgaattcacttttcattggcaagttttaaatgtttttcctccacgatatttgcggtcagattatattgttatatactccctccattaacctttgttatgatgtttgaatattcatcctatttgctagtatgctaccaagtcctatatagaatcaaatgttatatgtatgacaaaattcctaagtagataagtaaggtgtcccatataagaaagagaagtagagtgtaaaatcaaaggtgtttttgattattattctgtgatgaacgattggcattgcagattattggttttgttatttggaatttattcacaaagtggttttggagatgattggattcacaggtgatcgcagatttatcattttatgtgaccggtcagaccgggctatgtatgccggtcagaccggcggtgatcgagcggtcggaccggccagtccgcggtcagaccggccgacgctgtgtcagtttcggttttgggttatttgtttggatatccgtgattatttcatgattatagcttctagatggatactatacgtatgtaatactgttgtttgctactaatgagtcaagttggagatagcttggtcttggaatatggtttctttgtttaattcatatgtaggtgactcgatgtctcggaagagtatttgcggtgatggaccgggagtcggcttggggataagacgacgtccgtggtaatcagagatcatgcgggatactaaggctagagttgatgcatgtggttgatggagattccatatgtcatacgatggaggtattgtgtgcgtatgggatgcggagtcgaatttggaaggagtccaaatttggtacgattggttatgtaaagtttctttcttgtattagagggtttcctaaggtgtttaggactcttagtatgagtttggtttgtggctttaggatgcctacctcgggtataaatagagggggagcgtgaggcttctcggtatcgcttttcacagcaattgagttgagttttgagttagggtttcgagtttagtcgaaatttttgtaaggattgctgttggtgcactttgtaaacacagagagaatcaataaagtcgtcatccactttaagagttcttcgatttgtgtttcaccgggtttcggcggtgtaatcggcggcacaccagcggtcagaccggcggcatcgcggcggtcagaccggtgggtgacctacggtctgaccggcggcgacatcaggcgcgacagggattccagggctgtccaaccggtcagaccggctaatctactttggtcagaccgatctcatcgaaattgagggtaacttttatttgcgctaaaagtttttggtttttgggtataccaaccattcacccccctctgattggcttagttcttgtgattcgatcctacaagtggtatcagagccttggtttcttctttggatttttatcgatctagagtttttgccatggctactcctgctagggtttcaactaagcctcatgttttcgatggaacggatttttctcattggtgtagtaggatgcaatcttacattttggctgaagattatgatatttggagaaaagtttctcatccttatgtaattcctgaagctattaatactgctgctgaaaaaactgcatttgaacaaaattgcaaagctcgcaacattcttttgagtggtatttctcgttcggattatgatcgtgttgcgcactttcgaactgcttatgaaatttggaatgctttgagtaactttcttcaaggaacaaataacattaaagaacttcgtcgtgatattttcaaaaaggagtatattaaatttgagatgaaacctggagaagctttggatgactatctctctaagtttaataaaattttgagtgatcttagatctattgattcttcttatggtgctaattatccacaatatgagatttctcgtcactttttgaacggtcttgatatgtctatttgggagatgaaagttacatctattcaggagtcagttgacatgtctactttgactttggattcgctttatacaaaattgaaaacacatgagatgaatgttctttctcgaaaagttgattctaagtcgagtgttttggtttcttcttcttcttctttggatgttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17174 - DNA, 532 bp, Oryza sativa
acagcgacatcgccatgtgtgagctctgttttagctttggtttcagaatgttcagatcggcatctgctgtgtgcatgatgcttgtccctgagaagaaaactcactggtcggaacagaggcaggaacagctttgttatgtggaggatcatatacttctagtgaacatgtatacatgcagacaacaagaacagctaaaagggcagtagcaaagaaccaaatgcaagatagtttgagctactaacactgcatgaacaaagtggtctctgcatagctctcagattttttttttttgaacgagcatagctctcagatttatagtgcaggcttcgactgcctgcctggtcctgtttatttacgttttaaaatttaaagagacgatgaaatcaggaaaatgagtgtggagtaactctgaaagttcagcaaattggccaagtgatagcagtggcttgactccccaagtcaacgattcaacaaacagaaaaagtgagtgcgtagtactcagtataaataaatactacctccgtattttaat

SEQ ID NO: 17175 - DNA, 7699 bp, Oryza sativa
ccatttggtctggacacaatctggcccggttaatatgcttgggccgaggttacactggtacacaattttcccttgtatttttcacaaggaataagtccactttgactcccttgcaaaaccggatatctcgaccccctgaactattgaaaccggtgcaatttgactcccttggtagctttggagggcggtggcgctgacgtagtgatgttgacctagtatgtggagttgacgtggcgcttaggtggcatttgaattaaaaacgtatatgtgggacccgtttgtcattcacacacataaaaaattgtgggacacactgacatgtgggccccacatgtcatcctcctcctctctttcttcttcctcccctcttcctcccttctctctttttttctctttctcttctctccccttcggtcggccgcggggagcacaggatggagcggcgacgggcagggtctagagcgcggcggcggcgggagctgaaactaggcctgataggcatttctaaacttaagaaaatatacgacttatacggcaggtgggggctagagcggcggcggcggcagaagctgaaactaggcctaatggtaccgatcctgagacactatgtcatgtccgttatactcatgtccatttctaacgttaagaaaatatacgacttatatttttcctaaaaaaacactcgtgaaagacaccgcgaagattatattcatattgatatggcaagaatacaaattacattgtagcactatataacctgctaggctataattagaaaagaaaaggccacgtcatacatctacaatacaaacaccatgtctcatatgcactcaactccatccacgtctttggattggagggggagatgtctaagagataatagtggatctgctctaccttgctatccctgctgcaagaggacaatccctttgaagaaaaagtttgataggaagtagaccttcaagtgacgcctctaggaccgacgacaaatgataatgagtaacaattggacggtgttttttttttaccaattcggcatagaaatcataggcacactaactgcccaagcaaccaataatcataggtactcgtatagtcatgtgaaaaaacaaaagagacaaagctattgtcctactgtatttaatttattggaaaaagaaagactatgtattacttctatatagacatgttgacaattcattaagattaatatattctaactttctacaaattcattaagagcaaaagacaacttaatttgatattttcacagcattaatttccattggtttcgaaattagtttcacttccttaatctgattctattattgtcttggcaaatatttggagactcctctgacctgtttcacctcttattgcctcctcatggatcttatgtttgaaagaatttactctctctcttatctttgttgctacctcattgtctcccatgacaatcttgacactctttgccaactctgtccccactattactccttcgtcattgcgatacactctagtgccaaccatccattccttctccacaagatatgcaattgtgggctggtctgaccaattcggcacagcaaccatgggcacaccaagttccaaggcttctaaagtcgagttccacccgcattgtgtgacaaagcatcccacggagggatgggacaacacatctagttggtcacaccattcgatcaccatcccattgtgatggtcatcaatgttatccaccaaatagctcaaatcttcttcacgcccatccttacgcaccacccacaaaaatggccactcacactcctgcatgccgtgtaatatctcgtctacctgtcgcttgctatatgtgagtatgctcccaaatgatatgtaaacaacagacctctctgaatgtgtatcaagccactccatgtagttcttcttatcccgctggaacatgtggattctttctttggctgacccagccactaagtggccaatggtaaacacctcttggaagtacggctgcacggctgtgagcgtggcaacctccaaaacattcaatgtgttcacaagaacctttggcttctctctatccatgaactcaaacaactcttgaaagccttcaacaacaaaactggacagcttgtcgtttgtcacatcaacaaggaaggatggtaagctacggatgcaaagaggttgcattccaggtaagaccacttcatacgatgggtcagaggcatgtgatgcaaagagctctctgtagccgtggtagtagtgatagtaagctgcaagcacggtggccggctggttccagaacacgactagcgggatgccattctttcgtgcgacatcgagcaccggaggcatcgccatggtgcacacgatgcatgtgacgggccgaccacgagcggcgagctgagagacaattgctgagaggctttcaaagcttgtgcagcggctacgtgccctctcgtcgccagaaagtatgctcagtttggatatgtcgtcaaagccgtcagagaaaggaacataggagataataccgtcggtggtctcctcgtcaggggaggcgatcagcgacgagaacatgcggcggtgagcagaagcgtggatggagagagtgcacatgactgaggaggcgtcaatgctagcgagacggtgggcaaggttttgtgcagggttgatgtggctttggatgccgtaggctacaataaggaagtgcgttggtgctgacggttgagggccatcgcaggtgtgttggttggctgcgttggccatggagggaggatttggaggctagctgttcaatttgtacgtgtttcagagatgattgttgcaaagattgtgggtgatcgggattgtctaatgtccataagttctgtatatatacacactccatagactagttgccaatggttttaggaagcacgcgcatatggttttagttgccaatggttaattaatttcaggaagcacgcgcatatgttttttttaagtatctaggtagataattatcaagtatctttcaatatcacctgttgttgtcattagtccacttgaaatttaattttgtcagttgtctgattagatttgcaaagtagattttctgagcttattgcagagagcaataatggaatgcatgtgatgttagcactgacgtatatgtactcacgttctatcacccaaaaaaaaactccatccgttctaaaatataactgtttttttacttttactaaaaatatctataaaagaaatatgtttaaataaaaagagttacatattatgattttttgtttaaggataaatctagtaacatgaattttatataattggtttttttattcttttgctattaataatagttaaagttaaagttgtttaacttgtcactatttatattttgagacgaagccattgtgataggtttcttgtttcgtgctgtctttgttgtcacattaatggggctagctgggatacatgagtaaaagacaagctaatcaagaaaagagaagagtaaaaaggaccagctacctagcgttttgtgcagtactatatggatcttcttgcagttgcaaaatctgaacgactgctcaaatcacaaatgcagcataaaatattcagaacaagtgtcaatccaatcaggcccgtttaattggtgaaataaaaaattttggacgtcacatcgaacgtttaaccggatgtcggaaagggttttcggacacgaatgaaaaaactaatttcataactcgtctggaaaccgcgagacggattttttgagtctacttaatctgtcattagcacatatggattaatgtagcatttatggcgaatcatggactaattaggctcaaaagattcgtctcgcgatttacatgcaaactgtgcaattagtttttctttttatctatatttaatgcttcatacatgtgtcaaagattcaatgtgatgtttttgggaaagtttttgggaactaaacagcccctcatttccaaaatcttttttatccggcattaatttggaaccgcgtgcatctaaagcaccctttactaaaatcaatgtagttgtatgcaaacctaaagcaatagcatgatgaaccaagaaatctccgggtcctattattaagaaaagcgaattactattctcgttaacagcattcaaccatccgggtaaccatagggttcgacccgcattgaaagcgggaccgctcgttgaagataagagcagtataggggtgtctagatccaggggcgtaaagttttggtgtgtcacattaagtattatatagggtgtcgcatggggtattcgggtactaataaaaaactaattacagaatccgttagtaaaccacgagacgagtttattaagactaattaatccgtcattagcaaatctttactgtagcaccacattgtcaaatcatggagcaattagtcttaaaagattcgtctcgcaaattagtcgcaatatgtgcaattagttatttttttagcctatatttagtactttatgtaggtgttcaaacgttcgatgtgacagggtaaaaaattttgaggtgggatctaaacaggacctatcttttcttcttgagttacgctccggtgctctctacttgaagtattctactacaagtagaattaatctcgaccgttaattttataagatagattagtaatctcctaatatagtttagggataattttggtatgggatgttttcttcgcttcttcgcatcaggtccgacgcattgtatctcgccccgacgcatgcaccgcatctccccgatgcaggttttcgcttcctcccggcaggcagcggcacggcaaaaatcactggcggcgcggccggcggcgctgccagcggctcggcgcggcgaaatcctcaatttgcagacgtgtttgatttggtaattgaggaatatagtcttaggaaagcatactagtgggctgcctgatttctctgttaagacagatgcttatgtttctaatctgatttcactgtacagcctgcgattgatctcaacaagaacgatcttttggatgaatgctacaaaaggatgctggaagaccatctgaacgatattttgagagacgatatagctttagtttgtcaccttagtgacggaaaggtgagatagtgtaatgtcaggaacaagtttgattgtcaggaacaaccttagctagttagctttattctctatctttggatcagacagttgtagtatcgagatgtcgactagagagaggtgaataggcgatttaaaattaaatgatacctaatcaaaactaacctaagttgctaggctcggtgagggacaagtctaactaagccactcacaaaccggcaccgggcctcctccacaatcttctcggagaggtcaccgggcaacacctccacaagccgtctaggaggtggcaacctccaagagtaacaagcgatgacccggctcgaagatgatcaagtgcacactaactctacaatggaagaaaatgcacttgactcttggctagaacaacctccaaccactaccatggatgaacactaagctcaaatgtgtgtgagagaagtgcaaagggtgttatgcaattgaattgggtgccaagagagcccccttgctgctgaaggggagtatttatactcccaccaaccaaaactagccgttgggggcgaaatcccccaactcagtgctctgccggtctgaccggaggtatgtggccggtcagaccgtgctactctgcaaccgttgtagccctgtcagagggccccattggcttggccggtcagaccgacgttgagtggccggtcagaccggcctcagctcggtctgaccgaatacggctccgtcggctctgtaacggccaccccaagcaacaccattctggcctccaggaggccggtctgaccgcataagtgtcgccggtcagaccagcctaacacaccggtcaaaccgccactgtctgtccggtcagaccgccactgtctggccggtcagaccggccagggccgccagtcagaccgccactatgtggccggtctgaccgcccctaatcaggctgatcacagtaaatacatatgtgtgtgtgatgaaaatgtgagcacaagtctaaatgcataatgacctaatgtggcaattaaaatcatctctttgctaggtcattacccctcttaatagtacggcaaagctaaaaaataaactagcaaatttgatcgcccttcacctcgatcaatttaaaaattaaagcactagttttaccgtcttctttcacttcactttgcgccgtcaattttaatccttcgataatcatccatgcgcacatatgacgtggtactaacacaaaatatatagctcaaagacaacggttagttcataattagcgcttgtcattaattaccaaaattaacaccgggggcctagatgcttcaacagtaatactatgcaaagtgagactggttaagtcgcagacagctgcttaatcacggtgcgattagggctaatcttttgcatctttttggtgatccatagtttcgtggttttgcgatttaatagcgtctaccagatatttcccgtttgatcgtcttgatggcttgcgggtgtgtgcaatgatcaaatatttgctgtcaaaatatcacgtgactgaaaatgcagccaactctgattgctaaacagtacatcatctctgattagcaacaaagtgtgcagtttgtgacatcagtgtccatgaaagcttccaggctttcccctggttattgccaaaaatatagtcttatttctccttctctctagaataattttggtaagtttacagcgtttggcaggaggaacgcacaaagactgcatgagtgtgcacaaaatctgtccatattttctctaaatttgtactttgtgttaggtagtacatttgtgggcattcgaaatgcccaaacgagattaatataaggtgcggtatttcttgtagcaggaaacacacaccaagccaaaccaaagagcaagccaacatgcttgtgctgtattcagaggtgcagtatttgtgcagtgaacaaaagtcatctcacattgctgtcccttgataatccatggatgccatcagtatttcacatctgaacattcgcgcgtgctcctccacgggcatcatctccgcgccacgctgccggtgcagcggctcgccggtgctgcacatcctggcgagctggtccaccgccgtggagacgaggtcgaccaccaactgcttgtcctgctcctgcacgggcgccatgatggcgcccatatatgccaccgagtcgtccgcggctatctgctgtggcacgacgggtggcgggatgaggtcgccgcagcctatggccggcgcctgctcggcgagggagatgggacagcgatggtgacagggatggagggaaacgggcgactgaggaggtggacgggagtcaatggcgtcaattaggataatgataaattacgataatactcctacatgaattattatctctggataagtataccccaccacgtttctactaccactataccactaagttaggtggtagtagaactagatctcaaccctacgattaaatacgatcaacggcgcggattactttctactgcaaatagaaagcattggagtggggctctttcttctttcgtttctattcatgtacagtttagaaatgattttttaaatttgaaattttatttattgaaatttaaaaaataatttttggt

SEQ ID NO: 17176 - DNA, 3322 bp, Oryza sativa
ccctacgattaaatacgatcaacggcgcggattactttctactgcaaatagaaagcattggagtggggctctttcttctttcgtttctattcatgtacagtttagaaatgattttttaaatttgaaattttatttattgaaatttaaaaaataatttttggtttcaaagttttacaaatctacacccctaaacctttctatgacgttacaacgcaccaatgaatatgtgcccgtcataaaaaaaaacctgtttggaagagagagcgttaggggtgtaaatttataaaactttgagaaaaatattttgtaaatattttaataaataaaattaaaacttgaaaaaaaatcctgaaaaaaccggggaactgtctactggagtacagcccatcaaagagacgaggcccatagcccatcggccaccacaatccttctcgattcttctgctctccaccgagaggagcaaggcgaactgcaggcggagaggctgggccacacgataccctcctctcccttcccttcccttgccgcttccaactccaagtctcgctgtgatcaggagctagggtttgtgcgatcttcgggaggaggggaagatgatcgaggtggtgctgaacgaccggctggggaagaaggtgcgggtgaagtgcaacgaggacgacaccatcggcgacctcaagaagctggtggcggcgcagaccgggacgaggcccgagaagatccgcatccagaagtggtacaacatctacaaggaccacatcaccctcaaggactacgagatccacgacgggatgggcctcgagctctactacaactagacgccgcgcctctggtaatttctgtttgcagttcttgttaggcctttcttttttgatgctaggctcttgttgatcaaatcgtgctgtggattgagaaacgcttcgttcgtacttggaattgaggactaggtacgcttaatttttgtctaggaatcatgaattggcgggctttatttgggtatcaagtcgtgtactaatactctgatagcaacttctgttccgctatttagttcagtctgtgcttgcatatgctgtagctctggccgattgattaggatgcttctttctggtattgtagtcattcgtgtcctcatcatttgcagaatagagggatatgatgaactctcgcatgctgactgattactggcgaggcaattaggaggattaaatgcgcgctcttgtaattctacattctttggttccaatataagctatgggtcaatcaactagacattgatgagtggatatttgctggtactgttagttacaaaatgggtttagattattttatgatgtttcatgtttgtaatgacctctggcaaattgtgttgtattcactggtgtccccaatttcccctcttgttatcttttgtcaactattggtcaggttttagctttgtggctttagaaatttgtgaggatatgctcaacaccgtgtgatgcctcccccctcccagcctctatttagagatttcctaatccagtaatttagtgcattatccaatgcataccatttgtttcttgtttgaatgcattagaatatcgagattggcaggttaattagggtgtaatttgagaatctgttgggacctgagttagtatagggtattagggttgtcttggtttgttggctagttatgattaatatgaatggacatgtaagtatgtaaccatgtgccataaatataatatccaggaaaggaaaatcctggcagccggtacattcggtactagaaaaaaaaattctgatttgcaagttctgctgttcagttattgtacttacattagccttttaatgttgcataagtaacataggtgcaggctgaaaactatagaagcaaagcatcctcctttttttattctgttatatccttataatttcaaacagtgtcatctgtctttggtgttgtctgttgtggccagtcactcatacatcattattttatcacatattcagttgttcatgcattgtgagttgtctagttattgatatcggaaattgtagctaaatgcagcgtggataaagtagtttgattagtggtgttattcttgtgttgatgatctcattatccttcatattcctgtgatgatggttaaacctatagtttccattcctttggcatgtaatgggttagcatcgatatgccaaagtaacttgttaaactttgagcatggacacgaaaaaaacctggcatataggtgtttaagatattgctttgtccttttctgtagcagcatgctaagtattgactggatatagctgaatggttatatggataaaacagttagcatttgatcacatatatagtgatcacacctgaggcctgacaaatctggttttccactggctgcatcatagcatgtgttagttactggagaaagatctgaaaaaacgaatcatacttgttgctgattttgttcaacgaaagggttctctgtggactgtggagcagaacaatttatacaaacgggctagttggtgaatgcttgaattcgagtatgccacattgaacaataagctggagatgtactcctacctgatattgatatgtacaagtgtatggactgttttgttttgttcccctagctagaattattcacttttaggcttctattgttgtaggaaaggctaaatcaactttggtatgcagtaggataccagggaaatcataaaccatttcacttgttagcatgtgttttttgctgagacatgtgattatatgctgttgtattttgtttttttatctcaactaatatttgttcaactgcaatgcaggctggtatgaatttagtcatggatggcgaacagattatgcccatttgagcggccagcgtccatagctcatatataaaactctagtgagctgtgtagttcgttgtgccaatgactgttgtcaactttgaatatgtcgttgtagtatgatcaacctgcagatgtgttgtatttgtgttgctgctactcataacataaataacatgttatgaaactttgatcaagtctcagtatcctgctcgtcctagtctgctttctccatctgacatgcattgcattgcaacttggattctgataaactgtctgctactcttgaaagctgcacccacagaacagcagcagtaggggttgagccgtggaggaaacccagattgtagtccgattccagttcaatttgcagcccaagcttcgtcaagttttgatcgattttgctggctccagtgatcgcagagatagattttcggcggtgcaggcagaaaacggcaaatcgctctaccgtttccactcgcgggag

SEQ ID NO: 17177 - DNA, 4772 bp, Oryza sativa
  unsure (1)..(4772): unsure at all n locations
gtgcgcgccacccgcggcgtcgctgccggcgcttggtattcgaggtcaaggtccttcacctcggcagcaccggccacacccgcgttggatgggccaccgacagaattaggatcctctgccttcacacgtgaaggcaccagcctgcagtcaagtaatatcccccgtccaaggcaatccaacagctcacgtgcacacccacttaatttagccaacaaaacatgcacatcagaacccatggaagcccagcaactgacagcacatgcacttgcaaagtctggtgccggccgcggtggtacgcgccgccgtccgccgccgccgctgcggtagacggtagtgcaacgattcaacatgcttgttgtctgggatttagaacattattacaattacaaaacagagcaatgcatgtattccatttgaccatgcagcaaccaaagcatgcattccatcaggcttgataagaagaaaagggtgaggagagaaaaaaaggtacacctacatcacatgggaaaaaaccaaggtatttcttaatgaagatttcattctagtgctatattttagttccaattttcactgcttctaatgtgatctggagtaaattttattttgagttatgttctctttccagcaacaagaggctagaaatgatggtctggatgcacaagctacaaaagataatatttctggaaacaacaatagagactttgaacaacatggggtcataaataccttcacccaattgttcatggtaatcttgatcataatctaaaagtataaattaaatgactgtaatgttactaagttttttttttctattcttcacttttacagggcccaagtaccagtgacctgtgtactgaagacttattatagctagggggatctattccagggcattggttttgttcttgtcagtccgatcctatgcactaatcacagtatatttcgattttttttttggcgtgcagtatatttcgatttatgatgtagcttgaaactccatcatactttgcagcgattgatgttaactgaaactcatgaattgcctaatggaaagcatgctttggttgctgcatggtcaaatggaatacatgcattgttctgctttgtaattgtaataatgttccaaatcccatacaacaagcatgttgaatcgttgcactaccgcggtggcggcggcggtgtgtaccgccgcggccggcgatgacaccgcttcatcagactttgcaagtgcatgtgctgccagttgctgggcttccatgggctctgatgggcatgtttcgttggctaaattgagtggatgtgcatgtgagccgttggattggtcttggaccggtggatanttacttgactgcacgctggtgccttcacggtgtgaaggcagaggatcctaatccccaccaacagaattatgctgacatccacgcacccgtcggctactatgtgtttggattcggatatcgcgacatggatggtaccaaggtgcacaaggcatggaggtccaattatgctgaccaaggctatggcgagggcgatgtcctcgggttctacattcatcttcctgatggagagctgtatgagcccaagcagcctttcctggttcactacaaggggcttcctttccgcgctgaagctcccaaggcggctgagcagaagacgccggatccagttcctggtgagtaccattgtgttacttcatgtgtttgagtagactagtggtagattgccagccaggaaaataacacatgctatttttcacaaaaacaacttggtatgaactagcaatttcacaaataagattctgtatgtaattgcaaggatgcatgtttcatgatgttatattcaatacttggtgtaatgtagaatttgtaccaattacagaattaccagtagtagatctgcataaataaagtgatttaggattcaggacaacagaatcgggtgttctttacatgtagggaccccttacatgtatgattatataggaaatattagaacttccaatagctgtaatgtaacagtggtgcacttgtcctaacaaaatttagaagtacgtttaattaagtttcatcagtcttttgcatcctatgtttgagcaagtttctgatctctgtctggttggacatattggtatctactcccctacatgtgtttcaagtcactatatctccattgcacaaactagaaagtagtttctactcactgctcttgaaatcatttccaaagcataaagtgtcttgtaccaagaaatatagctacatattgtcatctttattattggaggtgcttagtgctgaagcataatgaatgcagcatacagttcataagtcacaatgtaagaaagagagcaagaaatgcagcaaatgcttctctagcaatgctctcttgagaggcacaacatggaaaatgtaacaatttgcttctacagttgtacataacttattaatttgctttgctactcaatcaaagacaaaaaaacacctaccaaatgttactaaatttacccattgttctgttcaagagtatctatgtcatcatctgaccttaaattatattcttgactgtttgacagtgcatagtctgttgtattccatactagtaaaaacaaatacctgcaactcactttttgagaagataatatgttattgactattatatcctaaagtataattacttatttggttctggccttcttggatttatctacatcagaacaagtactgcatgatatactgtaccaatcctaactcgaaggtgcaatcttctactgtatcataggaggttacttttgggagtctttacttatccagtcattattgcaatcttatcgtgcagtagattctattatgttatgtgcacatgaataaaaagggcagttctttcttatctgttcttatgatgaagtcagaaatcaacgactgcaaagttttttttgccccaaagtcagtaattgtaaataagtgcacatcagtaccttccattggatcactatgttttgcttacatggattaaaaaaagggtttcttgtttgttcttcgcatagaacaaagtcaggatcctataagtggttgttttgcacacttgcacttatcacttactactttctagcgtcccttgttttcctacttacgagtatgcgactgttttgcacaattgcacttatatttcatttccgactttctagcatccattgttttatttgtgcagcctctcctctggccttcttagatattccattttaatactttatagttcttgcaaatgcaggtagtgagatatgctacttcaagaatggggtatgccagggcactgcttatagaatgcagctagcgaggcgacggtggtcgtgactccggcggtgaagggcagtggccggcccagagctcggcgggccgaggcaggagaggcagcgcacgggctcggggcggagcgagctcaagacgtggttctccagactacttcacgccggggcagcggggtcggcggcggcattagcagcggcggggaacgggttgtcatcgaggaggctaaggagctcgtcggccgtggagatgaggagggagcgggagcggcggcgggcgcgggagcagcagccacggtgcggggaggtggcaggtgggacagcggcggagtgcgtcgcggttttctgctgcttcccctttgctgtcgtcgagctcatcgtcctcgcggtcgtccgcatccccgccgcgctctgccgccgcgccgtgcagcggaaacggcgcgggcatgcagcggccgtgcgagggccgcgacggggcgaggcgcgttcgacggcgaactcgagcaggcacacggttgttgatgtaaaacacgaggcctgagagatctgcttaactccagtgcaggtccaaaagcttgcctttaggtgtatgagcgtgccaattgatttgatcctgcaatcaacaagaaacaaagacaaagaaaccgtggttaaatctgtaaactatagctgatcggctagttgccaatgacatatcatttatctttgagccgatgtcatatgtgaatcgatcggcaatcgtgaataagtaggaaagaactaaatctactcgatcggctatagatattaacgatatataatccctatgtcgatatatacttaaatcaagtgattgggataaatcggtcgccatgccgagacagtataaaccacttagattgaaatatatattaacaacgagactatatatgttcatagcatagccgatcagatacatctagcatgtatcggttaatactccgataccactctatattaagatattaaagaaagtaaaatatactaaacagaagcctaatatacttaaatgtaacaagatcttaacataaaggcagatttaacatatcaatcaagcatatggaacgtaaagtagttaaatcaggtaagatcggctgaaaccccaatgctactctaatcggcaaccagaaagcaggctagagattaatattctaatcacgacttataaggtcaaactcaactgatacagctataagtatgaaaagaaagacaatatctaaacaatcaagccgctggttgtttcatagagtggtagatatcttatataatctaagtcaacgtcgatatataacctaatcggttgccttctagtaatagacgttagccgattgaaggttagataacgatattgccaaagattatataggatatatgataactcgacgaattacataaacaagannnnnnnnnnnnnnnnnnnnnnnnnnnnnnnnnnnnnnnnnnnnnnnnnnnnnnn

SEQ ID NO: 17178 - DNA, 8285 bp, Oryza sativa
  unsure (1)..(8285): unsure at all n locations
tatactaaacagaagcctaatatacttaaatgtaacaagatcttaacataaaggcagatttaacatatcaatcaagcatatggaacgtaaagtagttaaatcaggtaagatcggctgaaaccccaatgctactctaatcggcaaccagaaagcaggctagagattaatattctaatcacgacttataaggtcaaactcaactgatacagctataagtatgaaaagaaagacaatatctaaacaatcaagccgctggttgtttcatagagtggtagatatcttatataatctaagtcaacgtcgatatataacctaatcggttgccttctagtaatagacgttagccgattgaaggttagataacgatattgccaaagattatataggatatatgataactcgacgaattacataaacaagattagagtatcataaagatggaagcactaatcccgagaacgcaagccgccataacaagttttacctcttgttgaagatcgaaaccgatgcagctcaacccgaaagcaagaacccgtcgaaacaaaacgaaaataaagagggtggcgatgcgccgagattgtattgaatatgtgttagattgattacataaggctcggggtctatttatacccgagattacaaaatatgtccatgtcggacacgactcttatctctaacaaactctaagataccataagtctttgcggcagacttttgcccaaacatatctctaaggaaattacacagaatattctaattaatagatacaattgccttctcagaactctatccatgcatggcaatcatcatgaagcacgtttactcggtttgacaacatgtaccgagtcgtattgtcagaatcgacccaatcggctaaccttgtctgactcgaactccaccgaccttgatcgtagccgatttggactccacccgattcttgctctgcttccaaaacaatcttgatcttggattccgcttcgatctaatctccatctccaatactccaatactgaggttaccaaatttggtcgttaacaacggcatagtcgcacgcggcgttctggatagtgtcgtccggtgaggaggttggggatggcgacgacaacgacaacgacggttgtcgtccgttgaagtcgaagctgtcctctcgacggcgtcggcacgggagaagaggaacggctccagcacgggagaagagggaacggcgccgcggtggcgaggtcgtagcacgggacgagcagcggcgtgacggtgtcacgcagcgtggcggcgccgatcacccgccgcagcgacgaccttttcggcacccaccttcttcacccttcggcggcgggccacctgccctttccgaggctcgccgcacgaacgccagcgagtccgccgtcgtgtacctcggccgccacccccccttcaagaatagcatcgacggcaacacgccccccggccccggccccggcggcgcgttaaagaaatccatcaccctcgcatcattatccccggccttctcccgcaacgccgtctctagcgtcaccagcgccaccgccaccagcagcgcattgcccgcaaccattgatcacgagaaccctcacctttccctcccccaccaccaccttcatgaaacgccctccccgccggatccagccgcggcgcggtggccggcgtcctcctcctccgccaccgcatcgacagcgtgccccgctgctccctcccggccacctccgcggcgtcgtccctgcgtgtgcgagaccagagagcgagaggaaggagaaaggggaaagagaaacagagagaaagagaaaggggaaagagagagggtgacgtggacacctgccatgtgaggcccacatgggtcccatgctgacttagctgccacgtagactaaaaccggggtcaaaaccaccgagggacctcgggtgaccggttttgtatagttaggggaccccgcatatctggtattgcggttcaagacgttttcgtatctcggtgacaagttcagggacctccggtgcactttttcccacaggaaaaagtcaaaagcccacagccgagtagccacatttcagaaaaatcaagctacactgaataaaaaggagaaaggggaagcttcttcaagtaacttcttttcagataaggtacttacagattacatcacattttatatgaacatagtgcatggaattagtttcctgtttcaaactgtcaattttacggcacaatttatgtatctgctcaaaattcagtgctaacagaacaaaaaacttatatgcataatttatgacaattgattttatgcagattagccatgcatatctcaattttgatctaaatatgtacatgcagattagttctattctggtgaccaccaaataaacttatgacatgtctaaacttgaagggtctatcaaaagaatgaaaattcactcaaatgacaaacaatgtagttgttcttgtttttcttggttttgcatacatctctcacagaaactagttctcgactgcacacatgctgaaaaaaaatgacaagtagccttgaacaatgacagcttcttccaaggccaaattcagagcaaacaactacactcgacctgaccaaattcagaaccaaaaatattctggttgccatttttcacactggttgtcacatgatctctgacaattcaatgtagctaacagaacataactaacttgattatataacacaaaactcaacatgatatatcatagttttaaaacctaacaaaactaacttggtatttatattaaaaaaaacaattatttattagtagaacacggaactcttacaagggctgacagaacttgctcaaaaaaacatttcaagttatcttacaggagcaaacaaaacaaagtactctcaatagccatcaatgcggatttgatcaacatggattatataagtcttatgtatgcatgattatacaaaactatataaagccaggtactcttcagtactttccaacagatgacaaaactaagtactcttcagtgttgtcctatagatgacaaaacttacagagctaaacaaaactaagtactcttcagtgttgtcctatatatgacaaaacttgatcatagtgagtgattggtatttgctgacaagatagatagaagaagcaagcagaagaacaacacaaaactaattgctgacaaagcagaactaatacccatttcgaactaacaaaactaggaattctagtggctaacaaaactactaattacagtatttctgacaaaacttgaaagtagaggttaaagtatttctgactaaactagcaaaactaggaattctagtggctaacaaaactactaattgcagtatttctgacagaacttgaaagtagatgttaaagtatttctgactgaactaacaaaactaggaattctaatagcaaacaaaactaatctcttttcttacaaaactatgtttgttaaatgccatcataccttttaccttacctagacaagaacgaaatgcatgttagtgatcacccaccagaaatattttagttttaccaaatttagttaaaactatataccttttagttaaaactagcttaggtcttcataatgcagttatctacctaaaatggcagacaaaactaatttattaatttgattacaaaactaacatatttagatgcttagctcatcatgatgcggtcatctaaataacataacaggggagactacaggagagggaggaactaaaagtaatgcactgtgctaagtatttttaattgctaacaaaagtaaaaacgctatgtatcatagtgaagttctgaaaaaaatatattagtttcctctgaaatgttcagaacattaatcttgcaatgctttatattttttggaaaggagcagggttttagacactagcaaaaaaatggcatgatcaaaggaggacttgatggtactcaagctatttgaaaaactaaaaagctctcttgtcagtactaattgtttactgaattaggtaagtacagcttacagaaaaatcatgcttagttaacttcagtttgaattggcaaacaaaactaatactacccccacacaaatgaatcacaccttgctcacaaaacgtccccctcaaccacctgcaaaattcagctccccaaaacctgattttatacattcaacagtaggagataaaaaccattgagtaaatttcgtaaaactgcagatactttgcatgatcgatcataaaactacaattttaagaacttgtttcacaaaactacagattcaatttcttcgtttatcacaaaactacatatactttgcacaatatatcacaaaactacagatttaagaacttgttacacaaaactacagatttaatatcttcatttatcacaaaactacaggtttagtgtctccattatcacaaaactataggttttagcattattaaaacatgtagttttgtgataaatgaagacactaaatatgtagttctgtgataaacgaatacactaaatctatagttttgagaaacaagttcttaaatatgtagttttgtgatagattgtacaaagtacatatagttttgtgataaattgtgcaaaatacttgtagttttgtgaaatttactcaaaaccatttatgcattcaacagtagtaacagatctaaagcatttatacatcccacagtaacagattagagaagaaccccataaaaaatttgtgattacatcctccttatatatccaaacaaatcagcgtgcataagcatcacaaaaacaaaaataaattgctcaccaaggaacgagctggacagatcttgaggcctgagttttttggacccaaaccaacagcagcaacgtcagcctcacgattccccatcgccttgcctgttgaatgctgcaccagcatggattcatcaaagggggcagccgagtagggcgtggccgcctggcccctgaccttggcgacctcggagcttgtctccacggcggcggcggagggcgccacaccatgctcgccggcttcgcctggctgcagtgaatcgcctccgcaagatttgctccctcccctcgacgacatctcagcggaggccgccgcgctacgctcgccggctgagcccggctgtggccgaggagtcctactcttggcctcctctcgccgacaaggagaatcgctgccggcggattcaccccctcccctcagcgacattgtgcgctccgctgagaagtgggtggcactgtttcaaaataaaaaaaaaaaaaacgcgccctgtgtcagaaatatccccaaaccttgtttggattgggttacaaaacggatcctaacccgataaaaggactgcgggcccgataatgttgcacgaatctttatgtctatcaaaggctaggaatttgagtgtgatttggaaaaaaaaaacacgctggtaatgtacagtaaaaaccaaatacaaataaatgataggtacatctaattttatccatattattaattcatacatgataggtacatctaatattattcccagctgcaagttgagcatcagttcgtagttcttgtgccccttggagatggtctccccctgcttcttccccggcttcggcatcgtcggcgcgcgcatacacgacggtgtccgcacccatgacctgtcgttgcgactctcctcgccgccgtcctccccctcaaccaggctgtcaatgtcggacgacatgttgttcctcctgctcgacctcctcccttggtcagctccaacctccggcggccgccacatcccttggtcagcggcgacctccggcggcagccacaccggcttcttcgtcacgggctccaccccaggccatgtcagcaccttctgtgacggcagcagcgacaccgtctttccctcggacatctccagctcctcgagcagcttcgtgatcacccccttgggttcccggggcaacggcaccggcgggccaccggacggcgggtagtacacgcccttgccctgcgtctcggcggactcctggcaccacaggccaatgtacatccccgccgtcggaccaccggaacgtgcccctgcccttgggcttggcgtctcccacgcgccgtcgtaccggtcgccgtccgcccatatcaccgttccgcgggcgtgcatntcgccggcctttcacagtccgatgtactcgtggccggcgcgccagatgtactggcccgtgcccgtncctgcaagccgtcgcgcaagtgccgtcgtacacgtccccgttgacgtacgcttgcgtgccgcggccgtgccggaagttggtcgcccacagccccgcgaacgtgtccccgagctcgccgatgtacgtcccctgtccgtgcatgtacccgccggcgaagtcgccctcgtagatggcgcccgacgaccacgagaacttgccgcggccggccgcgcggccgccgcgccacgacccctcgtacatgctgccgtccgtccagagatacttgccggcgccgtgggggaggtcacagcgtaggtcgccctggtagaagtctccgctgggcagcagctggtcggagtggctgggctcgccgagcgacgcctcgtcgacgtcgtcgtcgtcggtgtcaacgtcgtcgaggacggagtcgatgtcttcgtcgccgtcgtcgtactggtagatggtgttggaggtggaggagctgacggagaggcttggggtgagcgtgatggggtcacctccagcggcattgccggtggcggccgccggtccgtcgaaggtgccgccggaggggacgacggagccgcgaaggatggtggagtacttgagcttgcggatgctcgcctcccacagccggctggccagagcagggagcgggttcatcttcttcccggtcgccgtcgtggcgtcctccgaggagcctaactcaacgtgacagggtcagaacgagaacgacgccggaggcggaggcagagcgaggctgtgcatggctggtgatgggtggcgcagtggaggtagcaggggcaagaaaatgtttggattggttggaggttgggaggagttgtcggggtgggtggatggcgctgccgccgctgcgccaaggagagctcggggggcgaaacatttggaaggaggcagaggtaacggtgagatagaaagccatgaacgctctaaaaataggcaaaagggagaaacagcagtagtaggctagctctggctagtagcatctcagtgtctgcttcgatcttgggggcttttcagttgatagcgctgagcaatgctcaggccctttccaataggctacaacatgagcatttcctacgttgaaatcgcagagaccaactgatgatgaactgatgctatcaggatccaggagctacggaactgaaatctgacagtaccaaactactccctcattcctaaatgtttgacgccgttgactttttaaaacatgtttgatcgttcgtcttatttaaaaaatttaagtaattattatttctttttctatcatttgatttattgttaaatatatttttaatgtatagatggccaaaaggcccgaggcccgatggcccggcccacggcaatttggcccggcccaagcacggcccggcccgatgggggtcgggcccgtgtcggcccggccggccgccgggccgtgcctggcccctccaccggcacggcacgatgggccggctggccaggcccgacaaaaaaataatagggagcaaaaatagacatattattcttcacagttcaaaggatagggatgtaaaatagacttattttagctatatatatatatatatacatatatatatatacatatatgtatatatatatatatgtatatatatacatacatatatatacatatatgtatatatatatatatgtgtgtgtgtgtgtgtgtgccagcccaatgaggagggagggaaaatagacttatttttcaaaagacacgatgggccacccgtaccatcgggccggcccagcacggcccgactgctagtgggctgttcctgggccggtggtgcagcccatgggccggcacggcacggcccggtgtgttggtcgggccgtgccgacccgacagattttggcccgagcatggccgtgccgggccgggccgcccgaatggccaactatatttttatttatacgtatagtttacatatttcataaaagtttttgaataagatgagtggttaaatatgtttaaaaaaatcaacggtgtcaaatatttaggaaagtaggcagtatctgtctcaacgacaatcaaaaatagcaaccacgacattcaagtacactgaaatcagtattaccagtaccaaatctaatatcgaa

SEQ ID NO: 17179 - DNA, 12582 bp, Oryza sativa
taccccacttccacttcaaattttttgcaaggggtcaagcacataaaggcttaacaaacttacctcaaaagactttcagctctctcattttggaggggccagcgccaacgctgccttcaaacacataacctccttgcccttgtcctgataatttcacagttcattagaaaacgtataacattagcccaaactactttataaggagaaagcgcacctgtttttgataaaccaaggccatattaacaatggcgtcagatgacaggacaggtttctgaccatggaaactgtgtgaaagataaagcagattgagattcctcaacctgtcccactctgttgtactcacatcatttctcagcgcctgcaaaaagagatacaaaaaaaattatgcacagcaggaaattagggtatgtcaaatttagaacttactttacagcaaatatcagctagcaagtagtttatgttttccaaagcattaaacatgcgctcacgcagcgcagtaactcttgctgctgtatggacatcgtcctgcagaaaaatcagtatataattataaccaaaacaaactaactaataggttaggttagccaaaagaaaaaagaaatcacattttacctctgctttaaacgtaacagattctgtatatgctattataccattcaagctccagtcaacaccttcgattggggtggaagaactcaatagaagttggacaacattcatctgtttccttttggctgcagcaatgatgggtgggtcctcaaacatgacctaggaagagagggaaaggggtgaggacatgaatgttattgtgactaacactacagagcacaccatttactttgaaaacaaaatgagggaaagagggggatgaagaacaagaggggaaggggtgagacctcatcaattgcgtctgcattagcaccagaatcaagtagaatctgaaccatagattcagatgaagtgaggtcagctactatagctttgccgattggctttgaaatctgaacattagctccagcctaaaagtaagaatatgtagatagataaggctaaaagaaaactacaaccagcatctgcacatgaagatattagcatatctcaaagagccaaacaaaaaaaaaacctgcaacaacgttttcatgcttgtaactgaaccattgtatgccgcacatgctaagggtgttatacctccatcaataatatcatccacctattaataaagacacattatgtgaaaacactagattcatattatgtgaaaacacatcatagcaaaagacgtgtattggtctttctcataagagcttcaagagcaatttcatcatccagtgctactgctgcgtgaattggtcctccataaagagaatggatatgaatgtcagccccaaagtctatcaatttttgcatcgcagcatatttgcctgacaatatatagagcaagaaagtatgtgttgggttgtgatgggattacattttgcaatagctaagaggaattcggaaatatactgaccaagaagaatagatagctgaagcggtgttaatccaagattatctttcatgtcaatgctaggttcaagctttgcaaggacatggccaaaataccctccgctgtttctcggaacagcaatatgaagaatcgtcctacctaaaagtacatttgttaactgaagttgaaaaaaatatgtgaatttaaacaaatgaacaacataactattacaaacctgtgctatcctttttgtcaacatcaatgcccaaaaactccactaaatgatgagtaagagtaacatgtgcacccttggcagagtgatgcagcacatgcatccctttgtagttaaaagtgcgaaaaagtgtcctatatgtgtaagtgcataacggcttctttgccaattctgcataccttggctgttaagaaacagaaaaaaaatgttgtaatgacaatgtaaatggtaggttctacataccttcggatgcatcgatagttgcggggtcggtaccattctcagccagctcaataaaccttaatgcttctataagacattgcagaatgacatgaatgtaagtatagatagagtaaaaacagcaaagggctagatgaagtaccatcgtcatgtttagtcagtttcttctttccagtcagttcccttggcgagctgtttgcatgcaaaaaaaaatttaaaaaaaaacaatcacagcatgttatgtaacctaataagagaacaattacctttttgatgacattgcaaaagccaaccagagaatgttatataacctaataagagaacaattacctttttgatgacattgctaaagccaactagaggtcttcggctctggaaaaagaagggaaacagcaatcagccaccaacaataaatctcattaaacatgagagtgccacgacatatttttacaaggatattgcaatgaaacaacacaaaatgtaaaaagggcatgacttatgaaagttctcatgtcatccagttggatagtaaataatcaaaccaaacaaatattggtacacccttaaacacacataatcgagtttggatctaagatgagacaatcttcacagctaaaatctcagtagttggccgttctgccaagcctgccacctccgatgaacccaaaagtccgaacacagaaacctgggcgtatcaaaatcccagttgaacacccaaaatcctaaaaagaaaatctaagagcaaatcgcattgattcggataataaaggaacgagacctttgttgagaaccggatcaagaaccccaaaatccgacacaaaaacctcacggcatcaaaaccactagcaacatcacacggattacatcgcaaagcaaggcagaaatgccaaaatccgaaccaaaaacctagcggaccccgatgaaccctcaaatttccacaacgaacaccaaaattcaataccaaaccggatcaacaccaccgacacatgattcaccaatgtactaaaaaatacggagactaaaaacctcacggcatcaaaaccactagcacatcacacggattgcatcgcaaagcaaggcagaaatgccaaaatccgaaccaaaaacctagcggaccctgatgaaccctcaaatttccacaacgaacaccaaaatcagataccaaaccggatcaacaccactgacacatgattcaccaatgtactcaaaaatacggagactaaaaacctcaccgcatcagaaccactagcacatcgcaaggactcgcggatacccgatgaaccgtcaaatttccacaaggggcaccaaaagaaagcggatcaaaactactgaaacatcgcacgggaaatgccaaaatccgaataagaccccgccggatcaaaagtcccccatgaaaccctcaaaaatacaccatgaacccaaaatccgaccctaaaaaacctcctagatgatcaaaatcactgggcacatcacacggattaatcacaaagtaaaggatagaggcagatgttaccatgggcctgattagtttggagatgagagctggctttccgtgttagggtttaggaattaggatgcggcgggttgggcaggcgcagggatgaaatttgtagggtcgggacttgcgccaggggtggggcctaatttatgaacttgcgtgttgcgtgtgggaactttcctatgaaatgttacattttaggccctgtttaattcccaaattaaaaaattttgcaccatgtcacatcgaatatttggacacatgtatagagtactaaatatagaaaaaaactaattacacaaattgcgtgtaaattgcgatacgaatcttttaagtctaattgctccatgatttgacaatatagtgctaaactaaacatttgctaatgacagattaattaggcttaataaattcgtcttgcagtttctaggcgaaatctgtaatttgttttgttattagtctacatttaatacttcaaatgtatgtccgtatatctgacgtgacacgtcaaaattttaatacttcaaatgtatggcccttggtcttaggcctggtttagttcccaactttttcttcaaacctccaacttttctatcacattaaatttttcctacacacgcaaacttccaacttttccgtcacatcgttccaatttcaatcaaacttctaatttttgcgtgaactaaacacacccttttgcttattactcctgattcgaaaaaaaaactaactaaattaaatgggactagaaacatcaaattccctccgtcccataaaaaacctaatttagaaccggatgtgacatatcctagtactacaaatctgaacaaaggcatatccatattcatagtaatagaatgtgtcacatctggtactatgttggtttttatgggaagtactccttccgtcccataaaaaacgaatctatgactggatgtgacatattctagtatgatgaatatggacatatatattcagatttgtagtactaggatatgtcatattcggtactagattgaatttttagggacgaagggagtagggggtgtttagatctaggggagtaaagttttggtatgtcacatcggatatacggacacacatttgaagtattaaacgtagtctaataacaaaacaaattatataatccgcctgtaaactgagagacgaatttattaagcctaattaatccgtcattagcaaatgtttattgtaacaccacattgttagatcatggagcaattaggcttaaaagattcgtctcgcaaattagtcgtaatatgtgcaattagttatttttttagcctatatttaatactttatgtaggcattcaaatgttcgatgtgacagggtgaaaaattttggtgagagatttaaactgggcctaggttgtttttatagagtgagtgttttacaaatagacacctaaacacttaggctgtattcttgggtgagggttgggaaccctcacctcccgcacggatggattagtgtatgataaattacaccctccgttccataaaaaacctaatcttggattgggttttttatcggacggagagaataagtgtttgctaaaaaaaacttaaaaaataagttagtatgattttttaaagcaatttttctatataaattttttgcaataattataccgtttagcagtttggaaagcgtgcgtgcggaaaacgaaggagtagaggatgagaacaggcagtgccgaacaccgccttaggccatgttcgacttagaaactaaggatcagtttagcacatttttgcctccacctcctctagagctgagtctaggcaaatagtttaactacacctaaaatggatgggtggagcgctattacaaaatgatctaaaaatgttgagctaggtttagacagttccacagctccactctaaattcaactcttgaagctaaatttaggagttggagctctaccaaacagaccctaatatttcgcgcacataaaaacaaagcaacttattagcacataattaattaagtattagttaatgttttctaaaaaatattaatatggatttttaaaacaactttattatatatttttttttacaaaaaagacaccattgggtagtttgggaaacatccacgtgaataacgagagggtagaggttgagaaagttgagagaataacacaacctaagacatgtttattaggcatgtaaatattttaggatatcatcgacgggttatacccacataccagattcggagggtacagggaaatgtttgtactaggggctatgtacacgagattatatcaagcagacgaagacaatggtttatactagttcaggtccctcaaaaggtaatagctatactccaatttatatggatgatgatgggaataccaaaaggattacaatgcgtctgccaagaatggcccgacgagatctaatcggtgaacaaggctatggtttcatacggattacttctcactgtggctggtggctatgatccgctactccatggaagggacttgtatttacactgatagatgtctccctctccaagtagaactcgaagaaacttatttcgatatagggctgaacagaccttatctcttgcgaataagactcttacaccttctattttgaagagataatttatttctattatcgctgtcgtcggcgaagccggggacggacgtccctcgagcccctccgtcgagcggtgcgcttctgtcgcccgttgttgccctctccttcacctcctgccgtctgccaccgagcagcgctcttctgccgtcgagcggcactcttctgccgccctccgctgccctctcatccgcctcccgcagcatccccgcctgctgtcaccgcctagctacgtaagacaaggacaatgagggaggtgaggatgaaaagtaggccccacatgtcagtgggcccaaaattttttttgaatgacaaatggggcccatatatatatatatatatatatatatatatatatatatataattctaatgtcatataagcgtcatgtgggatgaagactaggtcaacatcaccacgtagacaccatatcagcgaaaccgtcctctaaaaccactgagagagtcaaattgcaccaattttaatagttggggatcaagatatcagtattgcggttcagggataggaatatcactagttaaggaagtcatattggacttccaccgaacgttcagataagtgggtttgcgccgaacggcgtatcagaccctgtctcgcgctaggcggctcccagccggcaatcctaaccctcccctccaccacccccacccaccgacaccgtcgtcttcttcttctcccattagtcgctactcgccatggccgcatcccgttattaccttaatctggattttgacgtttccgatatgaagcctctgcccgactactgcttttccgaggcctgggaggtgtgggaagcccatgctgatcaatcggattatgaaagggaacaggctgttttgagggtaaggaaggaaagctctaaggttgatttttttttaaaaaaataattgattgcgtatctacattctcccgaattactatcattcattcgcatggttttttggatcgttttgtgttagtacgcccgacgccgtcgccttcttcggtggacttggttctatcagggtgcacttcgttagggcttatttgtatatcaggctgtccagattagtcctggtttagaagcgaaaaaatgaactaaaattccatccaattccatgagattagtgccacccgaactagaccgaaatttcgaggggtccgtcggtagacatccctgcggaaaggggagaggtagggcgtgtcggtgggaaaggagaaatgggaggtagagcgtgttggtggggatgaccaagggctgaaccccaaaaattctagtcccacggatgggagtttgcataaaggtcgcaaaatctcagcccgtttatttttcagatttaaatctttgtgttcgatctgtggtatatatacccgctggaatgctggttagttaactaatgattgcgtggatggaacacgtgggataattttgcatctacagttctattttatattttatttttaatgtagaactgttaccggatagagtaagtgctgatatgcatgttttaggcctaagtctttgccatcttctgtttgcattaaacatcagttccttgcattcaagaaacagacgtggcaacagaagtacagtctttaagaatgctacattgtcttatgttctgaaattattggaaatgaatttgctagatgagattgcgccattttttctgataatttgtgttgtatcctgttgtatgatttttttttgtatttcattctgttactcaatttgcataaatattcaactaatatttcataatatgcatgcagttctatgaagaaaaggagaaggagataaaagctgcttattctgaagccctaagtgacgaggatgatgaggagaaagatggagaaatatgtcaggtgatgatagctatcgtgacagtctatttgtagtgcagttgagattcattattcctcatgattattgactaatggttgcatctgttcagcttctgggttacgaagaggaacatggacaagtctctgcagggatggaagatataccagaaaaccatgtcaaaaaaggctgcacttacgcgagcccagagtacctggcggagctaactcagaaaattctattggaaataaatgtaaatgaagaccttggcaatgtaaggcttcaaggttcattcatctgcgtgcttttttaaatttatcttttaggtggttgggcagtttagtgcccagcgcagtttatattgattgataatttttctgccaatatgaaccgagatgaaagttctgcacctattttccttttgtttatcttgtactctgttatgctattggattgaacagccaggtgattaatacactcttattattttctcttttttatcgaagggtaacacagttgtctcttctggagtcatggaaggtgatgaggacaagaaaactgttaaaacaggttaggtgctgatgattttaattttgatttgccgctctgtttttctttttgttcaacaaaactaattatacaacagccatttcatattgcagtttaggttagttgtcaatcatagttcacatctatctctaatgcaaatgtctttttaggtgctatgtcatgaaatgaagcatgctcgtaatgaaggaggacaagtatttgaaggtgagctggaacacaagaaggcaagaatggcagaaagctcacagaacaaaggagaagatgaagagacccttctgccagtacgtaccgtttgacttgacttgatttaattgaagtgttctcttgaagttaatttgatttccttacgagtgttctgatgggccaaacttttgtacctgaacaatcaagatatgctacttcacatttcgtatataaccaaattttgatagggctagcttggaccccttcataagtttacttgaaatgcctacttcacataagttggaacgtgcctatttaaatttgaaccaatctttaggctttcaaatcagatagaaatgctgattcaaataaatgaactgggacttttggagtgcatttgttccctttaaaactacatttctccaattagtgctgagatattgtattttttcatgaaaataactcgattcgattaatttttgaatgttctttggtaggggtgacatggcattttatggttgatctaccaactttggtatttatttgcagtgaaatttggtttctgcacagaaagtattactacttcagttatagtgttcgctcgcattttagttttaacacttttagcttgtatgggcagatggggttttgattagtcaaaagcagttatgtgctttgttgtataagatgatttcttttcgacgcaatgtggtgtattttgtcctagaaaaagttcatgttgctatccgttgagaatgggaggtttgtccaaatgtttgcatacttttggatgtagttcttgtgcatctcaattttgcatttgtttattttggacctctgttgacacccgcatgccctgaaaacttgtttgtttttgtatttagtttattattcttttgtaatgtccaaaacttttttgattggtcgcaaagcctttcttttcttaccttgcattgtgatcgctaagctgtggtataacattgtgttatttcctgacaggtcggtctgacaccggatgacatctgaggtggctaatcaatgtgattcaatagaaactcaatctgctgcagtggtcctttggtgtcccaacattgttaaaaactgtgaacaacgttcatcgttgttccttgatgtcgacttctgtctagtgtcttgaattggcaagcctgaataatcactgttggtatttttaatatggggctgtatagatatcagtcaactaaagttttattaccaagttttgctcactttttatttacggcaggcctgttaagggataatatggtccgttggtgtacatgccttagagattatttaggctgtgtgatcgatcagtgagctttccttgggtctttttaagtgggttctgttggggtggaaaagctaattcgtacatacgaggtagtggcccacatttctatttgaaaggggaaaaagtctactttgactcccttaaaaaggtaggttcgtattctcaataaaaaaaaaccgagtttgacgacttcctcaaatctcaaatattaaaacctgcacagatcaactactatgacaggattgaaggtgtggtgttaaatgatgtagcctttgatcctggtcaacactgctgtcttagttggggtaatgggaaataaagggcgggggcttcttggcgggtttcttccacgtccagtgttccccatctcgttgcttcggcaggaggtgtggctgcggcggcttcgtcgacggcgaggagggtgtaaccgtgtaagagcagggatagtgagctcgccgagtgagggctcgtcggcatctgcttcgcacatcctgtatcgggtaggcccattcgactacgagctggcagtggcgtgcaagtccaggaccaaggctgcgaggtagatcttgtggagcctagacaaccttggtcagtgatatttcaaataccccaacgtgagggtgaggtttttttcgttttgctagctaggctggttcagatttgtgttttgggctggagttctagggtttgttgttgcagtctggtgggtgcgtgcgatttctttgcttggtttgaaggcccgacgagcagtttcatcaaagaattgttactaaagatggcaggttgaaggcatcagagcttgatgtaactaggcaggagttggctacatcaggctgtgttcttttgtctgtgttaccaacaccatttctctcgtttttcgtgtgcacgtttttcaaactgctaaacagtatgtttttttttaaaaaatatttctatacgaaagttgtttttaaaaaagctaatacttaattaatcacacgttactggaccacttcgttttctgtgcgaagacaactccacctctgacagcttaggattattataatctatattattaattaagagtaagctgaaacagatagcttattatgatatattattataatctccgaccctatttgattcagcttaggattattataatctggattattaatagtaagctgaaatggatagcttagggcctgttcactttgatgctaaaataaaccttaccaaattttggcaataccaaaattttggcaatgttggcactattaccaaattctgacataatttcttatgtatttactaaaatttggcaataaactaaatgtaggcactcttttggcaattttgctaaaaaatggtatggttgaaagctagattactataatatggtaattcactctaaatgtgcttttttaattattgggtggctaacagctaacaaacagttaataatctagagaaacaaacaactaacaacttgttttatgtcggtttattataatccagtttatagtaatctggctcaataatctagattacaataatcttaaactgaaacaaacatggcctaaagatagctgtgttaaaggataggaataagttcacatgccgtccctcaacattataccgagtttgtttgacatcccttatcctcaatatcagaaatcttcacccctaaactgtacaaaaccgtgcattttaggtcccatagtagtatagaaacctggttttgctgacttagcatcctagtcgaaaaaaaagtatgtggggcccacatgtaagtgagaaaatgatgtgggcttcacatctcttctttatttcctttttctcttctcttctctccttgtcttctcagtcggcagcagatgggggagaggcggccggtggcaggcgagcgcacatgaagaaactaggcggtggttgtgcgcatcgtctgcatcgtgcctgctccgtccgccgccgccccgcgctcacacactcctgccggccacctccccctccctcccaagcttgtgaagaagagagaagaaagaagatgatgacgtcgtcatccccgggtggtttcccacggccgcacccgacggcgggggcagtggcggcggcggcagaacaacagcttggagttgagaaagtcgtagcgtgtaggccgggcaggtggctgcgccaatggtgacgacattggcggggacagaggcatcacgaggatcgtcgggccggtcatccctccgagcaaggggaggtggagtagcaacgaggaggaggtggacacccgaagggaggaaagcagtggggaggtggagtagcaacgaggagggctaggacgcagccagttgatgccggcagaggagccactcggcgccgaagcaccagcagaggaagacaagggattcgctgctgcctctgacccctttgccgccgggaactgaagaagagaataaaagaaaagagaaaattaaagaaaaaaagagatgtagacctcacatttttctcttttcacttacatgtagacctcacatacttttttatatttttttctgactaggatgcacgtcagtaaaaccgaacatctatatactactatgagacctaaattgtatgg

SEQ ID NO: 17180 - DNA, 10856 bp, Oryza sativa
  unsure (1)..(10856): unsure at all n locations
gcgctaacacactcntgcgggccacctccccctccctcccaagcttgtgaagaagagagaagaaagaagatgatgacgtcgtcatcccgggtggttttcccacggccgcacccgacggcgngggcagtggcggcggcggcagaacaaccagcttggagttgaaaaagtcgtagcgtgtaggccgggcaaggtggctgcgccaatggtgacgacattggcggggacagaggcatcacgaggatcgtcgggccggtcatccctccgagcaaggggaggtggagtagcaacgaggaggaggtggacacccgaagggaggaaagcagtggggaggtggagtagcaacgaggagggctaggacgcagccagttgatgccggcagaggagccactcggcgccgaagcaccagcagaggaagacaagggattcgctgctgcctctgacccctttgccgccgggaactgaagaagagaataaaagaaaagagaaaattaaagaaaaaaagagatgtagacctcacatttttctcttttcacttacatgtagacctcacatacttttttatatttttttctgactaggatgcacgtcagtaaaaccgaacatctatatactactatgagacctaaattgtatggttttgtatagttgaggggtgaagatttctgatattgagggtaagagatgtcatgtaaagttgaggggctgtgttcgggaggaggggttgcggcacgcaaaacgaagcctctattattgcatgattaattgagtatttactatttttttaaaaatagattaatatgattttttaaagcaacttttgtatagaaattttttacaaaaaaacacaccgttttagtagtttgaaaagtgtgcgcgtggaaaacgaggggaggggttgagaactagtactaccgaacgcagcctaatttgtgagatgtactctcttcagtcttcccttccaaaatcacacagaaaaccctcacacagaaaactgccgatggcggacgccgtcgccgcctacgatgcgctgcccgcgccttcctcttcaccctcacccgcgttgccaccgccgttccagcccccgccccccgataccccgatatccgacgccaccccatccgccgccgaaacccccaatcttcccgacacccccgcctccgcaacccgactcccccttatccgacgccgcgctcgccgtcgacgccttcgatgccgatgcctcagccgtcgccgcgccacccgacgacgacgggaccaacccgttgggcggcgccatgaagcacatggccctcgcgcccccgccgtcgccgagcaagaagtccaagaagaagaacagcaacagcgtctggaccaggcccaactcccgcaagggcaagaagaaggccaagcagccggccaacgccctcgccggcggcagcgccggcgccaacggccggcttcccaagcccttcagcggcgacgacgagctcgtcctcaccccggcgccccgattcgcggccgagcgcaacgacgacgcgcccgatctgcccgtgctcctctcccgcgtcttcaagtccgacaaggtcgaggtctccgacgaccgcctcaccgccggcagcacaaagggataccggatggtgcgcgccacccgcggcgtcgctgccggcgcttggtacttcgaggtcaaggtccttcacctcggcagcaccggccacacccgccttggatgggctaccaacaatgctgacatccacgctcccgtaggctacgatgtgtttggatttggataccgcgacatggatggtaccaaggtgcacaaagcatggagggccaattatgccgatcaaggctatggcgagggcgatgtactcggcttctacattcatctacctgatggagagctgtatgagcccaagcagcctttcctggttcactacaaggggcttcctttccgcgcagaagctcccaaggcagctgagcagaagacgccggatccagttcctggtgggtatcattgtgttacttcatgtgtctgaataaactggtggtagattgccagccaggaaaacaacacacgctacttttcacaaaacaacttggtatgaactagcaatttcacaaataataagattctctatgtaataacaaggatgcgtgtttcatgatgttatatggaatacttggagtaatgtagaatttgtaccaattacggaattaccggtagtagatttacatagataaagtgatttaggatccaggacaacagattcgagtgctatttacatgtatatggttatataggaaatattagaacttccaatagctgtaatgtgacagtggtgcacttgtcctaacaaaactaaaaagtacgtttaattaagtttttgcatcctatgtttgagcaagtttctgatctctgtttggttggacacattggtacctactcctacatgtgtttcaagtcactgcacctccattgcacaaactagaaagtagtttctactcactgctcttgaaatcatttccaaagcataaagtgtcttgtaccaagaaatatagctattgcacaaattgtcatcattattattggaggttcttagcgctgaagcatagtgaatgcagcatacagttcataagtcacaatgtaagaaagagagcaagaaatgcagcaaatgcttctctagcaatgctctcttgagaggcacaacatgaaaaatgtaacaatttgcttctacagttgtgcgtaacttattgatttgccactcaatcaaagacaagaaacacctaccaaatgttactaaatttacccatattgttctgttcaagagtatctatgtcatcatctgaccttaaattatattcttgactgtttgacagtgcatagtcttttttgtattccatactagtaaaaacaaatacctgcaacctcacttttttgagaagataatatgttcttgactattatatcctaaagtataattacttatttggttctggaatttatctacatcaaaacaagtactgcatgatatgctgtaccaatcctaactcgaaggtgcaatcttcctactatatcataggaggttacttttgggagtgtttacttatccagccatcattgcaatcttatcgtgcagaagattccattatgtttatgtgcacatgaataaaacgggcagttctttcttatctgttttcttatgatgaagtcagaaatcgatgactgtaaagtttttgttgcctcaaagtcagtaattgtaaataagtgcacattagtaccttccattgaatcactatattttgcttacatggattaaaaaagggatttcttgtttgttcttcccatagaaaaaaaatcagtatcctatatgacatttacacaattgcacttaaatgacatttcctactttctagcatccattgttagatgctagaaagtatccatcgtaagtaggaaaacaagggatgctagaaagtagcaatttgtgcagcctctcctctggccttcttagatattccattttaatactttatggttcttgcaaatgcaggtagtgagatatgctacttcaagaatggggtatgccagggcactgcttttgtggacattcctggagggcggtactacccagctgcgtcaatgtataccctgcctgaccagccaaactgcgaagtcagattcaactttggtcccaattttgagttctttccagaagattttggaggtcgatcagttcctcaaccaatgaataatgtgccttatcgaccatatcagctggcgaatgaggtgcctgcagaaaacggtactgctgaaaaaaccattaaactgcagtgaaaattctgctttagttagagcttatgtaatccggttaaacagcacgcgggctgatggctatagctggtttagtaatgtttgtctggttagatggatgctgtagttattgaatatttttcacttgatggtttggccatttgaccttcgtgtagcaacgcatgccttcaatctttcccatccatgatggggcgaagttaatccgagatgttggggggcggtaagggcggttgcacgtagtctagcagtgggatgaggattaagggcgacagtttaatactcataatatgtaatatttggtcaataatgtttggccgaatcttatcctaaggaggagtaatacaaatagatgagaggtacatctaattttatccatgttattaattcataagaaggtattatacatttttctgtggatacatgtaagtagcttcgttaacagaaaaatgtatcaatgaagctgatattatacagaaaattttctgttgcatacaaggataccagcatttatgccagatgatactcgacctggggtaggcaggtagtgtgaattacctttgaagaaaaaaaattgaaacatcaatatcataatatattataacattttttataccagtgcagtctccatgtaaagaaacacaatgtttgcaaagcaccggacctttaatttccaatgtttcatatcttaatcttaaataaacaaatacaaaaaccagcttcatcattctgcgagataacagtgttgaagagctggaagacaagtgattttctaacataaatatggaatttgaaaatcctatataagacagttgacattttgcatagttttaaatgcatgtacataccaacgtgagagaaataacttcaacttgagtgccatttgattttcagatggctacaagccagatcggttttcaatctgctcaatgccatttctcgatgttgcagcaatgaggtcatgctaggttcactccttttgcgtgccattttccgggagatgttcttccattttgattcgaattcacaggctgcagacaaataattcagttaataggaattcttacgttttggtcaaacttgaaaagggaaacattcctttcatttttatgcaaaagatgcagatggcacctgagtatttaaagcacatagacaatgttaatgtttctctctgcagaaaaagaggcaaataactaaatattttctttatgccaaaggatcaatgaacatgatgaaactttcattataccaaacaaaacaagaaaagaatgaccagtacagacagtcatgtactcatgttgctacattatttcggtatggctaaataaacatagctttctagggtaatgtcataaaataccaacctaagatacaaaataatttcagaagaaagtgcaatgacaccctaaatcaagtgaaaactgcaaagaaaagctgcacttacaagctggagcactctatagctatatgcaattctagtaacatcttaatcaagtctgaggctgttggagaatgatggttacgatcaataaccttcacttctgttgacaaagccttcaataaggcatgcgagattccatggccttccagctgatgaagctttggcgccaccttttaattcaccattatgttgtctcaggctgaaataataaaaatactgtcatcaacacacaattacaatttaaatgtggtatgactaaagatgttcaaattttcacttcatactttctaatcatgttaattgctacatattcaagcatgtaaatcgtacaagcatgagcaagataactactacaatatttcaaggcaactgcaatgtatatatggagaaaaggacaggctctgatatacagcacgagaatatcacagtgacacaaatagacacaacttaacaaacatgatgaagacaggtagagacaagagcagataacagcttatttagcagaaaatattctgcatgtttaacctacattgctagaagtagaccaaactcaggtttgattcatgtgccaatatcttcaccaaaaggagtaggactaaacaatgacctgaatttcgttctctcccaagtcccataacttttcacaacaaatcggccgcaggaactgaggtcgattccaacctcctcaatccttattatttcaaacgctctgcgctgcgcctacttgctactcatgctctaccacaagtctacaaccttctgagacatctcgctctagaaatcagacaggagtaggagacagggaagcaaggtaagctgggaatcaccggcgagggaagtcggtggtgacgccgacgtaggtgcgggggatccgggaggaggcgatgaggtagacgcaccaccccgacgccgccttccccttcgcagcctccgccggcgaactaccgggcgcgcacgacgccgacgcggcggcggcggcggcggcgggctcgccggatttgggaggaagagcgcgagggatcttcgccgatcggaaggtagcggagagcttcatctcccacctcgccggcgaggcgacgacgccgtgagaaaattttcgaattggggatatttttagcacgtgcttttttagaggagtatcaggccgtggcccgtggggcgtgttggacatgggccgaatggacaaatgggccgtaccggaatgtgagcctaattcgacacggccagtttaagcctgggaaacgtgcgtcgaaaatgaattccggcatgcttcgaacgtgtgaaaatatgcgataaatcagaaatctacgtgatggaattcggatgattatattgcagaggttgcacgtgccaaataaccgtgcatatactagctgggaaatggcatttttctgatacgcgtaggggaaaaggctcgcttgtgccaaatttgaagctgggtttgggttgtcatgaaaggcaaatggagaaaagaattaggcactagggtgagtgtaaatcagagggtggttaggcagtgcaaccctggaaagtttttccaaatgtggaatgcaagctcgcggcatgaaagataactgggcgctaattgcctctgcattactgttcctcatccaagtctgacactatgatgttcagttaacaggttgatgtcgtgtaaaaaaaataggttgatgtcaagatcctcagacatcttaatgtggaatacaaatctcttttatttctaatgggaaaatagataaccggcccaattagtgtcaaatgcataatctgaggacacctggtgtccaataatgcaacactcacatggttcttgcttgaattatcttgaagtagatgctcaatctaaaatagtcggttatcttgtactcaaaatgatctagtgcaaactggcggattgtatctttaagtccaaaaggctttctgaataaaggtgcttctgaatttcatttaacgactgtcctatcctgaaattgtcaaactgacaaccagttcagccgaactagcgcgtatttaaattgcactgatctttcatcttaatattaaaatttcctgcaattttatttggcagaaaaaactagttcatcagttagcttgcggcattgccacgtgcagcatgcaaagcacaagaccaccaaactaacattcctaccccagcatggctgcatttcactgtaatcttcttcagatataaacatgtcaatttgcttccgaagaggctggagccttgcatcagtcccaagcagagtggatcattttggaggtttggccgatcaactttcgagtttttggttgcatatagtcacaaccaaactcaagatgcatgatgaatttcttccaagaaaaaaacttttggattaattgcccgaaatgtgggagcagagaacgcgcagctatgaaagacacggtgcctgacaacgcatttcccgccgttttcaaatcaacagaagcaactctgagctttccctccatttctcatgctccctgcgtatataacaagctccatctcggatcgagcgcatgcagcggtgacacatggcggcttctatctccggagctcgcacttgctaccctagcgcggcggtggcgcgacgtggcggcggcggcggccggtgctgctccgtcgtcaggagctcgctggcgacctcgtcgccggcgacgtgcaagccgtcagggatgatgcggattggcaggcagtggacggagctccagggtgctcgtgattgggacggcctgcttaacccgctcgacggcgcgctccggggcgagctcgtccgctacggcgagttcgtccgcgccgcgtacgccagcttcgacttcgacggcggcgcgccgtcgtcgtatgggtcgtgccggtttccgaccagctccctgctgcgccggtccgggctccctgagactggctaccgggtcaccgggatcctccacgccgcgtcgacgtcggcgcccggctggctgtcgtgcaggtccagctacattgggtacgtcgcggtgtgcgacgacgaggacgagatcgagcggctgggtcgccgcgacgtcgtcattgcgttccgcggcacggcgacgtgcggcgagtgggtggacaacttcaagtccactctcacccacctgccggcgcgatccggcgacggcgaggcggcgccggcgatggtggagagtggattcttgaggctcttcaccacccccggcgaagcgcacggcagcctgcagcaacaagtgcgcggcgaggtgcagcggatcgtcagcgagtacggcggcgagggcatgccgccgttgagcatcacggtcaccggacacagcctcggcgccgcgctcgcggtgctcaccgcctacgacatcacgacaaactcccccatgcaacgccacggcggcggcgacgacgacgacggcgaggcgccgatggtgaccgccgtgtcgttcggcgggccgcgcgtgggcaacgcggcgttccggcgaaggctggaggagagcggcggcaaggtgctccgcgtggtgaactcgaacgacgtcgtgaccaaggtgccggggttccccgtcgacggcgacgactgcggcggcggcgctcgggagggcgacgcgccggcgaggaggaaaccgaggttgccgaggtggctggtgtccaagatggggtgggagtacagcgacgtcggccgcgagctgcgcctttgcagccagggcgacacggcgcgcaacgtggttgcatcgcatgaccttgatttgtatctcaagctcgtggcagcctgcacatattagttaggacctgtgtctacgctaacacagtaattaacacagtaattagcacagcttagttaggacctgtagccaatgcattaacacgttaggagtaattaacgcacgcacctcagtttgctgtcaaacggtgattcttttttttttttactgacagagaacaggaatagatcaactacagagtgacagtatcagtcattcacagtttctgtaaaatggtgattcttttgtaatgacaaaacgtaacggaagttaaaatgtcttttgacctgttcacattactgttcttccataacagttcatatactgttcttccaaaacgtaacggagtacgtcatttgcttagcagatgacttaacgcgtacattgtcatggaaaattggactttcgatgtttttttcttttcgtagtaaaacaaagcaaattacgggctgttctgttataaaaatggatgagctacatattatcactgtttcagctcgaaagcatggccatcccgttctttttcccttctgcaccggccaaaacgcagaacattacaactgtcaggtgttcatggcactgtaattcctagtacaaatacagttttacctctcgcaggataaactataagtgtctaatagcatcaggcacgttgcttcttcccacttggcatatcatcatcgtaatgcccgccatcatgccctccatctttgtcacctttctttctcgcaagtatcttgttgattttgtggaggtcattcgtgagcttctggtccttgttctgcttcctcgtcttcctgccatcctgcatcttcaccccaaactggaatgcagccttcggcatggcttccttctggtcgttgtatgtggcccactcctcttctgtctcaaagtcccacctgtgaagacggcccttagcctgcaaaggaatcatacattataatgaagctggaaataggtagtattaagttttttaaaatggatagaaaacatgagctcaagaaatccacaaaagcaagtttatctttttttttctttgaaacagaggagaaacagctcctacccttaccaaatttactcttaaggaaaagcatcagttcagcgacaggaaaagacgaaaaaaaactaaaaacatccactgacgggttacacaacaaactgtgccatcccacacattctatgtaacccctaaaacaggctaggtgaaacaggtccatcaagtccacacaagaggctaaaaagcaactttatctgctataacgaagggaaacgaaaaaaaaaaaaagcatacagaatactacagtactcacttacccggccacccatgtccatcttcgataaatcatcttcttcatcgctgcctgcaatctcatgattatactcctgataaccaggatagcactcggagtaactatccgagataaaattaggatctttctcccgtgcatctttctccctcagctgtttaagcctttcatcatcgcgtttgaaaacagaaccaagacctctgtctttatctgcttgagtcatcaaccttggatcctgggttatatttggatcagctagtacatcacagtcctgagcgctttgttgcatgtactgttctggataagccatctgttgttcgccatactgatagcctgaccactccccttgatatccagcagctaccatttgagcttgaatagcatcgtacgcattctgacatcagaagagaacttttaggaaatacaggtcaagaatagaacaagctaataaatggctatttcagtagaaggttgtaaacaaacacttcgtttgtctccaacattcgacacgcataactataattgctcataacacagtagaaccaaagttaaacattagctggattaccgg

SEQ ID NO: 17181 - DNA, 3235 bp, Oryza sativa
tttgtgtccctctcctttttctttttcttcaagactttcccagatgatccaagtcgaaggtatgacatgattttagcaatcctatcaagtacagaaccatccacactgacagttaccatctcctgcataagcaagaagaatactgaggaaaataataaatttcaggaaacttcaatgtggcatatgatgtattgccataatacctctggaacagagcaatcagctttgctcctgtgaagtgttgtcggaatatcattggtaagtccatcctcctggtttcattaatgaaattaatcactctccagctaaaacccgtagttcaaatcaaagcagggaatgatgaaaaaaattatttgcaaatagcataaatcaatagtactggacatgccacaataataggcaatgcgaacacctttactcttattatcagaaaatcatttggaaggttaaatccattaaatgaaaacattatgcatacaaaatatgatctagtgatgatttctgacttgtaagatggatcatggtcatagtgaacatactgtatattagtaatcattgaagccatgatgcatcgcaatcacaatttaaatgtgcatgacataaaaatcattgcaccagacacatgtaaccgcaatactatactatagtctataagtatgatatttgaagagttctttcatccttcctttatttcttctcttgtttgcatattgtggagtgaagtgagagtttgagcatgttgattgtactgcattccaggtgatgagcagagaaacaaacaataatacatcatgaaacatagtcatgcatcatgtatactataaaagctgacaaaacataagcatgttatcatttacatgctagcacagaattgaaaaattcgaaattgaaatagcaataacgtttatttgcaacatagcagcatcatgtttcgtacagatgaatcctgatgagagatgaaaataaaataatatattgtagtatcatattatgaaggaaaatggccaccaccaattacaaaaaaaatgtaattaacataagggggaactttgaaggaggtaccatgttgtaaataaatgccatccgaccaggaagaaacatttcattcgactttatgatgctttgtggctttatgatccattgatagacagactgcaatgaaccaagaactgcttttagtgtccatgttacattacattacatggtcaataatataagcagccaacatcaattctattgtaaattaaaaggaaacctacctttgcagctgcagtgcggaatgagactgcttgatcttcttttgtagacctgtacaacacaaattcacaggctaaatatatgtatcctagttaaatacaaactcacgaagtgcgtccagacaaggacgaaggacatgagaccatattttcatagtgctacatcccaaatcaagagaaatgcctataagcaattgttgtattattccaatgagaatgctgtacagaacatcatgtttcactgagaatgatccagcagccactataaagcatagtaaaattatgaataattgaaatgcgcagaacaattctgcttgacagtattcatccacaacaaaacaggaaaacacctactaaaattccaacaagagaaaaatggatctctctcttaacttcacctcccattacaagaaataggactaggcctaaaaaaggttgacaatttgttgtatcacaaaataattaatggaatcaactctgcgctttcataaaaattatgcaagtgatagccactgttttcaatatattacagcatttgaaatgaaacatggatctgatagcttgtctacaatacttctcattattacaaaactatcaagagaaagtataattaaatggcgtgaaactaaagctgcagtatggtgggaagtaccttgactgtgtatcctttccatcttctgcttcaggcttcttttctatttcacttcgtactttgtgaagtagagcatagtccaagcctttgaccaaatgtgtatgttccagatcacctttaagatacaaagtgaaaattaaatgtcaatcaacatggtggtttagaagaaagacaaaaaagtgccagcaatctaagtctccaaatccacaacatatatcatattcttagaaaatatgtccaactaaagtatccatctttagttttgagctatagaaccaaattctttgaccgcatataactgactgactaggtcaaaatactaagtatatgctagttcttgatattttaaaataaaaaggaacctaaaaagcaagcaggtattcgctcgtcatatttcaaataaaagatctgaaactgccacaattttgtggacataaaacagttccaaagaaagattcaatttctcatttccacagatatcagaagcaaactatatcataatttcaaccgctcgtgcagatctaatgagcatttgtctatatacaaatgaagtgtttaaaacccaatataagttgttcacaaaaggatgaaaagcattctcttaaaagaaaagggtataacactgttgcagtaccaacctccgagatatttgcttttctcaatagatatcttgtgtgcatctgctagcctgtaatacaaacaattccagatgctgagttccagaatagcatacaataaaccaagcatataaaatgtcacacaaatgaaacctgtggtctgttaccttaaatctgctccaggaggtgccacagcatgaaatgaaccaagctctgtaggttcataatcagggttttgatcttcacgacgctccttagcacgatctcgataccttggtgtctctggttcttcttttttctcctctctgcatgggaaaacaagggagaattaggttagcccgattgacttgatccataagaccctaaagagagaggaatgctggaagtagttgtaactgcatctgatttatcagtgacgggttcccatcctagcggagcagtgcgagagatgacagggccacactagtaaaaaaaatggggatttttattaagtgcacaaaaattggtactttgtggccaggtttggtatctggtttagccagggcccaggggtgtgaaaaaatcattctaggtccaaaaagaagattcttattaatcattatcagtttatcacttcctactttaacatgattacagattctgcaaacttgacttgaaatgctgcaaaaagggaattaattatcctcctctgactacaatggatctgaata

SEQ ID NO: 17182 - DNA, 1125 bp, Oryza sativa
taatgcaagtcagtgtgttgaaagcgaacgagacatctagttaagtgggatggttcagtgagtgaggcaacttgtatgatcccttagaccctaatcacagtctaacaaggtggctataggattaactgcaagaacaatgacttcagtcgtttgttttcattccaaaaattcacgaaatcacactactacatagaatctggatctcaaaaactattttgcaagcaaacagtaactatatcatcacaggttgcaacttctgatatattctttttaacaatcaacttctaataaatttctcctacagttccaaaacatatcgattatgtctctacatcgaatcagttgaaatattgcaaaataaatgcataaatacatctttcaaatgaaatgatacttacttccgccgcatcatcttctccttgtagtagttcttcttggacgacatcttatccaataagccctagcaagccggcggtgggtggggtcagcggcaggggcagaaaacccgcgtggtcaggaggcggcagcgcctagccgccggagacggggcaagctcggcggccggggggcttctcgccggcgctgaaggagacgagacgacgaggaaggcaagctgtgcggcggcagaggaagagaggtgggggagacaacaagtagcgcagctagacgtagggagagtgggggggggcagagctccgcggcggccgggaaggcgagtgggtggaggagggagggaaacgaccgaggtggcctcgccggcgccggagtagcaaacggggagacggagacgacggcctccgatgggaaatttctcgtcggaggaggaggtaggggagtccgtctgatttgcgctgggccgcggccgcgagggtaggatcacatgggctattattgggcttcgtggcgcacggcccatactgatccaaaaaattcggcccgctatctcaagtggtcgaactaacctggatccgatccgatcgtccgcgcgagtcggaatggaggtggaattttcctcctccatactggacgatccattcgttcgcgcgtttgtttggattgcctcttcttcctcccgtctacgactacttcttcacgaacggcctcctcttcaacgatcaggagaac

SEQ ID NO: 17183 - DNA, 586 bp, Oryza sativa
gagctcggtaccctttttcttttcgtagtaaaacaaagcaaattacgggctgttctgttataaaaatggatgatttttatattatcactgtttcagctcgaaagcatggccatcccgttctttttcccttctgcaccggccaaaacgcagaacattacaactgtcaggtgttcatggcactgtaattcctagtacaaatacagttttacctctcgcaggataaactataagtgtctaatagcatcaggcacgttgcttcttcccacttggcatatcatcatcgtaatgcccgccatcatgccctccatctttgtcacctttctttctcgcaagtatcttgttgattttgtggaggtcattcgtgagcttctggtccttgttctgcttccttgtcttcctgccatcctgcatttttaccccaaaactggaatggaaaccttcgcatggctttcctttggtccgttgaatgtggcccactcctttttctgtctcaaagtcccccctgggaagacggccccttaacctgcaaagggaatcatacatttataatgaagcctggaataaggtagtatttagttttttaaaa

SEQ ID NO: 17184 - DNA, 902 bp, Oryza sativa
  unsure (1)..(902): unsure at all n locations
nnnnnnnnnnnnnnnnnnnnnnnnnnnnnnnnnnnnnnnnnnnnnnnnnnnnnnnnnnnnntggcttgagcagggtcagatggtgggatgggcccatagataggtttctcttcagtgaaataggactgcttctgatggttatgtggggactcatccatatcttcagagacagggctctggctcatttccttgttaggaacagaatagtaaaccccatctccaacaaaaatgtcatcttcatctgctctagcaactggagcagacggtttctcatttttgcttaaattattatttcgagggggtggcggcggtggcatatccttttcaaattgatgtttcagagcagacccattagtttggccaggtctagctacctcatcgtagtcaccacttgctaaactgttcttccctgcgtaacaagaatcaagatatctaacttcatcgagcaaagcaagtgaagatatggatgagaaagtacatacattgcaaatacattaagtgaactaattaattcgttcataatgtaaaacaaacgtgtaacatatggtcataacttaaaatacccaaacttaaattattgacgtgagactataaaacaattgaaacaagactcaaccattgtggaaaaaagtaccaatcatacttttcttttctttttttcacaatgcaagtatcagcttccaaacaaatcatttcagcgtatttcacatattatcttaaccaagaacattttcctaatgtcacttagtttttcagtcaacttccactgcacaaaatccattttaattttcaagtaacataccttttgtgtccctctcctttttctttttcttcaagactttcccagatgatccaagtcgaaggtatgacatgatttagcaatcctatcaagtacagaacca

SEQ ID NO: 17185 - DNA, 411 bp, Oryza sativa
atagggcgaattcgagctcggtacccactgtgcgctatgctgtacgtgctggagaccgaataactgaacttgtcacaaaatgtttcctgtgtagaaaagaaaacactaacagtatcaagatcgataccgcgtgatgttgggctaacagtgcatgatagtggtctgacagacactgccacccaaacacagcggaacgaggaaacagaatgtgagctttaccgcgtgctaatacaacagcatcttgctgatgatactgtaggggagcgccatataaacgacatgacgataggactagctaagtactactagtacgcaacataatgtagtttgcaaccgtactgcacagaattttaagtgatgttacaagcaggacaactctgctgtctactgtgcacataccaagttacagat

SEQ ID NO: 17186 - DNA, 744 bp, Oryza sativa
  unsure (1)..(744): unsure at all n locations
cgaattcgagctcggtacccatctgcacgcacatgcggtacataccgatatacgcgtccctgcacatcaatcttcaaattctcgatcggctagctgctcattggtgccgagcgtcgcgcgcattcttgtcctagtcgccggagcatggcgaccacaggacgattgctgctgccccacgacatgtacaggaggctgcaggctcccacggcagcggccgcggccgcggccgcgctctttattttggcgccccaccttccagaggcctaacgctgccgctgccgtaccggaaggatacagcaacggtcgcttcggctccgtcccggcgtgcagcgaggccatcgccgccttggaggagacgtcggccggcgaggcgaaggagaaggactgctccgtgtgcctggaggccttcgaggaggagagcgacaagctgatgaggaagatgccgtgctgccatgccttccatgagagctgcatcttcgagtggctgcaggtcagccgcctctgcccgctctgccgcttcgcgctgcccacccaggcggaggcggaggcgggactgtggccattgctcacgcctggttctggttcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17187 - DNA, 1339 bp, Oryza sativa
tggcctcatgatgcatacaaagaaggttgcaaaattgggttcccaaatcttcatgctatctcccacttgttctatttctggtttatgacgattatattctttcaattgtcccatttctgtcttacaatataattatctgatattgtttcaatatatggatccatcttgtagagcctgacaggaatcaagggattatctgaagcaaaggtagacaagatctgtgaagcagctgaaaagcttctggtgtggttctcttttcattgtttttggtctgaaatcttcattacgtcagttctgtatgatttgttcttctgaaactgctatgtttgtttttctcagagccagggcttcatgacaggaagtgatctccttatcaaggtaagttaataggagctgatctgcgtactaatgcatttaaggatatggtgttatggcaaataagtggaaactattccttgcttcatggacgctagagtgcttttagttactccagctgtgcactttccctaggctgttcggtttattatttttcttattttgaagcggaagtctgttgttcggatcaccactgggagccaggcacttgatgagctgcttggcggtaacatatatagtcctctgactctgttatgatcagttgttccattatgttgttctaatctacttacatttttcaatttttcaaggagggattgaaacactctgcatcacagaggcatttggagagttccggtgcgtagatgttcatgttccttttgatattttttgccctcgtttacaactgcagcttggttgtatcaatgaaatttatgatgtgtggccatacctgtctaataaatatggtgaaatcaagcttactaatactattagtattctggtttaagttaatttgctagtgccttttcaaacctgttgtgcacccatttctatcgtctattcatgccagtgcatacagcaattcctaaacatgttctgtgttctgctaaaactgagagcttaatactgtacttctcatttgtaaacttcaggtatatacacatcaatattgtcaaactatttcctttgatgttataccaaattggttctactaaacattacatttagctgatttatcttgttttgcaacaaatttgatgtatgatagagttcttcctagaattgtatcgcgtggaacaatttggatttctgtagcacataaaacatcttactatttaattttaatgtgagccagccaaactttgaaccttgatgtgctctggagttagttttcactatttctcaatttggttccggcttcctagctttgtaatctttcacttttttggtcctcagatcaggg

SEQ ID NO: 17188 - DNA, 1379 bp, Oryza sativa
  unsure (1)..(1379): unsure at all n locations
nnnnnnnnnnnnnnnnnnnnnnnnnnnnnnnnnnnnnnnnnnnnntctccactcaggttcatttttaatacatgtttttgtcatcaccaccttactgccatagattcagtgaattattttctttttttttgttcataaactgcagcttccaattcacatgcatggggggaacgggaaggttgcttacattgacactgagggaacattgtatctttttgaatttacttagcaatagcttcatctgatccatccattcaatggatttatttgcatttctgtatctctccaacttgtttccttaatggagttttcagccggcctgaacgaattgtgccaattgctgagagatttgggatggatgccaatgctgttcttgataacgtatggcccttaatttgactttaccatttcaggcctaacaaaagaagctatctggtatatttgcatctatttcttgtttagatcatatatgctcgtgcatacacctatgagcaccagtacaacttgctccttggcctcgctgccaagatggctgaagagcctttcaggcttctggtaggcatggcttaacataaaaatacattgataagtttgtgtatctcaatctcttatgtggtagtattgttttacctggaattagattgtggattctgtgattgcactattccgtgttgtttcagtggcaggggtgaacttgcagagcgccaggtattgccaatatttgtgttggctaaaacacacacaaataaataatcataaagtagttgaaggcctaaagttatgtactaattactctgaacttgcagcaaaaattggcacagatgctctccgcccttactaagatagctgaggagttcaatgttgcagtgtacatcaccanccaaggtgtgctttcaggactaatcctgtctatcccaagaaagagtaactcaataaggaatttcaaattacaagtgtctttgtttcagtgattgcggacccaggtggtggaatgttcatactgacccgaagaaacctgcgggaggccacgttctggcgcatgcagccaccatccggttgatgctgaggaaaggcaaaggagagcagcgtgtctgcaagatctttgatgcccctaacctgcctgagggagaagctatatccttttgcattgtgcatacatgtttactgaaactacttgttcaattggttaccttggttcagtatgctgctaaaatattgattgattttttctttgtccgaactttctcctcaaaactcttgcagctgctgtttttcccatctgaaaaaaaaacctgttgttttccatcactgaaactctgaagcttcgcatgacagattagcaataatgtggtgtaaaaaaaattgtttcccttgaccaa

SEQ ID NO: 17189 - DNA, 1072 bp, Oryza sativa
cgagctcggtaccccctgaagagaagataaagtgaagtgaagattagggtttcgtcctggttcccagccgtcgcctgtggtgttgggtgttagaccgttggttccgctgctgctgctgctgttggtgtttcctcgtccgcgtcgtcggttgtattctcgggctgtctgagctgcaacctaagttaagataaataagtcctctatttattttaaggattgctatgattcatatttgtcaccgtgggtaccagcactatgtcctgggactggtaccgagatcgcggtttcgtaggaagcggttcgcgccgttttccctacgacacgctcctgtcaggtgccgttttacggcggtatcagattggggtgtgacatcctcgggccgccaccacgcaaatccaggcgagggagggccagatccggccattggggctccggatccgccgcctcctccccaccttgccgccgtggccgccacggaccacgccggtggggagcttcgtcatcttcgtcctttgcgctgaggagggagacgccacgaagagaagaaggcctcaccgccgccttccctgcccgctgccggctttgccgccggcgggctccatcggcggccaggtggggggagggaggaaaaggaggcgcgggcgggtagggtttttcgcccccgagccgcccgacgcggggggagggggggcatcacttcccgtttattgactgctacaaatgaaaattattgttctatggatggatatactcccaattgtactagtagtaattaattggaaaaaaattatactgatatcctacaaagctgcatgccgatgcattactgtcgtacgtatcaaagcagggaaccgatgatagacaggaattcctcaaattgacatcccgccatacatcggcaaagttttcagtaacagaacagaaaccaacatatatgcaaccaaaggaaaatggttcagcttagctaccattaatttgaacttgcatatttatagagtgatatattacatgttaaaacatcttctcaaatttttttcataactattagagtgacaagcaaacaacgaggaga

SEQ ID NO: 17190 - DNA, 1645 bp, Oryza sativa
acataacaatgatgaagaagaagacgaagcaatgatatgcatccgtttcttgttccctgagtagattagtttaatgttcggtattcagcaaggaagcacttttttcccgctttgttatgtttaacgatgaaactagaagaaagtgtagttgctcatacactggggttatgatatcttttgattatatagagagtattcaccgtgcatctttcatgaaggcaacttcttaagttaaattatcggaattttttaaacaaaattataatattaatcgctcgtgagaccaacttcgttgtagtttaagccattcttcagattggagttaaaaatttcttgtcaagtggaagaatttcagcgccgagaccttctgaatcgaaggccaacatttcgagttgaaacttatattgttctgaatcgaaggccaacatttcgagttgaaacttatattgttttgagttaatgggaaaacgttgcatgtagaggtggccactgcagatagcggcagggtcgacacaggcacgcagcaccggaacataagaaacgaattcgaggcagaatcccaatcagatcgaagaaacaatagtgatgtcccagttaatcgagagtgattcggattccgatctgcctcttacaaaaagaaacgattctagcagcttaatcagcaatagctcaatactctgttggttttgccccatagccaccgtacgtctccgatctacgttcgcggccaatccagtcacatatccacttcaaaactcaaagcaacaatggccgatgaacagatcagagacctgaacttgtcggagacccatacgttgctgctcatcaacctttatttgtcacacgtacaggggccgagctacgttccacacggtgttgaatcagcatacatccacatcaatcgtgatatcgaagaagatgacgacacgtacagtgatgacgggttctgcgccgtcccggcctccagcgacgccatcgctgcgctgccagtgccagagacgacggtgagtgagaccgagacgagggaggaggaagcatgtgcagtttgcctagagggatttaaggagggtgacagagtcaagaagatgccttgctctcatgacttccacgcgaattgcatctctgaatggcttagggtgagccgcctctgtccacactgccgttttgctctgcctgctgagagggattctgaacagaaaaacccagaaggggaagcgtgagatagagcatatatggatttatggttattggagtttggctgcacattgtaatgtcaaaaacataattggtattaggagtttacaacgaattagaaattaatttgatgcacatctttttttgtccatgcaactatgcaaggttatttttattttgagtaaatttaggcagtacagtggcaataaaggaacacggagactataaagtgcacctcatgtgcttcctcggtgagatgggccgtgccggcctgtcacgaacaggccgactgtgcttgggcctgcgtcccccacccatgcgtgcgtgcaccaggaaaaagtacactgaaggtccctcaacttatcatcgagttacaaaatcatcctccaaccgcaaaaccggatacaacgcatcccccaacttacaaaaccagtgcaaaccaggtccctta

SEQ ID NO: 17191 - DNA, 1630 bp, Oryza sativa
tcggtgtactttttccgcgtgccccacgaccgagttcgaacttgattccgtctccgaacacgatcagcatatctccctgcaaagctcttcaataaatctctctctctctctctctctctctctctctctctctctctctttgtttattttgaaaaaagatattccaacaataaatcttgcagtctaggtggtatcactgtatatcaatctgttcgttctgccggaatatggcgggtgaagaaccatggtcaagcgaggcctccgacgatgtccccgacacatcgcacatgtcggacgaacaatttcaacagttcatcgaccagtactgggcagagcaaggattcaacatttggagttggattcgtgcttccaggacgtcgtcaagctccacgccggggccaaccaggcggacggcggcgtcatggcaggccgtcactttcgacggggacggcgtcgcgcgcttctccggcaactccgaccgtagcggcggactcgacgaccaagccaccagcggcttcagcatcgtggacctactggacggtatcctacaagcggatgacgacggcaatggcggtggagctacgccggcgtcgagcatggcgatcgtaaacctgccggagattaccgtcggcgacgagaaaggcgaggcgaaggactgcccggtgtgccttcagggcttcgaggagggcgacaagcttaggaagatgccgtgcgctgattcgcactgcttccatgagcagtgcatattcagctggcttctgattaaccgccattgcccgctctgccgcttcccgttgcctgctgagacggaggaggatgaagaggtggtccaggcagagaacgacgacgacgacgatgatgaagagaccatcctatgtctgcatcgactgttcgctgatgcggctgatgagtatacgagttgatcagcattgagagatgcaatttcagtttttgatgtaaatatggatctgaatggctggaattgttcattacacaattatgccatgtgaaaagagaatatcacgattaattaagagaatttttgagattgctaatgcgcgcgcacgcgcgagatcagcaagtcacgagcgtttcggcgtttgacatggtcctgctgggcctcgtgacttcggaatcgctaattcgcgcgcctcctcccacgccttttttacgtttttttaccgatttttttcattttttcccacttttttctgatttttttaatcttttagcatgttttgagtttgaaagtttttaaattttgagtagaaaatttttaaatctgaacttgaaagtttttaaatcttgagttgaaagttttcaaatctcgatttgaaagttttcaaaattttcaaatatggacttgaaagttttcgactctcaagttaaaagttttcaaatctcgagttgaaaattttcaaatctcaaattgaaagttttcaaatctcaaattgaaagttttcaaaatttttaaatctggacttgaaaattttcgaatcttgattctcgagttgaaagtttttaaatctcgagttgaaaggtttcaaaatttaactttaaaatttaaaacttaaatcaaaagttttcaaatctaaacttaaattttttcaatctggtagtaaaaaaatct

SEQ ID NO: 17192 - DNA, 4810 bp, Oryza sativa
  unsure (1)..(4810): unsure at all n locations
nnnnnnnnnnnnnnnnnnnnnnnnnnnnnnnnnnnnnnnnnnnnnnnnnnnnnnnnnttttttcccacttttttctgatttttttaatcttttagcatgttttgagtttgaaagtttttaaattttgagtagaaaatttttaaatctgaacttgaaagtttttaaatcttgagttgaaagttttcaaatctcgatttgaaagttttcaaaattttcaaatatggacttgaaagttttcgactctcaagttaaaagttttcaaatctcgagttgaaaattttcaaatctcaaattgaaagttttcaaatctcaaattgaaagttttcaaaatttttaaatctggacttgaaaattttcgaatcttgattctcgagttgaaagtttttaaatctcgagttgaaagttttcaaaatttaactttaaaatttaaaacttaaatcaaaagttttcaaatctaacttaaatttttttcaatctgttagtaaaaaaatcttccaaaaaattctccagaatctttcctaattactatcattagtgttaagtatattactaatagaggtagttaaggcttaagagggggggagtgctcgctagcgacgcgcacgcgctagctaggagccccctcgtgacttatcaacgcgattcagtcatgtatgtatatatgctccctattaacacattcaattagtatcttctggttgtaattggacaactgacgtatatacatgcatgcagtgattagaacatttaactaaactttttgacataagatttaattttaaaattgaaaattttgaaaactttcaactcaaattatgaaaactttccactcggcattttaaaactttctattcaaatttgaaagttttcaactcacaatcttaagaatttttcatctccaaattcaaaaaatttcaactaaaaattcgaaactttcaaatcaagttacaaactttcaagtcaaatttgaaaaactttcaactcaatttttgaaactttcgactcaaatttgaaaactttcaacttcaatttcgaaaactttcaactcaacttgaaaacttctatgtcaaatttcaaaaagttcgaatcaaaatttaaaactttcaactcaaattttaaaatcttttgactgcaaatttaaaactttcaattacttttcaaaaaaaattggtaactgaattatttatgttactgttttaaaaataatgctaatgacggtaattaacactaatcaccgtaattaccggcgtcagctcgtggactactagtgagggggcgcgcgcggctgtgcgagttaagaagctggcgcgcacgcgccccctaggaagccctgagaaatttacagtataatatactacctatatatacttgcagtattaataaaaggggttaagtccattttaccctccaactcttcgttttgtctaaaatacacccaaaactataaaactggatatttcacaccctccaactttcaataccgttcactttacaccctcaagtggtttttcaactggttttcaccaacgtggcattgatgtggaagtccattcagcaaataaaaatttggaccacatctcagtccatagccacggagccacttcttcttcttccctcatctcctcttccctttttctctctatccttcttcctcccagagcacgagagcagcggcggtggcattcttgagcttgtggagtaggagatcggtggcggtagagtaggggactcgttgcggcgacgaggctcaagcacatccccagccttcccttctgcgctgactgccggcgagacccaggacaaggtccgcctctcctgtcgtaaccgagctcgccggtggagctagagctgctcggggacgtagagttcgacggtggcaacggggcttggggatgaggaactgaagcttgacgagacggcggcggctggcggatgcggatatgagcttgagcttgtcctctaccaagcgttggcggcgctccatagggaggactcccccccctcgtgtgtagctccggtgaggtccgcctcttgcgcgcggggcagcaagctccaccgtcgtcgccactctccttgccggtgaccacctctgcaaccctggcagccccaccgtcctcgcagcagctccacaccaccgccgccaacggtcgtgaggaagagaagcacgaacagggcagggagagatagagaatatgggcttggcccatattacctcgtgggctgacgtagcgagggttgacgtggcatctgacgtgtcaaaaaccacggtaaaaacagttcgggggttaagtgttcggtattgaaagtttagggtgtattatatctggttttgtaattcgggggtgtattttggacaagcataagagttcgagggtgtaaaatggacttttccctataaaagggtatattagcaatatatcagctttataatgtaaagatgaacttgaaatgaagtgcaatttattactcgtacaaatctcacatgttccccacttcctgtacaggatatgcactttcacctgggcaccctttttaagtgaagatacaagcacagccaacaggcacgtcaacagcatccgcaaaggctccgacagctgatgagcagtgactcactggcagcgaaggcagcaggcggactccaactcggaaccagcattaccatccttgattactgatttcaattccgattcgaactagctcgaacacagcggcgtagtcgcgtgcgtggtatgcgagccctagctataaatctgcacgcacatgcggtacataccgatatacgcgtccctgcacatcaatcttcaaattctcgatcggctagctgctcattggtgccgagcgtcgcgcgcattcttgtcctagtcgccggagcatggcgaccacaggacgattgctgctgccccacgacatgtacaggaggctgcaggctcccacggcagcggccgcggccgcggccgcgctctttattttggcgccccaccttccagaggcctaacgctgccgctgccgtaccggaaggatacagcaacggtcgcttcggctccgtcccggcgtgcagcgaggccatcgccgccttggaggagacgtcggccggcgaggcgaaggagaaggactgctccgtgtgcctggaggccttcgaggaggagagcgacaagctgatgaggaagatgccgtgctgccatgccttccatgagagctgcatcttcgagtggctgcaggtcagccacctctgcccgctctgccgcttcgcgctgcccacccaggcggaggcggaggcgggactgtggccattgctcacgcctggttctggttcggggacatgatcagcattctaatttggcaattgtcaccgtgcatcatcaagcatgcacatgtatatgatttcttttgtaacctggctcgatcagtttgttgactcggccgcacggaaaattgtaacaggcaaacgcagattgattaattctttgtagacactataacatatgccatagagatgacccttttttttttttacattcatagagatgacccttaattttactgaactgttcgctgttgccgctttgccatgctttgatcggagtaacgccattcctattgggagatgttcaggtgggccagcattggcatcgttcgggagcccgtttagaaggcccaattccgtccgggaaaccggtccaattgccgggcgaacgacttggacttccaaatgggcttatgggccttggctttgtttgagtcgaagctggttgattaatcttcggaggaaaaagtacaacgaaggtccctcaacttgacatctagttacaaaatcgtcccccaaccgtaaaaccggatacaacgcatcccctaacttataaaactagtgcaaactaggtccctcgacggttttgaccctaattttgtccgacgtgatggctgactcatcgtatgacccacgtggaccccacatgtcaggatgccacgtcagcagggcggcctctccctttctctcctttcctcctcctctctctctctctcacagacacacacacaaccttctctctggactgggcaggccgggccggcccgcgggtggggaggagggcgtcggcagccggcgacacggcggcagcggccgaggcggcgacgacgacgacacgggagaaggtggcgacgtctccgcgtgtgcgagctcggggacggagcggcccgggaggcaggagaaggaggagggccagcgggagaaggcggccggcaagggcggggaaaatcagacgagcttcatctcatctccgacgacgacgagctccaccaagaacgtcgtccccctctcgccgtcgtccctccccttcggcggctgtgatggggtgcgcggcgtccgcgacggacagcgctgcgcggcagaggccggtgcggtcgcctggccaccgcgagacgtccaccgccacgggcatcttggcggtgcgccacgagcccacgacgaccagcagtaggatgggaggaggcggcggcgatggcgccaccagctcgaccggccgccgccatcttctcgacgatggcgcacggggagaaggcccggtaggtcagtgtgcgcgggcacgggcgggcgtcactggcagatccgggtgaggaacacgaagagggagagcaggaaggggacgtcggccgcttcaggaattaatggaccggcgacgacacgacggcgggggcgacggtgaggtgatggctatcctcgggttcgccatggatgggtgggcggcgagttggtggtggtggtagcgcccggactcgaggaggaggttggaggaggccgcggcgagggaggagc

SEQ ID NO: 17193 - DNA, 1553 bp, Oryza sativa
ggcctgcctagaggaagatgagtgagatagggaaagagagaggaggaggaagccagagcctgatgacgtggcgtccagacatgtgagtcccacgctgactcaccagtcacgtaggataaaaatcagggtcaaaaccatcgaatgatgtaaaacaaacggttttataagtttttgactgttttttagaaaaaatgcagcgtcataaatatagattaatcttttctttgtagacatatatgaaattctgacacggagctttggtgctcactgtgtcttctgcgagtgataaatcacatactctctatgctgaaatggtgcgccgcttgcaactattctggaatagttaattgctgcgaatatgctacaatatacttatgtcacgtcggtaaagatgcatgcatgctaatatttttaacaaaaaaaattaagtggtcggcgattgctcttgcaatttgcagcagtcgcaacttgcgaacgacgaacatgcacgcatgcaatgtgatcagttcgtctgtcgtcgatgctgtgtcgatgagcagtacgtacccaagcacagtgcacactgccactctctttgtgtgcaagtggcagtggcctacactacacacatactagtacagcaatgcgtatgtctcgttgcttttcacggtgctgcagttctaatctccttttggtaagtagcacgcacgaatatatcgagatactcgcatgctgtcacgtatggtcggcttcttcaacatggcctactgatagaattggggcaatttggcaatgaggtgagacgattatatattctgttcttcggtcagcagaacggcgtccacggtcgattacactgttggtcccataagccattaacactgtcactgtaggcactgcatgttctgaatcagatgagctgagatatagtcagatgtctaaacagcggtttggctacacgggactccaaagggtgatcgatcctatgcacgaacaccatattgccatgcaagctcggatggcttcaggaagcatcctcgcctcccggaaagtgtagatgcgtactccctccgtcttaaaaaaaaaaagacaaaccctgagttttcgtgttcaactttagctgtccgtcttatataaatttttttataattcgtattttcattgttgttagatgataaaacataattaatattttatacgtgacttgtctttttattttttttttcataattttttcaaataagacggacggtcaaacgttaggcacggaaaccatagtttgtttttttttggacggagtgagtacgagcaaggaacatggctgattgcatgactgctcatacagtaccgtgcccaaacttttgctaccctttcacgatcgcgtcagcctaacagatcagtagtagcatatccatcgcctacagataaaggtagataggcccatatgcactcgatctcatcagctagcgtttcacgatcagttctctgtctaccaatctaaaaaaagatgacgttactgctgctgtgtactgtcaggtacgcagtacgaactcgcgccggcagggggcgagctt

SEQ ID NO: 17194 - DNA, 3763 bp, Oryza sativa
  unsure (1)..(3763): unsure at all n locations
nnnnnnnnnnnnnnnnnnnnnnnnnnnnnnncgtcttaaaaaaaaaaagacaaaccctgagttttcgtgttcaactttagctgtccgtcttatataaatttttttataattcgtattttcattgttgttagatgataaaacataattaatattttatacgtgacttgtctttttattttttttttcataattttttcaaataagacggacggtcaaacgttaggcacggaaaccatagtttgtttttttttggacggagtgagtacgagcaaggaacatggctgattgcatgattgctccgacaggaccgtgcccaaacttttgcaaccctttcacgatcgcgacagcctaacagagcagtagtagcatatccatcgcctacagagaaaggtagataggcccatatgcactcgatctcatcagctagcgtttcaagatcagttatctgtctaccaatctctcgatcgatgacgttactgctgcactgtactgtcaggtacgcagtacgaactcgcgtcggcagggatggaggcaagcgagcgtgcgcaatcggtcgcaaacagcagctagggacaggtccattatgtgatccgtcgagagagaaaggggaagcagcacagagcactggagcagcgtcggctctgcagttgctgtatgttactgagatggttgaacgagtggtggtgattcttcagagttcaagctagctagtgtgcaagatggaggcagatgtgtgttggcttactgcatctgaactatgcactgtattctgtttcgattgcacactcatactcttaggtcttttagacagtcaatagttgcatcctgtgaatgtgaagtctgagatcatgcattcactgctttcttggtaataccggatggtcaagcagtcaaactttcttgcatgcaggtcccgtttctgagcatcactgtgtgctatgctatatgtactgtagactgtagaactgaacttgtcacagaatctttccagtctagaaaaaaaaacactaacagtatcaagattgataccgagtgatgttgggctaacagtttatgatagtggtatgacaaagactgccacccaaacacagtggaacgaggaaacggaatgtgacctttccccgttgctcatagaacagcatcttgctgatgatactgtaggggatagccatataaacgacaagatgataggactagctaagtactactagtacacaacaaaatgttgcttgtaaccggtatccacagcattttaggtcattttacaagcagcacaactctgctgcctactgtttacataccaagttacagatcaacaaaaaagagggaaatgcactacctatgcgagaactatttttctataattttttctatgtttagtctttcttccaagataagagcagctgcaaaacgacctaacgtcagcaaattgattctgaaagcagccgaagattgatagggtatcctttgagagttcgtgtggtggggaagaagacaagtctatcttcttcggtttcttcccagctgcaaattcattggtcaagttgttatggaatcagactggtgcccaatttggatcacaatgtggaaaatccatttgcagattatctacacctttctggctagcaagatagcgattgaatttgagagattaaggtggcttacctaaagcgcgttacaagatgatggaggaagatagaaacgacaacccgggcaagctcatagccaggacacaaccggggtccaccgccaaatggagtaaatatattggcccctaccgcattctgaagtttattgttgatctgcacaggaacaaatttgttgcagatagcttcagcgtgaattttacttttgtagcacaggacataattgaataagtagacccaatagcaataacacagagcccctaggagtacctgccatctccaagggttaaatgtccgagcattctcgtagtgttcattattaaggtgcacagctcggaatgaagcaaaaatcttgcatccctttggaattgtgtaatctaagaaacaaagaaaaatgccatacataatgagcatttctgatgaaaaatgtatggggatttcttttagataatgaataaaatgtacgtggacttagtatagtttatattgaaatacctttataatgaatatcagtgtttgctcgcctgaatactccactaataatgttacccacacggagtgtctcatttatcacctgcagaaatgttaacccttcatttaatcatgatgtgagtaaaccaactgtaccgtttcaaaggttcagttaagagatgccatttacactagatggattcgtgctgttggcatgatatttttaggagtagctaatttttaagaaaacaagggctttccaacttacacattgagtaaatggcatggacttgtaatcgctccactctagtggttgttttttccctttcatatccctgatattggcatgctcttcctgtaaaatcagcaggatatctggaatcagttacacatgtagtgaagtaaaaaataccacttggaccaatcttgaggactctcaaagcttaacatattggaaacaaaacttgtaccaggaaaagtcatgaagttcagatttctaagatttggacctattgtgatattattgctacgattctctcgctttgttgttagactgaggaacctagcactcatcaatgcaagtaaataaaatgagaaaaaaataaaatgaggaaaccagagtactgactgaactgaagattcattcttacacagttaaactaaaagaagtcaggactcaagaacataaatggttcgagtcaataataaattaatactcaggatcaagtattcaagtcaataacaaaccaggaacaaagctgtagtgaacttgactaaaaacaacagaccggaaatagaaagtagaaacttctcttttggacagaattggtgtgaaagatagtctaacaaccatatttttaacaattaacactcaactataataaatgaaattcctccctatttcaggcgttatttgacaattgacagcacctggtacctactaccgcacgtgtatacaagaattgacaattactaccaaacaactaatttaaatagttttataccttgagctcagctagcgcagcaggcgtctcagtgaggaacttgaccgcgagcgtcatgagcatggacgtagtctcatacccagccaccagcagagaaaggcagaaatccaccatctcttcctccgagaagctgccaccctccgcctcaagaagctcctcaaccatgtccttcttctccttcttcccctcatcatccccaatggagccaccattctccgctttctcctccatcctcttctttatcacctcccgcagtgcaccggccaccttcttcctcgcctgcaggaatcaaatcatgcaatgccacatttttatgagagatataagagtacatcaatagctgacgccaattcgttgtaaggcaatgtaagatgcatagggaaagattaaaaaaaatgaatggaggcaaaagaacgagcaccttgagggcctggccgtaggtggtaaaagggaggaggttggcgagaggaaaggggatggagaaaaagccgtcgatgagcttgacgtactcgcggcggaggctcttggtccacggtcccggctcgatgctgacgagctgcttgacggtgaggttgaaggtgattttcttggcctcgtccatgaggcgcacggtggcggcgggctcccactggcgcatggtgg

SEQ ID NO: 17195 - DNA, 4573 bp, Oryza sativa
catgaggctccgacaaccagaggatctgctccaaagggtaggatgtttgtggggtatttataggtggctgattaaattattgaggaaagaggttaataaaagggattagtttagatttttttggagtggattaattattaatttagagttagatgcataaaataatgttgtttggtccaaaaggggaatgtatggggcagcatgcgcatgttgggaaaatatgatagaatgacttttgagaaaaagaacatcagaacatgggagtttcatatgcaggaatcgtatacatgcatcatatcataaaaaatattcatattagaacccaaaatacggctttgtagcattgaagagattaacctatggagaacctatcctgatttgtagctaaaatttaatatatttaaacgggggagtatggtttatgagagaggggctacttctcaatgaactgaaagtcctcttcaacacgttacgttagtaaggttctcaaaataaaaacttttcacccatcacattaaatgtttggacacataaatagagtattaaatgtggaaaaaaaactaattacatagtttacgtgtaaattacgagacgaatctttttagcctaattacgccatgatttgataatatagtgctacagtaaacatttgctaatgataaattaattaggcttaataaattcgtctcgcagtttcctaatggaatctgtaatttgttttgttattagactacgtttaatacttcaaatacgtatccgtatatccggtgtgacaaccaaacctaaaatttttccctaactaaacaaggcctaaacaatactttagatgttaatatgaatatatagctaaaagttactatatactttagatagagggagtatttcatgatagagaaagtacatatctttgtaattcaaattagactataaatatacctatatttgagctacaaatatgtatattttgagataaatggagtttgggagttctaaatataaaatcgaggccacatatggaacgaatttcatgaaaattaaactaagaactccgaaagagcatgtgtggggttagaaatgtgatgtgacggcctcatcgtgcaaggtgcaggataacaatgttatcagtagcgacatactactatagtaatgatagatcacacacgcatgaattgtctgttgatgatggtgttatttcggtggagataccattttgtaagcttgtgcatggaatatagtatggcagttgcgaccatctgcctgtctactgtatctcaacagtaactcgtgtgccgcacaacgcacgaacaggcaggccgttcgcacacaaacacaacggctggatcaaatccgcacccagaggccgcgcgcgcttttacccatcaaccggaacggccttgtggcgtacgtgtggcccatataagatgggccggaacgggactgtggtgtacgtgaggcccatataagttgggctggaaggtgtacgtgcgtgcagtccatataagttgggtcggatagggactgtggtgcaggtgcggcccatataatttgagccttaactggactggaatgtagctgaggcccatttgtgttggcccataagtggttcggccgccggtcgtaacgttcatccgtgtactaagcctcgcttcggctacaaaattttcgtgcggacggaaactattctgacttttctgagcatacgatcgattcgcacgtttcacatgactgcatgaatcactctccgttactgtccattacaatcagcagcgatgtgatacagtgatagtactggatgcattcttgctgttttcgtcggttgcttgtacagctgtactgaagagacgacgttcatatcaaatagtacgtggaaatctgagaagatacccaagcccaaactaaatccgcgtttgatgatacggaatcctccacgctctgttccgttcggtcccaggtgaagtccacaccacacgtacatgcaaatgcaacgcaagcgcgcgcgtacgtacaaactgggattgaacaggtcaaggatcgaaacgcgagccaaaatgttcacgacaaaagagcgcggcagttgcaaggaaagcgaaaggcgcaagcgcaagtgggggaggaatcgggagcgtatccgcggcacaggaaaacgccactttcgtggtgatcggcagcggatactccgagcaaaatctctcgtctcctctcctcgcgctcatgtcaaaaccatcgccgccctggaaagcgacgcggcgatcgaacgcgatatcatatcgaatcatctccacttctcgatcttcttcagttggccgtgccaggcgtcaccggatccgcgccttcagatttgggtgactccgcgaaccacttcgcgttccatgtgttttgccttcctactcgctgagtcgctgatgatatgataaggaaagttgctggctgcatcgccaagatttggctggggaaagttggtagcaaccgagaaatcgtccgatcaggaggatttcttggctggtgtggcaaccccatccgatccgaggatttgaagcctgattatattttaatcttgttgtacagaagatgctattttactaatcttcttgtacaggagatgcttatcaattattagcagtttgtttgtggctagatcagaattcagatatgtgccagcatgaccattagcggttaatctttaatttgttctctgaggcatggatgtgtgcagtattattcccatgcaagcatgcgacttcacataagtttgatgaaacgatgtgtgacagactgacagtgtgagtgtcaagaaatgactgtgattgtagcaatatatgtgttgatgtacagcaacaaatctgatgcagcaaactggcaggtcacacatggagaagaattttcttttgctttaccaaatcgcctaaaacgatccgcatctttcagtctttcaggtcatccaacaagaggacaacccaattaactaaaaactaaagaaaaaaaggatttgaaaaaggggatagggagcaaaagaaaatggtggaccatctttcttgctctagaatacaaagagtactactgatgttgccgggggcctattctttgtggagtcaattcctggcaagatttgcagcaaatctgcccgggatcttgctttccatgaggcaggattttctttggtcattacacctgttttccccatcagcttttcttcttttttcatatctccaagaatcctttcacatgcttatgtatatatataagctcaaccacacccaaacgcccttgtaaagcaaagcctttcatgccaagcacacacaccatctgcatcttctcttctaccattcttgctttctccttgtagtctcttctgttctttcagagaagagaaaaacatatctgtgctagctttgccttcttccatggcagtggctatagaggctccgttccatgtcctggctgtggatgatagccttcctgacaggaagctcatcgagaggctactcaagacctcttctttccaaggtattacaagatttttcttttgtgcttgcagactcttttcttctctcggttgctgtatgaattggcatctgatggtaggtttggcttttgtttgtgtagttaccactgttgattccgggagcaaggctctggagttcttggggctccatgatcatgaggacagcccaatttctactcaatcagatcagcaggtaagaagatgaatggtaccataggtgctaaccatgaaaaaaaatacggattaacaggaggttgcagtgttctttgttctgaacaagagtttctgaattgctcttttatggattaacaggaggttgcagtgaacctgatcatcacagactactgcatgcctggcatgacaggatatgatcttctcaagaagatcaaggtaattaccatctctgctctatttgattgtaccaaccatttgatttgatctactcaagatgacagtgaggtcagttcctgaatacagttttttccctttgggtttgttcaatcaggaatcgtcttatttaagggacatcccagttgtgatcatgtcatcggataacattccttcaaggatcaataggtgagcactcttatggatctaccatattatttcgaccatctattacaatacaagcatcttatgatatttggatgaacatgccaaagtcagatgtgcagataatttagtaaaaacttagagcacaaaaaaggagaacatcttcgtatgcatatagagaaaaaaggtagtggaaaccttatcatttgtgaaaaataatcaaatatagaaccaagctggtttaaggctaaacttgatatggagatctctccgaatccttaattgatttggagtcacatgcagtataattaaggaacaagccccacacagctcacgtcgtcttaatattctatctcgacagttttggtgtaaaatcaataatgaagatatggagtgatacgcaaatcaatcttgtcgatcttccatgatgtggtgtctaataaaatggtctttagttgcagacaactaactagcaccacatgtctttgtcacaatatattctattatatatgtacaaca

SEQ ID NO: 17196 - DNA, 2613 bp, Oryza sativa
acaacaaatggagcaacaagagggcactctaaaagtaaagtaaaatatcctccagatatcataagatatgaataaaaaaaagaaatttgtaatggatagtacatggagaataatcctgtgtttaatttctggattgcatatcatggtttttgatcttagaataaactctgatacagttttgattttgttatctgaatcagatgcctggaggaaggagctgatgaatttttcctcaaaccagttcggctctccgacatgagcaagctgaagccccacatactgaaaagcagatgcaaggagcactaccagcaggaacaaaacctgcaaagcaacagcgaaagcaacaacagcagtaaccccacaagcgagaacagcagcagcagcactagcagcaacagccacaagagaaaggcagtcgatgaagaaattttgccccacacaataagaccaaggcatagttgatttagcatctgactggtcatttgacactgattttttttcttgcttctgtctgatcggtttttgacatacagattcgtaaaagggatactaacatctagtttacaaaatagaatggaatccgttaacggatactgcttgaattcgaatgggtgattctcagttcatcacattgtgattttaagccagttaagccttcaaattcctgctgagattaagggccactgaaaacatcttgtgccatatttgttaaggaatatcttaaaaccactaccaaacaactttaatgggcaagtttcccaactgcattcaggtaaagttcccaacttaaatgggcaagtttcccaactacattcaggtaaatttcccaactttcatgggcaacagggcaagtttcccaactacattcaggtaaatcacgcaaagaggagtcacatagatgatagatcaacaactagtagctaataacttactacaaccttcatccataggaacacatggatccctcaaaagacgcatcggtatgccacacgcttcccagtaagttcaccgtcatatataactttaaccacggttcccttgtcaaagccatagtagcgagcaacagcatcagtctctagcatgcgtggcaactgaaagatacaagcaccatttcagcgaagtgatgtaaaggtatttcaggacagtaattttagtgttaaaaatgccatatattaatgaccggaaggagtaaaatggtagtgaaaacaaaaatgatttggctttgaggcacaacaagattccatctaccaaaacaaagaaaattgtccatttctcataatgaatataaagaggatcactggtatgtttaccacataacaaggatactgcaataacaaatatgatgcagatcaacatgtgactatgcaaataatgtagaggatcaacatttatagcaaaacatggcatattgtggatatgggaaatttaatacactcaaggggacctgtactgtacatggatgtatgtgccctttgggctgaccatacaacttactattcacattagcaaccatattttacaacaaatgtagttttacaaaagcatcacattatttgattactgacataaaaaattggtaacagattctaaagccctgttgcaaattatagacaagcatacctgtgagtcttccacattgtattccttgaagagcttggccttttgatctgcactcaacacttcatgcttgggtttcaggacatgcttagtaatgtttaccagtaaatctgtggcctaccattggaaaaacacctcaatttatgtgtaaaccagagtatattaacaaattataagacagtaaacaaaacgtatgcatgattaaagtcacgaaatattaatccgaacatagcattattggtttaagagcataacttgcagaagcatgtatatggattagatatatatagcattattgccagaactttccgttggaaaaaaggccatagaaactaaacaaaaacaaacctggaatatgtccactttaaatttaaagatctccttgatagcctctctagctctagataatattttgctctgcagtatcagaacaagcctggacaagttctcttcttttgtttggagatatatctctcggatagttgcgattttgacaggctctggtggacagaatacaagttgtacctgagtagtgattgagttagagtttattttaacccccttaccaaaaggtaacaaaaatagacactccaagaaatagcattatgcatggaaaaagatatagacataagcactctaacagcaggcgtggaagtataccgattatgtaagcattaagtttcaacagttacataataaattgaacccatttaaagatggcgctatgcatggacgataaaaccacaagaatactaatttgctaaaccataataaaaacccctaccagatgcagggtttatccacttttttgcctatttgcaaactaacaagtaggagtatatgatatcactggaacacaaaaaggcaaatgtgccatcgtaacatactctttatcatacgcattagcaatcttttagcaaacttttttttcctgaaaagtatatttcgcattccacaaaataatttaaacaaccactggatagtactataacacaa

SEQ ID NO: 17197 - DNA, 1919 bp, Oryza sativa
cggtggtgctctcggcggtttctattgaggtggcggcggtcgcgctctcagccgattctattgtcgtgaaggattgctggtagggggaggagtgactcatcttaccctctttttatgatgaactaatatttttctgtctagctaagtttttagaaatattctgatgagatgaaatagagtttagaacgtgtttatactataaaagtatattcgtttttataaatgtctaatataccccatagaattttggtatgtccgatttgcccctaaacgataataatgaacgaaatctgtgctggactttttaaaccgaataaaacggggttttagaatgtatttataggagaaaagtctagattaccgctctagtttgcatttgtccgatttgcccttgaagtctaatgacggagaagacacgtcccaaactattcaaacctgaagagaacacgaggtttagagtatgtttacactactctatgtctaccttttttgacggttaatcttcacatatcacaactttggacgagctattcgaataaagacgatcactttgatctataaaaagatagttttggtaggttatagaataagagatttcctaaataacgctcaactgttttgtttatacaacaataatttaactcctaacatttggttagtacaaacattcatacttcaacttttctctcttggtgagcttatcgacttcagcaacaacactacaatggctaagataaagggtaaaatttcaggcaagttcgggggcttgtggaaaggttaaaagtgatggagttcttatctaggaagaatgaggtagcagttgaccggcagtaggtaacaatgaagacgatgcaacgaggatgtagcggcaccaccggagtcatgaataggaggcatgtggtgggcgggatatgcagccgagaaatcaagtggcttggtgatgtggaggaaatctcttaaaagatgatgtagagacatctcgctagatttgaaaaagataaaaacttgctttgagaagggagtggatatatagaggaaagcagggttaatgaggcgagagaaagcagtcaatgagggctcatcgacgctggtggtagcaccgttgaggcaaggacaacaacatgtctcgcaattttcaaaccaaacaaaaaagtttgtagagacatctcactagatttgaagaagatagaaacctgctttgagaagggagtggatatacagaggaaggcagggttaatgagtgcgacagaaagcggtcaatgaggggttgtcgacactggtggcagcaccgtcgagacaaggacaacaacatgtctcgcaattttcaaaccaaacaaaaaagcaaaaaccgtgtatcttaaggaagtaaaaggaaggcaaaaaccgtgtatcttaaggaagtaaaaggcacaaagatataagattatctattgcatcacaacttattaaccgagagctgggccttttttttaacaaaatactcatatagacattcccctctaatttgtccctaaactctaataacggagaaaaacgcatcccaaattcttcaaaccgaaagaaataaggttttagaataatttttacactactgctggtccactccctttttccgctgttaatcaccacttatcacaattctaggcgagctagaagcaagtactagtatattattatcgaataaaactatcattttggtttataaaagctaattagactggccaaatctttaatttcttgaagcgcatcaaattggtatttcacgcactttatttctgctgcaaagggtacatgccatttctcttgataaaacagaccatttagtctcataataggcatggatgttcccaagtataaaagccttcagcaacaaacgcgtcagtcagtactaagcactgatccaagaggaggagactaaa

SEQ ID NO: 17198 - DNA, 3210 bp, Oryza sativa
ccttgttagggtcaagctccatgcgtgctttgttatatgcatctactgggaaacgtttcctcaacctagcctggagttcagcgagttcatccttatccttaggaacctaaagagaaatgaagaaatgttgatcagtacggtatggatattgcaaacaaagcggactggacagtgctatcatgcatcatgctatgaatacaatgcaagggaggtcattctctcgaaattaacatgtctgacgttgtttttttttggcggtgaacatgtctgatgttaatttcaaccattctgcagcaatggactgtactaacaaacaataaataaaaatagctgcccagatcttgcatcaagcagtgaaagttcgcacctcaattttggcccagtgttcatatgcagaataaccatcccatagatttgtttgcgtcttacttctgtaattaaaaatttcctctgtaatttccttcctttggcgagcatccgacgttgggaggtacattattatcccaacctgcacattgatcacaataaatcaggtcactaaaactgatgttacagactacaaagtgaaactgcataatgttggacatttctcaaagaagaagcactactacatcagttgacagtaccgataagaaaatctcgaaaaaagagaaattgcacagttctcccggaaccagttaaatatctatatacagttagttgcctaccatgtattcaataaatattgctcgattgtggtttataccttagaaattctagagggggcatagcaaatgttgcagaacatgtgaacagatcatctacattgaagttgaagaaaatatttttcgtacatgtaaacagagtaccattgaagcaagagggagcatcctctaaactatatcatatgaagaaactagccaaattccaagtgcaatcaatgtggtaatttcgagcccatgagagcaaatgccaaaggttctttttctattgtttaaatatgtttaaatatgtaataatatattataagaaagactacctatatctatatgtagacacatttgctgtcagaaatgcaaatgatagctattgtagatttgtaggcagaggaactatctgccatcttgtatatcaattgcccagtccaactgtttaccaagttatccaatattcattacaacaggaaacaagttagcagtaaaatatataaacaaccagaggtggatggtggcaacaaggaatccttgttaaatataatgaaaaaggtaatgtgcagagcaaattacccatgaaaatatgtcatcttcttgagagcttgatgctgggctcatgggactcctgctgcaggcagtccaacgctgctcaataggtgccggtgcgggtatatcttccttctcaatcaactgcagcagctcctctatataatccagatccttcatattaggctttgctagggtccctgcagggaagcaagtttcagaaacccactgctgcccaccacaatcaaagcctaatatttcgtcactccagcccatgcgataaccctctgacttcttccaatattcagcttctgctttgttaattctgatcacatgatctttgtctagaggatccagggtaagcaaccgatccctcaattcagtgaatgaaagctgatctacttctgggtcattactttctgctttagttctgaaaagcatctacaagatggcattagctagaaactagtgaaatgctattgctgagtaaagctagaatgtttagtgcaaaagaaaaaaaagtaccattgagtagatatgtacagtgcatacagctacaggttgaatgcagtgcatattgttttgaggtagtacctatatttcttcaatgactcatgataaagatcacgaacatgttgtatagcctcatcctttccatattttgaggtaaactttggagttctccaccttgaaggaggattgcattggacaacaacaactgtatcggtgtatggaatccataagtacttaatatgtttattttcagagagccatttcctgagaaaggaggggagtgaaagaaagtcagttttctccagtaaatgatgacaaaattgataagcaaaccaattccagacatccatttaatgatcagaatgagataacattacttgtgatttttcttgacttcgtctgcattggaaacgaaagtgtgttcaataagttggtgtctttccacacattgaagagtaacttctgctacaactccaaggccaccaagtccacagcgagcaagatagaataaatcaggatccttctcccttgacaactctattgtccccttggcaggggtaaccaatttcatgctaataacttgttcatcaattggtggcaatcttgcaccagtgccatgggcaccaacctgcaatcagtcatgaaatgatcatctgattccgaggtaagctgtacagaaatgcatatggcctgaactgcatgttaagtcccatctatttattctggtttgagtaatactccctcgtttcatagtataagttgctttgaattttttcctagtcaaacttgtttaggtttgaccaaacttatagaaaaatttagcaacatctactataccaaacaagtttcattaaatgtaacattggatatattttgacaatatgtttgttttgtgttgaaaatattgctacatttttctattaacttgtcaaacttaaaaaaaatcgactaagaaaaaaaattcaaaacgacttataatatgaaacggaggtagtacttctttatcctccctacctaatccacaaacacatcttccctaacaagcttaagccaactttcatcgaagggaacaacatacagtagatcttatttccatcatttcaacagtaaactcagtgaatgcttataaggtagccatgtcattccatacatgagaatcaacagatatgtgataacagagtgacaaaaaaaaagttatattccttgtccaaatacaaggaagaacaatagctgcggaagttttcagtatatcggaatgcaatgccatgttaagaacaaacagtgaatgcatttctagcttccccaaattactatcaaatgcataaaaaattacaacaagattgtagagtagagataaccgtgacatttttccgatttgttactttttgttggatgactatcgtctaatcagaaagcctctctatctcaccaatttatctgggaaagttctattgatgtc

SEQ ID NO: 17199 - DNA, 1928 bp, Oryza sativa
aagcccatatatctaaaggcccaatggctgcaagttagtgggccgtactagcattccgtgggcccaagggctgcccgactccgctgccaaatcaaaaccctagcttagctttcccctttgctcgaggtaaaaaacgatggcgcccaagaggtagccggacgacgacgacgtacgtgggggaatcatccgacgagttcgcaaatccattcgacgacacgatgcagttcaccaagccggtttacctcgtggcggtgcgcgacgacgaccaggcggccgcctactccgttctgaagatcgatgccgccgccgttgccggtaacgacgagccgcggcgcgtccgcgccgtcgccgtgctgacgaccggcaccgagcctggcatgtccttcgtcacggcgcgttcgaggcacgggtcgtggattgtcggcgtcgccggtgggctaagagccggcaccatcatcttcgacccgggcaccatcatcacgcggctcggctaccccaagcacaagcccgtcttgatctcccatggcagcgaggtgtatgccatctcaggcacccccagagtgaagccctccatggactgcgagccatggtttgaatctctcagcttcaaagatggtgtcccctccaaggagtgcggccgttgggtctcatggcatcacctgccgccaccacccttcttcccgtgtttcttgaatccctatgaatttcgcaatccacctgaaatttttcagtctcatcctatgctgtcattggctcatacattttgatttccccacagccggaactagtggtaggtacttacgcttttcatgtggtgaacaaaatttgggagaagatccatgaaaagaacctgccttttgttggtcaggcagtgcaccttggcggcagcctcttcgccgcctgtcccatatccaacactgcctcaacctcaacatctgcctctgtgttccacatgtccatcaaaatctcctcgtccattccctcattatcaatccaaaagttcaaggtgatggcatcagtggacaagattaccttcccgctcttctgccccatgggaatgggcagcttctgttgcatcaggttggggccatctcgtctccggcacagacgaaaaaccaactatcgtcgctggcgcagcccaaaaaccagctgcttgaaggaggtccatgttatctcgactgcctttcggatagagaacattgaagctatcatgactcattgtcagtcccaggaatctaaggctaaggatcagctacttgcactacaagtgaaggaacagatgcattcatgcgaatccaaggaaatacatggtttgctgggttctggcattcctgtggttgctgccctctccatgtaagcacatgaggagtctccctcttgttcttatctattatactcccatttagtttgtgattttattcaagtacacatccgaattcgctgaaacaagacagatatgaatgtgctttgactcggtccaatttgaatccaatcagtttttttttttgagaaagagggcgaagccctcccatttcattaacgaaataaaaagatccttgaatccaatcagttacaggtgacaaatttcacaacaatgtgttactacatcagtaaacaatttgctactagtataaaggttaaggcatcttcactgtaggccgaactactgagagtgatcacctcattccagttctgtcggcttcttcacgtaagttgggctttgtcgaacagaactagacagccagactctgtccattctgattagtgattacttgtgcttctgagcccatcccataaattcacaattgtgacttcataattaatatggaacttttcgcattaacacaataacacagattatacaacagatgcaatgaactttctgcatgattcgtctccacgtctccagaaaaaaaaaaacaaagagt

SEQ ID NO: 17200 - DNA, 4632 bp, Oryza sativa
atatttgcagctaaacgggttcttaaggaacatattctgaaataaaggtgccaatgggacttacttatatggacaaaatagcgaaagcaaagggagagaacccatgggatgaacaggaaatcttgaaggcatgttcctattggttgcagactgtaacctctggcttcacagccaacaatgtttcctctggagcctccaatggtgaagtgttctctgtttgataggttctcaagtctacgtgtgccttggttggaaaaaaatcgaggttcttggaaagaatcacgctgttgctgtcaagcgagaaacttaaggaacagaagagtccatcctccaaggaaaagaagcatgaccctgcatcaacttcatgttccatgtatttcaccgggagcacaacgatggataagcaaggatcatggttcttgtcagaagttgtgacattgatgcgataagcattgatgggcccattatcctttgataagccaaggaacacagagccatgtggggcggcgcatccggtgaaaggtagcttcttgttgtcaaccttgtgccacttgattgagttggtgtcaaatgcatacgtgccccatggctgattgaatgataccaatatgtaggcatcaaccaccacataggacatgacgattacaaccggcagcaatgtgtaatctaccgggcgaagcttccaagggaagcaaggtggatgtggtagcttaatccaggaacatccctccaggtggtagccgcggccagcagtagcagcgacgactttggattgggagagatcgagtagctcgaaccatggcgggaaatcggggtctgcaatccaggagggggacttggacatggcataaaccttgtcgcccactgccattagggcagggcaccattttgcggagttgagagcgggcccatggatgaccttctctgtcctcgtgtcgaagatgatggtgtcgccgggatcgcccccgacgccaacgatccacgcgcgatggatcgaccgcacagaggtgaagctcttaccgccggcagcggtgggcaggcgggtgatccggcgcaggcgcttccgcttcgcctgcggtggagatgaagtggcggtggcagtggcggtgacgcctacattgtatacggagtagggcttagaatacctggaccaatcccagtggcacgccacaaggtagacagaccgaccacgtccttcatccaactcatcgccgacgatccccggctggttgagatcctctgttgcttcttgcatcggctgatcgcaatccgcttgatcctcgtccgaatcaccgccgatgatccccagatgccccgactcaaactgatcggcgtcttccgtttcttctagctctggatctgtaatggatggcttgggcttgtcatagaaagccttgccccttgctccatgacggtctctcgtcttcctcttttcgctgcccatccctggtctatgctgtcgccgagaggccggaggaggaggagatgatgacggcggcggcggctgcggctgcttaggacagagtaaggcccaccaaacacggaaaggaaaacaggcccaaacaaaacaaacggctggactctgttcagtctgattatacttctgtttctcagcccatctcacaattgtgagttcgtatttttttttcatcttttgacattaataacacagaatacacggtcatggtggatattcacggaacttctctatatgcaattggtagcaatacggatggatatagctcctgaatatgcaatgacagcctatgtttgacttcttcagtgttcacatggtttcacactgaagaattaacaaacttgtatgataaccagaaagttaattgtagtgataaatttctatagaaagtacatactcactagtacatattcacttttgtgtacgttgaaacttggacttgaggagtcaagccactgctctctcttggccaattcgctgaactttcatagttactcctgccccattatcatctcttcaatacataaatagagacgaccagccagttgacgcctcatgcgtgcactataaattcaagaaccatgcagaaaccagtactctgttcacgcagtgttagtatagctagtgctacctaagcatttggttttcattatccttctttcttatttgttgttctcattcttatcactgtgtttctgcggaaatatgttcactagaagtctgctcgtccatatgacgaaggtgttcctacctctgttccagcctctgaattttcttctctgtgacaagcacaacacacacagcacatgcccatctgaacattctgaaaccaaagcaagaacagagctcacgcatggcgatgtcgctgtggtaatggcagcgcttgggctcagtttcaatgcggagggcaacgaggtagaggatgaagctcttgtactattagaagagaagcaagcgagctgggaagaactagaggaagctttcagcgtgttcgacggcgacggcgatggattcataagtcccctggagctgcagaatgtgatgagaaggttgggtttgcagcacgacgctggccatgaggagtgtgagagaatgctcaaggttttcgacagagatggcgatggaatgatcaattttgacgagtttaaagtcatgatgcaaggagttgtctgagttttgttttttttagagaagatgttcatcgccggagctgcctgagtgactactcgatctgaaacatgcacatacgcggatacgcccctatcgatcacctgaggctgttacttttgtttcttgatttgaacaagtaatggtagctgagctgaaccattttcccttggttgcctatgctggtttctgttgtgttaccaaaaaacttttgccgatgtatggccacatatcaatttaaggagttcctgtctatcatcggctcgttgcttttgatacgcacgacagtaatggatcggcatgccactttgtactgacagaatatatttggcaatcagtacactcaggagtaataaaataattaattttcactagaccttacatgtggtggtatacttgcagaaatatacgaatgggctgggaacgggccggaagctccgtcctggtggtttcagcccatcattttttttaaggaaaaaactgaaggcgcgtctcctccgttccaccgtaatcctgtcctttaccttctccgatccgaatttccttccaggtttccgtgtatagcctacacctgtgcgcctatatattccacacgacgacgacgactcatccccaattcccccatcgattcttcgccaccggcaacatccatcgatcgatctcagatcgcctcctcttaccaagcagagagttctctgcgcaaaaacgcatggatccgacggccgggacaggttcctccaccaagaagatccctagttggatggtaacggagctgccaatgctatcgacggaggccaaccgcttgccacagatccctagttggatgataaggaagccgctaatgctatgtatggaggccggccgctctggcaaggccgccgccgccgccaccgcggacgccatggagcagagctgctcggtgtgcctcaagaatttcgagaaggacgactgcatctggtcgatgccctgctcccacactttccatcagctctgcatcttgggcgaccgctcctgcagggtctgtcacccagctgctccgccgtccaccgacgagaaaccggaagcccctcggactatgcattgattgaatgaattcgcgcggaatcagtgctttgtttaactgatcaatgtcgtggccgtgcaacaaatctgcatttctctgaaaattgcaagaaacatgcaactctctgagaacttcattatctgaattttttgtctctagttttcctgcgaatcccttatggaatatattttttgtctccagttctcccatgcatgaatcccttatggaaatttttatcgaaatgtttaaatttacatagttatatacttctgctttcttgatcttcaattcaaagtctgtaatagctctttgcattatccttctttttctctgttctcattcttgtttctgcgcaaatatgttcacggtacaagtctgctcctccatataacgaaggtgttcctacctctgatctgatgtctgaattttcttcttttctgaacattctgaaaccaaagcaagagcagagctcgtgtcagaaatttcccaagatcaaactcaccaaaccactcaccctctgaatctctgaatattgtcggatgtgtacagtacactgaagaactcagaaaacagagacacaagtgagatggatattgatacctcgaggggattgtctcctcgttgtttgcttgtcactctaatagttatgaaaaaaatttgagaagatgttttaacatgtaatatatcactctataaatatgcaagttcaaattaatggtagctaagctgaaccattttcctttggttgcatatatgttggtttctgttctgttactgaaaactttgccgatgtatggcgggatgtcaatttgaggaattcctgtctatcatcggttccctgctttgatacgtacgacagtaatgcatcggcatgcagctttgtaggatatcagaataatttttttccaattaattactactagta

SEQ ID NO: 17201 - DNA, 7357 bp, Oryza sativa
aagttgaacggagtcaacgggaagagcggttgggaagatatgaatttggaagtttaatttggattttctggtcaaggaaatgatttatcggaattttctggaatacgagaaatggtttatggggtttgaagaaataatattcccaagaatattattaacagtcactgtcatgcgggaccaaaggaaatgatttgtggaattttggaataaggaattgatttatgggacaaaggaaaaaggatttattaaatccctggaaaaagaaaaggatggagggatgtcaatcagacttgtctcgggtggcattggcgcggcccgagggacttgcgcagctcgggcgagcctaatgggccggcacggcctgcgagaagggcggcccaatggggcgcggggaagagagggacggcccggtggaccgattccaccgcgcggggtcccgggtggggcccgcttgtcggtggcacggcccacggtgggatgggcgcacgcgaggtgcggcgcacgggtttcgggtgcgcggggcttaggagcggtgcaccggttggacggatggcggcgggcccatatgcagtcgcacggctttccgtggaccgcgcgcacgggagggaagtcggagggaggggacgactgaccggcttggcccagtcaaagccgaggtggcgccgacgtggcgcctacgtggcagccacgcgggccggcgggaggaggaagaaggggaggccgagatggacggcggacggcggccgtgttcaccggagcaagcgcgacggatttggtcttcggggagcacaccggagtgacgagggcgtcgagaaggagcgagccaacggctcggatttcgccggagggagtttgtcggcggtggaattcgacagtggcggccggcggcgagagaaaggggaaatcaccgaggggcgacgaggactcaattcgaggcggtgaaagcatctccggggttcaaggagtccgcttccggcgtcggatggggcggaagagcaccaaggagggctggcgacgagcggcggcctccgggagcgggcggcaacggcggcgaggccatgccgggcggcggcgggtctagggaatggtttggggaggtcctagggagctcaaggacggtggtggcgcgaggtattggcgagagggcccacggcggctcacaggcgggcgcggcggcggtgaaccagagcaacggcggggcggcacgtttaaggggacgagcgagcacccgaatggctcggggcttatccaaaatgacgcagatggcgagaatttgggcgaggagctcaccggtgtgcgggaacggtatcggcggcgatttggggatggaaaggggtggaaggccgatgacggcacgcgaccgagcggcggcgcacggcgaatgacgccgaggcggcgcggcgtctaggcgagtgcgccggggaagaagagagggagaggtggcgcccggagctcctcgtcacgcgttcacgctcgcaccggctcctccggtgctcggcgacggacgacgacgacgagagcgggacaagcggcaacaaggcggcgatggtggttcggtggtaatggcgctacagcggtggagactgaagcggggaaattgagaggagggactcggccttataggcgaggaggagaggtcggtttggaggagggaaaccgacattggcagtcaagggatgcaagggcgacgagctggcggtcgtcgacgcgtgcagccaaggcggcggcaggtgatgacgccggcggtgttgggcaaaaggaaaaagaagggggaaaggggcttggtcccttgccaaaacgagaaaaggaggagggagagtgaggaggaggaggagagggagagcagctgcttctcccactcttggacgggtgcggcgtgaagtgcggggggcccatggatgacgtcgacgatgacggcgccggtcggtttggcatgaagcggggccgggtggctgcgcggcgcaggcgcggcagggctgacggcggcaatgaccggccggtcggccacgcgcgagcgcgggaaaaggcgaaggcggtggcgggttctggccggcgacggcgggaagcggcgtcggcgcgggagagagacatcgagagagagagagaaacagcgagagcgagagagacagagagagcgagcgacggctctctctctctcggctcgcatgcgtgcaacgcacgtgcgagggtggggggaatgatgggctgggagggggagatgggccgggggaggagaatcggcccatccaaaatcacagggaggtaaggtagacttttacagagaaactgatttggatagaattggggagatttagggtttggattcgaattcaaatttgatattcgaactcgagggtttagggatgtatcaagggaaactcaaggagaagtcatggaaaagatttaaaaggaatacttgggtatttgtcctcgggaacatagggtggagtcaaggaaaggattcgaggcgggatttggataattctggattcgtagaagtatttggcgaggattcaagggaagggattgaccttcggatttagatttcggagacttgaatcggaagaggaaatttgaggcggaggattttgattttgatgagagggaacaacgggatttgaattgagatcttggcacaacttagactcgcacacaaagaacgaaaattttcgcaattaggatttttgccgaattagtttttaacgacccacgaaaagcggagcgttacagatccaccccccttacaagaatctcgaccccgagattcgaaggtggaccacacacacgaaaccaaaaaggatcttcagacttcttcacagcttcaggctctgctagtctttcttcaacttattgttgtgtgcttgccgcaaaacggtatggtactctgactcacttagcattcttcatcttactgtggctctgctcttgcctgtggaacctgttcttctcctgctccttcaacttgctcgagattcacaacttttccgtttgtttctacttgcacatggttcagacgaccttgtccgacgggcggtgaggtcaacgaggcagaaccactgtttggtgactttgaactttttggtccagatacgttgggaaggcttgttgttggttggactcgttttgacttgactttctgagggcagcaccatgaatagtgtcccatctcatggcagatgaaacattcgactcctgccttataaccacgtctttttgaaggtgtagggcatggtacggagttgcttccttcatggctattactgttgatcattgtggcttgctgaccaggttctgacatagtcgaacgagacgtagaaccggaactagttgaatgctgagatgctttctgatagtattgtgctggcgagtttgtttttcgacacaaatcttcttttgcttgaatctctagggacattactttgcgtctcttgtattcttgcatctctttcttttcttggatgtcttggcacatgtcgcaggatgcttttgctcttttgtcatcagggaaggttgaacgtactgcattaacatttggcgaatttgggcttccttggggatagaagggcatccttgaggtgctcatattagcttgtagtggtgcatccatatagggtttttgggggcagtgtctcatgtaatggccaattttgtggcaaatgaagcatatgaatccgggaacgtgtctgatcttctttgatttgagggtgggggacttgggtaagttttggcaagattgcattgtctgacattgtgggacatcttgcatgtcaacttctgatggcaaggtctttcttttgtgacaacttccttctttaatcatgctattttctcgcgatacggatttattgattgagttctgaaggttggggcaattattagctcgaagtggggttttcatccctgtaatcatcacatttaagaattctttgttcttctctttatgggtatcagtgccttctactgattgtgttccttgtatttctgcggcctcattcttactcttgtctggattcaccttgggctgtggtagtagcagttggtgttgtatagaagccaaattttgagctatttcttgtagcatctgagtctgattggctagaatctgataaatatccattgaggagtgttgatttctggttgcaacttccttgtttggtccaggaacagtattatcagtcttggcaacttggttggtgacttgttcagctagttgatttggattttctgacaaagctgggtcttccttagaaccaaggtagttgcggacacaagtctgacaggttggttgaggtgccatctgcttcagagggactgagatctgaccaacgcagaaagtagataagaagaaaaggaggaaaacaaaaacactacatcaaaacggttttcgaaatcacagaagacataggtggtgtgttccagccggtaacccaactggtctaacacctgaacacggactaccaaacaaaactcacacacgcactagtttaccacaactcttaccgagcgggtgacggtactaaggttagcctaccaacaagggcttaactaagactcctaaaggcttgagcacacctttcttcaactgggcgtgaagacaggtttactctaggatataagtcaaaacgaacgactagcttctacttttggacacaaaagatttttcgcaaaactagagctacaggggacaacgacaccttagctttcacaaatagtttttgtattcagataatgccatcctattcaggggtttcgatcctagggccaactaatgctctgataccatctcttgtcacaccccaatctgataccgccgtaaaacggcacctgacaggagcgtgtcgtagggaaaacggcgcgaaccgcttcctacgaaaccgcgatctcggtaccagtcccaggacatagtgctggtacccacggtgacaaatatgaatcatagcaatccttaaaataaatagaggacttatttatcttaacttaggttgcagctcagacagcccgagaatacaaccgacgacgcggacgaggaaacaccaatagcagcagcagcagcggaaccaacggtctaacacccaacaccacaggcgacggctgggaaccaggacgaaaccctaatcttcacttcactttatcttctcttcagggcggaggaactatatatatatttatagagcaagggtgagtactttcgtactcagcaagtcacgggaacttaggtgtttaatgctagcttggaagagaggtaaggttgttttgcaaatcttttgtttgaaatcattttgaaatcactaagtgatttatttctttctatgtttgggcgaaaagagacttgcgtctcgattcgactttaagagatgcttttcaacagctcatttagcaatgtaccgacctcccgggtcagatcattacttctcggctcccagagccattccacttgattaatcggctcccagagcctttttcattttctcggactcccagagcccagctgcccagcagcacaacaatccgcttccactcgggaagcctagtctatgatgcccgcagacatcccgaatcacacagattcgtttctgaccactcaggtcgtccatctgccacataggctgattctggttacgattcccacaccacaacaacttttcacaaagcacaggcaaacaaatctacgcaacgggaaccacctcacatccgcccatgaccgtgggcacggctgttcgaacagttagttaacctctgcagaggggtacactttacccacaagatacgaacttattccgaacacccgtcggtatcggaggttcgcaacaaagcctttccccagccgacccagggttacctcatgccacatagaaggatcaaatcctcacataaacataggccattttaggcgttcacaaatcaaactccaaccacctcgatcggtaatctggcaagcttcgcgttcttgccttaccaggaacccggtttggctccaaccgaccccgccccggcgttcccaactattggcatgcgaggtttccctgaaccgactagctacttagccagggtgtcccattccaccttgtggttgcactttgattatgttcgatgagtttctcacaggaatcggtccttatatgcgaatacgggacagtaccacataggcacaacccccgcatcgcgagtttttcacaattcattttattttcaaacacaccgacaccacatgtcgggttttgaaggcttcacaaacccatttcccaagttttcgacaaacaacggtgtatgtgggatatttagtatacgcgctcagagagcacgaataccaaggtaccacaagggtggagcgacaaggaaacagggtagtacgacctacggaaattagtgcgactactgggtaggtccgtcggtttggcatggaaaccgaggccaagcaagttaagtgtgtgattctaataatgcaagttgcaaacgaaataataatgacttttcaattataggagcaattgatcaaagggtgacttgccttgctcaaggtcttcacgaagcttcacgaatcttcgagaaaacccgcgatcgacgaaaatccgataaccgcaactatacgcaaacaatcgaaaacctaaacaaaagaccaaaagaaagatcctatttagactaattagtagtgccattaaatagatctcaattttacggaattactggaagttgaacggagtcaaacggaagagcggttgggaagatatgaattttggaagtttaatttggattttctggtcaaggaaatgatttatcggaattttctggaatacgagaaatggtttatggggtttgaagaaataatattcccaagaatattattaacagtcactgtcatgcgggaccaaaggaaatgatttgtggaattttggaataaggaattgatttatgggacaaaggaaaaaggatttattaaatccctggaaaaagaaaaggatggagggatgtcaatcagacttgtctcgggtggcattggcgcggcccgagggacttgcgcagctcgggcgagcctaatgggccggcacggcctgcgaggagggcggcccaatggggcgcgggggagagagggacggcccggtggaccgattccaccgcgcggggtcccgggtggggcccgcttgtcggtggcacggcccacggtgggatgggcgcacgcgaggtgcggcgcacgggtttcgggtgcgcggggcttaggagcggtgcaccggttggacggatggcggcgggcccatatgcagtcgcacggctttccgtggaccgcgcgcacgggagggaagtctgagggaggggaccactgaccggcttgcccaatcaaagccgaggtggcgccgacgtg

SEQ ID NO: 17202 - DNA, 1670 bp, Oryza sativa
agggttaccctctccttttcttggcgagcttctctgggtgaaaactacatcttttagatgggcgatggcggcatcctggatgtcgtgaccaccatggtggcatcgtttttggagcctcgtctctgtggtattgtcgtaggcctagcggcgttcgcccacgcttagcggggctcgtttggtgctaggtttcaccctcagcggcttgtgcttgggtggtagtgcgtggtgtgtggcaatgcatcttggtgcattttgatgttttctcttataacttttattccttcttaatatactcgggtggcctcctcggccttcctggcggaaaaaataaacgggaagtggattctaaactctcgaggtgacatcacctcgttgtttgtatgtcacacaaatctctactattataaaaattaaagatgtttttaccggtactttggtacgttatccgtgaataaatcggtttttaagttcgttcgcttttagaaatacatctctgtatttgagtcgggttttaagtctgttcgcttttggaaatacatatatgtatttgagtcaagttttaaatttgttcgttttttaaaatacagaaggagtcgtataagaaatctttttagaaaaactcgcatgctaacttgagctgatcggacttctaattgcaactcatgattttctagaaaaatatatatccaagcgaattcccacagtaaatttcaccttaactaaactatataataataataagattaaaataactttcacccgttgtaacgcacaggcattttttctagtgaataaaaaatttagaaaaaaaatcaataagatagattaatatatgataaatcacttcacaaacatgcaaattcaaatttaacttctacaagttgtagcgaaaaaccaaattaaattgtgggtagttaatgtatattcgcagttaaatttgttttttttttttgcaacttgtacttatggagtgatttatcacatattaatctatcttgatgaattgttttatttcttataacaatttaggtttaatgcaaataataaaggatgtcccctcggtagtttaaaatagtttcccaaataaacgggccatctgaccacacgtttgccgagctggccaactccggcccggaagctccgttccggtagtatcagcccatcatattttcttcaggaaaaacggaagtccatcatattccaacttggcatcctatgcttccgcgtccgcccatagatcccacacaaatccgtccgagtccgactcatcccaaattccccggccatatccttttcttcgcctgagatcaccacctcctcctaccagcagcgagaacaaccagacggaggagggttaccccctgcttctgcttgcgttcgcgcacgcatggatcccacaaccaccacgacagattccgagtgcgacttcatcaagaagatccctagttggatgataaggaattcgccaatgcattgtatggaggccggccactttggcaaggatgccgcctcctccgccgcctccgccaccgcggacgccatggcacatgcactcccctacagcgatcttcaccacctgagagtcgccaattcggcagagcagagctgctcggtaaacatcaagtatttcgaggagggcgactacatgtggtctatgccctgctcccaca

SEQ ID NO: 17203 - DNA, 2852 bp, Oryza sativa
ttagcctggttttcttgggccaagccaataagagaaacaaaagggatcaacagatttgagaattcgtaattcagtgtatatatagttcctgaaaataattcagggagggtgtccataaaaatgttacagccggtgatgattgttatcattttttttttaaaagtagctatgcctattttcattgtattactgttttatgtatgacaatgacagtgtcccaatatttcccagaaatgctctagtttaactaaacgtcaggtttatacactcagtgtgacacacatgttgatgtatggtcccttgcctgatgaacatcagtgttcttggaccatatgatcttgcctgacgaacatcagtgttcttggaccaaatgatgccattctataaagttcctactgagctaacaaattgctgtcctgacacaaagctgcatgaagcaaatgacagatttatatataaccaagactagcacaatgccgatgctaaagctagaaggcaagcagagtttctcatctcagttcagccaatactatcaggtcagaatactagacatttttttagtaacacagttgctaagctaaaggctatctccaggtttacaaaattgagagcagccacaacatagtgtacatcttttcaggacaaggtgtcaacgggtatcatgtattcgttacccatgaaagcttacaccaaggatatcagtttttcatcttcacagaacccacccatgtaaaatgactactcagttggtcttcatagaatcttgttttgatgcttcatttggtatcgtcttgtaactgcagaatatctcactaggactaaccattcaaactgacaactttttgcagatccctgaaacaagaaacaacacctataacttcagataagacatcatagttcttatgatctaaaatatgtagacttttttttctgaaagatatgcaaggaagtttgcgtaatatattaatttcctatgagctaaagcatccacactgaactttatcatagcagccagttttaccttcatatccaagtaccacaaaagttatcctctttcttcaaatttatcctaacgtttggtgataacctatcaaccttctcaagcttctgttttgcttgagagagtatgtcatccgcattacttgttgtagacataatggtaagattttctatggaagccccatgttctagcaccgcggaagcaatagcaatttcagtttcgcctccaccatagtcaaacaacttgagaacttgtagatgtgactttaggcaagctatgtctttcaatgcagatgaccaatcatcagaatgaacgtcacattcctcctcaaagtataccttatcttctctctgtaaaatcagtaaatggttattggtaagtagaatcaaatcaaacaagaacaagccatgaatttcaaatgcttacccaaaggacaagttctttcagttctgtacaagatctgaagaaattcaacaatgcatgtctgccctttctctctttgaaagcaatactcagctcaagttttctaagacttgtaataggcacatggccccacaggaaatgcaaatcagattagtttttttttgagaggtaaagggcaggagcaaaacagattagatttgaatataggcagacacatgcttcacaacacaatcaaataacatcatcaacttaccacatctaagtaaacattgtcgatgcttctagtctgacttgacaagttgaaccatacttctcgaagcataggagctccaagaatacttatccatgtggaagacgatgtccgacttgagaaagatttcattccctgtgctgctccaataatgaccttctcaagttttggtgcccattgaattgtaatgtgactaacactggaccgccaaatttggaggaacttaaggctctctgatcggattcgctcctttccctcactgaacatgccaatgtcaagctccctaaggctgacacattggcaaactagagcaaacaaattctcgtcgcttattctgcagcatgccaaatctatgacagcaagacttgaaacatgatcgaggtacatatcagggatgttgaaaaagcagagatgcagagtcctaaggcttgagcaattaagactttgaagtgggaactcaatagggtgggatggccattgacagtttgccatcaccactgtctccacatttttctttcttagaacatcacaccactcctcaatcttctgttgagcaccattgttgatgacagatgaatcaattctgaaataactaacagggccaggatgagagaggagaatcgatgttattttacctgacaagtcgattctttcattgggcatgccaccttgatctttcattgcacgaacaaggtccagatcatgaaagatgagaggttttcccagccatagttcattccaaggactagagacaactgatccatgtagagtgagctctttgccaacctcaaacgcgatcatcccgtcgctttcatccacgctgctgggaagttgctgaactgagctcgaaccggctccctgatcctccacgcatgcatccccatgggcttgaaccgaagcagcgacatagccatcaccggcgcggttcccctcctcgagcctgcggccgcggccatcctcacgcgcatcgcggcggaggcggacgctacgtccctgatcacgcccggcgccgatgcgtagttggtgggttggtgcggcgtccttgcgctggccaacgcagcgcgcgtccccaaatccatagccgcgggcattctcatcatgcgcgctgccaccgctggggccttgatcaagtccaccgaggccgcatgcttggcctcgcgcggcatgcctcccctgatc

SEQ ID NO: 17204 - DNA, 6797 bp, Oryza sativa
  unsure (1)..(6797): unsure at all n locations
tgggggggggagcgggagagttcaaatgaatgagatgtcgtgaggaggacgggagcggacggggaaaatgcaacagaatttattccagctggcaccgctctttatctcgtcccgagttcgttagttttgcttccagaagttactaaaaatgcattgataggtgaaaactgaaaagtattttcaatttggactcccagaaggcgcacgttggcattttagttttccaatagtattttgaattactttatgcaaccggggaattcaagcaatactggaaggtgatcactgatattctttttcaattagatggtcgctgcaattctggtacatgcaggagagccttggcgacagcgtgaataacagtgcttacatatcaccgatttattaagcaatcacaaatgcgcatggcattgagcattgcaaaatgaaatgcagcaaatgtggattgggatgtagtattacaggaacaactactactaggagcacgcttgcaggacagcaagagagctggagacaaaaattcagatactaaaatcttcagggagatgcacacttgcaggagcacggcatcatttgaacaaagcattgatcctcgcattcactcgatcactgcatgctccggagggccaccggcattgtgcataaacctgaatccagtattccagtgcatactgttttgagggggaaatttaactatttgccactcttgtgacatgtcaattaacgatttaccacaccttgtcaatgaaatgccctcatgtgtttatgacatgtgggcttagtggcaaatcgttaagcaccactcgtaagagtggcaaatagttaaaagccccgttttgaggcagtacctatgtttcttcaatgactcacgaattcacgataaagatcacatacttgttgtatagcctcatcctctccatattttgaggtaaactttggagtttccaccttgagggaggattgcattggacaacaacgactgtagcggtatatggaatccataagtatttgatatgtttattttcagaaagcagaaaagatgggggtgaaatttcagtcagttttctccagtatagaacaaaaaaacagataaacaaaccaatcccagacatctatcaagtggtcagaattgaatgagatagcatttcttgtggtttgtttcatctctagccgcggcgtatcctctcagtgcgattggtcttgggttggcatcgggaatctgcagagcgggcagcgatggctgaggcggagccaatccaagatgcaggtcgcatggaagcaatgcgagcagggcatcttcgtcagcttctctcccgcctcgaaatcctccaggcacacagcgcacccgcgttccctggcgtcgcttgccatcgcctcctgcagttcgaccatggccttgctcgacgcggggacagcgccgaacccaccgttcctgtacgcatcctcctccagtactccatccatggcaatggcagtggcagtgccacggcgctgacgctgaagaatatgatcgcgaacctgatcaacaagctgctgcaagaagtcggcgtccagttctatgcgcccccgacgaatgtcagacctcaagcgctcgcgaatgatctcatgagcttcttcctgcgttaatagcgtccgactacctgggcggtacatcaagtcggtgttagaatggtgggattaaaccacaagtgtaaaagaggcacccaaaaaggttctacgctccctaacgctcctagtcgcctaggagatctagaatgaaagaaatcgcagaacattccagcataaggagctcccaccgagtggtcttctgacaaaaatcaaggacgaggccaagatatgggccttagcaggcgcgcatcatctgagaaattggcttgttccttagttgactagggccaaaggtcttgagtatttttctttccctttacgctgtacagttttctccttatatattcgatgaaattggcggctcgccgattcattcaaaaaaaaaagaaagaaagtataacgggggaagccttggaagctcaagttctcgatgggagggaaatctcttggtagtgctcttgcgaccgcggaggcatccacctccatcgatctgcggcagcaacacacgccggaggcgctcaccgtacgtcccctgcagaagagatcgccaatggtggaggcgagcaaatcaataggcggccgggtgggggggaatggatcaggattcacgaggtaaacgaaaccaagacacgatcgagcccctacctgcagagtttatagacgaagaaatcgatcggactccgtctccgcgtcccgatcgaaatcgagagtgaatccgactcggatccacccccaaatccccaattactggtgaagcttccgtttcacgtattgaaaaatttgttgccgtgccgtgcgtcatggggatgattaggtcagtcaagtggatgctgttagtagcctgtttccggctagcagcattattcacgtgattagaggatcagcaattcagcgttaggatttactaatacacacgattgcggaaaaggcaattgcagatttacagtcttaacagatacttgcatatttggatgtgacctgagattgtctatcctaatttctgccctgcggcctgcgcccctactaactttgtgctcactgtcctacgctcctgcgagatcagatgttgaagtttatcttgtaatcttgttttcttggctttcatatgtcgtagtgtcacggtgtcagttgcatgcatagaagcggtttaagtacaagcaattatcggacatggtgagtttgatcatcgattcatcgtattgttttttttggttcaaattcaaatttaagaaagagggcgtctgaagacgaggaaactacaagcaaaacaatggagaaagaaactggaattagtatcgtgatcaaaggagagcatcgacgtaatcacacaccgcttcaaaattaacaagttcaacttctccaaaaaatttggagaagtgcatttgaaccaaactgcatcataggtacattgctaaacttgatctttacccccataaataggaggtgcgcggtcaattagcattgttgaatcgtagctgtaagacctgtatccattgctctagctcagcgtgcagctcctccaaaacatcgttgtacgaggacatcgccgagcggcagacggggcagttgtctctgatcgcaagccaaccgaagatgcagcgctgatggaacgagtgcgagcacggcatcatcctgagctcctcgtctttctccccgaaatcctgcaggcacacggcgcacgcctcctccctcgtctcccccagcctcggccggtgcagcgactccagtcgatggtcgtcgatgccggctcgtgcctgtagccgtcttcgatccatctcttcgctaacgctggccaagtaatcccgtagccatcttcgctgccgcatctccctgtgaggaagctgatgatagcgagtgtatcgctgtgcctccggtgggctgtgcagtagcgtgtatcttcttccccgcatcatggtctccacgcggatccgattagcgtcccggagaggcggccggttagaatcgacacgtcgtgtgcgctccattgattggtttgcactttgcagcttagcttccgtcctagcgatggatacaagattaacgatgagtcgattagagacaacgggtagatgaatctcgatttcctactgttttgttataggcagaataaggcagtatagtatacggatttgattcgtcttcagacgtgatcggcatggtatgtcgaggagacgaacaaaaagattgatatggaggtagactgcacgtgttgggctttaatttccgggcatgcagcccatgacggacattaatgtcggcctgtttagcccagttcgtagaagcatggtgcagcccggcagtgggcttccagaatgggctggcttcctttgatctccgaaccccccggccctctgtttcaagctcccgagaagcgggaaaatggcgatcgagttggttgggtattttgcaatgccgtgcgtcacgtcgatgattgggtcagtagatgctgttattacttgctaacagctaaaactcacgtgcttataggatgaggattagaatttagtgcacacaagtaatctgaaaaaggcaattgcggatttacagtcaacagatgttgaattagaggaaacgtacagtgtattctattttgacggtgatgagttcatatgttccttagagttgcaaaatgtgatgataaggatgctaggtatgaggactgtgaaaagatgattcatgtttttgacaaagatggtgatggcaggattagcttggatgagttcagagctgtgtgactaaaacctctttcttgttcagtttaactggtatagaactagtatgattcagctcaagtttattgttggttcatgttaatggagattcctaaaaagtggagcattactttacttatcttcccatactagcaatgtatcccaaattcacaattgagcttcataaatgaaaggcgaaatttgaaagcacccatatattaatagtctgatttgaaacactactagaaatatgttattgaattttatgcaatgtaaatctaggatagaataattaatattagtagttgaaaatattcgtttgttacagtaaattcattttctaattttatattctctaacctcattaaaaaagaaggccccacccccaaaaataggataggcactagcggtcggagatcaaaaccccgaacccccattgccctctttgattcttgtttcagtggtatgtccgaactctatccttactgaacacatgaggtcctgggttcgactccccatgggagcgaattttccaggatttaatggcattgtgctttcagtggtaggcgacgtacccgtcaacagcgaggtgcctgtggtgacttcgtcaatcttaaggatttgccggcccagtcttcggagatgctcatagggttagagtttacgtacgtgcgttcataggggtgagtgcgcatgcgttgtgagtgtctccgttgtactgagtaattcttaaaaaaaacatatgctgaaaaatatgaaacatatgtttataaccaatctctgcaagattatctgaaataaatatatagagatgaaacatttgcacttcgatcgaagaacagattaggctgtcagatttactactgggagtatgaaccaggtatatgaagcccaacaagtgaagagtacacaaactacacaataacatgaaagcaggaaaaaaaaagtgatcagttttttatctgaaccaaagaaagaaatttctgttgcaccatgacgtggaaagtaagtgtatgtgtgttgtgtggtgtgaacgagtcagtcaatgcagtcaacattaacaaaccccacactgtctctactagtcttcgtcgtcctcgtcctcgggctttcctagtccttgccgcgacgaaatcaagcacatgccgctcacagaatcagtcttgcagacttgcactccagtactcttctgggaatttggcgtgaaatccaccgagcgacgccgacgcaaccccaacgtctacagagaaatctcaacgcgcagccgcgcagcgcaggcgcaatttctcagtacatcaccacgccgactggtagtgaagacacggcgagtgatctcgatcgactggacagtctggactgcgaagaacgcttgcacttgtgtgcagcgacgcgcgaatttccagggatttgttgctgccacctaccggccggagtccatggagacagcactactagtctactactaccaccgtactatgaagtaagcagattagtactctgcagtcgccgccgtccccgatagggacaaaatggcggggactcctgtcaggtcaggaaatttgcttgaaatcttcccgacgcgacgcaaacgcggcaagaaatttcccaaaacgcgggtgcggtcactattaaatcaccaccatttgctagtgaagttcaagaaaacaaacacatcgctagcaacaattcggatttagacgcgttaggaggggggaatggccgctgacgcttacgctgacgccgcgccgccgcggcgagctccggcgccggcgacttcgacagtggcgaaggaggcggagttcctctgggagcttcgcaagtatgttctgctgctggccacgctcgccgccaccgtcacctacacggcggggctggacccgccgggcgggttctggacggacaacgtgggcgagctcctcgccggcgacccggtgctccagaagacctaccctcgccgctacaaggccttcttctactgcaacgccaccgcgttcgtcgcctccctcgtcatcgtcaacctcctgctcgtccgcttcctgtgccgccgccggtggtggctgcgcgcgctccaggccgcgatgacactcgacatgttcggcctcatgggggcctacgccgccggcagcagcagggaggcggccatgtccgcctacatcctcgttctcgtcatcttggtttgctcctacgtctccgcccatgtcctgctctacgggctgacggcgcaggtgagcgcgccggacgcgccggagcgggtggagcgcgcgcgcaagtacctgctcatcttcgcgactctggcggcgaccgtggcgtaccaagccgggctgagcacgccgggcgggttctggctaggcagcctggacaaccagcacctcgccggcgaccccatgctccgcggcaaccacccgtaccgattcatggtgttcttgtacttcaacaccannnnnnnnnnnnnnnnnnnnnnnnnnnnnnnnnnnnnnn

SEQ ID NO: 17205 - DNA, 7997 bp, Oryza sativa
  unsure (1)..(7997): unsure at all n locations
ggaccgtgtcgcgccacgggttccggtcgagcgcgctctgggtgtgcgtgggcaggaccatggtcgggctcatgggcgccttcgccgccggcagctgccgcagcttcaagacgtccatctacgtcatcgcgttggtgggcgccgtcctgctctacattgccatccaggccatggtgttcttcagcgagcccgtgaaggattggctccaccgcgccggagaaacgctgcagaagtgcttgaaattggatgaactggagcagcgaaatcagcagcagatcactctatccaaccaaggcaatggcgacgcctactttcttctcaagaaatctcgcatgtacttgctcctgcttgggattctcgcggcgagcgtcacataccaagcaggactgaacccaccgggaggcttctggcaaagcgatggcaccgacggttaccgccattacctcgccggcgatccggttcttcacatcacgtatcaccggcgatacatggtgttcttctactccaacgccaccgccttcatcgcgtcgctggtcatcctcatcctcctcttgagcaacatgattagcacgcaggggatcaagtactgtgcgctgcaggtcgccatgattctgaacttgtttggcctgatcggagcttacgccgctggcagctgcaggcaggcgtccaaatccgtgtacgtctcggttcttgttctgccggtgttcctatatgtaggtatccatgtcttggtgttcatgctcgaggtatctccgacatgggcgacatggcgaggacgggtgagggagaagctgaagcaacgtatgcctgaatggctcaagaatctgcttgagttggagaagcatgtcgaggaggaagaggaggagtggaagctggagaagaggcgaaagctcctgctcctcgtcgcgattcttgcagcaagcctcacctacgaagcaggcatgaacccaccgggcgggttctggcaggagggcaagtccggccatgtcggcgacccggtgctcaacaacgacaactaccggcaccgctacctggcgttcttcttttgcaacacgacggcgttcgtcgcgtccttggccatcatcatgctgctggggaaccggaagctctcggcgagaggaatccggtcgtacgcgctgcgggtgtgcgtgattcttgtcctcgtcgggctcatgggcgccttcgccgccgccagctgcaggaaggtgaaaacgtccgtctacgtcttcgtcttggtcctcgccgttctgctctgcatcgcgttccaggtcgcactggtcgtgtcggggtcgctgcgacgtctcgtcaacagcctcctctccaagctaggggcgccgcttgaggaggacgccggtgagcggctgccgcacacggccgccgacgagcctcgcgatctctgggacgagaagctccccaaatacttgctgctcctcgctgcgctcgcggcggccgtcacctaccaagccgcgatgagcccgcccggtggcctctgggatgacggccaaaccgagcacatcgttggtgaccctgtcctcctgaccaactatgcacgtcgctacaaggccttcttctactgcaacgcgacgtcgttcatggcgtcgctggtgataatggtgttgctgctgatcaagagggtgagcaacacccagccggcgctcctggcgctgcacgccgccatgatactggacctgttcggcctcatgggcgcgtacgccgccgagagctgcaggagggtgacgacgtcggcttacatcttggcactgctcgtcggggtttcggcgtacatcgttgttcttgtggtggtgtccattggtgtggcgagatggatgaagaaggtgatggacaaggtgggggagaagctcacacactgcttctccttcgaagatttgtagagcctaagcctgactccatggcccctgatatggggcatcttccattcttcccagatggatggtgatcctctctgtacagtcacaactctgcctgcagagagaggggtttttcctaggatttgtaggaatttctagtttagttgttttcttttctgtacattgttgtttgtttttgaattgttgacagcttccagttgcaatgtatggaaccttttgtactcattgtactagcataacttgtaatgatttgttttttagtaacatcttgtaacttaactaaaaaaatcataattatcttgaggagaattttggaagtcattttattaaaaggaaaaacaataccgactactggacggtaaaattgatttaagtatttctcgcataccaactattttgctacaagaggaaataagtaaaacaaaaatgaaagaactgttacatggtcaacaatttctgtcctacatccttttcaagtcaattgacatgagtacaattacactacttctaattagtaattacacatgaaaagatttgggaaatgtacaaaatctatacacccatcaggggcagaaaccgtcagactaattacgtattgccatctacaacataatgaatgaatgatcttacctacaaaatagtcctggaaatggccaaaaaaacatccatcagctggtcgttatgctttcttcagttaagaattaagagtgttcccttttgttaatgaagtatttactgtaggtcttcactaaaagccctgtaaatgaaatccctgaaccttttgcagtattgctttggatcaacagccgatatggagttgggatcatattgcatggatttgtaggcatgctcaagcttcttgctgatatcatagtcttgtaggatgtcaatgattccaaagaacaggataacgtcctggaattcccctgtaggttcgccaatgagctgggattcactttcaggattcttcacaacattctccacccttgagggcatgctgatccctagcttgactggtgcttttctgcaaaattataagtagtgtgttacttctttggaatcaatatttctctgtactaactgtcaaagtgcatataatatagaggaggccgctaatgcagtagaacagagaaactgctttgtgaaagcttctttagtggtgtcctgaaagatagaagcttcttcagatgaaagcagtggcactttttttcaattaaaaatttattgaagaatagtatctaatatattagatgaaaaagttcaccatgttctaaaatcgtcaggaaagcaatttgtttacctttttgaaatacgtatgactgtatttaactgaaaatagcctattataaccatgttttagacacaaatgcgtcctgaaaacacactaccttctttcctcatcttcaagagcagtttgagttgtctcgttgtcaggactgctgctgtctgtaaccatgaaaaaagtattttcaggcccatgaattaaaatgcatctcctcaaaaaagattgtaactgtaagtattcaaaacaatcactatagtgtgaacatatctttgcatcggtctttgaagtgaacgccaaccagaagactgtaatccataattctctcttgctccagaaactcacaatccttgtccaattgcctggtatgaaaaaaaaatgcttgcatatatttaagaatgtctgctggcacagattggctttggaacctcaaatacacttatacttttttggagaaataattttctagtacaagtagtaaatagagaaaggggaacattctacatatgcaatttggggagagcaaaagtacctgcagaaatcttcataccatgatccctctaaccggaaaatgaaattgagatcaaggtccttcaaagtggtagtctcatcgatttgatcaatgggtttgtccgttgtgcgaccatgtgatgatcctttcaaatcaaagcgtctgtggattgaatagttggagcagaaaagattccccattataacaaaccgaacctgtagttatcaatgataccaaaatatgagcaattgccaggcatcattttttcttattacagtttgatcaattgatcatagcatatgctaacctttttctgaatagctcctgtaattttaacacaatgcaggccgaaaaattttgttactagagtattatcaaaagaacgaacgtgtttataataggctggaagcatcctcagaagtacctgatcataagaaaaaagatacaaatgcaacaggaaatgttgaatctcttctaaattagctaaacaaggaagaatggagcttactttaacttctgctttcttcattgttttgatcatgtacttgtcatcattggtgaaataaaagaaacttccacttttaccgggagatgaaagctccagcagtgcatcatccccgcaaatggagagcatgtagtctcctgggtcaacatcaaagagcttgcgcaaagtcctgtggtaaattatacacgaacaaatcaacaccggttttgaagcttccaacaacagttaagagaatgaagtttactatctgtagaacaaaataaagaaggaacatttaatgatattgcatcctggatgcagagactgggatgtaatttgccttccttatctcaaaaacgaccacatattttaccacagtagcttaatatactgacctgaaaaccaatggacagtagtccttccaccggaaatcacatgactggtgaggaggagtatgctttgatccttcaggaggaaatcttgtccacaccttctctttcggatcaaatgctgatgatttaagatccaatgaagcaggagctgactgccttcctacagcatgtctgtatccccaaataacatgatcaacaaatgtcaaatgcatcgaatttacaagaccaattcatcagcattcagaaaacaacaataaatcaaatggcaatacgtgtaataacattagtagacaacatgaagcaaatcatcccacctgatacccagctgcaagttgagcatcagttcgtagttcttgtgccccttggagatggtctccccctgcttcttccccggcttcggcagcgtcggcgcgcgcatacacgagggtgtccgcacccatgacctgtcgttgcgactctcctcgccgccgtcctccccctcaaccaggctgtcaatatcggacgacatgctgttcctcccttggtcagctccgacctccggcggccgccacatcccttggtcggcggcgacctccggcggccgccacaccggcttcttcgtcacgggctccacccctggccatgtcagcaccttctgcgacggcagcagcgacaccgtcttcccctcggacatctccagctcctcgagcagcttcgtgatcacctccttgggttcccggggcaacggcaccgccgggccaccggacggcgggtagtacacgcccttgccctgcgtctcgccggactcctggcaccacaggccgatgtacatcccgccgtcggaccaccggaacgtgccctgccccttgggcttggcgtcctcccacgcgccgtcgtaccggtcgccgtccgcccatatcaccgtcccgcggccgtgcatctcgccggccttccacgtcccgatgtactcgtggccgccgcgccagatgtaccggccgtgcccgtcctgcagcccgtcgcgccagtggccgtcgtacacgtcgccgttgacgtacgcctgcgtgccgcggccgtgccggaggttgttcgcccacagcccggcgaacgtgtccccgagctcgccgatgtaggtcccctggccgtgcatgtacccgccggcgaggtcgccctcgtagatggcgccggacgaccacgagaacttgccgcggccagccgcgcggccgccgcgccacgacccctcgtacatgctgccgtccgtccagagatacttgccggcgccatgggggaggtcgccgcgcaggtcgccctggtagaagtctccgctgggcagcagctggtcggagtggctgggctcgccgagcgacgcctcgtcgacgtcgtcgtcgtcggtgtcaacgtcgtcgaggacggagtcgatgtcgtcgtcgccgtcttcgtactggtagatggtgttggaggtggaggagatgacggagaggcttggcgtgagcgtgacggggtcacctccggtggccgccgccgccgccgcaccatcgaaggtgccgccggaggggacgacggagccgcggaggatggtggagtacttgagcttgcggatgctcgcctcccacagccggctggccgggggagggagcgggttcatcttcttcccggtcgccgtcgtggcgtcctcctccgagcgtagctcaacgtgacagggtggtcagagcgagggtgtgcatggctggcgatggatgggtggcgcggtggagggagcaggggcgggcaagaaaatgtgtttggattggttggaggctgggaggagttgtcggggtggatggcgctgcgccgcgcacgccgaggagagctcggggggcgaagcatttggaaggaggcagaggcagcggtgaggcagaaagacatgagtgctctaaaaataggcaagagagacaaatagcagtagtagcatcaccatttctgcttcggtattggggacttttgaaatgtttttccatggcaaaaggcatcatttgtcttcccaagattcagcacgttgacttcagttttggggctagcgttgttcaaatgctcaggtcaaacagtagatactcctttccaatagtactactccaacatgtgcatactagcctacgatgaaatcgcagaccaaaactgatgatcgaactgctatcaggacaggatagtgggagctaaggaactgaacctgataataactaaattatctgtctcaacaacaatctaaaacagcaaccacgatattcatgtacagtgaattacgtagtatcaccaataatccagtatgcaaatctaatagatattacaaactaacagccagaacaaaggtaacaaaacgacttgggtcacctcgcaagaaattttaggttgtgtctagttttcactaggtcagagctcatatagtggcagaaaagcattacatcaagcaagagaacattacaaaagagtactgtttggaaatctaacccagtaaaatcatagatacagctccaaaacaatctgacatcagtaaactgcattcaacccacattctgcttagaaatccatcttcaaccggctcatatttctgtccaagaaatatcatctccaacttgcatgcaaaagcaaaactcaagaacatttcccaatacctgttgctgctcaagcaactcttcaagcatctcctgccctctccttctcttgatcacttccaaaggtcaaggtcacataagttgcaaaataaaaaggagcacaatcagtaagcaacaagaccaaatgttttttgaacccgaacaaaaccaaatgtcatgccactaatacagtattataaatgtcctgcacttcaaacaaaaatctgcactccacggcattttgttcataatcaaacgaatgaaagaattgagataatcagggaggtaatatcaacctaaagcatttgtttcttgtaattgaaaaccatgtttcacaaaagtcataactcatgagtattcttgtgagcatctgcctacaaaattgaatactacttgatcagtaactcacatgtattgcatcaaggtaagaatatgccaagtttgacatgttttatagtggaattgctagctacagcagatgatttactgtataactagcacatgtacagatatacaggtcaatcttactgaaactgaaagtaaccccacaggggcactaccaattgtcatgccctttagcccttacaatatttatcataaatcctctaaaagaagatgatcaatacagtgctctagtctaggccactacatttgtaaagttctgtacatgtgcatctgaaaaacatacatagcaacattccgaacttatacgaattcaagaaataatctgaactagtctgaccaaatatttctgaacatttcagaaataatctgtacaaatnnnnnnnnnnnnnnnnnnnnnnnnnnnnnnnnnnnnnnnnnnnnnnnnnnnnnnn

SEQ ID NO: 17206 - DNA, 312 bp, Oryza sativa
gatatgcaatccagaaattaaacacaggattattctccatgtactatccattacaaatttcttttttttattcatatcttatgatatctggaggatattttactttacttttagagtgccctcttgttgctccatttgttgtacatatataatagaatatattgtgacaaagacatgtggtgctagttagttgtctgcaactaaagaccattttattagacaccacatcatggaagatcgacaagattgatttgcgtatcactccatatcttcattattgattttacaccaaaactgtcgagatagaatatt

SEQ ID NO: 17207 - DNA, 585 bp, Oryza sativa
ctccctccttgccgccgactcattacctccgccgacggctccctcctctcccacgtgcgcgcgccgccggctatccctcctcgccgcttcacctcctcgccccctctgccgccggccacgacaggcgacgacgacggttcgcatccagccgccggctctcctcgttgacgcgacgatgacgccggcggcgccgacgacagtggacgaggggagccctagccggcggcggccgtggtgaggccggtggcggcgccccatgttttttttttatttttctgagatgattttcgcaggcgggccatgggtccgcctgcgaaaatagtctattttcacaggcgagatggtagcggcggtcctctcccccgcctacgaaaatggttttgggccacctgaaaaaatattatttctagtagtgaaaatccctaaacccttacccttgcacccttatacaacggtactgtagcccatgtgagaatgaccaacgacgccttagacctgtgctttggcatggaataggcgagagaatttttttaaccccagtctgaaattcgctccacggtagtcgaacccaggacccgaggagtg

SEQ ID NO: 17208 - DNA, 1523 bp, Oryza sativa
aaccattacaaccgatcaaggttcaattttcgtgtccgatgagtttgttcagtttgccgatagcatgggtattaaattgttgaactcttcaccatattatgcacaagctaatgggcaggccgaagcatctaacaagagcttgatcaaattgattaagagaaagatttttgattatcctcggcaatggcatactagattagccgaagcattgtggtcttatcggatggcttgtcatggatcgatccaagtccttccttacaagcttgtatatggacatgaggctgttttgccatgggaagttagaatcggctcaaggaaaacggagttgcaaaataatttaacagacgatgagtattataaccttatggccgatgagagagaagatctggttcaatcacggttgtgagcccttgcaaaggttaccaaggataaggaacgagttgctcggcattacaacaagaaagtggtgcccaaagatttttcggaaggtgaacttgtatggaagttgattttgccgattgggactcgggatagcaaattcggcaagtggtcaccgaactgggaaggaccgttgcaaatctataaagttgtgtctaagggagcttacatgttgcaaggactcgatggggaagtttatggaagagcactaaatggcaagtacttgaagaaatattacccaagtgtttgggttaacgcatgattggctgatgcttgccgatacatgatagccgatgtgtttgcatcgccttgagatggccgatatggttatatcgcccttagctgtttttcatattgtaaatcggttgtggtttgccgatgtacaatggccgatattgttatatcgcccttagttgtttttataattttatcaatgcttttgacattgtaaaattaaggaggcacatatatacgaaaaatgaaaatattttagcaaatttagaagttatattaatcggcacaaaggattgtcaagacaataaagtaccagagtatcttagccgattacaaaaatttctaaggtctaatacacagaaagtcaccgagacaaatattgctggatagccaaatagcctttgcctgatttgttctacttcttccatggcttgggcatcttgagcacggttccaggaatgacttttaaagacttggtgagatcagcaacaatcttgatagccgattttaatcttgccttttgctcctcgacagactttgggagatcggctagcattttatgttccatatccagctcagcgttgcattcttcaagttgtgccgatcaataatagatttaatcgggccctcagatagctgatcaagtttggccttctcttcatgaacaagctgtcgattggcttggattgtagcttcgatatatgtttgcgctcccgacattcggctaatcttagtttggcttttttccagcttgaattggtgctgctcaagatatatagctagagtaaggacatcggctagctcatctgggattagagcatggatctcgtgtaaccgagtcctaatcggcc

SEQ ID NO: 17209 - DNA, 12291 bp, Oryza sativa
attataagtgttgctatatttttctataaacttagttagttaaacttttaagaagtttgacttagagaaaaagaaaatcaaagcttgtaaaacagtcttaatcttaaactgagggggttattaagtatgtaaataggaaactccacgacaaataaatagagacgtacaacagggaactcctaatttttagaaaactttcgactcaaattttaaaaactttcagtcaagatttaaaaactttcaactttgatttaaaacttccaattcggctttgaaactttcagctcaaatttgaaacctttcatcccaaatttcaaaacatttatcttgaaattaaaaaactttcaaactgaaaatttaaaacttctaactacaattttaaaaactttgactctaaattcgtgttgaatcgtgcgtgtgcacttgcacgtgattaaaaaagttcatgaaaaaatcatgcggaaaaaataaaaaatatcaggaaaagaaaatcatgctgtttacaacacatgggcatatacgaaaaaaaaagtaaaaaaaaacaaaatagctagctccccagcagcaggccagcagcagctaagccggaccccttcgctatagctagccgtttacctcccgatacccgattctttcttgcaggtattgggacgcaagccgggcattctttcgggtatcgggaggcaaatgtattcttcacattctttgcattttacgccgaatgtattcaatgtatttaccgttgattattaatgaataataaggtcgttgagcactgtcatttttgttgagcggtaaaatttacatgaaaattgagatcacacctcttaatcttttcatgcaagtcgatcctgctttgtagacattggtgctcctgggttttcttccctggggtcatagaccctaggtagattatctaattctaactaaattatatcctactctctctgtcccaaaatataaaggactttagacggatgggacaattcttagtacaacgaatctggataaaggattttagatggataggacaattacaatgaatctggacaggtttcctatccatccaaaatactttatattttaagacggatgtagtattagttagtatatcagtgaataattagataattagtatgtacatgaccctgattatattgttctgggttcgcgactgttcgtagagtgatgagaagacatactactatatgcttctgtagagtatgtccaatgagaaagcgcgctactcaaagacccaggaacttttttttatttattaattttgttaatagacctttccaaaaaatatttctaaatccgaacttttggccaagctagctcgcttggcgtgtccaaataactctgtcgcgccacgtacagctagtgtggtattattggcctgccacgctactgtaattggcatggccaaaatgttcaaaatgttcagtttttgaaaatattttttgaaaaggtctattaataaaatggggcaattgcaaatgtaccagtaatttgaatcgttattgcaagactgccactagaaaattgcaaaaatgccactagaaccgtcactcgagtggcattcttgcaaaattaaaaaaatcggtggcaaatttgcaaatgccccctaataaaatttaaaaataaaaggtctaaaaaataaaaaaaaaattgagacccagtcagactcgcattatatcaacggtattatttaggttacttttactacaaagcatacaacattttatcgaaaagtttacaggttcaaaaaaaaagataagaattgattatttatttagattttacctcagtacctgttgggttggtcgtcacttttctggttcaagcatacaacattttatcgaaaagtttacaggttcaaaaaaaaagataagaattgattatttatttagattttacctcagtacctgttgggttggtcgttacttttctggttcaatttcttttttattttggcattgacatccatctcaacttacatatatatattacgatcgtacacataacctaaatgatttgtatggatatttcttacattgtcgtacagccattaagatcagtggtaagtgtccgttcatacatgggccctgtttggatccggagggctattaaatagccctctagaatcttgctatttaggagtattatagatattttcattgatggtggttttaagagagaaagttccagctgtacacactagaataaccttgtattagaatggcaacaaaagaattattatcactactgtagttttatttatgatgaacctttagggatggtgcactctgcaaagaaatattggagaacatcgtaactcttgccagttactattggattgtaaatcctacacggagcacaacgagtgatgttacaagatactctcggtgctgcactcttgcttgtttccttctcatcagacgttctgttttgtttggtttaatttggtaatcttgcgtgttctcgtgccggacgagctacagtgcatgttctgttgcgtgcgtgccagataagctacagtgtgggtcctgctgcgtgcgtgctggatgagctacagtgtgtgttctgatatgctacagtgtgtattctgttgcccgtgccggatatgctacagtgtgttggtgagtctgttcaactacagtgtgttcaggacttcagggcgtggagttacaaggccaccattgccatgtttagctgtttaacgaaatgagaaagccattagcacataattaattgtgtatagtatatagtaactattatacccttgcaaattagatctatttatcttttaacaaaaaaaattatatagattttttttttgcacaaaacacaccattcggagttgaacgaaagaacttggccttatatatgaaatgcagtactatttaataccacgaaattacagaatacaaagctgcaagcatgacaaatattaagacctctcattgtgccgttttattccataattcgttgattggtctagctaggcatctagccagctagctaggggtaaaacatcctatcgttgatgtcgacgaagccgtagtggtcgaggttacccctgctacacctgcagcaccctcatgtgggcgcggatcttgcaccatcctgtatgtgtagtacgtcactggcggcgccggcgcctcctcaacggagtcgggcatattcattgttcgctctgctctgctctgcttctgtcatgacaactatggtggtggcggcggcgagatatactcacggaggaaggacgaagagggtgaagaagaagtggggaagggacaggactagggtagggtggtgagggaggagagagacgagaagccgccgccgccagctgcaacaacggtggcggcggggcgctgggtccatgtgagagagcacaagcgtcggtctctcactaaccaagagattctattctctcacggtgcaggacatgcttgcacgaggtaaatagaggaacatctgaatcaaaagtaccacacaaagatattagttttcccaaatatatatacaaagatattagtttgccacagtccattctcttgccctcaacctttccggtcccctgtaccccgatgcaattatttacatgatctccccttccccttctcttgaatttctatggtcctcctgtttactgcaaatgttttgttttggttcatgcatggattactgactatgcatcggcgaagaactcagcggcatatgacgagggaatagattgggagcgagcctttccattttcgtaggttgatttcgtcagcatgggctgaaaagaagccagttggttgccgtgcttgtttacctctgttcgatgatgatcgagcggcgtagcggcatcggatgtccctctgacgtagattgctctacgtcagaggatcctgttccggcttggctttatatgtgcctcccttttctctctctctatattttgcattgagattggtgcgttaccaaaggaacgaagacagatgagccgtgcttggactgattgcttggcacggtgggccggcccggcccggcacggcacggtccagtaagcaggaagaaaatagttgaggaatctaaagagatgagggaggaaatagacttgttttatagggaagcacggtggactgttgtgtcttcgggctagcccggcacgacctgagtcttattgtgctgtgcctgggccgttggtgcaacccatgggcgggcctagcctagcccgactgacctcagtcagggccgatcgtgctaggctgtatggtccatttggccatctatagaagactatatcaaaaaagagttaattaatcgtgtcatgctaatataaagttttcggtttttcaaatatgttattactattcataatattttagctgttgccattacaacttttcagatattggatatatgtggctacttgccaatatgatgcatttaacaaaacataaatactaacttatctttttcttcttgctttgtctcttcccattcctcttttcatctctggtgcctttcatctcccttgtgcacctcaacctgatcccacatgagtacccacaccatcgtagcgcctcacctcctccgagacactccctgacagttgtcgtcactgttaccttcatctcctactcgttgggatctgaggacggcgcaaggcggaggtgggtggagagggtggcccacgattgcctaggttcactagacaatgggagagaagataatcgaaggaaaaggacaaggaaagaagagatcaaaatgaaaaagctaaagagatattcccttcgtccccaaatataagcatttttagttcttgacacggtctccgagatgctattttgaccaacaatatctgtaaaactaagatgttttaaataaaaaatattgtatattataatagtttgtttaatggtaaatctagtaacatcaactttacattattgatcttttttctttttgttattaacggtcaaagttaaaaatatttaacttgtcactatgctaaaaatgcttatattttgggatggagggagtacgagatgggaatgaagatgacaagccgcaagatccaaatcctgaaggggaagaaagggctggaagacaataaacacaaaatgaatgaacaagccatgggcaattcagtccaaaaatgttagacaatgcattgaaggtcaggctgaattctttcacaactttctcaactcacctacctcgttttctacgcgtacgcttttcaaactgctaaacatgcgttttttacaaaaaaaatttctatacgaaagttgctttaaaaaatcatattatttcatttttgaaaaaaataataaatacttaattaatcataagaaaatacgttgctccgttttaagtcgtgggagatgagtttccaacctcaccttccaaacacagccgaagtagtggcatatgtcgaaaaaatataaaattataatggtgtggctctaaataagtgaatagtaatgtggtattttcaaaccgaatgatttattgtagcatgggtccaattaacccatttttcataaccttaaaattagtcatatatcgtttcaatacaaaacaagtaaagatttgtcaccaccttaaaacccttgaggtatactttcgccagaagatagcttccactaattaaagatatgaaaattacatttactccttagtgagccaagctatctttttttttgtgaaatctacttttttcaggttcaagctttgtcactaggtggctagatttctattctttttatagtttagaaatgtgctaggacagatcctcatggtatgtgtgtgcgcgcatgtgagtgtgatataagattcatttttgtatgtgattcccctgcgccgctttgtatccccttctcttatggctttgcaccgtaagatttgcaaaccatctccaagagagggctaaacaggttcctaaaagataaattttaggatttcgatgaaaaacaggcctctaacaaattcccaaccatagtcccaaaatttacctatgaccaaaatcagggccaatctgagccaagacttgggaacgtggacgcgctcccaatccaactaatcgcacgactttttctctgcctgcgccattttttgtccgtccgtgcccttttcccctctcgcgcatgtatgtgcgatgtttaccctcgcgttttctttccttctttcgtattctctagcttcggatgataccacgctcacgccgtcttcgattcctcgtctagggtgccgtatctcctccatccatggcatggggtcccgtgctgcctccgtcgtctcctccatccagattttgatggtgaaaatctgtctctctgaagttaacaaataccaataccatttccttatgaattgttgaataaaatggctccatgctgcattattacgcaaccctgctgatatgtgctttccctttttgttgcagaaagatttcttttgttcattcgtggttgaattacagagattgcataaagattggctttacctggacacagatttttaatatgtttccttggctcaaaattgtggaactttaggagtctatcatgtcttgctctgttcattagaatgtatgtgctttgtagcgtggaggatgatggcttggcagtatagtttcggttttctgaaaatcaattcgctgtacagaatgtagagtactccaacttcagccttgactttttatattcagatttataattttaagtactagtatatttatacattgatagtttatgatgttcctctaagatttgatgggtcagagtttctatgattcttggacagttcagtgtgaagtctgattcattttcagcttaatgtgagaacaaggtatatatccctgttgtccagtaatataaaaaaatcagttctatctctgttgtgaaactccaaattttcaatttttgttgcttactgatcatcagatcatgtcaaacttgttggtttttttttcgtgcaatccatttagatgttgtactgcagagtgcagactggagtagctgaagcccccataaataaaattttgtactgatatgaggaagtggaccgattagcatctttggtcttgagatgaactaatcctgtcgatagggagaggaacaatcggcttgacacagaacctgattgcttaacaccagcacttgaatttggagcagaacttgtcatgttatgtgataataatgcaactttatgtttctcacatgttcaggtaagggatcacacctttgccttctgtttctctacacgttgaagccgccggcgacgtactataccggcgaacagaaaacagagacaatggcgatgacgcgatgtactgtagtggtgaggccaccgcgagagaacgctcttatgcgtggggcgtatgagattgatatcagtaccgaaccagtccactctacaactaaaatattgggatccaaattttaggtgtctcttggagtatgaggtgatttttaggtctaatttgttttgggatggccccaatacaagatttttaggagttcaatattaccaccatatttgcttgttcccttagtctaacccgcttaatacatccgcctcaccccaacttgtggctagtggtgccactatcactgtgatgatgcactgccatatatatcaccggccatcgatcaacttcctaccccatgcagccatacctattattgaagccccctttgaacacatccttctttctctctaaaattttcctcctccgaacccctatctccccccccccccaatactagctaatcgggtgtccaagtcagtctgtgggcaatatttatttttattgaaaatattgagcactaaaagacgaatgagaggttgaccaccacatcattgcaaggggagctcgattgattcgcaaattggactgacttcaaacttttcaaccggattaatagtcaacgactttgatagcctttccttacaaggtttttaatccatcgccccattatatttttcttaagtttaattacacttaaaaacttaatgaaaaattagaaacgacttataattaaaacacagaaggggtaccctatatagactaagtcaaaatataagcttccatctataaatggccaaatggaccgccctgcacggcccagcctgagcatgaccaaggtacggcccgtgatcagtcaggccagcaccggcacggcccgaccaacacgccatgtcatgccgtgccccgcccacgggttgcatctaagcatggcccacaataagactcgggtcatgtcgtgtcggcccgaaggcaagatcagcctaccatactcgtccttttaataagtctattttggctccctcatctctttagtccggccaccgacgggctacggcctgcaagagccaggaatgttgggccgcggttgtgccgattgttggaccatgccgtgctgggctggcatgtcgtgtcaagtaagagacccagaaacggcccgacggtcgggtcgggtcgggccagcacaggcctaacaacagtcgagccgtgtcgtgtctgggctgggccaaatcttcataccatgggtcgggccgtcggactgcgggcctattggccaactatactttcacccaagtaccaaacgccaatctgaacgccgccggccggctgtcacgcatgcctcgcgcaacgcatgcagcccgcgtgctactgggccaacttgggccgcttgagacgtgcaccacaccagttctcttagcgatttgtttttcttttgcgtgggtttttgcaagctgttttgaatagatttaaaataaattcgaatccctagtttgttctgcgcttttcgttgccagagtttgatcacaacatccaatcatccatgactaaaatgacctgtcttgttttgtccctagaaaattatcaaaacaaagaaaaaaaattctagaacatgcaaaatatggtcacataattccttattatagcctcgttaacgttctacggtgctcctgaaagagcggatttcagttggaacaaaaaaggagaaatctctggagcgagcgaggattaggcaacaattaaagctaagatagacccggaaaagcttacaatctgccgccgaaagaaaagcacaaaaggcatatgcacaaattctcgtcacttgcgtcaaattaatttcttgtaattcactcaactctatcaattacgtatctaggcatcacttcagaatggccatgaattaattaattagtactacccaacaaaactccaaagactatcaataaaataattcaagcactgtattggtgggacaattattaacacgctaattaattaatcatggaaggaacccttacaggttgaattacagaaagcccatctaattaattactgagaatcaaaaacgaaatacatgcatggtgacaacgatatcgatctcaacgaaacagagaaaaaaaaaacaacgattaaattacaagcccttaattaatcactactttttttttagtcgtcgcactctctcactgctagctagccagctagcatgtctgcagcttcactagctctgaagctagcttggccacgtggcgcgcgtacgggctggacacgtcacgccttcttccttcttacggcgacccatgtacgcatgcacgcactcatgcagctaccttcttctcgccggcgccggcgacggcggcggcggtggcggcggcggccttgtcgtcctcctcaggcggcgcctctgccggcggggactcgacgtcgacggggtgcacctcgcgggtcttgacgacgtcgacggcggcagagagcttggcgatgttgacgacgtgctccttgacgccggcggcggagtggtcgtcgtcgccggtggccgtcgccgcctcgacctccttggtcagcacggccttgggcgtcgagttcctgtacatggcgtacagccccatctggatgacgccgaaggagaagcccagcacgttgggaagctgttccattttggatcaccatcagaaattaaaatcggttatcagctagccataatcactataattaaacaatcttccacaattagaaatagaaattaaatcgagcagcggaaaatttaggaagaagaacgggtcgaatcggagctactcacagcgacatatttgtccttgatgaggaggccgtagaggaaccagacgacggcgctgatggtgagggagaaggagagcgagaacggcatgaactccacgctcttggtgcgcaccaccagcctctgcagagatagcaaaagcggtgcgtaaatatgtgcatccttagttggtgcagagaccgaaagttattattgtttacaggcaattctagggtttcttacgatgatgctaaggggggcgacgaagacgctgacggagaagccaacgcagacccaaccaagaaccacgatgcggcggtcgccggcggagaggaggagggtgaggaggaggatgaggccgaagacgccgacgttgacgaggaggaggagcttggcggtgaacatcttggccttcttgggggcgtagacgaggtagacggcgatgtagatggtctcgatgacgcagccagcggagttgatggtgatgaggaggcactcgtcggacttgagcagcgcgtagtagatccacagcatcgcgctgaacagcgccaccacgtagggtaccgactggaacccctgcgtcgacttgctcttgtagatcctgtagaacgtcggcctgcaagacatccaagcaattggttaattctttatatttttccttgtatttactagcaatgttaattgataggattagctctagacatgtgtattggttgtctacatcttagttatacagagacggggagtgtttttatctgaagaaaaaggtaattttatcatttttgataaggtaccaatagtaccacattaattttatggtggtgtataagaaattttagtgtaaaaggtactttctggagcaatgtaaaatttcgctaaagaaaagaaaatatccggatgtgtgggacttacagtggggccaggtaggtcatgaaggagatgatgttgcctgcaaagagaataaaatagaaatcatatgttaggatcttgtttaatttgattaactaaaaacgaagtgcatgcataaaatgcgacggacgttataattaagcgagtgaaccatgcacagcaacgtgacacaaggagatacgtaacgaacacatatgcatctatccttttaataattgtgtgggtgacgtcatgttacactgatcaggccgggcaagatattggagccccttttcttttgagctccttttgtcttggctctttctgtgcctggctaggcttatcacagcaatgcatgtgtagtatgtatgtatatctaatctcctctaatgatgaatcaaatgtttcttatctttagtttggttctaaaagagggggctttgcaataatgagggtggtggaacaaaaagagtaaaggaatgaaagatcacaatattgtgctaactacaagggaaatcatattttgccaaacaatttatttggctatgcatggcccctctaatgtaaaccactcacaattgcatccaaaagtgcaaagtcgatccactagctgccttgctataatatagtagttttggatgaattggtaggaaaaatatagtagctttggcaacaaaagtggaacatggaaaagtacatgattaaaaatgtagagaataataacaacaaaagtaaataaccatgcaagattaattctcaagagaattccttggatcagatcaaaggcaacacacctaggagaccaaaggcgaaggcccagggatgctgaagagacatgccagccattgcagcaagatcttgattaactagctagctcggaatatgagagagagagagagagtttggtgggaggagatcaatgaggcacagtacactactgttcttgcttgcaagtaacaagaggatgatcaggcaataaagcagagatcaaaacttaattccctcttctcaatgagaagagagaagagctggtaatcagctactacttgagtttgctttgcttgaaggcttgatgagcttagcacctggttggagggggtttatatagtgctaggaaggaagaagggaatgaaaaggcacacatgaccagctgctgacatgcatgcccttatggtgtgtgaccctggacaccaataggcaatatagctgcacacacaaactattcctgatcaatcacagccatgggattgattaaattagatacaagataatcatcagcacccatgcatgacagaaagtgccaatctgctagctttttttt

SEQ ID NO: 17210 - DNA, 2587 bp, Oryza sativa
catgaataagaatcaacacaagtttgactgctcttttcgaaaagaaattaatcagatacgagaaaacgtacctgttaatgaacaatatatctttcaattaattttgttactctgtggctcacatgtagtcatgaaaagcaagatatatataatataatatgtacattatattcccgacgtcaataaagcaagagaatgtattgtacgacgaggatcttctgatggtcaaacatgccctgcatctgcaactcagattacattctgttagtacatctcagaagcatctctcctttgacaacttgcaataagcatgtccaggttcagtgtattatatagttactcagtacaattctacaacattcagctagaggttaacaaaatatctaataaagatatagagattaaaataatttctgcactaaacatggagctgaaaggtagatctagctagctagctagcaagcaagcttttttagtcggcattttcaggaatctttgcaagtcagttctattgtcatacagaatcaagaagatccaggtgagcgagacattcacggccgtgcgaatattccttctagatacaggttattagcaaccataagctaaaagaattaaagcaattaactggcgaataagagaggaaaaacgatgaaccttttctcctctctcacttgatcatctcgccgtcaccttttcccactgatggttaattaatttacttatgaaaagttgaaccctttttttcttctttggctttttagtaatctatttgaacaaacatatgcataggaatgtgctatatatatattaacttaatttgttttctttcatggatgttatataaagtgtttgggcaacaaaaaataagatcactgtgaaattttaagcgttggaaaacagcatccaattaatgtgatatttgggaaatttaagttggtaatgtaccattcatactacataaacgatttttctatacaagagcccctatagattgcagacagaccataaccaatggcgtctataaaaatcaagctccatttttgcatgcggctccttaagagatatgcgtgcgaaaaatatattttcgcaggcggatatgttaagggaacgcatgcaaaaagtgagcctatttttgcatgcggtcttcttaaaggaccacataccaaaatagattaccttcacagatgttttttctcctctcttttccctctcagacacatcaaaattttcacttctcccctcaatttattactttcacctctctctctcttcctctctctccctctcctctctctctcttcctctcctctcttcctccgatcggacggtaggcgggcggcggtggtggcggcggcggctccacctcctcccccgctgggcgactaaaccgccaagcaggcggaggcacgggctccaccccctccaccgcttagcgacctcggacggccccaacgctgacgaggaggcggccgagagcgggtgggcgggaggcgtggctatgggcgcgaggcatagcggctggcgcgtgccgtggcaggcgggctggaggcgcgacagctccacctcctcctccactgcccccttccgcgtggatctggccgccggtccaccccacgcgcacgaatttggcaacggcacgatggatctggcgcgggcgacagtgagagccgtggtggcggccggcggccatctcaacaccaccgccgacgaggaggtgcccaggagccagcggctccacatcctccatcgccaggcgactccaccgcctctctctcgcgtggatccaatggtggcatggcggatccagcaacggcgacgacgggaggcgcgacggcgggggccggcggggttagaggttgggttttttttggaaattttattttatttatcgcgatcttttatttttgcatacggtcgatataaccacccgtatgcgaaaataggacttccgcatgcgggtgcaccacctgcgcgcatggaaaaaacactatttttgctaaccttttggtgcaaacggctggcttaaccacatgaaaaaaaatatattttggccgcacggaaaaatggcttttgtagtagtgcatggccggaccagaaaggcatgtattgtttaccgacatttattatatgttgattcactagtgaataccggtgggtacactggaataccagagaactgatctttcgtcgaatggctcaaaacagaaatatctcggctcttataagaaccgatactaaagatgatttttactaccgggtaaatagttccgtcccgctgtagaatatttagtgctagttggtaacaccaatcagtactaaaattggtttttattactggttcactgttttcaaaccatgttaggtcccccggtcggcgcaagggatctttagtactggttggtgtcaccaattaatactaaagatctatactttattacaggttgtacttaaaaatgcccgtttttttgacaaattgacccttttcaaaaacttaattcgaaactaacccctgccaaaaacttcaaccaaaactaggccgtcggctcagcgccaagcgcattggcgctgaggttggccgtgtcagcgc

SEQ ID NO: 17211 - DNA, 1401 bp, Oryza sativa
aaggtcataacaaaggtggataggcatggctagataaaacagtgataacgcgggaatttaaataaagcgataatgcaataatttaaagcaacataattttataaactgggattcaatatgttcaaggatgatgtgacttgccttgctcgctttcccaaacgtcggcttcaacttccacgaagagcggatcttccgaagctgcagcgtctacacgaccaacggaaaagaaacggcttttactctaataaactccctataacaagcagaaacaaagcacaaaaatgggttcttgacttcttaaggaaaaattagagacttgaacggtccaattccgagttcaaatggccaagatatggccatttgaagtttatatgctctttaaatggatatttgcgaatttcttcatttaaattttaatttaaaaatcggatttattgcgtcagccgaggggaggggcgcgcggaccgggtccacgggagtggggcccacgcggcagcctcacggtccacggtggaccgggtgcacgcagcttgcgccggccggcgccgtgggtcccacgcgtcagccgcacccgagggcgcgggcggctgacggccgggccccacatggcagccgcggggcgcgcccgaaggcggcctcgccggcacagccgacgaaaggcgacgcgcccgcgccccgatggtcgccggcggcgacctccggcgcgacggagcggcgcccgagagaggggagggaagggggaagcgaaatggcggtcctcggctcaccccgggtcgacggcgacgacggaaacggcgaccgaagtggagagaggcggcggcgcggctcgggtcgacgaggacggcggcattccggcggtcggcgggcgaaacgaaggggtggacgaggtcggcgaggacgcggcgaagccgaaggaggcgatgccgaagcgggaggaggtccggggcgacggcggcggcggaccgaagctcggcggcgacggcggagagagaggacgacggcgcgagctcgattccgacggggagagagagcggcgagcggcggaaacggaggagggaggcacggggagcgtttatatagtgttgggagtgagagagggcggccggaggggaaggaaaccggcgcggctatctcggctccatcaatgacgccggcgaagtttgcgggaggatttccaaacgaatccgagagagagagagagagggaaaagtggggggggaaagagggagggaatcacggggagtgatttccccctctttattgcgcgcgggggcggcgggatgcggcggaatccgcggcggcggcggcgctagggcacgggcgaggcggcgggagcggcgggaggacagggatgacaggtgggccccacccgtcagcgaggtggcgggcgggcccgcccgt

SEQ ID NO: 17212 - DNA, 4855 bp, Oryza sativa
ccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatctaacgcgtcagtaaagtatactgtggcttgtctcgatcgccattgcaaatggcagattaatgcaaggaagagtggaggagataggtggcgggtgactagggtgggcgaagaccacacatgctgtagtgcggaagtaaccggcaagcatttgcaacttacttcaaggtttattggaaacaagttacaggcatttgtgcgagttgaaccaactttatctccagcagcgattgtcgaggcagttgagcaaatatggcactatcggcctacgtatggcaaagcatggcgtgctaagcaagttgctatgaaggtcatttggggagattgggacgaggcgtatgttcgcttgcctacactgatgcgtgccatcaaagcaaagaaccctaccatgcatttccgtgttgaggctcatcccgaaagtccaggatggtggatggagtacagaggcgagtatttggacgtgcatattggatatttggccagtccatagaagcattcaagcacttgaggccggtgctagcaattgatggcactttcttaaccggtaaataccaaggtacattgctcacggcaataggggtcgacgccgggttacatcttgttcccttggcgtttgctctggtagagaaggagaatacatccaactgggagtggttcatcaacatgttgagaaacaagttgatcggtcctaatagagaagtgtgtataatttctgatagacaccctggcattttgaactccatcatccacatcatgcctcatcacctaaccattcaccacaggtggtgcatgaggcacttctgtgctaacttctacacagctggagctacgactaatcagatgaaagatcttgagcgcatatgtcaaataaatgagaaagcattgttcctagatgagataaaacgcctcatgggtgtggtcggagagaggccaaagaagtggctagaagaccatatgccacttaaggtcaaatgggcaagagcatttgataccaacgggcgtcgtcatagcatcatgactagtaatatggccgagagtttcaataatgtattgagaggcattcggaaactgccggttacagctattgtggcatacacattttcgaagtgcaatagttggtttgtcgatagacacaaagaggcaactgtagatatcctgtgtggaaagaagtggcccacaaaagttaaggacatgttggaggagcagcaaagacgaaccttggggcaaagagcagcatgttttgatttcccttcaatgaagtatgaggtcagcgagcaaggcggagtcacggcggctggggttcaatggggtggacgtcactacgtcgtggttgcgagagataacacatgtagttgtcagttccctcagctccatcacttgccatgctcccacatgataaccgtttgtaagttgtgaggtttggatgtggaggtggccccccgaatgtgttatgaagcttccaataaggctgtgcaggactcgtactcccctaggtttgaaccttacctagatccatcgcagtggccaagttatgatggagagttcttcgtgcccgatttgtcgttaaagaacaacacacgaggaagaagaaggacaagaaggttcaagaacgatatggacaaagcatacaaaggctcagccaaccgacggtcacaaaagccgaacaatacaaattcagagccagtcatgcaaaatagatgctcgctatgccacgaactaggccataagaaaactaggtgcccgaagcgagacaagtctaaggatcgaccgaaaaagcgccgtaggacggggggaggtggtgagggtagcacacaggtgggattggatgacattcatttgctaagttcatattgttgcttcaatgtttactttctattgtcctcctttccattctcattgtgatttttccatttaatattttttcaattactaattattccattttcatttgcaggatggagtactttccggggttggaggatttctacgaggagaagcaccgggccccacagattgccagcggagaggttagcatcaacaatattccattttttttatgatcgaatttattttttcttctttgattttagtttgtacagatagatcatccatcatagagatatctcaaatcaaagttcaggagcctcaaagcagagcatgtaaacacacagatcttcttttcagttttcttgctcaatcccaaaattaaagttcctagttgcatgatgtattttccacaacccttgtatatgatatattgtcgctaactttatgttattatgtttgtctattgatgcagcgcttgaagacccttcgagtcagaggtcacacggcgcacatactgttcgacgaccggtacgtcccgtacctacggcgggcgaagctcttggcgttcgtgaccatggcgcagcgaccggtgcctctgtacaacgccgctgctctgacggccctagtggaccggtggcgtccagagacacacaccttccacctaccgtgcggggagctgacggtcactttggaggacgtcgccatgatcctgggtcttcctatccggggtcaggcggtcacaggtgacacagcgtcagggaattactaacgagtcttcgtattcatttgttaatttttttgcaattactaatgattccatttaatttccggttacaggtgacacagcgtcggggaactggagggagagggtcgaggagtaccttggtctggagcctccagtggcacctgatggtcagaggcagacgaagacatcaggggttccttcgagttggttgcgagccaacttcggtcagtgtcccgctgaggcagacgaggctacagtacagcgatactgcagggcgtacgtgctgtacatctttggcagtattctgttccctgactctggtggagacatggcttcttggatgtggctgccgttgctcgcggactgggacgaggcgggtaccttcagctgggggtcggctgccctagcctggttgtaccggcaactctgtgatgcttgccgaaggcaaggcggggacgcgaacctagcaggctgtgtttggttgctacaggtaagttcacgcatgttatgtttcataacatttcaatttcttgctaacatgttggaagctaacgtatgtgacacaggtttggatgtggatgaggcttccagttggtcggcccatgtggaggacccatcaggcttggccgcaccaggatgcagaccgacgtcccactgtagctcacctgtgggaatcggtcccatctccagtagtaggccgcaggaatttggcgtactaccactacacaaacgagatggactacctacagccagaacatgtaagctattcggggttctatcacacatgaagatggtttcttactatatagtactaaatgtgcttcaatgtgttttatttttgttgctgcaggtggtgtggatgccatatcaggcacaggaagtgctcgagctagaactgaatcccatgtgccatatagaggatgcgttgaagaccctacggtgcccactgatctgcttctatgcagtggagttccagatgtgccaccgcgtgatgcggcaattcgggaggcttcaaacaatcccgcaccatttctccacgagtatcgacctacacaagttagtaatttcacttaacaatttattttgcttgcccaatcagtcacttcaacatttactacatatttgagttggacattttgcatacgtgcagggtggaccgtcggaagaacaagaaggtgactgattgggcttactaccatcaggatcatatcacgcaatgggagaagttcgaggagaatggagtaccagaccagggtcagcacaacgggacggagttcgacttgtacttggcgtggctccacaggacctaccgtcttgtccttcgtccggcttggacactagccgacatagcggatgaccccgaggatgttgaggagcagaacgagtacgatactcgtacccgtctaggtaccacggtcgagacgggacctgttcgcgacagagtggttagtttctagcattaatgttgtatattatttcatttcaatgccatatatgttgtgacttacttcatttcaatcctacaggctcgagagctcttgcggaccgtcaacgacgcgggagtggcgctaggcacggctcctggctccgaaggagagggcggcaccctccgcaacgccctacaggtaatcgttggaaagagatgaaactacggtgttttcttccaaaagcgataacttaacatggattattttttatgcagagactacggcagcgatgtcggaagttggcagcaaggctcggctgcaggtcgactgatgtggtcgaacatgctcatgcccaccaagagggggatgaagaaggggaggtgggtgacgaggagggcgagcaagacaaagaggcggaggaaggagatgaggaggaagaaggggatgaggacagagaagaggaggcggatgagctcggtccctcgcagctagaggacgcaccagagtcgtcacagccggatatctcgcagcccggcccgtctcgaccacgacgccggcgggctccttcgcaggactggaggtacacccccgacgtgcctcgtcctcgcactagaggtaggaggaggtgagtgcatggttcaatggatggatggatagatggatggacttgatgcatggttcgatggatgtatggactggatgtatggactcgactggatgta

SEQ ID NO: 17213 - DNA, 1608 bp, Oryza sativa
ccagcccgcaagccatccagaaggctcgaaacggccaaggcccacctcagcgccaggtggactggcgctgagtgtcccacggtcagcgccattatggctggcgctgaggtcccagcccgcaagccatccagcaggcttgctggtctgggccttgggggttgcggccaagtcccacctcagcgccaggtgggctggcgctgagtgtcccacggtccgcgccattatggctagcgctgaggtccaagcccgcaagccatccagaaggcttgctggtttgggccttgggggttgcggccaagtcccacctcagcgccagtccggttggcgctgaggtagctgccacgtcaactggggatcggcctggccgccacggtggcacaatgtcagcgccagtcccgttggcgctgacacggccaacatcagcgccaatgtgtttggcgctgaggcgacgacctatttttggttgaagtttttggcaggggttagtttcgaaataagttttccaaaagggtcaatttgtcaaaaaaagggtaaaaatgctgaacatattagtaccgtctggagagaccaaccgatatatgtattgatctttagcactaattggtgacaccaactggtactaaagataatatttgcctttttatgccttctttcttctctagcccgagccattggtaccaagctagagaaggaagctaagagatgtgctgccaaaatttttgatgaaagtattttggtaatattacacaaatcaaaggaatctaaaaggctataaacttcatcctctattgatgtatggttaacttattgcatttctagccatgtttctatcgtcattctctctcaaaaatatatggaaaaagatgagagataataagcatacttcgtaattttggagacattggatacgaatgtaaaagaagaggcaacaaaggaaaattatattaaatgaaggaaaaaggaatagaaaaatagggaaaatagtagaaaataatagaaaatgaaggagatataatggaaaacatgaaggaaaaacaaatagatagtagaaaagttagtgtggcattgtatggaaaataggaaaaaaactatggcaatagtaaaaaaataaatgaaatctaactgtggttagcaatactcttcatccactcaacttttgagtttatgatattgtaacgtcctgccttccccaggccgggcccgcttacatctgatagctttcataggtcatagactgccctcacagactaacacatgtcttttctgcacactttgtcctcactcgtgtgcacccgggaagaattcccccaggccgggcccgcttacatctgatagctttcataggtcatagactgctctcacagactaacacatgtcttttctgcacactttgtcctcactcgtgtgcacccgggaaatgtcttttctgcacactttgtcctcactcgtgtgcacccgggaagaattcccggtcggtcacccatcccaaattgctccaggccaagcacgcttaaccctggagttctttggagattggctgccggaaaagaagttgcaacttgttgatatgaatattctattaatcctattaagccctacgccggaatg

SEQ ID NO: 17214 - DNA, 2343 bp, Oryza sativa
gggggagcaattttggcaggcaatagtagttatggcccgcctacaatctactggccatcccacacaggaaaaattgtttctgtcgtagtgttctctttgtacatatgtaatatatagaattatcaacattggggatttcgatctgcataaataaacaccgttacaccgtcctttacatcctttaattaaagaaggctaaagggtgatcgattacatagatgataaatagtgatccacattagatcccatataataattgtattctttttgctcaagaggcctaatatcctatgtcaaatagcatctctaagctgcatgtgtactgctggagaagtgtacaatagtactggccggttagcaaccccttctagtcccagttgtgctatcggtacgcataattcatgactagaaatgggtacctaaaaaaatagccatcaataaacttcttcaaccgtcggtccgcggtatacatccgttgctagttcatttgcatcaaataaaagaaatttaaaggaagtctgcgaaagtgaaaagaatgaaaaaagctattaataattaaaaatatctgtcacgccccgaactagtcccaactggaactagcccgtgacgctccaaattaacctgttaatcgataccagtcccaggaaacagtgctggtatcacaggaagacagaatatcacagcaacagaggtctctttattatagagtaggagtacagtcatgttgggctgcggacagatcccgagctcacaactgcattacaaaaggaaagcggaagccaggactaggaccaaacaacacaggcgcgacttgagaactaggccgaaaccctaaaactcatcgtagccggcttgctcctggaagaactcctcatcagcaggatccgcttcatcttcttcagcaactgggggggattatttatatagagcaagggtgagtacgggagtactcagcaagccatgggaaataagtgtttaatgcaggcttcaaggaaaggctgttgtttttgcaattgattttagttgaactcttttctaaaaacaactaagtgagtgctcctcaaacgacacggatgagacagtgcgtctcgtccggtcggagtatgtgcaatgtatcagtcttgaaaatttaaaacaaggttggcacccggccaacagcttttcaaacggccacccgggcctacaactttcaaacggccacccgggcctagctgatcccatcagctgcagatttttcaaacatcgaacccctttccataacagcaatttcacaagcagtagtcaaacaaactacgctaggaatcacctcacatccgcccatgaccgtgggcacggctgttcgaacagtttgttaacctctgcagagggggtacactttacccacacgacattactaacccggatcacccagcccgtggggatcagccacgtcgggagacctccaaactttcatgacaaggcatttccaaagccgatacaggtttaccatatgccgacgagaggggtcccagaccaacaacaggttaggtcccagaccatactgtgccaggaagcccaggggtcctccccgacaccaccccggcgaatccacatgtctctcgacatcaaggctcccctgataagctagttactcagccaggggtgtcccattccacccatgtggtcgtacttgtcttatgtttggatgaaattccaaggaatcggtccttaagtgcgagagcgggaaaaaccgtacacccggtacgttccccggtccgcggttttggaaattcatttagttcgcaagcgccgacccaggtgtcgggttttccaactcttttgtaaaactccagttttacccaagttgttactcagattttaagtttgaaggcgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacagattaagtgcgatcctatcaatgcataatattttgcaagcaacataattaaatttcaaatataggctcaagatgttcaaaggtggcttgccttgctcgagatctggagcttgatcctcgaaatcctcgcactgcgggtcttcgggctccgaaactacacgcgaaacggggcaactcaacaaacggtgaaaataaagccctattaatgacctctaagcgtgccattagatagatctcgagatttgaggaattttggaagttgaacggagtcaaacggatttacggttgggaagatattgaattctaaaatattggattttcgtctaaag

SEQ ID NO: 17215 - DNA, 853 bp, Oryza sativa
ccccggggtagatgggccgagagggattcggcccatcgaccccgggggaggcaaaatagacttttgcggagggatttgatttggaaggatttggattcggaattgaactcgacgatatatcggggattgagatcttgagatggcacggacactagacgacaagcgaagaaacaaatttcgcaattagggtttttagagataattttcctgctaggcgccacgacggaacgggcgctacagacggttgcgcggttgagagctgcacgcactagccaccacaccatctcgttgcttctttaagttggtcgaacaaatcgtcaatccgtggcagcgggtacttgttctttatagttacttcattcagggctctatagtcgattaccattctctcagagccatcctttttcttaaccagaagcactagggctccccaaggggatgagctaggtcgcacataacccttactctccaattcttcgatttgtcttttaacttctgctaactcattagctgccattcggtagggtctttttgccattggtgcagtgcctggcgccagttctatggtgaactcaatctctcggtctggtggcatactcgttaattcttctgggaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacttttcggcacaatttatctgtcctttgtgcttagccaaccaatccatccctaggatgatgtccaagctttgcgagtctaggactatcggtttggctag

SEQ ID NO: 17216 - DNA, 615 bp, Oryza sativa
  unsure (1)..(615): unsure at all n locations
atgtggaggagaatgtgcagaggacaatgtgccgttaagggaggaagttaatgtggaggagaatgtgccggtaagagaggaaggagatgttgaggatggtcgggaggtaggagatgatgtggagttgcctgaggaagaagcgaatgctaagaatgtaagtatgggcctaagggagttggctaggctgaaattctatacccgagaggagtgtgaggaggctatgatacgcagtggattgaacccaggctggttggagtatgatacagaggatgaattggatgagtccgcttccgactccgatgatgatcgtccagtgcgtaaggactgtgtttgcgaaactggtgggtagaaacccggaaataacacaattcgaggatcttaccagatctgggctagcaattgctgatggggatccacaatatgacggtgccttcgaaccaatgtgtgatgaaccaaggaaggggttggagtttcgatcgatggatgatctgaaaatatggctacagagttattctatccgtgtccaccggccgtaccatgtgaaggaatnnnnnnnnnnnnnnnnnnnnnnnnnnnnnnnnnnnnnnnnnnnnnnnnnnnnnnnnnnnnnnnnnn

SEQ ID NO: 17217 - DNA, 1865 bp, Oryza sativa
  unsure (1)..(1865): unsure at all n locations
aggtaagatcggctgaaactccgatactaccctaatcggcaaccaagaagcaggctagagattgagattctaatcacgactcataagatcaaactcaactaatgtagctataagtatgaaaagaaggacaatatctagacaatcaagccgttggaagtttcatagagtggtggataccttatataatctaagtcaacatcgatatctaacctaatcggctgccctctaccaatagatgttagccgattgtagattagatagcaatattgccagagattatgcaagatatatgataactcgacgaattacgtaaacaagataagagtatcataaagatggaagcactaatcccgagaacgcaagccgtcataacaagttttacctcttgtgaagatcgaaaccgatgcagctcaacccgaaagcaagaactcgtcgaaataaaacgaaagtaaaaagagtggcgatgcaccgagattgtattgaacgtgtgtttatttaattacatggggttcgaggtctatttatacccgagaattacaaactatgtccatatcggacacgactcttatctctaacaaacactaagaaaccataagtctttacggcagacttttgcccaaacatatctctaaggaaattacataaaatatcctaattaatagatacaattgccttctcaggactctagccatgtgtggcaaccatcttgaagcatatcaactcaacccgatgtcgtacaccaaatcgtattgtccgaatcggctgtatcacctaacccagtctgactcgaacttagccgatcccgatcgtagctgatccgaactccagccgattcttactctgtttccgcgacgatcctcatttttgattccgcttcgatctaatcttcttctccgataccaatattaccaaatttggtcgttaacactgcttcaattactttgaggatgggcgaagaatgttagtggtgcatataaaaaaggaaaaagctaaactaatagcaaaggcaaatgagctggataaattagccgagatgagaattttgactagtcaggaacatgagctaaaaaattcagtaaagcaggccttagcaaagttgttgagagaagaagaatttaaatggtaccaaagagctaaaacaaagaaaattatggaaggagacaataatactaaatattatcatatgattgcaaatggaaagcatagaaaaactaagatttttcagcttgacctagaagagggtgtaatcaaaggagatgaggagcttaggaagtatataactaagttctataagaacctttttggggcccccgaaagaaataatttttctatgttcgaggaccaaaaagacgatataccacaggtgacggtgacagaaaatgaaatgttaacaagagaattttctgaagaagtcaaaattgccatttttcaaatggaacacaataaagctccaggacctgacggttttccgggaaagtttcatccagtattctgggatgtgattaaagatgacttaaccgcagtctttagggacttccatggggacaatctttctctcgagagtttgaattttgtaattattactcgtcttcctagcaataaggaggcaaggataattcgacagtacataccaatatgtttaagtgtgtcagtatagagtgtgtaatagggtaatacctgtttcgtgtgtgtaattgctatccgcttcctattccactcacacatccgcgctgttgagcataaagtgtaaaacgtggggtgcttaatttgttagttaactcacgctcattnnnnnnnnnnnnnnnnnnnnnnnnnnnnnnnnnnnnnnnnnnnnnnnnnnnnnnnnnnnnnnnnnnnnnnnnnnn

SEQ ID NO: 17218 - DNA, 738 bp, Oryza sativa
  unsure (1)..(738): unsure at all n locations
nnnnnnnnnnnnnnnnnnnnnnnnnnnnnnnnnnnnttaaccgggattaaagatgaatatctttagtcccggatttatagtcccggtttgtaacccagaattaaggggagttacaaaccatgactaaaaacccctttcccagtggtggtatcgattctgaaggatctataggtaccggttctggtaccggcactaatggcccaagtctaatagcagaggtacatagaacacctaggtaccaatgagtggttatagattatagctactccctctgtttcacaatataagtcattctaaaattttctacattcatatggttgttaatgaatctagatatataaatatgtctagattcattaacaactatatgaatgtgggaaatgctaaaatgacttatattgtgaaatggaggaagtagttcataaaaaccgacagttatatgatgtccataagtatcagttgatataagaaccgacaattatgacttgggagctatatgggggcgtcttcgttggcactgagaatgaacagctgccaatcaggagcaacgacgcgagcatggccttgccatcctcgactttgtcgtctggccgccagagcaagggcaaggagcgtgaggagtattgaggagatgccaactcgtcgtctattatgtttggccaagggagtgcgggcgacgcgacgcgttgctagtgtcggaaaccggagtgggggcgacggtgaccatatccattggtg

SEQ ID NO: 17219 - DNA, 800 bp, Oryza sativa
  unsure (1)..(800): unsure at all n locations
aannnnnnnnnnnnnnnnnnnnnnnnnnnnnnnnnnnnnnnnnnnnnnnnnnnnnnnnnagcacatttagtactatatagtaagaaaccatcttcatgtgtgatagaaccccgaatagcttacatgttctggctgtaggtagtccatctcgtttgtgtagtggtagtacgccaaattcctgcggcctactactggagatgggaccgattcccacaggtgagctacagtgggacgtcggtctgcatcctggtgcggccaagcctgatgggtcctccacatgggccgaccaactggaagcctcatccacatccaaacctgtgtcacatacgttagcttccaacatgttagcaagaaattgaaatgttatgaaacataacatgcgtgaacttacctgtagcaaccaaacacagcctgctaggttcgcgtccccgccttgccttcggcaagcatcacagagttgccggtacaaccaggctagggcagccgacccccagctgaaggtacccgcctcgtcccagtccgcgagcaacggcagccacatccaagaagccatgtctccaccagagtcagggaacagaatactgccaaagatgtacagcacgtacgccctgcagtatcgctgtactgtagcctcgtctgcctcagcgggacactgaccgaagttggctcgcaaccaactcgaaggaacccctgatgtcttcgtctgcctctgaccatcaggtgccactggaggctccagaccaaggtactcctcgaccctctccctccagttcccagacgctgtgtctacctgtaaccgg

SEQ ID NO: 17220 - DNA, 477 bp, Oryza sativa
atcgtaatatatatatgtaagttgagatggatgtcaatgccaaaataaaaaagaaattgaaccagaaaagtaacgaccaacccaacaggtactgaggtaaaatctaaataaataatcaattcttatctttttttttgaacctgtaaacttttcgataaaatgttgtatgcttgaaccagaaaagtgacgaccaacccaacaggtactgaggtaaaatctaaataaataatcaattcttatcttttttttgaacctgtaaacttttcgataaaatgttgtatgctttgtagtaaaagtaacctaaataataccgttgatataatgcgagtctgactgggtctcaattttttttttattttttagaccttttatttttaaattttattagggggcatttgcaaatttgccaccgatttttttaattttgcaagaatgccactcgagtgacggttctagtggcatttttgcaattttcta

SEQ ID NO: 17221 - DNA, 645 bp, Oryza sativa
  unsure (1)..(645): unsure at all n locations
nnnnnnnnnnnnnnnnnnnnnnnnnnnnnnnnnnnnnnnnnttttcttcagaaagaaaatgtgcaggtttggttttctataatttttctagagaggaaacgttcaggttttggatgtttttgcttggaataagtccactttgactatcttaaatatatctctaatctaattcatatcccgtaacaacaataccggatatcttgaccccctcaaatattacaactggtataatttaactccctcagcagttttggaggatgggtccgctgacatggcgctttgaccgggtctatctcgctgggtcatcctgtgggacccacatgtcattctcacactccttcccttttttcccatttctctctctccttcatcttccccattcgacttcaatacagtgggctgagggacgatgactccaccacccgtgccgtgaggggaggccgcagcctcgtcatcatcgtggttgctctccacatatctgaagctttcgagcctccattctcagcttcccagggcaagcctcatcgatctgtagcgttgtatcaagaagcagcgggtgacgttctattnnnnnnnnnnnnnnnnnnnnnnnnnnnnnnnnnnnnnnnnnnnnnnnnnnnnnnnnnnnnnnnnnnnnnnnnnnnn

SEQ ID NO: 17222 - DNA, 151 bp, Oryza sativa
ccagcccacctggcgctgaggtgggacttggccgtttcggccgtggcccagcccagcaagccttctggatggctgggctgggacctcagcgccaggtgcactagcgctgagtttggacatgtcagcgccatttagcatggcgctgacgtcc

SEQ ID NO: 17223 - DNA, 681 bp, Oryza sativa
  unsure (1)..(681): unsure at all n locations
cacggcatgacatggcgtgttggtcgggccgtgccggtgctggcctgactgatcacgggccgtaccttggtcatgctcaggctgggccgtgcagggcggtccatttggccatttatagatggaagcttatattttgacttagtctatatagggtaccccttctgtgttttaattataagtcgtttctaatttttcattaagtttttaagtgtaattaaacttaagaaaaatataatggggcgatggattaaaaaccttgtaaggaaaggctatcaaagtcgttgactattaatccggttgaaaagtttgaagtcagtccaatttgcgaatcaatcgagctccccttgcaatgatgtggtggtcaacctctcattcgtcttttagtgctcaatattttcaataaaaataaatattgcccacagactgacttggacacccgattagctagtattggggggggggggagataggggttcggaggaggaaaattttagagagaaagaaggatgtgttcaaagggggcttcaataataggtatggctgcatggggtaggaagttgatcgatggccggtgatatatatggcagtgcatcatcacagcgatagtggcaccactannnnnnnnnnnnnnnnnnnnnnnnnnnnnnnnnnnnnnnnnnnnnnnnnnnnnnnnnnnnnnnn

SEQ ID NO: 17224 - DNA, 1154 bp, Oryza sativa
  unsure (1)..(1154): unsure at all n locations
nnnnnnnnnnnnnnnnnnnnnnnnnnnnnnnnnnnnnnnacaagtcgtcttataggatgagcgtctctgaaaataacacatttccacatgcggtcgcattaagggaccgcctataattaaaaaactatttctgaaaaatgtctagtcctttcatcttcctcgaggaagccgatcgagctggcgcttcattgatcacactagtagcctagacgtccatgccagctgtcaacgccagtcatatcatccactaccactccacctcctcacctcccctctcctcatattcagtaaatagagggcaatatgggtgggtttttctcatcgcactcttctcttcttctttctcgcatgccttcgaccatgatggacttgccgcaccaactttgttacaacaccactgatgaggaagaggagctccctgagctattgtcggactacttcctccccctgctagcgcttccactgaggaagaactatgaaacaccaatgatgagcgttttttcgatgataggtcaatagtgccattgtactctgatgaggaggaggacatcaacaacaaggaaaaaagtggcaggagatgtgactggcacagaggaggatgtgacgggaggcacatagaggagcatgtggtaggcatggcagcccgcatggtggccagcgcgccttcgggaggcgagctactagcgaagagactatgtcaggagtagtatagtagttaattataattaatgtagttagtttagtaatgtaattaatttgtagtatgtgttattaattagttgatgaaaagttaattacttttggaatgcgtaataaccttgatttttgggtggtcggcttaaacaaccgcttctagaattctacttctatgaataatgtagtggcttctagcttctcacttccttatttgctctccgtgctcatactttcttcctcactctttccctccctccctccctagtgttggcctcatggtggagacaagaaccggtgcgagggaaaccctaattttcagttctggcaatggtggtcctagacctagtggaaaaaaccctgactactctccacgatttctcgcaagagcaatcaccaagtgcaggagcgctccagccagagcatgagcaaaagagcaggagctggattattcttgcaat

SEQ ID NO: 17225 - DNA, 3781 bp, Oryza sativa
ttcgcccgcgacgatgtcatcctccgctagctagtctaccgcgccgtcagccgagtatgctgaggtaaggtctcatcggctagatctcttttctcggatcagattggtttttctattcctcatcctgctttccccttcttgattctcttgaatttgtagcacctctccaatctagttgcaattccaagcctctcgcatgaaaattacaaatttctcagcccggttggcaaccctgatcctaccgaatttatcatcggtgaaacaaatagggttcctttcagattagccaacccaaatctaggtcattggaagaacaccttcatatcttggctatctcttgagaaaaccccacccgagaagagctggaccacgtggttcaagcgcatgtcagctagtaaaagagttcattgggacgaaattagaatcggccaagcactcgaccttaccatagccaattcagccaaggacgaacccctaatggcagccgcctcctatttctggtccaacaccatcaatgccttcttgttcaaccaagggccgatgaccccaactctagtagacatcactatgatcaccggtctagatgtcacctcattggctaaccccatgagtttgaacacgaagaatcagtatgacttcatgaccaagagcataggcggttggtcaggttatgtagcaacatacatgggtcaaggctctatcacccctcgagagcgtgtagcctttctactgatgtggctagagaaatctcttttgtggatcaagctgtggccctacaaccaattggcagtttatagccgaagccttggaaacaaagaagcaatttcctttaggaaaaatccttctcggctacttatatcaaatgctaaacaatgcatcagccaaaatagtcgtccgctcagtagtcggagcaggtggaccatggtggttgttacaatcttggctgaatctagtagtcatgaaatttgtcaatcggccgtccgtaacagaagcagatttcccgagactggagccgattatagatgatgatggagaggaacacacccatcgtaggtgtacatcatatggagaatatacctccacaccaaccgatgcatgagcaaagctatcgaccgagctgctcaaagactggttttgcagcttttatgatggctttctcaaagaagctcgaatttggttcctctacgaagattcatcgcttctagagaatctatcagactttagatttgaagacatcaaccatgaaagataccaaaagtctagagaagtccttttagctgcaatcagcccatgcatccttcctgtcggcattcatcaaggaagaaatatcaaggtttcttatgagttctattacccaattagctcagctagacaattgggaatgggtcaactcccaatcagcttattctttgctgataagatccagtgccgaggagaaatctcatcaaccctgatgatgtatcggctgctaaatctccaaggacctcctctaggaagcattgaaaacatagagctggaaaccttcaggagcaaaacatttgacagatggtgaggcgagtggaaactgcatctattccatcaatcggcttccatgacagatctctttccagacgttatccctcaggtatgtcttgattaattttttgaataattgctcagccgattcataacttgactaattttcttttgaaatgcagacgacagaattttctcctcctcaccagagcaatagtaacagaaatatcaaatatgctccaggtctaattcctaatggaggcggaccatctccccctatcattggctttcatgcccccaggacttcaactcttcttcaagggctcatcagagaaccagccgatgccagcaaaaagaaaagaaccagatcatcggctgtggatgcatcagctcctgctccaaagaagaaggccaaactaaagaagcctatgccaaccgatgatctgcctgccctagatccatccattgaacaagctctagatgaagaagaaatcggcgaggatgttgatcaagccgcagataaagtaagcgataccgaaagaactccatcggcttctcctaagcacactcgtccaactccttctgctccagcccatttttcaagggtaagcaacttcctctgattctttttgcaacttcttcacttatagctgattcctcacagactttatagttccagaagaagaaaaccgctgtaaagaagaatcggcagcaacgattttcaaaccagctccaccagtaagacattctttatttttttactagttgatctcagccgattttgtctaacatttgcctcttttatagcctcctcctcctccttcttcccctgtacaacaatcattgagtgatcaaactccatcggctgtagagaggcaccatattgaagaagaagaacaaccagctattcctactatcccagtaagtcttgtctatacaaatcttgaatcggccaaataactcatgttgatactcaactgtttttaaattccttcttgcaggccttagccgatctgttctctttcgaaattaaagactatcttgatgaagaaacagaagaagacaccaccagcaagtctttggctcccttgtctgatgatgtgaagaaaacccttgaagacatctctcatcggctagaagcatcatcactagacaacttggtggtaaactgtgggccgattaggactcggttacacgagatccatgctctaatcccagatgagctagccgatgtccttactctagctatatatcttgagcagcaccaattcaagctggaaaaaagccaaactaagattagccgaatgtcgggagcgcaaacatatatcgaagctacaatccaagccaatcgacagcttgttcatgaagagaaggccaaacttgatcagctatctgagggcccgattaaatctattattgatcggcacaacttgaagaatgcaacgctgagctggatatggaacataaaatgctagccgatctcccaaagtctgtcgaggagcaaaaggcaagattaaaatcggctatcaagattgttgctgatctcaccaagtctttaaaagtcattcctggaaccgtgctcaagatgcccaagccatggaagaagtagaacaaatcaggcaaaggctattttggctatccagcaatatttgtctcggtgactttctgtgtattagaccttagaaatttttgtaatcggctaagatactctggtactttattgtcttgacaatcctttgtgccgattaatataacttctaaatttgctaaaatattttcatttttcgtatatatgtgcctccttaattttacaatgtcaaaagcattgataaaattataaaaacaactaagggcgatataacaatatcggccattgtacatcggcaaaccacaaccgatttacaatatgaaaaacagctaagggcgatataaccatatcggccatctcaaggcgatgcaaacacatcggctatcatgtatcggcaagcatcagccaatcatgcgttaacccaaacacttgggtaatatttcttcaagtacttgccatttagtgctcttccataaacttccccatcgagtccttgcaacatgtaagctcccttagacacaactttatagatttgcaacggtccttcccagttcggtgaccacttgccgaatttgctatcccgagtcccaatcggcaaaatcaacttccatacaagttcaccttccgaaaaatctttgggcaccactttcttgttgtaatgccgagcaactcgttcct

SEQ ID NO: 17226 - DNA, 2006 bp, Oryza sativa
ccatccgataagaccacaatgcttcggctaatctagtatgccattgccgaggataatcaaaaatctttctcttaatcaatttgatcaagctcttgttagatgcttcggcctgcccattagcttgtgcataatatggtgaagagttcaacaatttaatacccatgctatcggcaaactgaacaaactcatcggacacgaaaattgaaccttgatcggttgtaatggtttgaggaataccaaatcgataaattatatgctcttgaacaaactgtatagcatccccagaatcgactttcttcaaaggagtcgcctctacccacttggtaaaataatcggttgccaccaatataaacttatgtcctttacttgagggtggattaatcatgccgatcatatcaattccccaacctctaaatggccatggtttaatgataggattcatagccgacgccggtgccctctgaattgctccaaatttctgacaaccttgacaccctttgtaatacttgaaacaatcctctagcattgtcggccaaaaatatcctacacgccgcagcaaccacttcattttatgagctgattgacgagtaccacaaattccttcatgaacttcgccgattgcaaccttagcctaattggcactgaaacacttaagcaacaccgcatcaatcgtccgataatagagttcatcatccaataaagtatacttcaacgctttatatcgtaatttccgagaagccggttgagatggattctgtaaatattgatgcacatcatatctccaatcatcggttgttattgcagcgacttcaaccttaacatctttgatcatcagcttataccccgatgccccttgggccaaatcattagcttcaatgttttgttctcgagatacatgcttcaaagtaactagccaaagattcttcattagttcttggcacttctcattataaaccatcaatgtatcattcttgtactcatattctcctgccaattgactgattactagcaaagaatcccccacaatttcaatagcatcggcttctacttccatgagcaactgcaaccctttgagaactacctcatactcagcttgattattggttgcataaggtttgatagtataagcaaactcaaaacttgccccccgaggggaaataataaccaagccgatgccacaaccatgagtgtacactgacccatcaaagaataaagtccatgacacaatctcaaccgagccgattgaatcatcacgatgttcaacaataaaatcggctatagcctgccctttgacagccttcggtgactcataccgaagatcaaactcagttaaggaaaatatccactttccaatccttcctttcaaaattggagccgataacatgtacttaacaacatcggctttgcatatgacaatacattcgttggacaatagataatgccttaaccttgtacatgaaaaatacaagcacaagcacaacttctccacaggagaatatctagtttttgcatccatgagtcaacgacttaagtagaatacaactctttcttttccatcaagctcctgaatcagcaactaccttcactttgtacttctgaaccaatgtcaccttgcgggtctccgtgaatgagctcaagaactgattccgtgcttactgcatcattgtatcaaggtctttttgctgctcaggtgtcaacttgtctagagtgacgggcacaatgttggcttcatcaacctcggataagcccagcttctagatcttttctttaacatagccaggaccagccgaggacggcgatgctggtggtttctcggccatggagaaaaactgctgttgtgattctgacttctaatgggtcccaccaagcgtgccaaaagcgtgttgatgaaaaactccagtgcaggtccaaaactcgccttcgggtatgcaagcgtgccacttgatttgatcctgcaatcaacaacaaacgaagacaaagaaaccgcggttaaacctataaaggat

SEQ ID NO: 17227 - DNA, 2303 bp, Oryza sativa
gcatggatgaatctcaccctctctcaagtaatgaatttaagaattcatgtcattctttctcgcatcctcatgttgtaaaaaattaaaatgatataggtttgaacctaggtgactctagtactagttgctgatttggttttgctctaaagggagggtggttgtctcaaatttgaaaacttaggtgctttggcttctcttttggtaaaaaatcatggtggggtcttgtagtaactcagacttacttcatgaggaggatcgggaggatagttttttgcttaacctttcatgtggcgaccttgatggatgaggttatggatgaagaggacattcacctaagttgagatttcgataaagtcctaataaataattatcccaaaaaaaataggaaatgacctaaaaaaaatgagggagggtacggttttaaagtaggaagcaacaaaaggtttcaatgaaaggaattttttggaatagcagaggtcttaaagacttggctaaaatgagattcctttcggaaatttctaaaaagcaaaagctagactttatcgctcttctagaaacggggaaaaacaagtctgttgattcatggcttaaaaacatatgtggaggaagagattttttgtttcactgaacgaggccgaagggtagaattgggggatttttgcttcgagttaatttggagctttttgatgtctctagtatcgacaaaggggatttctatgtaaaatttcatttgcaaaataaagacgacgcgttccaatggattttgtttgctatttatggggcggctcaagatgaatacaaggaagcctttctctctgaattggttaattcttgtagaagggaagcgttacctatgataataggtggagacttcaatattttaaggaatccacaagagaaaaataaagagaactttgataataaatggcccttcttatttaacgatgtcatagatagcttaaatttgagagagattaagctttcagggcataagttcacctgggcaaactctttaccaaacccaatctatgagaagttcgatagcgtgttagttagtgcggagtgggaggagaaaaatccattggtgtctgttcatgcccttacccgagatccctcggatcacacccccctgctgctagacacagggaaagggtctcttaagaacaaccaacccctgtttaaattcgaacttgggtggttgctgagagagaactttcatcaattggtggtcaatagttggtccaaacaagttagagggaggacattgagagatggcaaaataaaattcagagactgcgtgttgatgaaaaacacgaggcctgggagatctgcttaactctagtgcaggtccaaaactcgcctttgggtatgcaagtgtgccagttgatataatcctacaatcaacaagaaacgaagataaagaaaccgcggttaaacctataaatgatagccgatcggcaaggtgccgatgacatatcatttatctgtgagccgatgtcatgtacgtatcgatcggcagttataaatagataataaaggactaaatctactcgatcggctgtagatattaacaatatataatttctatgtcgatatatacttaagtcaagtgattgggatagatcggtcgccatgccgagacagtataaatcaattagatcgaagtatatactaacaatgaaactatataagttcatagcatagcagatcagatagatctagcatgtatcggctaatactccgatactactctatactaagatattaaagcaagtaaaatatatcaaacaaaagccaaatatacttgaatgcaaaaagatcttgatataaagggcatatttaacatatcactaaagcatatggaacaaatatagttaaatcaggtaagatcggctgaaactccgatactaccctaatcggcaaccaagaagcaggctagagattgagattctaatcacgactcataagatcaaactcaactaatgtagctataagtatgaaaagaaggacaatatctagacaatcaagccgttggaagtttcatagagtggtggataccttatataatctaagtcaacatcgatatctaacctaatcggctgccctctaccaatagatgttagccgattgtagattagatagcaatattgccagagattatgcaagatatatgataactcgacgaattacgtaaacaagataagagtatcataaagatggaagcactaatcccgagaacgcaagccgtcataacaagttttacctcttgtgaagatcgaaaccgatgcagctcaacccgaaag

SEQ ID NO: 17228 - DNA, 1067 bp, Oryza sativa
agatcaaactcaactgatgcagctataagtatgaaaagaaggacaatatctagacaatcaagccgttggaagtttcatagagtggttgacaccttatataatctaagtcaacatcgatatctaacctaatcggctgccctctaccaatagatgttagccgactgtagattagatagcgatattgccagagattatgtaagatatatcataactcgatgaattacgtaaacaagatcagagtatcacaaagatggaagcactaatcccgagaacgcaagctgtcataacaagttttacctcttgttgaacatcgaaaccgatgcagctcaacccgaaagcaagaactcgtcgaaataaaacgaaagtaaaaagagtggggatgcgccgagattgtattgaacgtgtgtttatttaattacatgaggttcggggtctatttatacccgagaattacaaactatgtccatatcggacacgactcttatctctaacaaactctaagataccataagtctttatggcagacttttgcccaaacatatctctaaggaaattacataaaatatcctagttaatagatacaattgccttctcaggactctatccatgtgtggcaaccatcttgaagcatatcaactcaacccgatgtcgtacagcaagtcgtattgtcggaatcggctatatcacctaacccagtctgactcgaacttagccgatcccgatcgtagccgattcgaactccagccgattcttactttgtttccgcgacgatcctcatctttgattccgcttcgatctaatcttcttctccgataccgatattaccaaatttggtcgttaacacatgctccccaagtccggaatatttggtaatgtttcggattttccatatatcgactccgagcaagattcgcactctgtcgtttcctgaccgttattccagtgctttaaatactaaccgttgctcccgaaaaatcttcactccgtcacttccgttttcactgccaaagcaaactttgtcctctctctctccgacgattcctccaacgcataaggcgatccccagg

SEQ ID NO: 17229 - DNA, 1492 bp, Oryza sativa
  unsure (1)..(1492): unsure at all n locations
ccgaactagtcccgactgaaactagcccgtgacgctccaaattaacctgttatcgataccagtcccaggaaatagtgctggtatcacaggaagacagaatatccagcaacagaggtctctttattatagagtaggagtacagtcatgttgggctgtggacagatcccgagctcacaactgcattacaaaaggaaagcggaagccaggactagaccaaacaacacaggcgcgacttgggaactaggccgagaccctaaaactcatcgtagccggcttgctcctggaagaactcctcatcagcaggatccgcttcatcttcttcagcaactgggggggattatttatatagagcatgggtgagtacgggagtactcagcaagccatgggaaataagtgtttaatgcaggcttcaaggaaaggctgttgtttttgcaattgattttagttgaactcttttctaaaaacaactgagtgcttctcaaacgacatggatgagacagtgcgtctcgtccggtcggagtatgtgcaatgtatcagtctttaaaatttaaaacaaggttggcacccggccaacagcttttcaaacggccacccgggcctacaactttcaaacggccacccgggcctagctgatcccatcagctgcagatttttcaaacatcgaaccctttccataacagcaatttcacaagcaatagtcaaacaaactacgctaggaataacctcacatccacccatgaccgtgggcacggctgttcgaacagtttgttaacctctgcagagggggttcactttacccacacgacattactaacccgaatcacccagcccgtgtagaacggccacgtctggtgacctaagggctttcatgacaaggcatttcgagagcagacacagggttgccatatgccgacgagaggggtcccagaccaacaacaggttaggtcccagaccatactgtgccaggaagcccgggggttctccccgacaccaccccgttgaatctacatgtctctcggcatcaaggctcccccgcttagcaatttactcagccaggggtgtcccattccacctatgtggtcgcacttgtcttatgttcggatgaaattccaaggaaacggtccttaagtgcaagagcgggaaatcgtacacccggtacgttccccggtcggcgattttggaaattcatttagttcgcaagcaccgacccaggtgttgggttttccaagacttttgtaaaacccaagttttaccgaagatgttccttagattttaagtttgaaggcgaccgtcgatactcgtgcagagtgcatgaataccgaggctcaactaggtggttacaggggaatatggtataacaattaacaatggatggatcagatgcaacaagttaggtaggcccaccggtctgccttgcagacggggnnnnnnnnnnnnnnnnnnnnnnnnnnnnnnnnnnnnnnnnnnnnnnnnnnnnnnnnnnnnnnnnnnt

SEQ ID NO: 17230 - DNA, 515 bp, Oryza sativa
  unsure (1)..(515): unsure at all n locations
nnnnnnnnnnnnnnnnnnnnnnnnnnnnnnnnnnnnnnnnnnnaaacaaatttcgcaattagggtttttagagataattttcctgctaggcgccacgacggaacgggcgctacagacggttgcgcggttgagagctgcacgcactagccaccacaccatctcgttgcttctttaagttggtcgaacaaatcgtcaatccgtggcagcgggtacttgttctttatagttacttcattcagggctctatagtcgattaccattctctcagagccatcctttttcttaaccagaagcactagggctccccaaggggatgagctaggtcgcacataacccttactctccaattcttcgatttgtcttttaacttctgctaactcattagctgccattcggtagggtctttttgccattggtgcagtgcctggcgccagttctatnnnnnnnnnnnnnnnnnnnnnnnnnnnnnnnnnnnnnnnnnnnnnnnnnnnnnnnnnnnnnnnnnnnnnnnnnnn

SEQ ID NO: 17231 - DNA, 1194 bp, Oryza sativa
  unsure (1)..(1194): unsure at all n locations
ccctcacagactaacacatgtcttttctgcacactttgtcctcactcgtgtgcacccgggaagaattcccccaggccgggcccgcttacatctgatagctttcataggtcatagactgctctcacagactaacacatgtcttttctgcacactttgtcctcactcgtgtgcacccgggaaatgtcttttctgcacactttgtcctcactcgtgtgcacccgggaagaatttcccggtcggtcacccatcccaaattgctccaggccaagcacgcttaaccctggagttctttggagattggctgccggaaaagaagttgcaacttgttgatatgaatattctattaatcctattaagccctaggccggaatgttacaccctcacccccttaagagagatcgacgcccccgtcgatcaaccctaggccaggaacgtcctctcttggccacgtccatgtgtccagtgccagcgcatgtgccatgctgtgtaaccactcccggtctacactagccatgcgcaccatgcctgcgcaactgcgacacacgcgcccgtgaaaccgcgagagtcggctctgataccatctcttgtcacgccccgaactagtcccgactggaactagcccgtgacgctccaaattaacctgttaatcgataccagtcccaggaaatagtgctggtatcacaggaagacagaatatcacagcaacagaggtctctttattatagagtaggagtacagtcatgttgggctgtggacagatcccgagctcacaactgcattacaaaaggaaagcggaagccaggactagaccaaacaacacaggcgcgacttgggaactaggccgagaccctaaaactcatcgtagccggcttgctcctggaagaactcctcatcagcaggatccgcttcatcttcttcagcaactgggggggattatttatatagagcatgggtgagtacgggagtactcagcaagccatgggaaataagtgtttaatgcaggcttcaaggaaaggctgttgtttttgcaattgattttagttgaactcttttctaaaaacaactgagtgctcctcaaacgacacggatgagacagtgcgtctcgtccggtcggagtatgtgtatcagctnnnnnnnnnnnnnnnnnnnnnnnnnnnnnnnnnnnnnnnnnnnnnnnnnnnnnnnnnnnnnnnn

SEQ ID NO: 17232 - DNA, 1677 bp, Oryza sativa
  unsure (1)..(1677): unsure at all n locations
gtacttgtcttatgtttggatgaaattccaaggaatcggtccttaagtgcgagagcgggaaaaaccgtacacccggtacgttccccggtccgcggttttggaaattcctttagttcgcaagcgccgacccaggtgtcgggttttccaagtcttttgtaaaactccagttttacccaagttgttactcagattttaagtttgaaggtgaccgtcgatactcgcacagagtgcacgaatatcgaggcgcaactggatggttacaaggggacatggtatagcaattaacaatggaaggatcaaatgcaacaagttaggtaggtccgccaatctgccttgcagacgggacaacagattaagtgcgatcctatcgatgcataatattttgcaagcaacataattaaatttcaaatataggctcaagatgttcaaaggtggcttgccttgctcgagatctagagcttgatcctcgaaatcctcgcactgcgggtcttcgggctccgaaactacacgcgaaacggggcaactcaacaaacggtgaaaataaagccctattaatgacctctaagcatgccattagatagatctcgagatttgaggaattttggaagttgaacggagtcaaacggatttacggttgggaagatattgaatttctaagattattggatttttggtctaaaggaaaaggatttaattaaatcctttttggaaaagaaaagaaaagaaaagaaaagagggatggaaattagacttttcctcgggcggctagggcgcggcccgagagagatggggcggtccggccgagctaaatgggccggccggcccaagattgcccaagcgcgcgcgcgcgggaggggaggagagagtgggccggtggaccgggctcaccgtgcgcggtcccgggtgggacccgcttgtcagcggctcggctcaccgtgaggagggagcacgcggcgcacgcgcgcgggcgggggagggacgcggtgcacgcgcgcggtctgcgtaggaacggatgcggcgggcccacgcgcagcctcacggctcgcggtggaaagcgcgcacgggaggggctgaccggggtcggcccgtcccgacctcggctgagctggcgctgacgtggcgcctacgtggctgccacgcgggccggcgggaggtagacgacgacgccggccggaacggacggcggacaacagcggcgagcggcggagcgaaccacggcgataccggcgaaagcgagcacaccggctggttgcacgagacgaggggagacgagccaacggctcggattcgccggaggaagcttgacggcggcgaatcgcggcggcggcaaccggcggtgggaaaaggggaaaacggcgacgaggtcacgaggggccgattcccggcggtgagagcatctacgcggccacgggaatccgatgctagcgtcggattgggcggagctacgccgagcgaggctggcgacgagcgggtgctacggagctcgaacggcaacggcggcgagcacacggcaagtgatggcaacggtcggggcggcgccggctagctacggggaggctactcgtgctaccgacgaaaactaaggggaggagatggagcgaggaggaannnnnnnnnnnnnnnnnnnnnnnnnnnnnnnnnnnnnnnnnnnnnnnnnnnnnnnnnnnnnnnnnnnnn

SEQ ID NO: 17233 - DNA, 3602 bp, Oryza sativa
tatttgatgcaaatgaactagcaacggatgtataccgcggaccgacggttgaagaagtttattgatggctatttttttaggtacccatttctagtcatgaattatgcgtaccgatagcacaactgggactagaaggggttgctaaccggccagtactattgtacacttctccagcagtacacatgcagcttagagatgctatttgacataggatattaggcctcttgagcaaaaagaatacaattattatatgggatctaatgtggatcactatttatcatctatgtaatcgatcaccctttagccttctttaattaaaggatgtaaaggacggtgtaacggtgtttatttatgcagatcgaaatccccaatgttgataattctatatattacatatgtacaaagagaacactacgacagaaacaatttttcctgtgtgggatggccagtagattgtaggcgggccataactactattgcctgccaaaattgctcccccgatgggtgcttcaagggtcgcagcgaaaatatattattgcatgcggtccattaagagaccagtctaaaaaatagacttatttcttaattcttaagaaggacctcttaagcggttgcatgggaaaatgcattattttcatggtgggctagagtgggaccgcacagctgcgggttcaacggcgacgacagcgattacgatagatccatagcttctctctcaattccatctgggtggcaccacgacagggatccaccgctgagcagcctcgcgatgggcaaatccactgctatcggccctttgaccggtagatccaggttgctgccgccatcagggtatggaggggcagtggagaaggttgtggaggcgcagggagaggtgaaggcggcctcagtgatggcagcggctacaacgacgacgagctgtggagactcggcgactgcgacagcaacgacgagctacaatgacaacgtcaccggtgaatgggagctagctagggttttggattttggtttttttatttttttcatgatttttctttttgcaggcagacgacataagcacccgttggcaaaaaatctaatttttgcatgcgagtgcaccacccacatggaaaaattatgatttttatagacacctccgggtatacggatggccaattactgcatgcaaaaattgggtttgggcgcatacaataatgtttttatagtgatatataaaaaccattaattacatcatacaaaactagtcaaaaagctgtggcattattaattttaattgttgcaaataaataaacgacctttgttgtatatatatcacaaagtgatcctattataagcagtacatacaaatgaattattggtttgttgattgagtcgatcatgtgtgcatagtggttcggacacccgaagttatatatatatagtcccgattatccaaaacataaaattgatatcctaaaaggtcaggcagtgactagagggatggcagatttatcagtactaggtccttttatatgacataagcgaatgagcctctctatctgagttagttaggtgactctagtagcactcctcgggtcctgggttcgactaccgtggagcgaatttcagactggggttaaaaaaattctctcgcctattccatgccaaagcacaggtctaaggccgtcgttggtcattctcacatgggctacagtaccgttgtataagggtgcaagggtaagggtttagggattttcactactagaaataatattttttcaggtggcccaaaaccattttcgtaggcgggggagaggaccgccgctaccatctcgcctgtgaaaatagactattttcgcaggcggacccatggcccgcctgcgaaaatcatctcagaaaaataaaaaaaaaacatggggcgccgccaccggcctcaccacggccgccgccggctagggctcccctcgtccactgtcgtcggcgccgccggcgtcatcgtcgcgtcaacgaggagagccggcggctggatgcgaaccgtcgtcgtcgcctgtcgtggccggcggcagagggggcgaggaggtgaagcggcgaggagggatagccggcggcgcgcgcacgtgggagaggagggagccgtcggcggaggtaatgagtcggcggcaaggagggagccggcggtgtcgcggtcgtcgtcgtcgtcgtggccggcggtgcgcggacgtgggagaggagggagccggcggtgcgcggatctggagcggagggagctgtcggcggcaaggagggagccggcggtgtcgcggtcgtcgtcgtcgttgaggagggaggcggcggcgcgcggacgtcgtcgtggagggagccggcggcgggcggacgtgggagaggagggagctagccggcgattttactaagtgtgtgtgtgagagagagagagatgagggggagggaaatgagtggtagagaggagaggataaggatggtggagaggataaggatgactgatttttttgtaggtactatttttgcaggcggaccatataaggtgcgcctgcgaaaaggcgcacattcgcaggcacaccttatatggtctgccaggcgtcgcttcaccccgatttatattttcataggcggtcatttggctccaaaagtcatatccgcctgtgaaaataagacccctacgttagggaaaatgctttttctagtagtgtttattgacctgcgtgacaagatcttctacatatgcgcatgatgctcaggagttgtcttagcctcttgcaggtcaagtttttttatatgtcataattaaatacattggaaaaaccagtagaaatacatctgagaaaaacatacagtacaagcaattggatgcatgtgctactcacaccacacatgtaagaacgtatgtacgtagctatagatcagtcttaatcaatttgaaattgtcactacattgttttacaatgattaaagcgcctgcatagaaaagtatgcgtgttgtttttggtttggaagtgccttttgttattttttgcttttgttgtacgttctttttcaacgtcactctcaactctcaaaggtgtgtaaacatcggaaatttttttttttaaaaaaattctatcatccaaaggttcagtaaagggttggctggcctgaaagcttcagaatacttgtaattaagttgagagaagagaaacagacggaatatattccagctggaattaatatggcagtagaagagtataactagttgcttagcgtcatcaattctcattttataggaataattcaacgaagaacatttgatttcgaacgatacttctgctttcaaggagtatttgacgttgattaattagtttaattgatttataaaaaacaattagtggtggtctgtgcatttgatttcgaacgatagttctgcttatcaaacatccaaccactactggagaagtgctcatctctcccggttcgcaaccacctttactcccgagtagcgaactgggagggagaatccgggataaaagatggcagtctttagtcccggtttaaatacccgggagtaaggatacagaaaacttctacatttatttcctagtatttgacgttgattagtttaattttaaggt

SEQ ID NO: 17234 - DNA, 707 bp, Oryza sativa
gaaaaaatcccacaatgccaattccaattattaattgcatttattaattatggaattagctctaggttaattaagataatttcttcggacaatttatttagccaatttttaaagctaggagagggggaaacttcaaggcgtgacaggtatcgccgtggttcgctccgccgctcgccgctgttgtccgccgtcctttccggctggcgtcgtcgtctacctcccgccggcccgcgtggcagccacgtaggtgccacgtcagcgccagctcagccgaggtcgggacgggccgaccccggtcagccccttccgtgcgcgtgttccaccgcgagccgtgaggctgcgcgtgggcccgccgcatccgttcctccgcagaccgcgcgcgtgcaccgcgtccctcccccgcccgcgcgcgtgcgccgcgtgctccctccgcacggtgagccgagccgctgacaagcgggtcccacccgggaccgcgcacggtgagcccggtccaccggcccactctctcctcccctcccgcgcgcgcgcgcttgggccgtctttggccggccggcccatttagctcggtcggaccgccccatctctctcgggccgcgccctatccgcccgaggaaaagtctaatttccatccctcttttcttttggtttcttttctttcaccaaaaggatataattaaatccttttcctttaaaccaaaaatcca

SEQ ID NO: 17235 - DNA, 510 bp, Oryza sativa
  unsure (1)..(510): unsure at all n locations
annnnnnnnnnnnnnnnnnnnnnnnnnnnnnnnnnnnnnnnnnnnnnnnnnnnnnnnnnnnnnnnttatttgccgatctccgcgttcatatgagcttgaaatcctggaatgactggattcccctcttcagctcctggattacaggcccaatttcaaaccgatcaaaacttttattcatgaccaaactcacaacttcaactgagtccgtttcgaagactactctggttgctgcaagtcttgcacccacccgctcgcttcgaggcaagccaacgcttcagcatgagttgcacttaacacttccccgaagaaaatcctgttcgcacccataaactcaccccgatcatttctcactatcactcccccacttcccatctgttcatctgcagcaaatcccccatccgatttcagcttaatccatcctgattccggcaacctccagtgcattgtcggactaggacagtatgatcagatttttcaaatagacttgcccactcttccatgaggaacaaa

SEQ ID NO: 17236 - DNA, 1443 bp, Oryza sativa
  unsure (1)..(1443): unsure at all n locations
aaaagagcagtcaaacttgtgttgattcttattcatgtggcaaacagtaggaaccgtttattcccgatgctggccttgtgcaacccactcactttgtactcaaatttcagatttatcgtcaattttcagaaatttaagatatgcatattgatcgctaataaagtgaatgcctccatcaatctccaacaaaattggatgaaaatttggatatttgtgacacgcttttaaattgctaaacgatgtgtcccgtgcgaaaactttctatataaaagtgactctaaaatatcagataaatatatttattaaatttgtaataattaaaacttaattaatcatacgttaataccactcgttttacgaaaacactcactcttaatcttcatcttcatccacgtgagtttcaaactccacctttgtgtgcttatatggcctcattcttttcagctacacttaccactttattatcatggattatttgctccacaactttaaaattatgtcttcttagaaaacaattctactgcattgctaacgctacttgttctaagctagtagtactattatttgctaaatttgtttgtacatgaaaatatttaatttattgatataataaatagataattcgtggtaacttggcaacaacatctatttgacacaaaaaaaatctctaaatttgaaacattatattggggatggtttgtgttcagtcgtactctcggaaataaagaaaaaagaaagcacatagaaaatggtagaatttccagagaacaaatcaattccaacaggttctcattgacgcgaagtacttaggaacttcccccataaataaagtttacaaaaagcagagtaattcctggaccctcaaaatcccacatatgctttccaattatcagtagattatgatgtagctgctactgtcattatgcactaagcaataatgttcaggtatcagcaaattgcacggtccatatataaaaaaggaacagcaaaagtacacataacactgcaacatgtgtagaaattttaatccggccatgatctttgtttcagacaaattgcagtcctagtacaactagtctgcttgcagaagcagcagagaagtttcccgccaaaaaagaagtaaaaaaaaaggagaggagatgcttcatcgcttgcgtttgactgcacattctgaagattttttggagcaatcagagccgtccaaataagcccaaagcaacgaccgcaaaaccaacggtagtcgagcatgcagacaccctgcagcagcaggcaaaaaggagaaagactggattgattaattaattaattaatttgcttgagtgcgcacttagcgattgataattgagtagttaattagtttcagctttgcttggctaccagtgctgtagtgtacaatctatcagaannnnnnnnnnnnnnnnnnnnnnnnnnnnnnnnnnnnnn

SEQ ID NO: 17237 - DNA, 650 bp, Oryza sativa
ggcggtgacgccggcgagagggaaaaaggaggaaaaagggggagagaaaggggggctcgcccctttcttctttgggaaaaggaggagggagcggaggcatcgcggcagagggaggagggaggctttgcctccgtcccttggaggctagcgcgggagtggcggggccgaggcgatgacgacggcgatgacggcgggcggtgtggagcggagcggcaacacgagcgacaggcgcggcaggcactgacgacggcggtgaccaggcggtcggccaccacggcacgcgcgcgcgggaagcaacgggcggcgcggcggtttgagcggcgcggctcgggcacgcgcgctggctaacggagccgggcgactgcgcggcagggcagcggggccaggcggcacagacagcgcaggcgcggcaagggcggcgaccgcgcgggcacgtgcacgcgaacacggcgcgcgggaagcggcagcgagggagcggagagggaggactcggctcggcgcgggcggctcacgcgcacgcgcgcgggcagagcggagggaggggcgctgggcgcggctcacgcgcacgcgcgcgcggcgcgcgggcggagcggaggggggagggggggagagagagagagagagaggacgccgggagggagggggagatg

SEQ ID NO: 17238 - DNA, 1038 bp, Oryza sativa
  unsure (1)..(1038): unsure at all n locations
nnnnnnnnnnnnnnnnnnnnnnnnnnnnnnnnnnnnnnnnnnnnnnnnnnnnnnnnnnnnnnnnnnnnnnnnnnatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttgagaacccgtcacagaacctaagccaccctctagggtagagtcgttagtcgtgtgtttccttgcttgtgtgtgtagtgtgtggtttgcatcggtgggttgtgatgtgaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtatctcaagctcccgagtgaatgaagcaccagacaccagttgtgtgacactggtccaacacctgattaaccagaaccaattgcttatagagatactacagcagcatcagacgccaattctgaacctaagtcagatacaacctcaagcgcagttggaggcagtccaagcactcacaccacaagtcagcatgccgccagcatcccgaaggacccatggtgaagtgccacatgttgactcaaaagaagcaagtatcatttgttttatgtgtgatgagcaagggctctatgcaagggagtgtcctcagcagaaaagaaaaacaccaatgcgaaccgaagatgaagtccgtaagatgagcattaccagcacagaatggcctcannnnnnnnnnnnnnnnnnnnnnnnnnnnnnnnnnnnnnnnnnnnnnnnnnnnnnnnnnnnnnnn

SEQ ID NO: 17239 - DNA, 4317 bp, Oryza sativa
caaccgggaccaaaaatcaactgagccgcgcgcgccagtccaccgtctctcccctctcattaattatcccttatcccttcgatcccaccgtcctctccatcccttcgctagctagcttatccctctcagcctcaacctcctccatccattctcctctcaccttcctcccccttctcttctcttcctcctcctcctcctaccacgtgaggccgagcggcagcggcagggaggcgggcagccgagcaggcggcaggcgaggccggcgaggcggcgggcggccgggcgggcgaggccggcgagggccgcgaggcggcgcgtggccgggcgggcgagtccggcgagggccgcctcggccgggcaggcgggcggcgaggcccgcgaggcggcgctccctgggcgggcggcgaggcggcgggcggcggtgctcccggtgcggcggcgctccccaggcggcggcggagcacaaggcggccggcgggaggacggtgaggcggcggacggccggcgcccgatctctgtgttgtggttttttttcctgatctgtgtgatatgtgcggccgatctatgcgatgtcgattttttttctgatatgtgtgatgtgtgatgtgtgaatgaatttgtggagatgtttttgtgattttgtgaatgatttgtgatgtatttggggattttgtgattgatttgtgatgtatttggggataaaaatgtagcttgatgtatttggggattttgcgaatgatctgtggtgttaaaatgattcgtggataatatgaatggtggtgctcgaaatcatgaaagcaggaaaaaaaagaaaaaaaaacattagtcctggttgttaattctaaccgggactaaatctttagtcccggtttttaacactaaccgggactaaagatccatctttagtcccagttattttaaccgggactaaaaatatgcatatttagtcccggattcgtagtctcggttgtataaccgggactatatgaggttgcgaaccggtattaaaaagggtttgtccaccagtgtatatttattcaatagccatcatcgtttagagtcaggtttgcttagattatttcttgcattgaatttttgccgctagttaggtttgtgaaacccaaacttcgaatactaaatcatttatctgcaaattgagttgcaatcttccttgttcttgcttatgttcttcgattcacatacagggattagccttcttggcgaggtcaatcaggcaacgcacggttgataactagatgagacgtggcactgcaattgcatggttcggatcgtgttgatcggaagccgattcttgtgtgtcaagtttccgctgaattgggaattatcaatatctatcgaaagaccgggacctagttcatcatcactaagggccacttctgcaattgaaatttgtacgcatatagaatatgagccaaaacaagaaatacacacagaaaatacagaaatacacaataacgtattgcaagaataatccagctcctgctcttttgctcatgctctggctggagcgctcctgcacttggtgattgctcttgcgagaaatcgtggagagtagtcagggttttttccactaggtctaggaccaccattgccagaactgaaaattagggtttccctcgcaccggttcttgtctccaccatgaggccaacactagggagggagggagggaaagagtgaggaagaaagtatgagcacggagagcaaataaggaagtgagaagctagaagccactacattattcatagaagtagaattctagaagcggttgtttaagccgaccacccaaaaatcaaggttattacgcattccaaaagtaattaacttttcatcaactaattaataacacatactacaaattaattacattactaaactaactacattaattataattaactactatactactcctgacatagtctcttcgctagtagctcgcctcccgaaggcgcgctggccaccatgcgggctgccatgcctaccacatgctcctctatgtgcctcccgtcacatcctcctctgtgccagtcacatctcctgccacttttttccttgttgttgatgtcctcctcctcatcagagtacaatggcactattgacctatcatcgaaaaaacgctcatcattggtgtttcatagttcttcctcagtggaagcgctagcagggggaggaagtagtccgacaatagctcagggagctcctcttcctcatcagtggtgttgtaacaaagttggtgcggcaagtccatcatggtcgaaggcatgcgagaaagaagaagagaagagtgcgatgagaaaaacccacccatattgccctctatttactgaatatgaggagaggggaggtgaggaggtggagtggtagtggatgatatgactggcgttcggcagctggcatggacgtctaggctactagtgtgatcaatgaagcgccagctcgatcggcttcctcgaggaagatgaaaggactagacatttttcagaaatagttttttaattataggcggtcccttaagacgaccgcatgtggaaatgtgttattttcagagacggtcatcctataagacgacttgtcagcttgtatatttggggcccatttatcagtgaccgataggatcctctgatgaaagattgaccacacatatatctcccacaagcttttaaagcctttacatgcatggacaccacgctcctcgagaccctgatcgagctaattgagcctcatcagccagcttatcctccttttgagctcatgcatgcacatatctgtgattgacagaaagcgtacgacgatggcgagatttgcacggcccatcttgtcccctttagcgcgcatttgctgctgtttggaccaatctgaattcatggagataagcgttatcacaatcgactcaagaaagtgtggctcaatccctgtaccatgcgccttatctttgttcctgccgtttgggccaaatgcatctaaaggtcattccttgataattagtcattttatgtgacgttacaccattgctccctcaagtgtgcactccattaaccaaagatgatttgccaaaagaggggtaatgagaggtacttatggggggtcctaatagcgtttggaaggagattagaggtgtgtttttgtgttttgccagggctactttgggttgctccttgcatcatttggttatccttgcatgcaccttttgttgtgccaaattatttttcaatatctttggcacattctctgccttatcttgttagctagtgtctagtgatgcatgcctcctgcagttgtcagcagcttcagagtatgtgtgttatgtgtatgaaaccctaaaccctccaatcatgatccaggatagaaaaaaatcttaatttgctgatgtctagctctactgtgcatcaaattgacccagaaaatgttgtatgctaggactaataaatttccacttctttcaaaaggaggactgaattatgtgttaggactaaatttgtagaattgtgccaaccaataaagattgttgtctttcagcatatactataataagcaaattgtgttatttgtcaattcaaatggagatatcattttcattcagaaattttgcttatccgtagttttttagcatactataataagcataacaatattgcctcaataatctcgaaaagatcaatatatagattggtcctaaagcatactaacgttgaatttgcaatcatccactaataatactgagcactacagcatcattgtggccatgcaagtggcaagtcaaatataatccatatatcagtctcaccatttcttttctttcacataatgtacatgtacagaccctatcaacattgacatatagatagttggcatatgatatgattaacgcagatttcaaggatgtacattgtgcgctatatcatcaacattatctctaaagagtaatacttgaaggcatacgcgtaggctacgatagtataaatcaaaattgttgtacagcataaaccaaaaaccatgcaagtattagataataaatcattaccactcaacaagctatgcagcagaagttagcgctaagaagccgaagaaacgtcgggacgtagtgcgcgtcaatatagagaaaatagtcgatcgcaacagctcgatcttctcctcctcaagtgttctcctcgccatgctcttacgctaatcagtaccacaaaccaacagcgcctaattcagaatggtttggccacaggtagagagctgcagagaagaaatattaaatagggagttcgatgcttatactgtaatcgggaggaatccctttttcaccg

SEQ ID NO: 17240 - DNA, 1537 bp, Oryza sativa
  unsure (1)..(1537): unsure at all n locations
atcatcaacattatctctaaagagtaatacttgaaggcatacgcgtaggctacgatagtataaatcaaaattgttgtacagcataaaccaaaaaccatgcaagtattagataataaatcattaccactcaacaagctatgcagcagaagttagcgctaagaagccgaagaaacgtcgggacgtagtgcgcgtcaatatagagaaaatagtcgatcgcaacagctcgatcttctcctcctcaagtgttctcctcgccatgctcttacgctaatcagtaccacaaaccaacagcgcctaattcagaatggtttggccacaggtagagagctgcagagaagaaatattaaatagggagttcgatgcttatactgtaatcgggaggaatccctttttcaccggttctgggactgcccatttgctaggtggatttggcagaaattggaagagcatcgtggtgaggacattccacaaccgccagcggaatgcagaaacaataaaatcttatctgtttggctactggatcaattatcaatacagacacaagaagtctctttagtgctgttagttacaatctacattatgtggtcagcacggaatgatgcacggaatcaacagatcccagataacccagacaggacggtggagagaattttgttcctcctggaagagtgggcaagtctatttgaaaaatctgatcatactgtcctagtccgacaatgcactggaggttgccggaatcaggatggattaagctgaaatcggatgggggatttgctgcagatgaacagatgggaagtgggggagtgatagtgagaaatgatcggggtgagtttatgggtgcgaacaggattttcttcggggaagtgttaagtgcaactcatgctgaagcgttggcttgcctcgaagcgacgcgggtgggtgcaagacttgcagcaaccagagtagtcttcgaaacggactcagttgaagttgtgagtttggtcatgaataaaagttttgatcggtttgaaattgggcctgtaatccaggagctgaagaggggaatccagtcattccaggatttcaagctcatatgaacgaggagatcggcaaataaagtggcacaccgtttggctaaggaaagccttaacacacgtgcttcttctagctggatagtgtcagcaccggagtttttattttctctgttatcagaggactgtaatctggatgctgtaatttgagttttgcttgctttccactctcaaaaaaaaaaaataaattgcccttattcgtcatttagtctatcccaccatctcccttcgctgttcacatacaatccatccggtggcgtgaagatttcttctctgtcactaacgtgccacacctgagatacattcatatgatcaacatattgttaaccttcagtctgtacgatataacgagattctctacagtattacttgttatcctgcaaaatataataatatannnnnnnnnnnnnnnnnnnnnnnnnnnnnnnnnnnnnnnnnnnnnnnnnnnnnnnnnnnnnnnnnnnnnn

SEQ ID NO: 17241 - DNA, 4343 bp, Oryza sativa
catattgttaaccttcagtctgtacgatataacgagattctctacagtattacttgttatcctgcaaaatataataatatataatatgtggctctcacttgatctcgaggtattgtgtgcctctacagccaagtctccgactctatatccttttaacaccgtgactacttggctgtgttcttttggaggggtttccaacccctcctctccgcacggaaaacatagtgatagattaacacatgattaagagcaagtttaatagtatagctaactactagctccaattcatctatagccaatctaatagctcattcatacaatagttacatactacactattaatgcatagtcccacctgtcatacacacgctgcgtcttggagtacgtgctacagctggctacaaatctgtagcccgctgctcttctctctcctcatttatctctttaaaatatatttacagctggcttatagcctactattgtacctgctctaattaagtattagctataaaaactttgaaaaatgaattaatatgatttttaaagcaacttttctatataaacttttcacaaaacatataatgtttagcagtttgaaaagtgcgtacatgtaaaaaacgagagagatgggttgggaactcatgtgaaagacatatataccaacgagtggataaaccccagcccacccgtcattgtacacagcatcatcaaagggggtggccacatgaatttctccttgtgcgttcatgcgaggatcgatatgcatgccatacgtggcaacgcccagcacatgctatcagttctttattttgaataaatcctgtccatgatctttgtcttcatgagattatgtaataaataaaaccttgtaaactgcgatatataatatacatggacaggaaaaaataaggcatgcagtggcaaaaggtttccagcgtgtagtcactaccattaaaaaaagaaagagcatgaagtcactaacagcagcacagtgtgcactttcaatattgcaaagagaacagcattattatccttggttagtactgtacctgtcttaatttatttatgcaacctaactttttcaaggaacctttgtttgttttggaactcggctagcgtgtgattattcctccaaattaacacacactgaacagtacacgtatatttgctgatgtacatttaaaattaatatttaatcagtgggattttcaccttatagttaagtagcaataacagcgagtccccttgcatatatatgatggtgcagatgctgggattttactggcaaaggaaacataacttttattagcctctacatcatttgaaaatacacacagtcaatatttatatttatcaacataaggagttaaacttttgtgggtccatgactttaccatctcaccaatggccaggaacatttatcctaattataccttaaaaaaaagccccagtaacatgagtgcccccacctatatataattaaaatatgtttgttgatacataatttatagataagaagagtggtgcacagccacctggtaaatgataataatctttatccgaaggtacaaaatctaggatgcacctgatcaacaacaaaagatgtttatctttcttacgaggacagggtatatcagagtggatgaaccacttattattattgttataactgtcttaaggtttgcgcaatactataggtcacacgtctcatcacaccattaggtcctaaaataattcaacatcagaaaaaagaactccaagtaaaggagtcgttctaatttgtgcctctcagcctctggttaattaaatgccaaatgagcatgtaactaactagctagcttattcttctaatattcaggaatataatcaagataatcctagttgaaaattaaattaggatggcaacggatccggtcaggcacgggtagagcaaaaccatgcccgacttgttggcccatgttgcccacccgaatcctaccccgctagggttagcaggcaagactctatgcatgtacccatactcgatgggcatgagcatgcccgatggctacccgcgggtttcatatgcataataatttaataaagaaaaacaaaacaaataatttgccaaattattagttgtcaacaataatttagattgcatatcaagttattaccagctagcatcacaaatgagctaaaagaaagagatatgagaattaagtgatgggccaaaatcgactaatacatatgtttcggatcaggcatgagttaccaacgggtaaaatataaaacctggctgcttcccactatgtctccgggtctcgaacgggtatgcctacgggtaaaaagttacaccacgcctgtgctcatcaggttgggtatccgcggatacctggacccatggatatccctaaaattaatcaaagggggtgccctgcatcgaccccctgcaaattaaggtacttatagtagtaagaaatggatcgtggtacatacatctgtaatatatattaatatttatatatatgtgtttatgaacattgattcttgatatataattaagaactctaaaatacacattactttattccggccacgagcttaagaaatcaataagacacacacacacactatggttcctgagccaaagaatggttcagggttcatattcttgagcaatgaaaagtaatggtccacacgtgcatatctagagatctgtccgtgttagcttcttcttcaacttctctgtgtttgcaagggattatgagattattggtagatcataaagctgctatctgcataacttccacattttctcgtaattactattacgtaaaatctattcagagagttctcgtttttgtcttaactgaatatagagaaaacgtggagtctactacatcatactcgtactgtatgcatgcattttcttaatagacatgcatgtattttttcctcttcaaacaaaatttttctctcaaattatttatccgatctacaatccgattataccattgtgttcgttacaattaaatcttcataacaagatcttacatgattatattacgatcaaaaaatatttatatttataaattgcttttattatatatgtaagttacttttatcatatatataagttacttttagatttaactaaattacttcttagacatactacctccgtattttaatagatgacatcgttgactttttctcacatgtttgaccattcgtcttattcaaaaattttatacaaatgtataagatataaatcacacttaaagtactatgagtgataaaacaactcataacaaaataaattataattatgtaaattttttgaataagacgaatggtcaaacatatgagaaaaagtcaacagcatcatctattaaaaacggagggagtataaaagtaaattcaataaagtctaaaagtaatttacatatattataaaagtaacttaacacaaaacggaagtaactttatcacgacattagaagtaaattcgtgtagggataaaatatgactttttagttaattccataatttgtgctgattaatttaatttccagatagagttatgtttttatctctacaacggatttacttcaaatgataccttcgttttgttctaatttacttctataacatatatatatatatatatatatatatatatatatatatatatatatattacttttagacttactgaatttacttttatattttaagaagtaacttaatgaaatctagaagtaatttagacacatcataaaagtaaatttgtgatttttcatcaaaatataatcatgtgagatcttgttgtaaagatttaattgcaacgaacacaacagcgtaattggattataaatcggataagtaatttaataaaaacttctctaagaaggaaaaaaatacatagatattgagtgtactagtagttttttttttttggaaagaatggtgtctctctttagcactatccagctagcattctcgctgtagtgtccttttctgcagtagtcgtgtccttttctgcagttgttgaatatatatggtgttgatcgtgtgtaaaaagttccaaagatttaaaacgggctgatagactttccatgtatgtatatacgctagtagctaactaaagcagggcatcaattttgttgggagtaaacttttttttccctaaactcgcttcagacaaattatatagttttattaaatacaagctataaatcgtgtctcatttgtaattcatgatcaatgcatgagtcacttcagttgcatgtcttataacagagctaacacctcactactgcagataagcctataggtacactactgaaaaaaccatcttt

SEQ ID NO: 17242 - DNA, 12260 bp, Oryza sativa
  unsure (1)..(12260): unsure at all n locations
nnnnnnnnnnnnnnnnnnnnnnnnnnnnnnnnnnnnnnnnnnnnnnnnnnnnnnnnnnnnnnnatatatatggtgttgatcgtgtgtaaaaagttccaaagatttaaaacgggctgatagactttccatgtatgtatatacgctagtagctaactaaagcagggcatcaattttgttgggagtaaacttttttttccctaaactcgcttcagacaaattatatagttttattaaatacaagctataaatcgtgtctcatttgtaattcatgatcaatgcatgagtcacttcagttgcatgtcttataacagagctaacacctcactactgcagataagcctataggtacactactgaaaaaaccatctttgctgagttgaccaaaaactatattaatcccagtttgagtaggaacaaggactaaagaatatctttagtcctggttcaaaaggccaggggtacgttttgatctttaattccggttcaaaatatggtaggcggtgtcagaccccttcactatctttagtcacggttagtaacaccaaccgggattaaagatctatttttagtctcggttgttaaacaaccggggactaaaaatcggccccgagcgccgtccactataccaggccgcctcttcgatcctcctcgagcgctataatcccaaggacgctcctcacctagcttcctcgatcctttatccaccttatctcctttctcctcttctcctccccctcattcactcacccccatctccacccctcttctcccctcttctcctccggtcccctcccctctcctccccattctcccctcccctccggctcccttccggcgggcagcagcgcctaggcggcatgcggcggtggcacaaagagccggccacgtggcaggtggccgggcggcggcggcggtggcagcctgtgcgaggggcggcagcctgcggcggtggtggcgcggggacggcgcgaggggcgcgagggcggcggtgggctcccctccgccggatccgggaggggaggcggccgggcggtggcaccagagcgagccggccgggccgcaaccggtggaatgcgggaggccagtggcggctgtggagttgatttgtaatgaatgatttgtagattatttttttgattttgggatgattttgtgattgatttgtggactgtggatgattgtgtatgatgtgtggatgatttttgtggatgattgtgtatgatgtgtggggatttgggtgtgatggagattgtggtcgaggtgcaaacagcataaaaaacaatgaaaataaaaagaaagaaaatcctttattccccgtatcggttattttaaccgggattaaagatgaatatctttagtcccggatttatagtcccggtttgtaacccagaattaaggggagttacaaaccatgactaaaaacccctttcccagtggtggtatcgattctgaaggatctataggtaccggttctggtaccggcactaatggcccaagtctaatagcagaggtacatagaacacctaggtaccaatgagtggttatagattatagctactccctctgtttcacaatataagtcattctaaaattttctacattcatatggttgttaatgaatctagatatataaatatgtctagattcattaacaactatatgaatgtgggaaatgctaaaatgacttatattgtgaaatggaggaagtagttcataaaaaccgacagttatatgatgtccataagtatcagttgatataagaaccgacaattatgacttgggagctatatgggggcgtcttcgttggcactgagaatgaacagctgccaatcaggagcaacgacgcgagcatggccttgccatcctcgactttgtcgtctggccgccagagcaagggcaaggagcgtgaggagtattgaggagatgccaactcgtcgtctattatgtttggccaagggagtgcgggcgacgcgacgcgttgctagtgtcggaaaccggagtgggggcgacggtgaccatatccattggtggggaggccgagagcatcgattgggatgtcgttgatccggatttgacacctcaccgagcggagtggagagagcgagggagagggaagagatggcccacagtggcgtggagatgaaatccctctcatccgggtggccggatatgccagccaggagggcgatgcccggtgccgcaatgatagctggagactgcagcggcggcatatgcgaggggaggaggtgagcatggcggcgcgctgaggaaggagggcgagggcgagggcaagcgcgagtgtgagggtgggggcgacgaggctagggtttgaattggtatgggccggcgaaatcctcactgtccattccggatccaacgatttcacgggcgcggaagggccaccacagtgggacacgtggatgaccatatcgaccctagagagagatcggacggttcacgatggatagcagctgggaccaatgcgtaattaactggaagttcggggacattttgcaaaatatttgccaacgtggcactttaattctcaagcattcccactgacgtttagagaggttaatattagtatcaatgttataaattggtaccaatacatggttatatgtaccggttttcaattttatactgaaaaaggtggaacaagctttacagaggccactctctatggggtgttttgtagtagggcctgtatacatgtcggagaccatggataaattcgtgtacatcacaaaattactaattaataaagtgcactcgctgaatgtgtataactacaactatgaacacactgtactagtcctcaagtaattttattttttctaatttaaatcatggaatgtgcgtacgaacacaaccatttcacacgcacgccacacacatatgggaatgtgttcggctcccaaactcatgctcaaatatagatgataaagttttccggtcaagtataattaactaaagctgaatgtgctccatcagtggttgatctagtttcagattggttgttgctcctttatagcaatttttttgttagttaattacttttgcaaaccagatcagtttagatatagttgtctatctcaccttttttttcctttgtacctaaatggcgcatacataaatcacctgccggccggctcgttctgtgcaaattaacaacaaaataagtaagtttacgtggcaacattctacaagccgcacttaattttttccataccggcgtacaccaccagcaacacatcctactggcattctcgccttataaatatattaactgatcaatcttgtaaacaattccgtacgacgatctctgtgaagcactgaacaaataatccacaaattaattaaagttgaacacgatgaaacgcaatctcgtctaatcggattcccctctttcaaataaagcgcaaaagtgcaaaaagcgaacataaaatttgattaaatgtctgaactttttgtcacgtaaactatctgaacataatgggtgtgcattctctgtggctcacgcctgagcttggtgctgccactgattgcttgaaacaattaacagtaaccggccggcttaattcgtgttctggttcatcattagggtcatgataagtactgtggcattgtatgctttcatggttgcttttgtgcttaatatagtatatcctttctgttcttttggaggtttgaactttgaacaaattagataaagttcacaaagtgtgtactttggcatgttaactgtaacacactgacaagaaagctatgtgatcgataaactttggtacaagattgtaagtatacgtggatggtacagggcagtttgctacaatttttttttttgttgaggaaattaaccaatcttatcttgacgatgtaccagatgtgcctttcacttgacacatttttattcggtttgcttggagctttttggcatcttggtgggaagttctactaactttagctgccctaattaataatgtgtgttaattaacaacgtaacattatgaagagcaatacacagaagaatttattaatatgaacagatctgtgagatcccatactcatgtaataatatgtatgatgacattatcgaaccatacatttgcttgtgataagatttttagggttcttttttcctgttgggaagctgaaaagtttttgcctgattgaccactatgcatcagatgccctttttgttaaggcttttgagttttgagcccctagctggtaaggcttcattataagatgttatgagatatgagaggcatctagccgtataggttatacatccagttcggtcatggatacaaatttaattagaacccataacgggtggcagttcatatgatggtttgcttaggtataattactttaattagtacttccacagtctctttgtagcttattaatctattcataactggcactactacgcataattgacatttcacggacaagaccccctccaaactctaggtggaccataattgcatccacatgtaaaaatatttaggcgaggttcggttaagtgcgggtgggcctcttaagactccagtttgcaaaaatatcctatttttataatcgggaatcttaagagatctgcctataaaaatccattttttaggtgggggtgtctctcttctacctgcgctccactcattttttccccgtgcgcccgcacttccccgcttcccctttttaatcaccctcctctctcccggcttactctatctctctcccacttattcctcctcatcgcctctaccctcctctctctcccacgacatcatgcagtgacgtacgatggcgtccttgcgtggcgacaacaaccatggtagcggcggctacagcctcgggtgatgaggacatcacacctttggatacacacgttactcctcaagttgttttgcaagatccaatcactagagctcgcgcccaacaataaatttacaggtgagctcgttcctatatacttctttatgtactcttgagaatagattactacctaatgacttaattatgattagaaactacggagaggaccatggagcaattggagagtggctgagagatagacaagatcatcatgggcgttcaagtcatgtcgatgtccaactcatgtcaagttcgagtgcacttcgggctaccagagcagttcacactaaaatcatcgtcgggttgcattcggactccgatttcgacgttatacatatatatggaaagctaacgagaccaactttggatctggtcccacgccaaattccttctgagtcaacgggaatcttcgaaataagaaggcattcagaatttgtccgggtgctgtgtcacatctttgagcctgttgggccgtgcgtcgtgtcggggtttaatagggacgtgtccaggggtctaaggtcgaccctagaacctatatattcggtagtcgtcattgtgttagggttgggttttgcttagattatttctgccattgcagtttcgtcgctagtttggtatatgtaaccccaaattcaagtgcttaatcatttatatgcaattgagttgggatctaccttgttcatacttgtgtactttgattcgcatgcagggattagccttcttgtgaggtcaaccatgcagcgcagggttgataaccagatgagacgtggtgttgcgattgtaaggttcagatcgtgttgatcggaagttggatcacgtgtgtcaagttttcaccaaatcgagagttatcgatacctatcggaagatcgggacctagtttccttatcatcgggaccgacggatccaccgttggtgggctcgggaagggcggatccacctccaatagtctcgggagcagcagatccaccctcgtgcgttgtggagatgaggtagaagggcagcacggcgaccaaggaactgggagtgaaggccacaaccacggcagtgaccggcgggctcgataatggcggatccaccctcgtgtgcagcggagatgaggcagaagggcggcgcagtgaccacgacaccgggagcgaagaccatggccacggtggcgccgtgtggtctcaggaatggcagatccgccctcgcacgccgtatagaggatgtggaggactgggatcggcgaccacaaccattgcagtggcgggctcacaggctacgtttgcggtacctgatggcggcggccttacaatgatctacggttttggatttcttttctttttttatttttttaaatcgttgtagtcaggggtccttaattgaccgcttacaatgatccggtctttgcaagcggcttccttaggatgcccgtctgcgaaaatagtttttttgcatgtggttgtggtgcctgcatgataaaatgcggattttcacatacacctgactccagacacaggtgctccactagcctacaaaaactagttttggctgcatgtgaagatcatttatgtagtagtgtggagttgaaagttgtggtacgtagaatccaaatatgagggttagttttttaaaataaaaaaataaaatcagaaataataagggaacaattaaagttgtttggtagaatccagggtgtcatttatccaactaggggcccagttatacagagagtccttctgaagcccaattactacagagaatcctgctcaagcccaattaggtctacccagcttggtctgaagcaaaacaaaataagtccaattagactccctcaaatatactccaatccaattcatatccctaaacaacaatacctgatattttgacccctcaactatgaaaacgggtgtaatttgactccttcagtagttttggtgagtggttttgctgatgtggcactttgacttgatctaacatgttgagtcatcgtacgggacccacatgtcatcgtccccctatttcccttatttctatctccttcctcttcctctttgtcccccttggctcggctcgttcctcttctacacaatggcggtgacgggacaacgaggggagcggtgcggtggcagctgggtggtggtagaggggcggcggccggcgggaccatggaatgcatgaagctcaagctcgacaaggtctgtgttctctcccccaccgttgcgccgatgccgtgtaggagctcggcggaatcggccaacccaccgcccctgaggagggggagatcgaggacgacgacgatggggtccgtgaaatcatctattcatgaaagagagggacaaaaaggcagacgacggagggtggcagaatgtcacgccccgaactagccccgaatggaactagcccgtgacgctccaaattaacctattaatcgataccagtcccaggaaacagtgctggtatcacaggaagacataatatcacaacaacagcggtctctttattgcagagtaggagtacagtcatgttgggctgcggacagatcccgagctcacaactgcattacaaaaggggaaagcggaagccaagacttggaccaatcatcacaggcgcgacttgggaactaggcccaaaccctaaaactcatcgtagccgacttgctcctggaagaactcctcgtcagcgggatccacatcatcttcttcagcaactgggggggattatttatatagagtaagggtgagtacaggagtattcagcaagccatgggaaataagtgtttaatgcaggcttcaacgggaaggctgttgtttttgcaattgattttatttaaactcttttctgaaacaactaagtgagtgcttctcaaacgatgcggatgagacagtgcgtctcgtctggtcggagtatgtgcaatgtatcagtcttttgatttgatcaaggttggcacccggccaacagctttcaaacggccacccgggcctggctgatcccatcagccgcaaattttccaaacatcgaacccaatccacagcagcaaatttcacaaagcagtagtcaaacaaaactacgctaggaatcacctcacatccacccatgaccgtgggcacggctgttcgaacagtttgttaacctctgcagagggggttcactttacccacacgacattactaacccgaatcacccagcccgtgtagaacggccacgtctggtgacctaagggctttcatgacaaggcatttcgagagcagacacagggttgccatatgccgacgagaggggtcccagaccaacaacaggttaggtcccagaccatactgtgccaggaagcccgggggttctccccgacaccaccccgttgaatctacatgtctctcggcatcaaggctcccccgcttagcaatttactcagccaggggtgtcccattccacctatgtggtcgcacttgtcttatgttcggatgaaattccaaggaaacggtccttaagtgcaagagcgggaaatcgtacacccggtacgttccccggtcggcgattttggaaattcatttagttcgcaagcaccgacccaggtgttgggttttccaagacttttgtaaaacccaagttttaccgaagatgttccttagattttaagtttgaaggcgaccgtcgatactcgtgcagagtgcatgaataccgaggctcaactaggtggttacaggggaatatggtataacaattaacaatggatggatcagatgcaacaagttaggtaggcccaccggtctgccttgcagacggggcaaacagattaagtgtaatcctatcaatgcataatattttgcaagcaatataattaagttcaaatataggctcaatatgttcaaaggtggcttgccttgctcgagatcttgagcttgatcctcgaaatcctcgcactgcgggtcttcgggctccgaaactacacgcgaaacgggacaactcaacaaacggcgaaaataaagccctattattgacctctaggcgtgccattagatagatctcgagatttgaggagttttggaagttaaacggagtcaaacggtctttcggttgggaagatattgaatttccaagtttattggatttttggtctaaaggaaaaggatttatttaaattcctttttgaaaaagaaaagaaaagaaaagaaggagggagggaaattagactttcctcgggcggctagggcgcagcccgagagaaaggggctgctcggccaaacttaacgggccggccggccagagaaggcggcccaaagcgcgcgcgcgggcggggaggagagaggaagccggtgggccgggtccatctcgcgtggtcccgggtgggacccgcttgtcggcggctcggctcaccgtgagcgaggtgcacacggggcgtgctagggtttggggaggggaggcgcggcgcatgcgcgcggtttgcgtaggacgcggtgcggcgggcccacgcgcagcctcacggctcgcggtggaccgcgcgcgcgagcagggccggagggagcggccgaccggggtcggctcgacccggtcgcggccgaggtggcaccgacgtggcgccttcgtggtagccacgtgggccggcgagaggaagacaaaggcgtcggccgcgaatggacggcgggcggcggcggtttctccgggacgccgtgcgacgacgaggggcgacggggtgtacaccggaatgacgagggagaacgagagggagcgagccaacggcttggattcgccggagggagttcgtcggcggcggattgcggcggcggcaaccggcggcgagaaaagggggaaacggcgacgaggtcacgaggggctgatttccggcggtgagagcatctacgcggctacgggaatccatcccttgcgccggattaggaggaaacacaccgagggagaccggcgacgagatacgcttccgagctcgggcggcgacggcggcgagcacgcggcgagtgacggcagcagtcggggcggtgccagctagctactggggtactacacatgctgctaaccgagtctaaggggaggagatgaatcgaggagggagaacggggagttgcactaccgagacgaggcggagcgctgtgacgagaggccgacggcacgggagtgatctctccggcctcgggccggggaagaggaagaaggcgagcgcccggagtccccttctgtgtcctagcgcgcaccggctccttcggcacacgtggcagcggcggtcagcgagacagaggggacggcaatggcgcggtggagcaagggcaaaagggagagggaaaggaaggggggagcttgggtttatatgggcgacaatgtcggtttgggagaggggaaccgacattggacggtcaagccagcgagctggcgctttggctagcggccaaaacggcgacagggaggaggggaattacgccggcgggagagaaaagggaaaaaggaggagagaaagggggcttgccccttgcctctttgggaaaagaaggagggagagagggcgacgcggcagagggaggaggagctctgcctccgtcccttggaggctagcgcgcggagtggcggggccgggttgtgacgacggcgatgacggcggaggcggtgtggagcggagcggcgatatgggcagcaggcgcggacaggcgcggcagaggctgacggcggcggcgaccaggcggtcggccaccacggcgtgcgcgcgggggaagcaacgggcggcgcggcgatttgggcggcgtcggcgggaagcggcagcgagggcggagggcgctcggctcggcgcggctcacgcgcgcgcgcgcggcgcacgggtagagcgggggagagagggagagagagagatggggagggagggagagatgggccgagaggaattcggcccatcgaacctgaggggtgcaaaatagacttttgtggagggatttgaactcgggatttgaacttgacgatagatcagggatttgagatccggaatggcacggagactgactgcaagcgaagaaacaattttcgcaattagggtttttagaaattacatttttccgctaggcgccacgacggaatgggcgctacacagaagaaaatgcaaaggtgaaaaaaacggcgcaaggaagaagccggcgagagactgccgccaccgctgggtcatggtgtccacctccctgctccccatgtgggcgcacctttgctccatgccgccgcagtagctcggagccagtgccgcctgggagaattaggtgagggccagcctctgcgtgcctcaggcggtgctatcccccgcggaagtcgcggcggtgatgaaatccgcttttgctgctccagatctgctgctatttgcttcttgcttgaaagccttgaaaaggacgaacgagcttgctgttgctagctcaaccctacaacaagctgctgctgctgcttgtttgcttgaggatgaagtgatgaactgaaccaaaagaatagaacgtcacccgctgcttcttgatacaacgctacagatcgatgaggcttgccctgggaagctgagaatggaggctcgaaagcttcagatatgtggagagcaaccacgatgatgacgaggctgcggcctcccctcacggcacgggtggtggagtcatcgtccctcagcccactgtattgaagtcgaatggggaagatgaaggagagagagaaatgggaaaaaagggaaggagtgtgagaatgacatgtgggtcccacaggatgacccagcgagatagacccggtcaaagcgccatgtcagcggacccatcctccaaaactgctgagggagttaaattataccagttgtaatatttgagggggtcaagatatccggtattgttgttacgggatatgaattagattagagatatatttaagatagtcaaagtggacttattccaagcaaaaacatccaaaacctgaacgtttcctctctagaaaaattatagaaaaccaaacctgcacattttctttctgaagaaaagagagaaaattgaagacctgcgaaaataacatcagcagtgttcaagagcatagtgttaggagaaattaatgcgaataataaataatcatgtgaaaactcacgaggttcgataaaccgaaggaaaataattacaagttggagggttttcatggtgagaacgcagaactcaacctcaactgctgtcacgaaacatcaattcacatgcaattacgatcattttgagagtgaaaagttcatgtttgctagctcaactattggcctaatataatgcatatccctcaacccaaaaccagattcaaagggtttcccaacgatcaaagctagatcattttgcctcacaacgtactcaccgtagccacgtgtgctcggcgaggaaggatgagagagctcagggcagcggtagaggcgg

SEQ ID NO: 17243 - DNA, 1914 bp, Oryza sativa
  unsure (1)..(1914): unsure at all n locations
agagagtagagagagagagaaggcgtgatgaagaagatgagatgggggaattacgtgtgtatcacatttttgttttatttatttatgagtgaactgcactttgtactagctgacttacgtttgttgcactttgaaccaccgactcatttctctagccatgcctatcctttactccagaaaatgtatggcctgctcataggtggacgatttcgctagcgtgctggagccaacatccttgagatcgttgatgcactaaagaagtggttacgtcggccgagggcatggctcatcacggtggagggacttgggggagagcggaagaggcgaggtggtgtgaggaagagggttttctccatgagaggggatgtgagggaggggagcaacttcgtttccagcctagagttggcttcgggcagcggaaccgtggaagattccggccgctgttcggccacaagccgccattcggccacaagctgagagaggctggcggtagagcaaggagagatggcctcaccagtagaactgggcgctacttcggcgctcctgttccccgcggtagcaaccagcaagtgggtgggaacatgttcaagcgtcgctgggatgagccggcactgatgaaggagggtggcagcagcagggggatcggtgagatgacgcagacgaaggaggaggcaaaaggtggaggagaaagcaagaaaccgggtcagatcaaggtaggagatgtggttttcccggtaaattcagaagtgaagaaaggaaagaattgtgtctctgagtttgatgatgacgacgatgatttgttggagtttgatgaggagccgcgagtgattagggacaagaaaggggatgatcaaaagggtggtgcacgggtgaaagtttgctctaggtgcactcaaaagggacatggtgttgctgattgtaaggtggatgtatattgtgatatctgcgactgtagcgtgcatgtctaccacaaatgtccagtcctaaagcttccaaagccggtggtgcagggcggttggctatgcggttgaaggcctaggttttcagcacatcccacatcaaccgcttcaaaggaacaagaagactacgaagaaggctcttgtgcatgtggttggtggtgctctttcggtggaaaggttggtcactcttctccacaagttgtgtccaactaaatggaagtgggagccagtgccacacgggaaggacacttttgttgttcttttcccttcaaagggcgaattgcaatgggccatcaactttgggggtgcagatgtgaaggaaggaggggtagccacgggagtgagggcggagtttgaagagtggtttgaggaagaagagggttttcttctacctaaggtatgcgttaagttttttgggctgaggaagaaactaagggaatatttaactttatgggcagtaggctctcttttaggggcaacacaattggttgatataaaaactactagaaagaatgtttttggagattgtttgtggctgtccttatcccaaaattgatacttaaggtgcttgatgtggtaattgaggatcgttgttttgagttaaaatttgaggtggagaaaaaaggagtcgatgagaatggggaagaagtagagtttaatttggaggattgggatggagatgaggaggatggtaatgtagagtgagagaaaagtggagaagacaatgagggaagggagaagggaccaaaaatgtcaaaggttgatgatatggtatttgatgacaattatgataggagtgaagggagtaaagaggcacaggaggttctgatttagagaaagaaatggatttttctataatggctgaaaatatcttggatgtggctgtctaagnnnnnnnnnnnnnnnnnnnnnnnnnnnnnnnnnnnnnnnnnnnnnnnnnnnnnnnnnnnnnnnn

SEQ ID NO: 17244 - DNA, 1408 bp, Oryza sativa
cattaatctgccatttgcaatggcgatcgagacaagccacagtatactttactgacgcgttagattccttcacatggtacggccggtggacacggatagaataactctgtagccatattttcagatcatccatcgatcgaaactccaaccccttccttggttcatcacacattggttcgaaggcaccgtcatattgtggatccccatcagcaattgctagcccagatctggtaagatcctcgaattgtgttatttccgggtttctacccaccagtttcgcaaacacagtccttacgcactggacgatcatcatcggagtcggaagcggactcatccaattcatcctctgtatcatactccaaccagcctgggttcaatccactgcgtatcatagcctcctcacactcctctcgggtatagaatttcagcctagccaactcccttaggcccatacttacattcttagcattcgcttcttcctcaggcaactccacatcatctcctacctcccgaccatcctcaacatctccttcctctcttaccggcacattctcctccacattaacttcctcccttaacggcacattgtcctctgcacattctcctccacattaacttcctcccttaacggcacattgtcctctacatgtacttcttcccttaacggcacattctcctctgcatgtacttcctcccttaccgggtcattctcttccctgatgtcacgtcctgataaattcatcccgaattaaaaatcattcgctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaatgagtttataaaaagaaaaaccctaaaaagtctttttcccccccttcccctcttgggccggctcggcccacctccctccctctctctcctctcccccgcggcccaatcggcctcctccccgcgcgcgtgccgctgacgggcgggcccgcccgccaccctcgctgacgggtggggcccacctgtcatccctgtcctcccgccgctcccgccgcctcgcccgtgccctagcgccgccgccgccgcggattccgccgcatcccgccgcccccgcgcgcaataaagagggggaaatcactccccgtgattccctcaatctttccccccccacttttccctctctctctctttttcggattcgtctggaaatcctcccgcaaactttcgccggcgtcattgatggagccgaaatagccgcgccgggttgcttcccctccggccggcctctgttaatcccaac

SEQ ID NO: 17245 - DNA, 1188 bp, Oryza sativa
tcaagaacccatttttgtgctttgtttctgcttgttatagggagtttattagagtaaaagccgtttcttttccgttggtcgtgtagacgctgcagcttcggaagatccgctcttcgtggaagttgaagccgacgtttgggaaagcgagcaaggcaagtcacatcatccttgaacatattgaatcccagtttataaaattatgttgctttaaattattgcattatcgctttatttaaattcccgcgttatcactgttttatctagccatgcctatccacctttgttatgaccttattattattgttattgttattattaccttgttcaccctagattaaacaaaaccccaactagtggacactctactcatagtaccactagtataattttaggtagatgcttcgctgattaattaggtaacattaggcggttttacaactctagactttgggatattcatatcacctggacactttggaattgttggtttattgtggaattggacacacacctccccctctattcaaaacccccaaaatggttttaggctgggctcgaggtgcgtggttgggttttgctagtcgtacctcgggtactataaggattaagctcgggcctctgttgcaaagcactaccgtacttccacatgtctagtgggtaaggcttagtttgtggctcagtctggttataaacaaaagtacacggatggagatggacgaagtcggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtagg

SEQ ID NO: 17246 - DNA, 6288 bp, Oryza sativa
ggttataaacaaaagtacacggatggagatggacgaagtcgggggtcgatggacatctctaggacaaatgaaggctacacgagctgcggcccggtagacgagatgtcatggcacagggctggtgtcctgctgctaggggctcaatcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatactgtgtagctctaggatcgtctttttaaaatggctttgggcaactaagtgacttttaaatgctgttttctgcaaaacttaacccctatatcattaccccttgtacccccttgcattagtcgtgcatctgccggtgtggcttgctgagtactgtggttgtactcattcttgctctatctttctccccccttcagcaagagaagctttggagaagaagtcttaggtggagtcttggcttataccccagttgagcgcctgtgaagatggagccgtaggcccgctagtccgctgctgtttattttgattgtcaggacttaagtgcctttgtaataatgtaaatattatcgatataataaagatgtgtcttttatatcatgtttgtatggtgtaccccggcttttcctgggacggggattaatacactagcgttcgggaaaaggcaattttctcggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcaggtcagtgaagaagaagacatcgtcagttgtttgccgaagctccggaagactgcaggatccgctagcgaagtggaggaagcagtgaagccagctgtaaagcaggagtgaagatcttgagaacccgtcacagaacctaagccaccctctagggtagagtcgttagtcgtgtgtttccttgcttgtgtgtgtagtgtgtggtttgcatcggtgggttgtgatgtgaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtatctcaagctcccgagtgaatgaagcaccagacaccagttgtgtgacactggtccaacacctgattaaccagaaccaattgcttatagagatactacagcagcatcagacgccaattctgaacctaagtcagatacaacctcaagcgcagttggaggcagtccaagcactcacaccacaagtcagcatgccgccagcatcccgaaggacccatggtgaagtgccacatgttgactcaaaagaagcaagtatcatttgttttatgtgtgatgagcaagggctctatgcaagggagtgtcctcagcagaaaagaaaaacaccaatgcgaaccgaagatgaagtccgtaagatgagcattaccagcacagaatggcctccaccaggaatgacaaaacgtcagagaagaaataccttccgaggtgcgccacagttgacagagcatcttttagctaatggaggtagagtgtctgatagtgaagattcagatcaagtctcctcagatgatgaagatgagaagtctccccaaggtttcaaccagaataaaatggaacgtaaggcatgctctcgttgtggagaaatcggtcatgttgccagctcgtgtgccactacatgcgttcattgtgaggaagaccatccacccgacaggtgtccaacgagcaggatcacttgtttcttttgtgaaggaactgatcatgtcccaaaagattgtcaattcagttttctgctgacgaagaagacggccaaccaacccgccagttccaatggagagaagtatcaaggcaacacaaatcctcaccaagattacagttttagcctaactccagtgccaggacagaggaatcaaaatgagaaaagaaaatgccgagtccggaaagatatctgttgcttcaattgtcaaggaatgggtcatttcgccgacaagtgcccaaaaccgagaaacatagctgccagcacgtcagtccacgcaactccctgcaatcagaagcttgctcctcagcgaactgtcatccatgcatcccgaagcagtcctacagcccgcgttgcaacagctccaactccagcgagtgcattaccacaagatgtcactgcccaatttcagccccagccatcagttgacgagaccgaggccagtatcggcattgtacctttggatgttccagcacagcagccaagaaatcaagtacaagatgaagaacccgagcataagaaagttattgtcagttacaactgcagtacctgttaaagaagcggacatgccaatcgccaagtggtcactggagcaaatgcagtacctgttaagcctagcactagtcagaagcaaccataatactcttatatcagtgttcaaatacttttgttttatagttgttccccatcaatcatgtaataacagagaaacatgagataatgaatgagtttgataagtttattgagggatccatgttaagattgcaagtgctgggagttgtgtacattttgttgttgattagggagacctagggtctcatttctgtaaactcataatctattataaatcaaataacctagcgattgatggcgaagaaaatcaagtgatcaaccaaagagacatttgtttggactgagagtttcagatgtgtcttcttcggatcagaggcatgcacccgttgtggagaaactggacacgttgctggcatgtgtctcacactctgctctcactatgaagaagaccatccaccaggggagtgtcccactcgcaaggtgacatgttttctgtgcgaaggaacaaaccatatgcccaaggatggccaactcagtgtgttgttgaccaagaccgcggaaatccaacgaacaaccctacgattgtctcatcagctagtcagctccaatagcaacatcgacaatatcatccccagcaccaatgctcctcctgctccacctgactctgcaataaatcatagcaataataccttcagcaccaaccattctctgcaccgacagcctcagcaaagaattgtcatcgatggaagaagttgtgtccctccccgacctactccaggccgagcaaagggcaatcaacctccggagggcgataccaagcagaagaccgtcatccgcttcaaacagcaatcagaaggaagcttctcctatgaatgatagcaatatgcagtcctatcacatcatcacagaaccaatcaaggatgatgcagtcactagaacaatgccagctatatctctccagaaacaaaatgagcagctacgcttgtggttttcagttcgctacttatcactgtaatcgaaagtttgcagcgatcatatataaataaacatattgatgtctataaacagtgagcttgctatgtttatggatgattcctattgagggtacaatgtaccgatgttaagcaccttccctttttgtttaaggcagggccttgtattcgtataataagggagaaatgtgtaatacagacaagttctaagaggattcttttggaagatgcggatatgtgatcatgtgtataattgtttactgacaaaggagacctagggtctcgtgtcagaggaactatattctaacctcgagttaataaccaacctgttgatggaaaagaaaaccaattaaactgtgttgggttaaaaagccaatgagacagtagttggggataggagtttggatacgccttttacagatcaagataatgattgttggatgaaacccataagggtacccgccatgcctctacattgataagttcggatatacctgcaagcagttaagaagatccaggagatatcaatatttgagaacatagtagtcgatggttggtaattagtctatcaggtatcagaaaagggtcaaaggtgatatggcagaagaacaatttggatgctccccatctcgaggaagcactaaagatgatcatcggcaattaaaccctagtggcatagatacagatagcaagcaatgtatttccttgaaggtagtcagtgcagctttttgacgaaccacatcaaggtttcactgaaaggcagcaagccaaaggatctcatcgtccccagaagcgtccgcaatccacattaaagaataccacctgttagagataagccgaaagatgattgataaaagagattggcaaagatgttctctagcatgaaagaagtaggccgaaaggtgattgataaacagaaacatgctctgcatcgctcaaggaagacccctgattgtaattgccccgcaacagtcaccttgtcattaagtaagcaagatgacctaggtaaaagtgtttctaggaaggcaaagagtgaaatcttcaactcggtgtcagatgctacacggagtgaaaagtgcaagcaccggttaccaggcaatgccatttcttgggagatgatccaatgggaaagaacacatcaaggttaaaggtgtaaaggaatacgttgaatactaactgaggacaacctgaagatgataatgggaagtaaactgaatgtaaagaaagtgaatccgagttgcttgttcgtgagagctattcccagttatgaatcaagtgatatgttcgaagataatctacagaggtcagattaaaatcacatctaacaacgaagcctcagatttggcaggataatgattagacaataacaaatccagcagtaaaaccatttgggaagacgtcaaagtatgtcaagtgggataagttggttctcttgggaagcataattcaaaggcaaagttatcgacccttacatcgaatagcagaagtagcttgcacccggtgaccaggaaagctaatatgaggcagttggtggcaagttagaagtaaatgacaagcatggtattctcatgatgacaagcatggtatcttagtaatgacgagctgatctcgacgcatgacatgaagcgggtaacttgtatgaggttgacgccaaaggtacgaatgataagaagttctagaaccgaagccccatcctcaaccaccgcagcctagtctgggtcagttagaggttcaaccagggacaagtcgggtgaagagaagattccatctgcaacaggagatcgagccaagcattccagagtggagaagttttgttaggcaagttggttatagaagacggagcggaagaagtcagacaagaagagaagaccgcccaacctatcttcatgctagcctcctcgaatctcggggacgagattcttgtaagggggggtggatttgtcacgtcctgataaattcatcccgaattaaaaatcattcgctaaaaggaataatagaattaattaaaattcgaaaagaaattggcaaacattaaaatacgtgcaagaaaaattcaaatgtggcccggagaatttttgttaaattctccttggtcaaaaaggagccctcaaattttagtggaattttcagagcacaaataataattattaagaaataaacaaagttaaaatgagtttataaaaagaaaaaccctaaaaagtctttttcccccccttcccctcttgggccggctcggcccacctccctccctctctctcctctcccccgcggcccaatctgtctcctccccgcgcgcgtgccgctgacgggcgggcccgcccccaccctcgctgacgggtggggcccacctgtcatccctgtcctcccgccgctcccgccgcctcgcccgtgccctagcgccggcgccgccgcggaatccgccg

SEQ ID NO: 17247 - DNA, 1158 bp, Oryza sativa
  unsure (1)..(1158): unsure at all n locations
nnnnnnnnnnnnnnnnnnnnnnnnnnnnnnnnnnnnnnnnnnnnnnnnnnnnnnnnnnnnnnntggtttgtggctcagtctggttataaacaaaagtacacggatggagatggacgaagtcggggtcgatggacatctctaggacaaatgaaggctacacgagctgcggcccggtagtcgagatgtcatggcacagggctggtgtcctgctgctaggggctcaatcctgcctacctgtcccggaggttccggccgtaggtggggttgggtcggtactcttgtttatggctaggatgggttgggaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagttagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgagggttcacggccttgattaataatactgtgtagctctaggatcgtctttttaaaatggctttgggcaactaagtgacttttaaatgctgttttctgcaaaacttaacccctatatcattaccccttgtacccccttgcattagtcgtgcatctgccggtgtggcttgctgagtactgtggttgtactcattcttgctctatctttctccccccttcagcaagagaagctttggagaagaagtcttaggtggagtcttggcttataccccagttgagcgcctgtgaagatggagccgtaggcccgctagtccgctgctgtttattttgattgtcaggccttaagtgcctttgtaataatgtaaatattatcgatataataaagatgtgtcttttatatcatgtttgtatggtgtaccccggcttttcctgggacggggattaatacactagcgttcgggaaaaggcaattttctcggtcgcgacaagctggtatcagagccatctcgactgtacgataagccaagtggataaaacctaaggacatattt

SEQ ID NO: 17248 - DNA, 589 bp, Oryza sativa
  unsure (1)..(589): unsure at all n locations
aattcgagctcggtaccctaacccaacacagtgtaattggttttcttttccatcaacaggttggttattaacgcgaggttagaatatagttcctctgacacgagaccctaggtctcctttgtcagtaaacaattatacacatgatcacatatccgcatcttccaaaagaatcctcttagaacttgtctgtattacacatttctcccttattatacgaatacaaggccctgcctaaacaaaaagggaaggtgcttaacatcggtacattgtaccctcaataggaatcatccataaacatagcaagctcactgtttatagacatcaatatgtttatttattatatgatcgctgcaaactttcgattacagtgataagtagcgaactgaaaaccacaagcgtagctgctcattttgtttctggagagatatagctggcattgttctagtgactgcatcatccttgattggttctgtgatgatgtgataggactgcatattgctatcattcataggagaagcttccttctgatnnnnnnnnnnnnnnnnnnnnnnnnnnnnnnnnnnnnnnnnnnnnnnnnnnnnnnnnnnnn

SEQ ID NO: 17249 - DNA, 2024 bp, Oryza sativa
tgactttcccttctgcctcatttaaaacttctgtaccaaacaattggcgttcccctgtctgatcccagaagagcggagtacgacaccttcgtccatacagtgcttcaaacggtgccatctgcagactagcttggtaactgttgttgtaagagaactcagcatacggcaagcttttgtcccatgctccaccaaagtcaagcgcacaggctctcaacatatcctctagtatttgattgactcgctcggtctggccatttgtttgtggatggtaagcagtgctgaaattcaaccgggttcccaattcttcttgtaatttctgctagaactttgaagtgaattggcttcctcgatcagacacgatcttcttaggtacaccatgtaaacacataattcttgccagatagagttctgctaatttcttccctgagtaggtagtgtgcaccggaatgaagtgagccactttggtgagtcggccaacgactacccaaatagaatcatgccccgatgatgtcctgggcaaaccggtgatgaaatccattccgatttcttcccacttctattctggaatctaaagtggctgtagcaaacctgctggcctttggtgttctgcctttactcgttgacagacgtcacatagtgctacgaattcagctatttcccttctcatgctgacccaccagaaattttctttgaggtcttggtacatcttggtactgccgagatgaatggaatattgagtttgatgagcctcggttagtatcaggtcttttaattccttgttttcgggtatacacaatctttctcccatccagattgttccttgttcgtcctcaacaaaacctcgggcttttccaaccctcatgttctttttgagctccgctatttcaggatcacttgcttgagctatgcgaacctgctccaccagtgtgggctgtgcctctaggacagccacgaatccgtgctcaactataccaaggttcaaatgttcaaaatcacgttgaacctcacagcatagttcctctacccatgcgacgttgcagtgactcttcctgctcaaggcgtctgcaaccacattagccttgccgggatgatagtgtattcccatatcataatctttgattagctccaaccatcttcgttgtcggagattcagatcaggttgggtgaagatgtactttagacttttgtgatctgtatatacctcacaacggttaccgatgagatagtgccgccaaatctttaaagcatgaacgactgcggccaattccagatcgtgcgtcgggtagttgccttcatgaggacgcaactgccgtgaagcataagaaaccactttgccatcctgcatcaacacacatcctagcccctggcgagatgcatcacaatagacctagaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaataacccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttggtcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaac

SEQ ID NO: 17250 - DNA, 1246 bp, Oryza sativa
  unsure (1)..(1246): unsure at all n locations
nnnnnnnnnnnnnnnnnnnnnnnnnnnnnnnnnnnnnnnnnnnnnnnnnnnnnnnnnnnnnnnatgaatgctgtctttggaatatcctcttcgcggatcctcaactggtgatagcctgatcgcaggtctatcttagagaacacaatagctcctttcaactgatcaaacaggtcatcaatccttggcaaaggatacttgttcttgatggtgacctcattgagtgcgcggtagtcaacgcacatcctcttggttttgtctttcttctccacaaagataaccagagcaccccaaggtgacgtgctcgggcggatgtatcccaaggtaactgttcatcgacttgtttcttgacttccgccaactcgttggctcccattctgtaaggcctcttgtggatcggtgcagttccaggtaccaagtcaatccggaactcgatatccctttttggtggcattgttgtcagatcgtccggaaaaacctctcgatactctctgactatgggaatatcctccagcttcttagtggttttctccactgctacctcttgttcttcaccagcagcctggtttaaactaatccctggcttccgcggtactggagactggaaagttaccacctctccttttgcattggtcaacttgatggtgcggctggcgcaatcaatcactcctctgtgccttgtcaaccaatccattccaagtatgacatctaggtccttggattcgagaagaatgaggttggctggaaaaatcgacccttgaatttcaactgtcacagatgggcagtagtgagttgtggtcatgccacctccaggagtatgcactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacttctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggttgaactgattgagctggaatctttagtgaactcggagtagggttgagactgtgctgctcactgttgttgtgactgccactatggtggttctttgtgaagctacccgggtggta

SEQ ID NO: 17251 - DNA, 3395 bp, Oryza sativa
  unsure (1)..(3395): unsure at all n locations
aaaatttaaaaattcaagtacactttatgtgattaaaaaaatagtaagaaaagaagggaaacagaggcaacagagactgcagtctaaaattctggatgatactgtagcaactttttgcaaggaatataataatagcaatgctttactttgagtacattgagagtttgagatctcatataaaacaccatcatagtgcttgatagaaaacaggatcatatttatgcatgatgaacaaaataggataaggttaatggcaaagagcaagcttgttacctgttgcagaggcatgagttgaatggttttatatgtattttttctcaactactgtaacgtgatattccaaaactcagtttattattgatcaaaagctaacttccaaatctatggggcaaggagatgaaaaatactgaaaatactcgacacagtccttatctttcatgcgttttattgatggaaatttggagattactatcatatctaaaaataaacaggagtcacctaaaatacaaagattcaggactaacgtcatgcaaattgagtggctgacctgatgctacctcccatatgaggaaatgagattcatgaatagttgattaattataccctttctcaacacatgaggaagaataacatgatagatgaatcaatagnnnnnnnnnnnnnnnnnnnnnnnnnnnnnnnnnnnnnnnnnnntcttaagcttcgctaaggataacccatgtgcaccagcaaaacgcttggaaatgaaggaatgggttgcaccagaatcaaacaatattactgccggtgtcgagttgacggggaatgtgcccaatataacttctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggttgaactgattgagctggaatctttagtgaactcggagtagggttgagactgtgctgctcactgttgttgtgactgccactatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaatgtcctcataatctctagagatcaactggttagtcaattcatcatcaagacccgacaaaaacttctcctgcctctcggcatcggtacgcacgtcctcaggggtgtagcgcgcgaggcggttgaactcatgcaaatactctataactgttctggttccttgttgcagggaacggaactctctcttcttttgtgccacaattccctcgggaacctgtgctttattgaaactatgacaaaactctgtccaagtaacttctgccccagctggacgggtcaccatgtagttgtcccaccaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaggtgggcggcttgacacgaagaaattctaacagtttggactgaggaggtggaggaccaaactgcaggttctgctgctgcagctgtgcttgctgctgcacctgctgcaacacctgatggtactgttgctgcatctgttgcatcatcattgtcatcatctgagtctgattgtccaacacctgagcaattgttgggttctcgggtggtggggacggactgttgtcagatgcaccgttggcacgtgctccattgatcggctcttcactgccactggcgttgttcgagtcgcgtgaaccattccttatctccatctgaaggggataggtagaaatatgagaaatggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaatccgactaagaaggcgataaagctaagggcggcgactctgaagctcggggcggcgcttgcaaacgagggataggactgacatctaaagtagacaagggataggaaccaattcatgctcaaatccaaattaaacaaagcaaaagaagactcaaataaataaccgagcatgatgatttttatgcatagaacatttttcatgaactcaaataaagacactaatgcaagtaaacaataaattaatgcatagactagttgcatggaaaatgatgcgcataacattgcccccatcgaatatagacacgacctaatgcataacccccaataaattcccgactgactatcgaataaactccaactaaaatttttctaaagccctagactgagctaatttttttttttaaaaaaaatccgatccgaaagaacgaccaagatttttcctgcaaaccaaagaggcaaaactccaaattttcccgaaacaattccaggtgcaaaaaggcatatgcagatgaaaaaggggttcagagggctcttagggtttccagttggcttgtcctacggtcaaggtcggctctgataccaacttgtcacgcccagaaattctcaaaccagaatttctaagctgaatgtgcattaaatccctgtccaggaccagccagggtacacaaacggcaattgttgacatacagatccacgtcttacaaaaatagaaaagattacaaatgcagcggaaaagatgaaagcgagctaaaccgggaagcttgacttcagcagcgagcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggnnnnnnnnnnnnnnnnnnnnnnnnnnnnnnnnnnnnnn

SEQ ID NO: 17252 - DNA, 2101 bp, Oryza sativa
  unsure (1)..(2101): unsure at all n locations
nnnnnnnnnnnnnnnnnnnnnnnnnnnnnnnnnnnnnnnnnnnnnnnnnnnnnnnnnnnnnnnnnnnnnnnnnnnnctgagtaataggacccatcccacatgatattgtaaaagaatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactatagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcatccaacgggggggcggcgggcaccgacaggcgggccccacgggtcagcggttcaagagaggggagagagaggcgccggcaaacgggcccactgggcagcggctcaaagggggtcggtccaccgtggaccgggaccacgcgggtggtccaccgccggtccacgggaccgacggtccagatcggccgggagaccgatcggacggcacggcggcgactaggcacgactcggctcggcttcaaaaccggccggccggccatggcgaggcgacgacggcgcacgaccgccggcggtgcggggagacggcggcggacggcgcggaaggcggcggcggacggccggagcggcggcacggccaaaggcggcggcgcacgcgtggaggggagaaaagggagggggagggaggcatcggccgggctcagctcggcctcaaggccgaccggggcgaggcggcggcgaggcacgaccaccgacggcggggaccggtgtcgcgggaagcggcggcgacggccgaaaggtggcggcgcatggccgaagcgcggcgatgcacgtgcggagggcggcggcatgcacgggagagagagtaaagaaagaaggagagagaggtagtcctcaccggcgatgtgggggaatcggggtccggcggcggcggacggaaagcgagcggcggccgaggtagctctcgcggcggcgaatctagcggcggtgattgcgcggcgaggcgatggctctagcgacggcagcgtgcggccggaggcggcggcaagcggtggcgctagcggcgagcggcacgggctcgttaggagacacgggaggggacggcaaatgggggaaacgagagaggggactcgggggagggtttttatgggtgagggaggggcggaaacggccgggaatggcccctatttggccggcgatgtggggagtggagggagagagagaggggtgggattcgaaatcgaatcccgccctctcgagcgcgcgcgcggccgggagatgcgggggaagaggcggcgacgtggggaggacgcgggagcggcgcggcgtgggcgcgggaagagcggaggaggcggcggcgtggcggattcggcggcggttgccgtcggaggcgggtggctggaggaaggggacgacctgacaggtgggccccacctgtcagcgtcccggagagagggggaaggagaacgggccggcccacaaggggaaggccgagcgggagagggatgggccgacggcccaacaaaggaaaaggacggaaaagaaaaaaagaaaaaggattttcctgggattaaaattgcactttggtgatttttaattggtaaaaattatttccaaggctctgaaaattccactaaaaatcctgttaatatattgtgacatgtggaacccaagaaaaaatcccacaatgccaattccaattattaattgcatttattaattatggaattagctctaggttaattaagataatttcttcggacaatttatttagccaatttttaaagctaggagagggggaaacttcaaggcgtgacaaactatccccgtggttcgatccgnnnnnnnnnnnnnnnnnnnnnnnnnnnnnnnnnnnnnnnnnnnnnnnnnnnnnnnnn

SEQ ID NO: 17253 - DNA, 732 bp, Oryza sativa
gtctcgctgaccgccgctgccacgtgtgccgaaggagccggtgcgcgctaggacacagaaggggactccgggcgctcgccttcttcctcttccccggcccgaggccggagagatcactcccgtgccgtcggcctctcgtcacagcgctccgcctcgtctcggtagtgcaactccccgttctccctcctcgattcatctcctccccttagactcggttagcagcatgtgtagtaccccagtagctagctggcaccgccccgactgctgccgtcactcgccgcgtgctcgccgccgtcgccgcccgagctcggaagcgtatctcgtcgccggtctccctcggtgtgtttcctcctaatccggcgcaagggatggattcccgtagccgcgtagatgctctcaccgccggaaatcagcccctcgtgacctcgtcgccgtttcccccttttctcgccgccggttgccgccgccgcaatccgccgccgacgaactccctccggcgaatccaagccgttggctcgctccctctcgttctccctcgtcattccggtgtacaccccgtcgcccctcgtcgtcgcacggcgtcccggagaaaccgccgccgcccgccgtccattcgcgggcgacgcctttgtcttcctctcgccggcccacgtggctaccacgaaggcgccacgtcggtgccacctcggccgcgaccgggtcgagccgaccccggtcgggcgctccctccgg

SEQ ID NO: 17254 - DNA, 841 bp, Oryza sativa
gttctatggtgaactcaatctctcggtctggtggcatactcgttaattcttctgggaatacgtcgggatattcacagactatgggcaccgactccaaggaggtgacttgtaaacaggttaggatagaccgacttgcggtaggggtgttaggggtaaagcggacttgctttcctccaggtccttgcaaggtgatggacttttcggcacaatttatctgtcctttgtgcttagccaaccaatccatccctaggatgatgtccaagctttgcgagtctaggactatcggtttggctaggaagtcaacttcctcaattctaaggttaacttccgggcatatttgagttgcccttatattcctcccaggggaatgtactatcattggtacacgtaaattttgggttttccaaccatttcttttcacaaaagcttgtgatatgaaagaatgggaagctcctgaatcaaacagaactatcgcgggttcggagttgacagagaacatacccatcacaacgtctggagcatcctgagcggtttcagcttgaatgtgattcacccggcctcgaccaaagttgttggaagcacgtgaaccttgtccacttgcctgagagctaggacgagacggagctgccgctggagtaggagttctggcagtgctgccattagcatgccctaagttggtgttggtaggattctgagggcactgtctggcatagtgacccatctggttgcaccggaaacactgaactgctgacggtccctatggtgacttgaaagaggtaacactgttgggcgcagtattgccactaggggcacgctgctgtggctgaggtgccggacggtt

SEQ ID NO: 17255 - DNA, 1801 bp, Oryza sativa
aaagaggtacccctgtgggcgcagtattgccactaggggcacgctactgtggctaaggtgccggacggttcatctgaggacgaggggcgtagcctggctgccggttagcttgagtgaccgactggtggtattgcatgggttgaccgtagcgagggcgaggtgcgcctcgggaagaatttccctgatggttagacttgcgtttcttgtattcttcggtagcctcttttctggcatcctcaagtagaagtgccttgttgatcatatgttgaaaagtggggaagtcatgagcaagcaactggagtctcattccaactgcgattcctttcaagaatttcctgatcttcttcttgtctgtgtccacttcctcaggggcgtaccgagccaacttattgaacatacttaggtactcattgacactgctgttgccttgcttaagtctgttgaattcttctttcttcatgtcaatagtgctttcaggcacatgagctgcacggaaagccgtagcaaactcatcccaagcaatgttagtgggttcagggtgtgcattgcagtaattctcccaccaatctgctgcaggtcctcttagctggtgagaggcgtagagcgtcttctcaaccggagtacactgcactaagttgagttttctatcaacatctttcagccaatcgtcagcctcgacgggctcgacggtctgagagaattctggcggacgagacctcagaaaatctgtcagcttggacctattgttgctcctgtgagggtggccatttccatgcgcattatgctgaaaaccggctacggctgcggctaatccttgcaagatttgtgtctgaactgccattaagtgttgcatgttgttttccacatgaggtggggaagggagtcgttcttctccagaattgtgactggcagtgcggagagagcggtgagactgttccatccctgcatcacgggaagctgtgcgatgcgagcggttgctgcggcggggttgctcaacttctgcgttgcgggaagcagtacggtgcgaacggttgctgtggtgagactgctcattagctgactcatgattcgcttctggctcggctctaccatcttcaaaaccaaagcgggctggtgcacgagctgcacggcgggggtggctagccatctaaactcccagaagagggcggggtaagagtcagataagcacttaggagggcgaggagcaaagtaaatagcaactcagatagcacatactaggcataaattggatttttcaaatcataaaaacacctgatacaacgggtgtggacaagtcacagagctacgccgagcttgactgtgcgcacaccacctaggagaaccacactaccaaacaacacccacaacaaacacacgcacgcactacctcgccacgactccaaaagagttggcggcggaacaaaaggacctaacacacggacggctgctgaagactgcctcctctactcctcgtcggcctggctgcctcctgtagtcggctcctcagtcgaagaaacgtcgatcggctgacgcgaaggcaccggcggaatctgtcgagggccggcagcagcacgggccgctggcggtgggggagtctgtagcgcccgttccgtcgtggcgcctagcgggaaaattatctctaaaaccctaattgcgaaatttgtttcttcccttgttgtctagggtccgtgccatctcaagatctcaatccccgatctatcgtcaagttcaattcccaatccaaatccttccaaatcaaatcccttcgcaaaagtctattttgcctccccccggggtcgat

SEQ ID NO: 17256 - DNA, 2718 bp, Oryza sativa
ggccccgccactcccgcgctagcctccaagggacggaggcaaagcctccctcctccctctgccgcgatgcctccgctccctctccttttcccaaagaagaaaggggcgagcccccctttctctccccctttttcctcctttttccctctcgccggcgtcaccgccctgtcgccgatttggacgcaagcgccgagcgccagctcacgccttgaccgccctaagtcggttcccaaaccgacattgccgcccatttaaaccccagcctccccctttcccttcctctcccattcgcctccgcgccattgccgccgcccccgtgctctgttcgccgtcgccgttcatcgttgcgcgtgccggaggagccggcacgagcaaggacgcggaaggggactccgggcgcgccctctccttcctcttccccggcccgaggccgaagagattactcccgcgccgtcggcctctcgtcactgcgccccgcccgcacggtagtgcctccctccgttcttcctcctcgctccatctcctccccttagttttcgtcggtagcacgagtagcctccccgtagctagccggcgccgccccgaccgttgccatcgctcgccgtgtgctcgccgtcgtcgccgctcgagcttcgtagcacccactcgtcgccagcctcgctcggcgtagctccgcccaatccgacgctagcatcggattcccgtggccgcgtagatgctctcaccgccgggaatcggcccctcgtgacctcgtcgccgttttccccttttcccaccgccggttgctgccgccgcgattcgccgccgtcaagcttcctccggcgaatccgagccgttggctcgtctcccctcgtctcgtgcaaccacctggtgtgctcgctttcgccggtattgtcacgcccagaaattctcaaaccagaatttctaagctgaatgtgcattaaatccctgtccaggaccagccagcgtacacaaacgacaattgttgacatacagatccacgtcttacaaaaatagaaaagataaaaatgcagcggaaaagataaaagcgagctaaaccgggaagcttgacttcagcagcgagcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaagcagtagttgaaagcagtaaaacagttgtagtaattaatcaatattaaccaaacactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggtaagcacggtaagtctcccagggtttcccgtgaaccggtccttaactgccatgggtgcgaccagcaaaaccatgcacccacagcccaccattcaatgtattttaattaactaacaccattgcggtggcaccaatccaaagctatgctcatagacaaagtctatgtaataaagtgatccccatttgtgtgctagttgaactaagcatggctaagcatttcctaaaccaacatctagtcattttgatacccaggttatcaatggcatatggtaaacaataaatggctgagtaataggacccatcccacatgatattgtaaaagaatgcaacatttaatagaaatgcgggatatttgtaaattgggtacaatatgatcaaacgtattgcatgacttgccttgctctcgcactgatgagatcacagcaacgtcttcgagaaactgcggatcgacgaaacggccgaaacctacgcgacaaacaaagcacacaagcaaaacatgctataagactatagaaacaggaaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcatccaacggggggggggcgggcaccgacaggcgtgccccacgggtcagcggttcaagagaggggagagagaggcgccggcaaacgggcccactaggcagcggctcaaagggggtcggtacaccgtggaccgggaccacgcgggtggttcaccgacggtccacgggaccgactgtccagatcgggcggtagaccgat

SEQ ID NO: 17257 - DNA, 868 bp, Oryza sativa
ttccactaaaaatcctgttaatatattgtgacatgtggaacccaagaaaaaatcccacaaatgcaatttccaattattaattgcatttattaattatggaattagctctaggttaattaagataatttcttcggacaatttatttagccaatttttaaagctaggagagggggaaacttcaaggcgtgacaaacctaccccccttaaacggaatctcgaccccgagattcggaagagctggcgaagaggtgcgggtgggtggccttcaactcatcttctctttcccaagtggcctcttcctctgagtggtggctccactgaactttgcagaatcttattactttgtttctggtccttctctcgctggtttcgtggatacgagtcggcttctccacatacgtcagatcttcctgaatttcgatgtgatccggacttgcctgttccttaggaactctcaaacatttcttcaactgagagacgtggaacacgttgtggatgccaagcatgttggagggaagctcgagctggtaagcaacttcacctctacgttccaagatcctgtatggtcccacaaagcgtggtgccaactttcctttggtttggaagcggtgtactcccctgagcggagtgacacggagatacacataatcccctacttcgaaagcgagctcccttcggtggttgtctgcatagcttttctgccgagattgcgcaattctcaatctttccctgacagctctgactttcccttctgcctcatttaaaacttctgtaccaaacaattggcgttcccctgtctgatcccagaagagcggagtacgacaccttcgtccatacagtgcttcaaacggtgccatctgcagactag

SEQ ID NO: 17258 - DNA, 9865 bp, Oryza sativa
  unsure (1)..(9865): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatgttgagttgtaagttaccagaaaattacacttgctgcagtgtgggcaatgtgaagagcccctttgggacctggccagaaagacttccagaaactattgaactgagtgatcaaaacatatagagatgagtatgaaattgtcatcacaagacgacacaaaatttaaaattccaaaagttttggataactcacacagaagcaagagatgttaaagatgtgaaccagctgggggccactgaaggatcaaatgtgttgttgctcaaatccctggcaattcaagagtggaatctttagttatgcagacaaattatatgattggatgatgaggcatgggggtggttagtttcttacacaacattcaagttggtcatgttgctgagatctggcactgatccagttagcttgttgtttgctaagttcctgcagaagataacattttcaagagaggtgcctcaagtgtcataactcttcctttaagatcagatgtcacttacagctcattcagtttgaccaaactgccaattgtagcaggtattgctcccgtaaaaccattcctatccaatcggctgtcaaagatacaaaagcaagtcaaagatatgaccatttttttttttggagaaaataaaaggatgagttccacctatgtgaactttcaagatacttacagaacttcgagtgtactaacagtcccaacctcagctgggattgagcctgagaatttgttgctatcaaacaaactgacgagatagggagagatgttagcaagatatatctattcggtattcatattagacatgaaaatttgtcgatcccttacatgtgtatgagagtcatattggagttgaaaagtccagtaagcgttccagttaactggttcttgttgaaatggctgttcatcaatttgaagtttggagcaaaacaatcaattgtaagtacttacatattctgatatttctcaattgataataccataaagtaagattaaaattacttacaagtgctgcgttttgacaagttggtccaggcctggtgatgttgatgttgagatggggacagatccagtgagttgattatcagccaggtctagccataagaggtttgtgagtacgccaatcgaagacggtattccaccactaaacttgtttgaattcaaggccctatagagaatggcacgaattcattatgtcaatccactcaaaagaaaagaaaaaaagggtttatcatctgaaactgtggaccaggtatatccacttacaagaacccaagtttccgcaggttgcctattgctattggaatgtttccagtgaagctgcaaccagctaagatcctgacaattacacagcatttgtgcacatcagtaagaaagtttggtatttctgattggaaaaagtagtgttgacaacaatgggcagtgcggcgcatacagtgtcgtaagctccccaaggttcccaatctcagctggcagcggaccaccgagattgatgttgaaggaaagatccctgcaagtgtttctgttatcagctactactactagactatttcttcttagacaaattagttgtactccagaactttgtcacggatcatttcatccaggtacgtttgctattgataatttaacttcaagtgtagtatcttgtttctttcttttggtaagaaatgagcctaatccatgtcacattgcgaaaatagtcaaagcttcagatatttcatccagatctatttactattgtaacttggcatcatatctttgtttctttcatttggtaagaaatgaacctaatccatgtcacattgccgaaatagtcaaagcttaagattggtaaacatgaactggtcagctgaactaagcctcaagaaaaaaaaaagcagagttcataaactagaagcaaactgttctgacaatctgccccttgactggttcaatcagaagttcctagcctgattgcctgaattcacaatctgaactgctacagaagcatgaacaaaatttcgaaaatcccaagttcatagcctgcaaaatcatgctgttttgaacttttgctaagctgggtgatgaactgatgatagaagaaggtgcttacaggtacgtgagctggccgagctggccgatgctgctgctcagtgttccctgcaggctgacgcttgacagcctcctgcaaaaaccagagacatccatggcacgatttcagaggaaggcccatcacatgatattggtggtaggaggagaaggagatggctgtaacttacagcgtcgtcaccctgccgttggtgcacatgatgccgtcccatccgccgccgcaggggtcgccggagttccagctcaacgggtagttcgtccattggctcttcagcccctcgagcgccgcagctgcacgcatgcatgcccaagaagaagatcatcaacaccagcaacaaaaaccaagcgattcttctccgggcaagaagatcctgcctgactttagaatcatctatggaagaaacggaggtgatcgccggcggcgaggcaagagcactcaccgtcctgggcgttggtctggcacaacaccgccggcacgcccgccgccaccaccaccagcgcaagagccatcaacacccgcggctccatcctgcgccgcgccgtcgccggcgaggcaagccaccgggagagctagcacacgcttgtgctctgcttgaccggagatcgtggaggaggaggtggaggaagaagaggagaagagtccgcgcaaggtgcggggaggcgacgacgcctcggtgtatatggtgggcgcgggggccggggagtgatggcgccaccaaccgcggccgggttgaagtcttcccttctctcgccgcgccgccgggaagaggtcaacccacccgcggatggatgatcagagtgtgagctcctcacgcgttcagacagccagacatcctccctcccgcctctgctccttcctcgcgccgtttggtcaaagagccgacctgcttatgcttaatcaatattagtacctctgtttttaaaagataacattgttaactctttatcacatgtttaaccgttcgttttgtttaaaaaaattaattagttataattttattgtaagttgttttatcactcaaaatactttaagtgatttatattttatatatttgtataaattttttttataagatgaatgatcaaatatttgtttaaaagttaacggcgtcatctattagaagttggaggcagtgctattgaaaaagaaaaaaagacctgcgctaatatagagtaattagtgtcgacttggattagttaaccatttaacctgttgttcagtttattaattgatctctctcaatcaggtcggctgttggtgtcaggtagccatcgcgggcatgatttcttattattttgtgtgttggccgtcgggcgcgcgaaatgggatcgtgaggcttaatccaacccacattttgatattcctttttgttaacattattatactagtactggtatatctatatcttaggaagaaggtgcctaggttaatgtgcaggttagtcgtcgtcttggattgtactcccactgtcctattctattttaaatacaaccatgagtttccgtgctcaattttaatcgtccgtcttattcttttttttataattagtattttattgttatgagatgataaagcatgaatattactttatgcgtgacttatgtaaaaaatttaaaaataagacggacgatcaaagttgagcacggaaaatcatggctgactgcacttaaaatgggacggagggagtacatttgtgcccgtgcagttgatagttgacaatgcaggagaggaatcgtcgttgtggattctgtcctaatctgtccatgtaatccacggttaagataaatgcatcaagtacaaagaacagaaagagagagagagagagagagagagagagagagagagagagagagtatatgattctaggatctcttatgtcttcttgattacgacgagaatccttgtggtaaatttgtaccttagttgttgtgagtacctttcatcctcttaaaattaggtcaatctaaaattagcagaaataacttccggatcgaaacatagaaacaccttcattaatactccacatgtgctcataggtcggccggacacaattaaccctaattaaatagggttaataaatacttcttcaaccgcgtcaggctcgcggtgtgaagtttgcagaaaagggcaagttgccaattggggtcgtcatgccttatctcgagttttgatttgctcgtgattttttgcattgtgctactgttgtggacctgaaagagagtggctgggaaagggagagccttggtcaaattgccgcacgttcatgtcaatcgcgatctttcactagattcatgcaaaaagcggcaaacgagtgcatgcttagctgatttttcaattcttaaaaattacttaattctcaggaataattttgcactaaatcacggaaaggttggacaatgaaagcggcgaagaaacacacggaattagttctaaaaaaaagttttaaaacttaaaatcagctttggctttgtaatgctttcatcgccctgcatggacgtgaattcttattattttcgaaccttttgtagtttttaaaataaatgctcctaaaacttatttcaaatctaaattttttggtctaaccacgtcatctcgcactgcttgacaaaacaactctgctacgtctcccataatggctataaagtgggctgttgtctcgccaaatcaatctagctggattgataaaacccttgccacgtgaccaacagttttagatttgaaaataagttttgaatggtttatttctaaaattttaaataaaaaaggtaaaaataaataaataaataatccacggggaagatttcaacaccaatctcaaagcagactacatgaccccgtcccatagaataattccagaggtccctagttgacatttcccattgtcgtgccgcgctttgcaaacaagaaaaccccagagttgatggagataaaacgttaagcaacatgcttgacaaattcagatcttaaccacagctaccacttcacaatgttttcaacgtttgcaacagggcacgtctaaaatgccaaaatgtgtcattgctttgcaaaaaatatgaactgatgtcaccaggagactgtcaaaaagacatcgaaatcacctagtcaacaccattctcattagataaaactcataaaagccgaactgtgacatcagtgcaaacacactagaggaattcataattcaaatggtatacgtatgcctgggggaaaaagctagctgggttgaaagttccatgaagggtgtgaacattagtttttgatttgatctacaaaatatgacatggtacaaaagcctagtgccgcctcgctttagactcgctcttcgcgagaatcattccagagagcttatcaacctcgtagagaaatccagcagaaaacaggaagctgcagccaaagttgataaaaattgattaacacattcgcaaggactgcagcaacgggtgcacagactgaccaaaggttaataatatgaatttatcactgtcaaagaactctccaaagtatcaatttctcactgtcatagaactctccaaagtcatggttatgagggtatccacaatgtgtcaagttgcttaaaaaaatgccaagtagcggcgggacttagaccgcaagcataataggctataaaagggcaattgatttgatattttatatagacaggttcaacagaactactagtaacccattctatatgccataattctgaatagcgtaatctgcaaattgcatagcgtttccagtgacattgttgcataaatacagcttttacaacatgtgacaaatccatatttaccaatagcattagtgttaacaatatacaacttaagataggtaaaaaatacttgtgtgaaatacacattactatcttgaatgatatcacattcaacaggatgaaaaaagttttaactccttgcaaacaaaggagtggagtatcttgtttttgcctaaattgttagtttcatttcctcccatctaaacagagcaacagttcataagcaaatactccactagtatgtctgagattaccatctctggataatccaagaattttcttatttagcaaacagcaaacactcagatctatggatgtgttaatgggaccatatagaaaaattctaaatgtccgtagaaagaaatagtaaagtgtcttaaagataacataccatgttgtgatgcaaacacgatggacagtgccggcaacaataagtgcagtaagttccgcgacaacaactgcaaagaaagagacagttaaagaaagtcgaaataaaaatcagggggaagcagcaagaatgagatcgtatgactatacatacctgcaccccatccagttttaactccattagcttcctgatagttgccaataaactgcaaaagtatatcgaattatcatatactaatattaatgttgagaggaaacagttaaaaaagtgcaaaactcactgatcttttaatacaaccataaaaggtgaaaatcaaatgtggataccacctgctcactatgtcttatgtgcttgtttttgctaagttttgttgccttcctaagggtctgcttgcactgttctcttgttacagagcagaaagctgggataagtaccccatttcaaggatactttctttgaccatcagataagactagtagtatggacattggggctgctagttctgctggatgctcttggggcttagcatgcttttggccaaaaccccctttagttctattatcttggctcaaaaagtaaaagttcgaagctccaggttccatacttaacatgccctttgcaagaattatgatagcatcatggaaatactagcagatagcttagcctacatagtaccaagtgagcttaaaattaaatgttctattctctttcagaagccatccttgacttcttgtgtagagagtgaacttaatattagatggtgtatgatatttcagaagctattcttctgtggatatctggaaaactgaacctgaataaactagttccaggtcctctaagccgaaatctcgcttatgcgcctagtcggatattacaattcagagaagcacaatgttactacccacttctgcacagagcaaaactatgttttcttctatggtgtttatcccctacagactgaatcactcaaatgtgacaaaagctacgagagacaacatcttggcaactccatttgctacggggtttgtctaaattaataataaaacgaaaattttaccactcatgtgattctatcacttcaaattagctaaaaagaaagagggacaaacaacggcatcacgagcaaaacttaaaaacttattaaggggtataagatcgtaagaggagggttgggagcggacgattcaacgcaccgtgagaaggaagaggaagaggagggagctgacgaatccgccggcgatggtcatgagctccgacgaggcgaacctcccccggtacatctcgagcagcgacagcgtcaccgcgaacagcagcagcgacagcgccatcgacctcccccccgtgctcgccatctgcaaccacacaccaccacacaccgccggatccaccatggtcaaaactcaagaaaccaaaatcaagaacaagaaacctcacgtcacgcacacaccgaccgagcacgaagccgcctcaccttggatcggtggaccctggggagatctgaggggagcgggaggggtcaagggcagtagggttttgcgcctcacgaaggtgatgaatttgccccgcgacgcgatgcgcccgcgagatctacccgccgaggtgaaggcgaggctgcagacgagaccaacgctgggtggaagatggtcaggtcagacggagtggaggagggcgtggcgtgggcccatgaagggcccactgtctgatcggtggggggagtgtgggcttgacgagtccatcggaaacgtccgagtggcccaggtcgaattgatgagggccatttgggaagttgggctggttcttgtaaaatgaaaaaaatgtttaatatatatttatattaagtggagtattgttataaattatctatgtaactatatagaaatattttttaaaataaaaaaataagtgaccttacaaacagttggagatttttctaggaacatatttaaataatctgttttaacaataccgtaaataagatgtaggtcgtacacttcatgattagaactagttaaatttaacattacaagaaaatgtttggtttttttaagtgagcgtaacttaactaatcaagttttttctagtcgaacccgctcttttagtgagacctatcaattgatagtcacatggtaacttcattaatttcaagatttactagcccattccttcagtttggtactccctccgtttcacggtgtaaatcattttagcatttcccatatttatattgatgttaataaatctagacatatatatctatctagattcattaatatcaatatgaatgtggtaaatgctaggatgacttacattgtagaacggaggaagtacttatcaatagcgagctaccagctcgtaacttcgttaatcttagctcaatatttcaaaaatattcatacggtaggttggtgtttttttttgcacctctcttagccttaggatctgtctggagtttaagattgtaagaaatagctggatgtagccggcttagaaaagctagatttctcagcatccgatttctaggttttgtttggagtagtttaagattctgaaaatctactggttggtagccagccttttagattcagttttagatttctagtttattttctagattctacgagtaaagattcttagaatatgggtgaaaatatagacggtttagggagtgggagattatgtgatgaaagcttcccaaacagctctctaattcattttccatattctataactaacttcttagaattaaaaaaaaagtgggattatttggaagagcttcagattttacgagataaggtgaagcttcgcaaacagagccttaccaccttacacggagtgcatcaagattcgttcacagggacgaagggcacaagcacaaacccctcgtccccgtctccaccgcgacagagagatcctcgcctcccgccgctaactctcggtctcgccatcgccaaaactcagattaggtcggtggccgcgccgctgctcaccggcggatggatcttgtgtcatctcgattcgcagccgacggcgtgttcgtcccggcccaggggaatagtttccagtcgtgcatcgtgcttggattttttttcttttttggggggagttgggagtttgatttagcggcggcctttcctgcattcgaattagagagatgcttgggccattggcgttggagtttccagcctgggtgatctgaatgaacccaatctgcagaatgttctctccctttccggttgccccgggggagggattgatggaatgggatagggtggggggctttattctgatgattttgaatgaactcaagccacagaatgttctacaggtctca

SEQ ID NO: 17259 - DNA, 35705 bp, Oryza sativa
ggagaagcaattacatagaaaatctttctttacttggttgacttaaataaatcaaccccaaaactaagcaaccaaggtgatgttagaaattggttacaaaagaatggtgacctaccatagatttgcttcctcaagtagccttcatatttggtcaatgcatctgatcaagaaatcaatgggagagattataggtgtgcatgagatgatgtgctgatattgggccagtttggtagagctccaactcctaaatttagctccaggagttgggtctggagtggagttatggagctgcctaaacccagctccacctctctagttcattttgtgagagagagctccacccagctccgctcccatttttgttggagctgaaactgtttggctgagctccagctccagaagaggtggagctggagctggagctgtgccaaacagacccattgtatagttgaatgagggagaagaacctaaaatatttttattgggtggaaattttcttctcagttcgtagtgtgaatatagggtaggatttgttcaaactaaccaaagaaaactttatatctgtggcttaccttcataaaggtgctaactatagtaagggcctgacaactgagttttgtaggattttcacatgatacaagtcattataggatttggaatgtgcattctaaatatagccaaagaatgagctttgtacccatttgtgtatatctatacaagagactacaaattacaagtggcttattgttgataaaatttgatccaccagagtaatgtttgaatgcttacgtttaatatggtaatttccagtcccttttccttatttttgttcagtatgttgcaatacctatgagtgaaaaaagagcatgtgttattctgatgaaatttcattgtttcttgctgacccaccacctaattttggaagtcacttttggaaatttcgagtttgcatctcaagctcatccaaacatgttattggtttagtatcacatagctaattctactattcaggattatacatggaaggtccataaatacgtggcctcttgaggctagttggaacaccagcttattataaagctactcacaaaatgttaatcctagacttccatgggttgtgagttctagtctccagttatagtaggcctgtgtttgttcagtgttggtaattattactacctccgtttcaggttataagactttctagcattgcccacatttatataaatgttaatgaatctaggcacacatatatgtctatattcattaacatatatatgaatgtggacaatgctagaaagtcttataatatgaaacggaggaagtatttgtttcattttatatttctttcatttcaaattattttgtaagcattagcacttttgttttgccttctagtgatcaactactaagtataattttcgcctgtcaaattaggttgaattttagtcacatattctaaagtaccacttttaaacttgcttgcactcaccctcatttgggttttcggactggttgtaattcacctactctcattatggatctctattactttttctagaatttttccatcaacagttcattagtttgccatgcatgacatagtgcctatttgcaatataacgagcaatgtgatcacatgttccaacatatgtcaaacaaatatactaaagatctatagttaaaaaaccaacatataactatccacagttttataagttgtatacacaaccatctaaatcaaccaaatacctaaaaacacatgtagatagtgcattttttaggagaatactgccaggtgacagccaatagtcgcttttaactagtaatatgtccgttcattgcaactgaccatacgatggtggggtgtgggtctaacctaaagcatgggatacaactggtattttttaccatttgttttttatggttttcttggggaggtagtgactcgtgctgtgcgtcatgagggggagggcagacggacgactccacctctaagtagtagagattaagaggcaacaaggattactaaaaccacaatccttacaaagttcgtaaccagctaagactatatctttaagagtctcattcattctgcgaatatgctgaagaatatttttcctaatgagaaaatcagaaaaactgtgactgtgtgactgcgtgagaatggaggaagatgttgccaatagtggagcgtaggtcaggattgaggaggtgaggaggaggtgccaattgatgagggtacaaccaaccaagaggtgggatacaagatattttttttgacatgacgggatacaagatatcaccggtgaactgataatgaaaatgaggattaagtgttgccatggtggcaaaaggaacaataaagatgagaaagaagggcattcactagagcaaaaatgtattttgatgtatcaataggcaaataaagaagggaagttgagaaaggtggtcaatggattggagggcaattttgcaagggcaaaaagggacgaaatcaactttcaagggcaaataaggaatttactcaattttgtatgcttagcccctttcgataaattccttattcacccctaaaagtttgcatatcctcttatttgccccttaatctcacaatggcatgtgggttatgggcccacatgtcaaagagattagggggtaaatatgggattgaacttatgtgcctatggcaacaagggatagatgcggttttgttccataaaaggggttgaacccctatgcctagccgcaattcttggtcttttcacctctcaaccttctcaccaaagtaaacgctcaaggatgggcggccgcaaatctccatcaaagtcgacacaggtaatcctccctttccgccaactcctcaacgactgattttggtaattgttgttgtgatttggttggtacgcatgaggtttggtaggtagagatagtcggcaagtatgtactatactaggtaagacctcaattttccatttattcgggagtggtctacgttgacaagtatttaggattccccgtggaaaagcaattgaatactaatctagcggtaaaacgcatagatctagggttagggttagggatggcaattgggtgtgacgggcacgggtattggctacccatgcccacgcccgcgagtttgttgtccacaggcgtgcccgttactctatgaggggtgaagaactcagcccataactgtagcttgtggacgctgtgtgctcgcaggcatgcctatgtgtccgccagatagcttaacgatatggtttcaaaagttcagcggattggaaagagaacattgaaatagaacaaaaaaaaatcccacatgttagcatgaggatgctaatcgcttgatgtacaagctgaacaattactggcaagcacatgcaactagaggcctagttactggtaaacatgaacgaaaaccaatactccattttagatttctagatctgacaacatgatggtcctaatctgaaaaggcaaaaggggaatcgagagaatatgagagagacaatcatcatcgggaggattaaaggatgcgcggatggagtcctggtggttggtcacaccttgcttggttgtctggttgcctccatagtcagcgcatgctgcaccgtccgctgatgccatggatagctgctacctgccgacgcctgggaggaaggaaccaagggcagagctagcaggcagtgcgttgagggaccggctgggtgtcgtgcgctagggtggcttgagcaggcggcaaacaatggaatcttggaatagttgagcatggagacactgtccgcggcagcggcggttgtgggtaatttggttgaggggatttggaagaaccctagagagatttatatatataccttggaggaaatattacaggccaagcttacatggcagttggatgagataggtaaacaggcgaagcaaaacaagcctctgcggcatgagatcccaagtagagtggttacatcttcttatgattatgttttaaacaggttttggatcctgcattgcatccattgcacatcgtctgttcaataatacatcaatcctttcccttttgttccttgaaaaatagcctgcattttggaggattgcctatacagggtattgtcttatcttgaactctagatctgataaatggtgttatggaattggtagaatattgttgacttgctcttggcctgtttgttctttgatcatcatcaaaatgtcaggatcgctgaatgtgtgctctcatccttgtttagttgttttcagaaggccctcatccttactatcataatttttttacgtgtttatatcttatttcaataaatcattgcagtccagattagcagactcacgagcctgtttatactttattggtggtttgtgtatccttctggatactgtattcttgtaacttaccttctctttgtttagttcctctatttcacaaggaccttaaactatgtctgaaatcaaaacaaagtgttatgaatcatgctgttgaaggacacttttttcttgttgttattagtgctctttagagtagtgaaaagcagctttgaatactagctatgatttattatttaagtctatattataattaaaatttgatcctattattttgttttggcacaaatgcatattaaaatgtcacaattataggttaacttatgtcttgttactttttcagtcaagcagtagtggtgccagatcaaaccttccagtctcaacaggaaaagccgttgacaccgaccttttctggtcaatctggatcagtttcaggttttcgtcatcctggttagtgacattacagttgtttattttgctagtccgtttgtgcatgttagaaagtgatgtttttctaaaactaactctcacgaaaaacttggaagggttgtatatgggaatctcaatcttagaaacatgtcaggttcactagcaccaaggggttcctcaatgactggtagttcatcccttggggttcaaccacctaggggtagtatttctggtgcttggtttcctccaaatagtcttcaagcatccatttatcaggttcttttttcctctcctaagctcgagtctgtttatgaagctcttctaatccagctcacattttctttcatcctttttgtaggtcgggtatcctgctctcagcaaccgaggaggtatgcatgttgggggaagtcctgtttttactggtaacatgagtgcaattgatggttcaatacaagcttcctcctcgtacttgactaaagatggtaaccacaattctgctcttggattggcagctgctccagtttgtgggaattttggcccgcgaataacttatgtggctagcgttgcgggtgggggcaacattgggagaaccataagctctgccggaatgtctatgcctactgttgcatcccctgtgaatttgtctggaagtggggctcttaatatccgaggatcaaaccaaatgggtggtactcatcaacaaggtatatactaaacatataaaccccttgtataaatgcacgcgcatatgttctcaatttgtctttctttctgatttgataatgaaatgatctaaaataaataatattaaaaatcacatactccctatttttttatatgacattggttggttcaattttgaactagccaacgccatataaaaaaaaggactgagtattaagcctatgaagtacactagtcatctggagcaaaaaagaataaggaagcacatatttgaccggtacctgatctggggaatggaagtgttaattgggtccattattaaagaagtacaccattctgttgaggcaatttgccatagttctgctagctgttatttattctgtactgacatctcatccatcttgttaatgtgcttattctattacatttatcaatcaaacgaagcaactaaaacgtgtgcagaacttactgtgtttagtaagaatgtgaacgttctcatttcttatatataaaagggcagttttgtttcaaattgtttatttaccaggattgccggctatgaatatgcttggaagctctagttcagcacctggaggaacactatctaagaaccaattgcaggcaggaagcagttcgtctggttctccaggaatgcgacatgatggtaactttggtgaaaattctctatttgacatcaatgattttcctcaattagttgggcgacctaattctgctggaaatattcaggggttatatggtaatgctgacatgcaaactaaatattctgaatgataatattagttaactaacttttctcctttataacaaatgaaggacctctaagacaacaagcatttggtattaatgctgttcagcaaaaccaggaatttagaatccataatgaggacttcccagctttaccaagattggaaggtactcttactctactttttgtttcattatttaattctatatgttattcagacagttccttgccaagtacctcatgctataggtttttattatgtcttggtactttgtttgaacattacctcatgctctgaatgtaaggtatggagttgcatcgcaaggatcatcttcctaagaatgcaaatattatgcaagcacaacattatcctgtgagtttttttctaaaaaaataaaaattgtaattccaacaacagttttatctccttttccttaaatttccgttacatgtgattctacagatgggcaaatcatctggctttaacacgggcagcagttgtccaccccgtaaacaacataagcagacagctaattcggtaagttacctgtattatgatttcttttacctcatgaccagatagtcaagattgaaaacaccaccattggtgaacacgactcttttttgttcatgtaccttttctttatggggaatagtaagtaagaatcctacaaaataattggtagcaggtgcctgctgagcttttcaaatatggactgaccatactgattgtgtttattaggttcaaaatactgggcctgaaaatgttggaccaaagccagtaaattctccaaggttgcctttaaatccgaggcctcgtgaacaagttatccagcaaaatcatgaaccacaggctcagaagtcagttaggctgcagtcatcttccggcccagagtctcacaaggttcagagtcccaagtcttctcagagaactgataccacaccagagtcttacaaggttcagagtcccaagccttctcagagaaccgataccgcaccagagtctcacaaggttcagagtcccaagtcttctcagagaactgataccgcaccggatccatatgatccatatggcttacatggactactgagggtaatgaagttgaaagaggagggaccggcatctcttgctttaggattgatttgacaacactagggttggatatgaactcttcagataatctttacaagacatttggctctccttggtcaagtgagccagttaaagaagagtattcttatgaaattccggattgctactcttctatgcagcctccacccctgcaagtaaggccctcaattttcgagttaccttcttttttctttttgtgagggaatgtttaggttagcattaatcttgttgtatctgacattacgatttatcttcctctgcaggcgttgcattttctgaggtttcacctcatgacactattctacatcttctacaggtacttagttcaatcaacagtgaattcctgtgttagtaggctatgcattatttgactgtcttttgtgcagtatgccacaggatgcagctcagttatatgccgcgaatgaaatgtaagcacaaaaccacagttctatattgttttctcatttgcctgtcattttcagtaaaacgatggcctggtatgccagatagctcagattgttgcttccatttcttcagatgcaaatacgggtgggtttaccacaaagagctgcgtcagtgggttaaaagagctcctaatacgacccctctcgtcaaaactacaacttatgaacaaggactctgctatctttttgatgccaacatttgggatgcaattcctaaggtaaacgtccgaaagaaattctgacagatattttcagctttttccgatagcagaagaaaatatatctgaaagttggttgcaggacaactttattctccgttatgacgatatcgagaagatacctgcccttcctccccttcttcctgccacccaaaatcctgccacccaaaatggtagtgtaagaataaacaaggtcagatttgggagtcccaatagacgttttttttgtgcacaatgtcaaaatagtgtcataattatgattaaaaaaagtgccataattcccttttctgatgtaagtttgcatttgcagccattgcagtaggttctccgtgttgaagattagagtttcatggcttggatcaattgttggtattattaaggtacagttaactctcacaaaatgattctgcaagaacttgtttagttctatagtaagttcagattaacttacttggtggcctaaactacattaatttcctctgaacagggtatgcatgctggttctggggatcggagctcctgcgatggccggcgtttgtggtagctgcgaaataccgcggttcataattcgttggctgcaatcagttaaacccatttttaagttttgaaacaaagttgaaccccgttttaattatgtttcggtcttgtgatgactgaatgttttgaatgtttaaacctgtttttacctgtaccgtaccagatatgtcgtttaaacttatcaggcaccgacattttggatcttgaatcagctcctgtcctgtttttttttttattattactttgataatttttggtcaggtaaaattttgccatgttgtgaacttactctctccgtccaaaaaaaaactcaatctgggcatgaatctagccatttccttctacatcctttttaggttgagtttttttggacgaagaaagtatgattcaagcaacagacaactggctagtggtaacgatctgacaaggacgacacatcgccgatgccgatggtggtggtcaggtaaaagttgccgtattgggtttggctcgcgtgctagtggtatgaatcgagtgctcgcgcatggacgccttcggctgcggcgagctcgatcggccaggcgctggtggttgtggatggcctgacgctctacgcgcgcctcggcgccggcgccggcgacgacctcctctccggcctcgccttcggcgcggccgacgaggctctgctgaggatcaagatgaacaccatcatgtcatgccggccgccgctggaccaaggtgatcaccttctcctgcaagctgcacgccgcggatgcctgtggcggagcgaacagtggacacacaagaggattcttctgcacggacaccatcttctcgttcgacggcaacacattctgggcggatctctcgcagggcttcatgtgctgcgacaccgccatcgtcttcaccggcgacggaggcggctcaccaccacccgtcgatctcaggtacgtcagcctccacccggacagtagcggatccaaaaaaaaaaaagcaggtggggctgaataaattagataaaatttaaacctccattttctatatatgtggagcaaatagttgtagaagagctcaggtggggctcccacattcctaacgccagtagtgagggctgagatcccttagcggggccctatgtcagatccgcgtctgccccgtagtacctacttctccacaccttcaaatccgagaagcttggatgtatggagatgcaccacacctaggcatcttggacaacttcatcaaactcgtttccgttaacaccgcccgcatcgctgttgccgctgccacaacgaaagaagaagaagacatgccatcgtcaccgtgccacgccgccaccgaagcagccaacgcgacggtggccatatggactctggacaaatcagctgatgagacttgagacacgctcgacatgaggagcttatgggcgtaggaggactacaagacgtcacggttgccccggatggtgctcacgtggcccttcgtgaggctgcgggaagatggtgttgttctctacttcttagggcctgtttactttgttgccaaaaaaaaccttacaaaattttggcaatgtcattttggcaatgccaaaattttattaactatgccaaaattttggcaggatttcttatatagttatcaaaatttggcagcaaactaaatgtagccattttttggcaactttaccgaaatttggtaaggttgaaaatggcactaaagtgaacagcctaagccgctcaggacataaaatgacccccaactatatcacgtttgcaggattgacatgcacagcaggagagttctgctgtcggggctactctctcaccgctcccatatcattcatcaatcggttgccttgcctgctaatgtcttccaacatcttaggatgatccaatgagaagccacccatgtggtttccgcggagaggtgtggctctcggtagctgtcactattcgccattgtatattgttttttataatggaagttttattatctcagtaaataatataaaattattccgagagcatctctggcgtatgcacccaaagagtgcacccagccaacaagaaagaaacaaaagataatatcatcatccaagacaaccgaaaaactttaggaactctctaaccgtagcctagaactccacccatgtgctagggtagaaaactccatggccactaactccaattattggcaagccgcagtgatggtacccaacaaattgaccttctggagaatagcccatgagtagagcctatatgtagtaaaaaaaatataacctataacagagaagatatgtttttcatttcaaaacccacatcatttttgcaaagccaaatagatcaaatagtggcagttgccccaaataagaccaaatgcctcaaattgtgtagttgtcttcttatgaaatgcccaaacatatgagttatactattaggtaaactaatattcgaagcagattggattaaagaccaaaccgcgcaagataatcaaagaataaatgattaatagtttcatctttacgacaaaaagaacaagttcctctcccattccttttaatcagattatcttttattaaaactactccctgatataagtaccataagaagatcttaatctttaatctttatggggctttaatcttccaaattctttaatttatattgggaacatcggtatgcaccaacacaagatatagagatttaaccgaaaatctgtcatcagtggttagattccatttaaactcatcttggttgtgagaaatataatattagcgatgtgtgagagaaggtgattacacgccactaacttagagccagtaaggtccctgcgctaagaaaagcttagcagactagtatggaaaatttctgaaatagttgcatgtttatgcctaacaacattataaagacatgggtattgttctattaaataggcattccctaactatttatcttctcaaaaccgtacttgagagccatctttgatgttgaaagagtcaaatatgtgaaaatcaggcttagccttcattagactagcccaaaagtgtgactctcttgttttccaatgagaaggctgtgactccaaatattttttccttagcatttattgccacacaccatctatagtgagtagcttatacaactacttactaaagagaatcttgttcttaatttcaagatcttgaattcccaacccccttgatctttacgatgatgtctcaccttgctagtcggtatttccttttgtgtccatcctcttgccaaaagaaccttgattgaaaataatcaattttattgatcactcctttatgtatttcaaaaaagaacatcatatatattgataggctgataatcactaaattgattagtgtcagtcgccctctaagtaataaaagtttgccttccaatttgccagccgtttctcaagccattcaatcacctactttcactccgagctacaaagtctcctatggtgtataggaatgcctgtatattgatcctgagctgtttgtgtttctttttgtacgatataaatgaagtaactaatgtacaaatattgcggtgtagtaactactagtaactagcaagtgtactgtagttattacaagtttaagtctacaactaatcatgagccgtggcttcttaggaattcgcaaccagaattgcaaagaatcggagtccctctcggttttaggcaaacggaagaagcgatcgatcgcctttggaaggccggatccgaattaatcccatattattcgcctttcgcttctgcttgctttccgatcgatcaccgaggcgccgatcgatgggtcgtcggcgacggcggcgcaaccgcgacgccgagttcgacatggcggagatcgaccggatggtgccggtgatgaagctggaccggacgaggcagccatggctgaccgtccccggccgctcaagctgcacctgcgactgctgcaatgtgacgacgaagaagaagccgtccaacaaggctctcatcccggcctggctattccgatccgacgacgacgacgatgatcaccacgaagaatcagcagaagaggaggaagaagataatcagctgcaaggcctgaataaacacttagctgaatatcggattggtcaatatgagattcgtaagtgcctccattgcaagcagcaccaaagtataaatttcttgttcataatatgcaagtcaaatattgggacaggattctaaaccctcgaaggatatctcctcgtgtaactttttcttttttttcaaattcaatgtgaatgtttgtattttttttaaaaaaaaaacttgacccaccaaagacaaaatagaccctgtacatcctgtgtagaataaaaccttctcacgcaggtcaagaaagcccttgaacccatgccagcccttacacaatggcattggagaacgaccaacaaccgaggcctctagctgtaaaaattgttagcaatgtacattatagtaacttttatcaccaccaaaaaaatataattcaaattcgatttacatattgagaattaaaaaaagataaatccagagcactttgatttgattcttttattcctagatgggtgatttaagttttaacttgattttatatagagtattttatatatacattattaatgttgtcgtttttttataaaaagatttaccaactatttatatgatgtttaaacaaacaagattatattccctcaaatttaaaacacttgccacatactccctccgtttccaacatataagcatttttaactttgaccattaatagtaaaataataaaaaaagatcaatcatgtaaaattgatgttactagatttattattaaacatactatcataatgtgcaactcttttaatttaaaataacttttatagatattgttagtcaaagtagcatctcggagactgtaccagagtccaaaaatacttatattttaggacaaatggagtatatgaacatttcttgtcttgcaggaggagccacgataaaacgatacccttacacagatggctacgagctcaccgagaagctgaacgccgagctgccggccggcgagcggcgctacaccccgaccttcgtcctcgagggctcctcccaccgcgacggcttcttcggcctctcgtggcactccgagtaccggatgcacgagacggcgccgacatcgctgccccgctccaggttcaccacccctcacccccgctgggactacgaagccgacaacatgctgcagctctgctcgctcagcctcgccgccggcgccggcagcggcggtgatgggcggcggctgctcgtctatgggatcgtcgccgcccgcgacgacatggaggggctgcccaactttgtgttcaaccggacacgggacaacgcccaggaagtgacactggtgagtgacaatgttaaattttgagtttgaacaggatctatcttggctgaatttgaacaaattttaggaaattcaaacacgttcgatttttttaaaaaaattgatttgtttggaataattcagagctctcctgcactggagctgtcatctccactgcgcggcatctccgcgttcgagcatgtgttgctcgagttcgacctgaagctgaagaacaccgccggcgacggcgccgacgctgacgccgacgacgtgctggtcgacgcgtgcaaagagttcgtcgacaggacgatcacctgcagcgccggcagattgctgaggtcacgcatcgagggcccaatctgctcgctggacatggactacatgttcatcaagagcggcgtcgaggccgccgtcgaggtgttcctgggcgactcctgcgcgagctgcttccagagcgtggctgccgtctaccgcgccatcgccggcgacggtgacggcggcggcgacgggattgtcatccacgaggagtccatcccgcttcctccgaagctgatgctggccgccgataccgctactgctcaggccgccgcggtggcgacggtggtcgccgtgccgtcggccggcgagctaacggtgacgctcagcttcgccacggcgaggcaccgcacccgcacgtcgcctccgctcagctatctattcgctaggtctatacccatatgagaaatgcagttgtacggggggtcgtttcatgcttaacttcatggctcggttcttaattgaccggggacggcactagccttttccggacaccacccaaatcctccgtccgccccagtcgaaaacagttgtttaattttatttctcctttcacaaatcatgtcatcaacatcatggcaatgtggcgctcatgtctccacatgccgcatctcaattaccttcccaaagataattgcccaagaatatagcatttgataaatatgagtatgcatgattctagaatagcatttctaagcaattgtcataattgactagggactcatacgtaaacatggttacgaaggcataaggggtaaacaataatcaaggcatggcataatcacaagtaggatgttcatcattgcatgcaattttatttgtaaacaaaataatttcgcaattgggatcaacatgttcaaagaatagtgatgacttgcattgctcgtagtcctgcgggtcttgatcctcgctcggatccgcaactccctcgggtctaaaagtacgtgcgaagaattgatttgaattcaattagaattcaaatgaaatccaaataaacttaaataaaagtcgaacgcgaatcgatctttctatatcgactacaaagtttgcaaaaccacttcattccaattttaagttcattcatcctaagtctttttttttgtgatttagaagtacattcctaataattcaacataattatttagctcttaaataaatctaaatttctaccacgaattgattttgtatagagattaccaaaatattctataattatataaaattttgtgattctacaactaaaagaaacctacaactaaccccaattatttaattttccaaacctccttaatctctccctaattttctatttatttttcctttttcttcttttcaattcttttttttcttttctttctttctttctttttctctccctcccggcttctcccttcctctctctctcggctcactgcctacccggggcggcggcggcgaccgaacaaggggaggggcggcggcggcgcaaggcgggcgacgcacggcgcggcactccacgcggtgcggcggcaccgagggcggtggtgcggcggcacgaagacggcggcgcggtggagaggaaagaggggaaaatgggggaagaggaggtggggtggtgcggggtgaaatggcgaccggggaggggatttatagggcgcggggagaggtggccggccctaatggcgacgcgacggcgcggcgcgtggggcttgaggcggctacggcgacgggcgcgcggcgcggcaggcggcagcagcgacgcgacgggtgggtggcgcggcgcggggctcggcgcggcttggcacggggctcggcgcgacggcaacaggcgacgcgacggcgacaggcgacgcgacggcgacgcggcgcggcagcggcgcggggcgcgaggcggcaagcgcgtggcgcgaggcgacgggagtagagtaaatagaattttagcccaaaatatatggcatggaatttaaagaattagatatgggctaaatgaggttttggatttcgggtggagggataaagtctattctcttagcacaggagcaattgttcataataatattattctcgtgctgagaaggaaatcaagccacggaaattaaatcggcggctagatttaaagaaataatttggatcgagaattttaaaggatgggtcgacaattaattccaatgaaattggaattgcttgggtttaggttcaaaggtatagttggaggatttcttggaccatgattcataaaagtaaaaaggatttttaaactaaatttaaagaaaggaaattttggtcgaaagaaggtttaagatacaaaatcaaatcaaagagaatacctcgatttaacaagatcaatttttagaataaaaccacgaaagattttaaataccaaagagggattttatacaggttagttttaggaggtccctctaattataatttcttaggtttaggaagttattaagaacataagaatcggcatgatgcatatttagaaaatagcaaattttcagtatgttacatgacgcgacggcgcgacgggacggcgcgcggcgcggcagcggcgatggcgacggcgcgcggcggcaggcggcgatgggacagcgcgcggcgatggcgacgcgacggcgtcggcggcgcggggctcggggccggctaggctaggattacatcaagcaccttgtaggcaatgaatagggctagatccttattaaccctaatttagtctattttctatttaaatctcgccctataaattctaacttttgcacaaatcaagtttactcaatatttgtgttgctctaaccaaaagattcgccctagattaacattacacatattttatttttatataaattacttgaatttaattaaagttaattcttattccatcgcacttaaatttaattgatactaatatggtcgcgataatatttttatttattaccaacctcacttaatctttattttaaattatattttaattatttattttgccagtttaattttagggtttattcctaattaattattctttattcgcgatcaacgaactccgaaatcaaaatccaatgaaataggtgaataaaatcggcataatgcaatttgtttaaaaagtttttgaaaatccgtatttttagagttttgattttattggtcgaattttcagggtgttacaatagtacagcccactactaaggccctctttgtttaggcttaggcttattggcctagacttttaagtcagcttattggcttatatgatttataagacagtggatttaatgtcctaagtttagtggtggagtcatacatctatctcataaaagccaaaaaagcttctccaacctatcttttggcttaatagtgttagagtggcttatggcttcaaaaaagccaaataaaaaaaagctacttgtttgttttgacttagacttttcgacttataagctggcttataagcctaaacaaagaggacctaactccaattcatttatagccaatctaatagccaatttatacaatagttgcttgctatactattaatatatggtcccacctgtcatacacacattgcgtcttagagttcgcgctgcagctggctacagatctgtagcccgctgctcttctctcatcttttatctcattaaaatgtttacaaccggctaataatccactattgtacctgctcttagtaggtgaatatcaggctaaccagatgtgtcagtaaacatcgaatggtttatatatatacaacagcattactgtcctacagtgccaaagatttgatctgaagggcactgctccaaaagcacctacaaattgccaacaactagccatggatatatgctttaccatgtacagtcacagcttgcgccattacacatccggggtgaagtgatccttgtggctgagaatctgtgcatcataagccgcaatggcatcaaacaccctcaaatggctgatcacctgagctccacaggcagcatactctctgccctcttccatctccttagggagatcatcaagcaatccttgggtgaaatcccttggagcgcccccgtcgtagacgaagtagcatggcttcacagcaactttctccaggttttcacgcagcaaatgcgagccgccgtttgtctccagtatctgccctccagcagctgcaatcaggctctgtatgtgttgtctgtcgtcagggtttatgtaggcactgaggcaaaagttcagtcccgagaacaacttctgtgcctgaaagcatcgcattatcatcatggagattgttgcggcagaaaatttgctctaaagaatgaaatgtcgtaagttgcaacacaaagcaggtggaatatatggagttatgcactagatatatacaccttgactttgaacagcgatatgtaaaaagtatttttatgcattgttgtacccagttgtagctaggcctgtaagaaaatattactgggaaagatttgcaaatcaaattcctaagcttatacaagtgacagcctacgatagttttcactacataaaataagtctaatcttatagccagcgatgtatatgtaccccttcagaagcttgatttcttcttttcttgtttccaccaattgatgcacgtgagtcatggctaaatcttaactcaaaggaagcttctggacttggaataaactttaccaagcaatccataatccctaaaagagcaaggcgaagcacttcagcttaggaatagataatactctgcagatttatgataaaccttgaatggccttagggatacttaggtatatcaaacaatataaacgtaaaggaaagaatactcaaattggggtcctaaaagaaatagagaactgtagagaagatagctcaatactgacatccaaccgtgacaacccatttcccaaacagtagagccatcaggacctcataagatcggctccatgcactaccagcactttttccaacgataacatgggtcacattttcagtccactcgttgaccacagttgcatctgtccaagacgcaaactcttgcaaggaatcctgcttgaaaaacataaatcatgtttaccacaaaagctggaatggaagagttaacttcataaatgtagcaaatcatccactatgttgaattatccatgaagtaggattcagcattgtttgtccgtatacttgttcaccacaaaaaaagagtaatgtttgctacttctcacttatcctaccttctcggattcacttaaagctgaaccaagcaaaacccacagatccgaggggcaatctctttctgtgtaaaggtgatctgtttgcttttctttcctgtattcgtcagtggaaattccttctttgtccaagtattggctgcaatgattaaatacaacacaaatttatggaatgcaagactacaattgatcaaagaatcaggaaccttaaagacatctaacaagaaaggttaggaaagattgtgtacccctcaggaaaggaagaacatgaagtgttaagttgatctatttcccttttaggaacagcagaaattccttctttggctgaactttgtctggaacaacaaaaggcaaaagagaatgttgtaggtatttactccgtattagctaattcataaaatgattacaaagtaactcaaaaggcaggtgaataaaggtcatatacccttgagacaaagaacttgatgtgttccattgatctattataggatattcccattcgcaatcagcggaatcgctttgttcaattgacgattggctggaacacagaatcaaggagaaaaatacaaatgaaggatcaatgattaatcaaataccagagcctttgtataaccttccaagaaagcaataagattgaataacaatttcttattcatggaaaaacctctgagggaaggaagaagaattgccactctcatttcttggcgagcttatcttatcacatggtagtggcatcgttgcatgttcagggcacataacacaaccgttatcctgcaaaatgaaaattagcatctcggagcttagaacattagactattagagtggtgacgaatatcacaaacaaaaggatcgattacacaatattctcaagagcttacaacatcccagcggcaattcaaagtcatcattgcacatggaacatgatagctcctattgcactttgtataataacacccaagagctgctccaggaagcttgcatcttttgcacttcaatttcgcggcacgttttatttccaactccaagttcacaatggtatcaccttcgtaaaatacttgcggggcccttcgcaaaagaaaaaagtagggaaagacaaacaatttacccaagaaatagtcctttgagagtaactagctagtgccaactgttgcactggaagaagtaaatatagtttataatgtaaagctaaatatactaaaaataagaattgtctccaaatctagaaaattgaaaaattactacatgagatcaatcaaccatctacacatacacatgtgcaaacaaatcaactttttgcagaagaatatatcatgcaaacaacaaaattatgatgggggatggagggagggggatgtagaacgcaccatcacccctcaactacccactttaataccactccagccactggttatttttattaggtatggttagacttagcacgtctcaaacattgaataggctgtttaatggctaaaaaaaaatatcatgtgaatttactttgaaataggaatcaaaatggtaattcttgcatgccactaaaactatatatcatactgactaatatttggacataattaaacaaatggaatggttgtcttataaagcaaaccaataaggtattaaactaaaaaattatacaagggtccagatctcaacaaataaaaataaaaattgtccagcatccttgtatcttaaacctgcattggaagcgcatgatgataaatctaaattgtggtgaataagcatcaagagttgaaatatatttaggaacttaccactccaggcatttcttatgaacataaatgatatctgttgggcatggactgccattgtcactggacacaagctttcccttttgataatgcgccattggaccatgaaactgaaataggaaaagtgaggacctttagtgtcagaaatggttaagaagacctcaaaacataacctctggttaatagatcatggttcacctgaggaggtgttctaaatgaatggcagaaaacgcattcatcttcaaataagttgattggcgtttgcagtctcttcaatctagtagcacgtcccatgtcttttgacatgccatcgttgccatgttttccaggcatgttgttttctctatcagaatgttgtcgagtgttgcttagattagaaagaggcaatgaaacttcatttgcatctaccgcagctttctcatttgaaccctctgcagccaatgctgtcttattctataatagaaaaaatgtatacagtcaaactgttgagtatatgtgtagatattatagaaaaacttgatttttcttttttgcatgaaccaccacataatgtgtaggtccttgtccttgagcatgcaaatctgcaggactgagggaaagaattttacaagagatctgggaaagacaactgaagtaccctaacaagacgtgatttactcagaaagatgctttgcctagtcaactaattgctgttcatatgacttcgttgaagaatctcgagattactgctgtccctttctccaaatacgctgtcagccattgtgctcatgatctacaaggcagcatgagagtagggtgaagctgagagcagcagctggacaatattagtcccatcattatttaaatagctcccccagattaattgattaatcaaatcataagtagcatatccctaactttttcaatagtcttgtttgtaaaaacgagatcaattcaagttggaattacaaaactcgtcgcattattaaaatccaaactctagaccatttgcaaagaaaattcattggcaaacacatccctgcctttagcactttactaggaaattcaatttgcgtttatatgtccgttgttacaatgcaaccctgattcaggggcaggacaggagtaatcatgcatctcttactgacaaaaaactagtaaccatctcgcaccattcacagtggagttatattccaatgatcactgcttaaagttgtcgaagcaatcaagcgaggaggggttcctgggaggcagaagagcgccaaattttggacttcgaaagggggcaaaacgtatagcactgctaattctgttgatcattgtagcaatagtacacaaatatatatgcagctaatgaaatgaatgcagcgtgttgaatagactcaaaataatttgtgggtaaaacttttatatctgttcttagcaatgaaatgttttgctgtgttcttttgtaagagtggcagatagggagaagggttccttcgtttttcgcgcgcgcatttcccgagctgctaaacagtgcgtgtttgaaaaatatttactatagaaaagttgctttaagaaattatattaatatatttttcaaatttaaaatagttaatatctaattaatcatgtactagttcaggcgttcagcttgttttacgtactgtatattccaagtcttctcctttctcctcagggaaaaccgttggaaataaactatggtgagaaccctaaaatcaacaccaaaattaggttacaaaatttaaattcggggaagcgtaggtacccgcagcactacactaccgtcgtcgtcgccgccgaccatctgccggccggccacaccggagatggtgggtgggagggggagacacgtgcgagccggagggtcagaaatagagggggaaaaggaggggaatcaaagcgctcacctggtcggcgatggcgctctccgcccctctccctccccctcccccttcctccaccgcccggttcgcgcgcgcgatccgccgagcgaagcgggctacggcctcttagccgccgccgccgccgcttccgcctcgggcagcgtcggcgagcgagtgagcgagtgataggagagtagtacaggagaggaggagggcgcgagagacgaggcggtttgagaggagggagacgagacgaagcggacgttttgcgtgtgagctgagtggagtagtgcaggtgcctctcgagtgtcgacgacgacgacgagtcgactcgttttggtctctggacgtgtttagccctagcctagccgagacgatgcagttaatgcagccgaagtgcggtcacttcacagtcagttcacttcgctttgctcgctgtctctctcttctcacatccaatgagatccgaatcctgggcattattgtagaggtttattgtttacgccttccgtcccatgaaaaatgagaaaataaacgtttagctatctttaaaactggatttcgctattatgtcatcctcaaaacgtaattcgatataatactaatctcgagcgcgcgctactcgtcgcattgccattttcgccttttcatgatttccgaaatgttttttttgctgttcacgtggtgatcagacgaaaatacccctccggcttgccttttcttcatctcgcaagtgaaaggggatcgagcatttctaaaaaaaaaaaaaaaggcctcacgccctcaccgccgccggctgcttcttgcgcctccctccgttggctaggaggggccacaccgccgcactggccgaagcacgaaaggctgagggggttgtgggctcctcttagcaaccgccgtcggtgacagcggcggaagtggcttcttcttcggtggtagtgacagcaaagcaattgttgggaggaccgaagcgacgcagtggtggaagggggagttgagggcagcgctagggatacggaagtggatgcacgcggcggtgagcgcgatcttgccagagccatagtcaatgatgaggttccgtgcgatgtcgtcgctactgacaaaaacatcgcccatgacctccacctccacacgagtagagctcgagctcgagctcgctaaagggtgcgccaagctcgcagtggtcatggcgctctagctcatccccgcgcatgtatcttcagcgagctccgcgtctctgctcgaagctgcttcgtccctgcgccactccctttgtcgaaacacaccgctcgcactgccaccaccgccatgccgaaggggagagagagagtgggggaagaaaggggatggggaagaatatcaacgccgtagggtgataaggggcagttccgtcttattacccagcggaggagccaaaatctttttggaaatgaataaaatggtgaaaatggcaaagtgacaacagatgcacgcttcgtattggcattttatcgaaccgtgtttttggggtggcattctagcgaaaccgtgttttgaacgtggccaaatgttcattttctccatgaaaattatggtccaactatgaatttgaacacgtgtgtctatatttatagttaagattgattttttttaatggagggagtactccctccgtccataaaaaactaacatattggatgtgacacatcctatctacaaatctggacatccagtactaaattggttttttatgagatagaggaagtatgtgagtataacagtggatcaatgtaatgaataccgtcgatttatggtatctacaataacatgaaaattgtagcacacttttatttagtgtagtaatgatgtgtttagttcacgtcaaaattggaagtttggttgaaattggaatgatgtgatagaaaagttagaagtttatatgtgtaggaaagttttgatgtgatggaaaagttagaagtttgaagaaaaaattaaatttagagctaaactcggcctgagatatataggccttatgcccttgatcggatggctgccaactcccataatttatagtaatcatgttgatcctctgccttacaacgtctctaatgcagagtagcatggtccatcgtaatacagttagtaatatgttaagtaatacttccttcatcccaaaataaagggttttagaatggatgtgacgcatcttactactgtaaatttgaatagacatttaaattcttaagacatccagatttgtactattgtgatgtgttccatccattcaagaacctgcatattttggaatggagggagtacttcctccatctgaagtctaaaacatgcttcttccatcccataaaaaccaatttttgattgtgtatcttgacctagatacatagtcagtagttgattttatgggatgaagagagtatttactattttttaagcaagaccaaagaaaaaaaattaacttatactaagatgcatactgttaatgccctaaaattaacttatatgatgcatgctgttaatgccctgaatatgggatacccaatacttaatacatcaaatacgaaatcaagtctcatacatatagcaaaaatcctggataaagaaagagaaatatctactattataaaaattaaaacttaaagatgtttttactggtattttggtacgtcatccgtatctgagtcaggttttaagttcgttcgtttttggaaatacagatgcgtgtttgagttagattttaagattgttttccttttggaagtataataggagtcgtataagaaatctttaaaaaaactcgcatgctagcatgagatgaaatacgaacctaattgtagctcatgatttcctgaaaaaaatatccaaacgacttcccacagtgaattttatctaactaaaccgtaaacaataataaaattaaaatagcatttacccgttgcaacacatgaatattttttcaagtaaataaggaaagagaaataaataccactcggacactacaaagtctagcctgtttgaagggaacgtactttagctttcctgctacccgttcgcaaaaaatggtgaaactttaaaagtcaaattcgcttttaacgctactaacaggatttcaaaagcctatatttctgtagagaatataatacgatgggatttctagggccgtcaattcagaacgagcattcagatcatgatacatgaacaccaatgctctttaccgaacaaaacacaagaggattaaaatgccaagcagcatcaaactttgctcagaaacattaagccaagtcaaatctcgtaatagttacacaaccaaagaaaaacatttttcccacatagcatttcaaacttcatgacattatctccagtggcgatgttaaaacattttggcagtagtgctaatttaacagaggttctacagggtagcttttgatgagatacgatttagacagccggcgagaaccaggcgaccctttcctggggatcaagaaatcttcagcgctttccaccaccaccaccaatcttcgggcccttggaacccctcggggcggcacccttcgactgcgacttctgggacttggttacctcagccttcttcgccttcttttcatccttggtcttcttgatgcgttccttgatctcactgcacaatgcataagctcaaatgaatttaatcctttagcatcatcgaaatgtatatcggaggattatgcatacacaatatgcaataggggattatgcatgaatatgaacagagagttcactaggagcaaacatccaataagaatgggtagcaaacatcatgttgcaatgatacagtgagctgtgcagaacaaaggcagcaaacgaaaacactgcttgagaagttaagaggcaccgcatgaggtaagggctaatgcagtgaaaatgaaggcaaaatgtaacccatatagagtggcaatgttctattccatgggtggatactttgttggaaccagtaaccagtctaaatggcaatcattcagggaaagagcataccgaagagcagcttctctagcagcatcacgaacttcaggcttttcagctctcttcttttggatgacttccaacgaagcaccaacaattgacctagagtatggcttcttggtggtgcggcgcctcttcttgacagcttcagcatggatatcctaaaaaacagaaaattgggaaagggtgtaaacagaatttatctgatcggaagcaatacatagcatgactaactgtacatatatacaaggaattgagcataagctgacaaagagaactacatggcacagacataaccaaagtacccaaacatacaatatttttatctgcacgcaaacactgcaaggcgcttatttgaagaatcaacatgatgtttgcacagtaaaaaaaaccgcaatcttgaatgtagacggtcacacttaatcatacaaacagacatttactggaatccaggtttgatagcttaagaaacaattaacttagcatttcaagcacaatacaacattacaaattttaagcattcggctcaacccaacaaatttaagaaagcaacggtcagtgaacaaaaaaaaaagggttaaaggtcatccagttagagtatgtgcatataggtgagaaaacgcccgcctaaatctagatacaataccttcttgtgctgcttcctgtacatggctgtccaggtaagctttgcaggcttcaggcggttgtggaagtagcgcttgcattttgagtttgcaaaaaggaagacctgtacaatataccaatacgtttacaacaaccttctaagcagagaaatatcctgacattaaagcaatcattcgatgaacagcctgacctgtgaatcagcacgaataaagcgaatgcccttccctggatatatcttctggccactaaaacggcaaagctctgtcctgtaggataaaaataaaagtaatagttgaaataccttccaaatatgaaatagtactcattggtaaatcattgctattaaccttttactaccattaaccaaaaaactacatagcctagagcatgcacaggataaaagggcactaaaacaatctacaatcatattgaaacaacaaaatatacacaggaacttacttcagcaccatcttctcagcttaaatcctcacagaattctgccaaatttccaacatcaaaagaaaaaggaatcaggactagaatccagaaaacaaaattgtgcagaggtaatcatggaacattaaaaacctacatcaagatatcgacaatacacagacagggtaatcatctcaaattttaactattaaaaatgtagggattctacaggcagtagaagcataatcaacttagcttagctcctgctgcaaggatactaccctggtccatcttgcacattaatcaactaggctactatgcaatcacaaaggccatagcacctgagtgcgactgtgcgacacacacaaggttcctcaaatgctcaaagcactcaagagaaccagaaacattgcagttcatacgcgcatcggattaccatccatgactaggaatccagaaccccagaaaggggtgaactgtcgggcgactactggcagaagaaacatgggacaaatctcccctgcaaagcgggttccctggttcatatagcacacaaaagaataggctgctacggccatcacaatggccatagcgcctcagtaccggtgctttcacacgcatctaggcaaataatccagaatctatcaaagaagcgcagctagccatggtaaatcaaatcaaacggaatcaccacggtgtcacatactcaagaaaaccggaatcctgcctccaaaggagtagcaacagatgtatatacaccgcactacaccgtgtcaagatcaactataagagagaagaagaagaaaccatccccatttacaagctcaaggatctccggcatttcttcttcttcttctcgaatctagcctaggaccgccgcaacgaccaacccgccctaattcttctagtcgctcgagggaaatgtaaagggcagcagaggcatagacgctgcaagaactatctgcggcggtggtagaggcgagacgaagagcatttcgacgcgataccttcggagcgcagccgtcggcagcggcgatgcggcggtggcggcggcggcggcggcgcgggagggagaggggggagcagcgtgtgctccgcgagggtttcttatgagacgggggagagctcacgagtgggccgggcttaagattggggaagttaggaacaggcctatatgggcccgatccatcggcatgtgggccgtcaggttgaatcctatgcgtatggtccgtgggcccgtggcccatcctaatctgctttgcttaggcttttttttttcattttcttctgcgagatgcttaaccatcttttttccccattttgtaatagctcttcgtttttattacatcatctgagagagcatcttcctactagggtctgtttatatttgagttgaagtgcgtatatttggtactaacttttttttcgtagtcaaattgttttcactttgaccaaatttattaaaaaaaagttagcaaggtcaataacgccaaattagttttattaaaactaacatttaatatatttttataatatatttattttgtgtcaaaatttttttttatatttttctataacttttctagaaacacattaacatttaatatattttgataatatatttgtttcgtgtactatattttttgagaaacacagaataaatgcatgcgctcaaaacgtgcacacacccactcctatgagcacctccagaagactggaccagcatatctctagatcgatgaagtcaccacgggcgtcaatagaagactagaccgatatattttgaggttgatgagacgaagtcactatgggtgtcgatagaagacttggtcggcatatcctgagattaacgaagtcaccacgagtgcctatctgtcgatgggtaagtcgcctatcactgaaaatataattagccgtaaatacaagtatatatgtcaattctatgatttgagctcagatgagctgtttccatcacaagtaatctagttgagctatactcatttcatttctatagattcgatcaaacttaaaattttaattaatatttaagtaggaaaaaaataaatagtagacgtgatttagtttactactccatctgtttagtctacgactttgccagcagacaagctgaggggcaaaacggccggcgagcatccacggtgctagtagtcttcaatatgaagcgtcgccgtcgacggccggccaccgccacacctgcgcactcgtcatgccgggattttcgccggtgcctatctagtaaaaaaaaatcttgcccacgtctaaaacaaattatttattgaattatttttacaaatttagttataaaactaaattaaatatttgataactaaagttaacaaaaaagctttcaatgcagtacaacacggtattttcatgaaaacatactttttttaaagactcgtgggaaagaatttagcctagatatagttgatggtcttaaattattttttttcagacaatatgatatttttgctctttgtcttaaattaacatttgagactgattctagaaatgtaatttgactaacatgaaatttaataatataatttattaatcaaaatattattacaccgtagcattagcacgggtaaattactagttctatgaagtactagaaagaacggacatagagcctgtttggggaagcttttagtagctgaagatttttctagaagcactagttatcaaatcctccctcaaacaatctagattttcattcagattctaaaaagctgtagctgtagaacctagggatggcaattttcccgttgggggcggggacccgccgggtacccacccctacggggacggggacggggcgaaatttcaacccgcggggctgcggggacggggcaccggaactatgcgggggtgggggcggggccacaggctcacccgcgggtgacccacggggccccggaatatagggatctaaaatatggcatacagcccataatcaaatttaggcccatatagcccaatatatatatatacagatcagtaaagagaagccaaccctaagacttgtttggtaacttgagggaaggggattaggagtttacacgagggaatttatgatgagattaagatgggaatttgatttttaatcccaatgtcttgtttggtagatgtgatagaaactgatagggagtttagttggagattagctcattaataaaaacggatggctgagatttgcttagacaaagtaaaggagaaattccctcccaattacctgcccctacccaggtattgaaaaggagggagtttcttcctcaattccccatcccaatcccaccaaaattcccatgtctcccaaccaaacaaaatacttaatagcctcatccctctaatcccaattcctcttaaaaactccctccaaccaaacgggccgtaaaatcaatcccgtgagtttgtcgccgccgccaccaatctctattctcgttccagtagttttgacttttgacgctatcccacaaatcacgcaacacatcacacgccgcacgccgctttggcgcttcctcacctccacaaatcacgcctcgcgagttggtcccgcaccatcaagtagcggcggtcggcgctcttccacgctgcccgtatcgttgctctcacggacgccgtctccccatcctgccatccgccgacgccccatgtcgttctcctacctctccagctgccggcgcctgtgctgttctcctccttctccgaccgttcctctccctccggctgctgcaggttccccacatcattattcccttcctccacccggctgctgcaagtttcccagaccattctttccttccttcggctgctagcagtcgccgcttgtatctgggtgcggggacccggaaatggtgcggggccccggaggggccgggggcggggattgatttcgccccgttcctcactccggggccggggccgggtgaaccctcaaggatgcggaggcggggccgttcctatccaacccgcacccgccccgtcccgccccgttgccaaccctagtagaacctataaaataaactataaactaaaagttggcttctccatattcttacccactgtttctcgtaattttaatctcctcgagacaaaggtcatagtttgaccgtcaatgttcagttcgctctcactgggacaactttcagtttttcagcgccgtattgttatactagcctagcacatgcatacaccacacattatcagcgttttttcaacaagacggcaatttaattgacaaggatacgcattgcatttgcaaacgaattgacaatgccactaactcgccgtaacgtatggccggcctccgtgagaatgaaatgcgagtgagactgatcaaatcatttcattttatcatgtaagtgcagtgtctagctaaattcacgatgagcacgcaacacttcagtagagaacaattaagaacagggtaggacgtgccatgccacacgaggagtttctatacgtacgttctctatcttaaataggaagaatatatacgcaaacatctccatgtagtgcgatttctcccactacatccactccactaattaaggtgtgatttctcccactacatccacccactaattataaggtggcatatatagccacatgttaaggttttagaattcaaatgtcgatgtttgaacaaggatgagatgcacgagacaatactgatttttacaaacacctgcgtgcatcacggaccgtttaaccgtaggcgaagatcgatttcgatcgcttgatctgtagtagtgttcattcatagagtatatttcttaaaccgaaccttagaattgatagattaattgagtcagctcagaccgatcagtgaagtgcacaactcttttaaatcacaataagaaaatcccttaaaagtaataaggtagagctatattacgtggcgaaatcaaaaacattaattaggttgagttctttagttgatcgaggttaggaactaacatctcacgcacgtaaaatgaagtaatttattaacttatcactaattaagtattagctgaacttttatgaaaaatgaattaatatattttttaaacaacttttgtatataatttttttaaatacgtattatttagcaatttaaaaaacatacgcatgaaaaacgagagaagtaagtgaaaaacgtgaacaaataaactcaaccagagtattaagaacacgctctttgctccgtggctcgctcttaaaatgggttgtcaatagacacgctcgctaaacgacgtgcgttttccatcgtgcgtgtactgttgctccacaaaatcgatgaggtcaaaagaacgaaacagcttccattcacacgtgcgacccgagctagagtagttttaaaagctaacacgtgcgatcaaaaaagtcgtggactggaggcgtggccgtccgatccggagtgaagctgacagcgaattttctttttctagtgagccatgccacttgtcgccgtacgttcagttggtccacggccactgtacaggctgtttagatttaaagtttagatccaaactttaatcatttttcattaaatcaatctatcatatacacataacttttcagtcacatcatctctaattttaaccaaaatttaaactttatactcagccaaacattaaatcgatctgaaagcaggagtagccgagtagtacggcaatagccgcaatatgcagacatgcatccactaaactcgaattcaaagacaagaaattttcttactgccacaaaaaacaatcatgatcaaagcacgtagtaataattaacctttctgggtaacgtaataatgctattagcagcagcactacccctctatctaaaaaatacaatcctaatcctagctacgaacttgaataactatctctcagtctaaaaaacaatcctagttacgaacttgaacatatatgtgcccaggttcgtagctataatttatttttctgggacggagtagtacgccagtaagagattagagtcaattttctttttaaaaaaagagattagggccaatttaaatagtaggaacaagaaaacgaattaataggaaaaacccattattctaacagaaatagaagtgtaaaacaaataatttaaaatacaggaaataccatgtgattgtaccgtaggaaaaaaatcatatgagaaagataaactcaaaggaaattttctaagagttttgagctcttgctaagttttctacaaaaatctctgtagaattatctattcaataggaatttcaaaggattggatatgattcaatcctttgattcaaagccattctttgaaatcttttctataggataaaagttatcttaaaatttctatgtttttcctccaaatcaaaagggtccagtgtataaaatacataactgtcaacaattaaaagcgttacgtcatattacaggtgaccaagagatcatacatataatagttggctatcgacacaatttccaatagattgatcatactttttttaatttaactttcacacgcagatgcttattatactacacataaccccacaatcatgtttttagagcaggtacaatagcagattataaactagctataaacacatattaaggagatgaaagaagagagataagcagcgagctataaatttatagccagctacagcatggactccaaaacgcaatatgtgtatgacatgtgagaccaaatattaataatatagtatatatttatagataactattatatgaattagctattaaattgactatatcagataattttgagtcagtagttagctatactattaaacttgcttttaaatgtgtttggaaccgacgccaaatcaatcacctgcgcacatatggctcatcactttttcttgcatgcatgcattaccgccagattaaactgtatattagagcaagtttaatagtattaatagtatagccgattatgggctccaaatcatatatagttaatttaatagtcaattcataccatagttatctttaagtatgtgctacataattaatgtctgatcccacctatcatacacacatgtatcttggagtccatgctgcagctggctacaaatctgtagcccgctgctcttatctcttctcttttatcttcttaaaatatgtttatagctggcttatagtctactattgtacatgctcttatagtttctctaattactccctttgttctaaaatataagatattttggtttgatgagacatatcttataaatagctctagatttgtagtactagaacgtatcctattcaattaattttttttatattttgagacgaaaggaatacctaactttacgcatgtcaaatcttgttgaatcatcacagcgatagtaaaagttctctttttctttagaggaatcttaaaagttttctagttcttacatcacttgagaacaaacaacgaaatcaaatcttgtcattatgcaaacgcttcagaatgtctaaactgctcgttgtttgcttgcttgtgccgcccaactaacactgcactagcttgcgatgacagcattggacatttgttaatttggatgatatctccattgaca

SEQ ID NO: 17260 - DNA, 2772 bp, Oryza sativa
ttttatgagtattacttttattgttattagatgataaaacatgaataatactctaagcatgactatttgtttttaatttttcataattttttaaataagatagacggtcaaacgttagacacgaatacccacgactgcacttattttaacgttgtagatgacagtccgacagtgacatggttcatatgattccctcagcagactattagaagctttgattagcctttgccaatggctgctctcgcttggatttaagctcctggcactggccactatagcccactagccacatagtactatggagtatggacctgcttgaaagctgtagattccaagggcccgttcgaacgagcattttggctcagctaactggcggcacttataataaaataatctattaatgcataattaatcggttcctataaacttaaaaatagaattatttgattttagaaaagccttttgtgtagaaaacttttacatgaaacacaacgtttagtaattctggaagtgtgttcacgaagaagaacgagtaagttgccattgtaaattgctctctagaacttagcatacaaagtataaagtgagtagtagctagctggtgagaatctaaaaaggttgaaggttttaatttctgatttttagtttatttcctaaagtgtatagcttttattctcgtaatatatacttctacatgaaaaagattgactacccggtaccgagcaacttgtcatgtgattgactttatgatcaatgtcctgatgtgcagtactatctccaagattggaagatgacgagccaaatgacgcagtttttgcatcgaagcgttgaaaccggttgtcaaattaaagtatttcttttcttcagattaaagtatatctgcaaattctttaagctgcattattttgacttgggagcaaccagccaagaccacggaaacaagagtgacatgggcaacaaagtcgataatgtacctagactgagttcttttcatcaaccccaaaccgtaattttttagcatgtttctcaaacgattaaatgatatgttttgtaaaaaaaaattgtatatagaagtaactaaattaatttttcaagtttgtaataactaatacctattaatcatgcgccaatggtttatcttacgttcgtgaaaaagtgcagccgaaaatctaccactagctacttagaaaagaacgcacccttatattaaagtataagtgaattgtttgtcttttttatgagctaagtttttatagtttatattgaactggatgatacatacaactcagtataacttctctttgccccaacacccaaaaaagtttcataatctgtggcactgtctgtgggcctcatcgtttggcttttttcgtaataagccaaaacggcttattagagaataaaaatgaatttgtaggtaaaacttttatatatgtgttctcggtgacgtaaaagccaatgctgaaaaagaaactacgttgaaaatatcacaaaatcaatgttaaaattaagtttgaaaatttaaattttgcctttttctttggctgaataggccatccgatggaagccattgttgtaaaacatggtactcctagcagatattcggttgaagcaatgccaacatgtcatcaagtacaatatcttatcctctttgtaaaaaaaattataatcctaacttcgaatctagatatatacgtatagaggtttgtagctagaatttgttttttttaaggcagatcttagtagcttccaaagccgtcatgcattggttaagccttaactaagcctaacgacatatgtcaatcacgatcataacttgactgagagaatgttgttgcttcaaggagtaactaacagtgcgtgaataaatcctgtaccactcgagaaaaccaatcattgattgctttaagtatatccattcgtgccagcgttaattaggacaagaaataggttgtattacaggttgtcgtcatgaagctgaggcaacaaagaatgaagaaaataagactaaacgaagtaaaatcacatgtacatccaggttatactatataagctgggctgggatttggttattacagaatgtctacacttggagtaggtgatcaatgagtattttacctagagacatatgtgacggtctagttttaaaattgatggtccttaatactttttttactttctttcttttaaactggttcatgtgtgtcttggttgtgtacatcctagttataccgagatcgagaatactccaagcacaattgtattattttgatgtaattgactaagatcaaagaaagcttctatttctaacaaaatgtacatcctagctgtgtgtttctttgcctgcctgcaatggtgtttgaggctaaagagctatgcatgcacatttaacgttgaaaaatactttcatagatatgactcaaaaatactttatcaatcaagctgttgctccaattagcttgcttgtagtttcatattatctctgctatgtattggcaactcctagaatttataaattgtctacgaaacatgtttttttcgctgtggcctaccctcaaaggctcatgaaaatcgacgagtttaaaaggcgggcacgctaaaagacctgcctaaaaaaattgattttcgcgggcggcacacttaagtcactcacctaaggatttctagtgtaaaaagatgaaattccaaattcctaatatcctccaattcacaaattcatgatgcaattccaccataacaaattttaaaaagatttgacaaattcacaatgca

SEQ ID NO: 17261 - DNA, 27115 bp, Oryza sativa
ttctaattaaagccattcggctaggatggagtacacctttttttttcctcctcataagtcataactagatggagtactactgatgtgaagttgaccttttaagagagagaagaagaacaaaatggaaagagccattgcctgcctagctagcatggtccaactataaaaccccaaggcggcagcagcagccagcaataaacaccatcagtacaccatccatccatccatccatcgtctcatcctaccacagatcacacacacaccaagaacacctagcggcgagctcttcgccctcgcggccgttcttggctttgtctggctcggtttgcttctgcttttgctcctgcatgcgccgcgcaatggagaggaggcctcgtgacctcgtcgccgtcctggctctgtcctgcctcctcctcctcctcccactgctcgtctcctcggtgcccatgtcgagtaagctttcgttgatgggtagctgtttcttgattcttctccctcgagttcttgatctctgtgcttaactgtttcttgattgtgatttgtgtgttgattcgttcttgcttttgcaggaagcctgcacttgagcagccagcagcagcaacacccgccgtctctgaacctctctccagatgtaattaatctttctcatcccctgcaatctctgaattttttccccctccaatttaagtttgtcgactttgttgctgcaaaatcacaaacactattcagaatacgggcagcacagtgctcaaccagttttgaaacgaagccaatttctgaatcaaactaatagtgttagtgacagcaactctgaccatggcttgtgaccgttcttgcagaagatgccgccgccggcggcggcgagagggctcggcaggaggccggcggcgaggatggacgtggaggtgaacgactaccccgggtcaggacccaacaaccgccatgaccctcccaaaggtcctgggagcgcatgaattcagtcaagctgaagctgctgctgctgctgctgctggaacagcttgtagtagtttcatatccctgctagctattagcaaattcacataattaatccagcgtctaattacataagtcgagaggctgtatgtgtgatttggggtgtaattagtagagagcagatgctagcaagttacaactgcagatcgaattgagaaaatattcagggatgaagactgtaaagcttttgctagcttgggcctcctctttgcagcagtagtatagtaagtaaactagtaaattaattaatcagtgattttgtcgacatgcatatgcacatgagcacatcacgttgggatgtcaatataatacaggattaattaatcggttaatcagatattggaagcttcttcctcctctcactgtcgagaccgtcgtgtcgaacgattcaattcaaaatcaagtgatgagtgagtgtttaaaggaaaatatataatctcgtcgcgatcccaagctgatcactgctactgcgactacggccactccaatcagttagcacactgattaacgctgcgtcgatcattggtgtactataatcattgctccctctgactaacctcacgctgcatatgcgtctgccgttttctcgaactagtaatattgttgtttaatttctggaaataacctgttgagatattcccctcggatgccacaacacaggggcatgttttaagaggtactccctcaatcccataatatgagtaactttagagggatataacatatcctaatacaacggatttggatagagagcctatccagattcataacactagaatgtgttatgtctttccaaaatcctatgtgcttccattgtttgctctacaattaagtgaaaaaaaattaatgaagcaaaaaataaaaatttataatagacgaaaaaaatgttttctagtgttttagacaccttttgaaaccgaaaaatcaatgggtaagatagatgtgataatagagatagcaacaaggaagagggaacggagttagaagaccgagggatcatattcttttactcaatctcaaagcaattctagaggttcctttcgaatgtactccctccgtctcaaacaaagtcaaaccctgggtttccgtgttcaactttgactatccgtcttatatgaaatttttttataattcgtattttcattattgttagatgataaaacatgattaatattttatgcgtgacttgtctttttatttttttcataattttttcaaataagacggatggtcaaacattggacacgggaagcagggtttgtctttttttgggacggagggagtagtaaatttacaagagtgattcagacatatttcgaattactacctccgttttttaatagatgacgccgttgactttttcttacatgtttgaccattcgtcttattcaaaaattttatgcaaatgtataagatataaatcacacttaaagtactatgagtgataaaacatctcatagcaaaataaattataattacataatttttttttgaataagacgaatggtcaaacgtgtgagaaaaagtcaacggcgtcatctattaaaaaacggagggagtacatattttgaatatgtaattcggtttagcttttcagtgacatgtaaaataaaataatccaataacatataattaatcaagtattaattgttatacggtttagaaaaaaccttttaaaaaaacacatcattttacggtttagaaaaactaacgaaaaacaagaaagttatcgtctaaagttttagttttagaagcgaacgcagctgaattcaagtaagattgctttagcatttttctattctgaaacaggtcttgccgttaagaggtggctgagatttagcatttcgttgctatatagaatccatttgctgcatttggatgaggaagaatccgcacaacatttgctagcagcgggcaattgcaggagaggctcttaccggcacgcattacgcagtttcgatggagccctttgactttgtttgtacccctatatgcgccgaggaataaatgatcgctagtacgctgacaacaacaatggctgcaacgaaagtgacgtggccagtgcttcatctgacgcgtcccggtagaagaggaagccaggaaggaacacttccggccggttgcagtctcatgcatcatctcagtatgacaccgcgggtggcaactggtgccaggcaaccatggaaaattatgtacgataaatcacttatacagtgaatacctaaaattattattagattaaaaaaataatgaacttttgagatttgttcacgttatccgaagtaataattttactcatggatgtgatgtccacatatgcagtttccgcaaccacgacggtttcatggcactctgttcctcccccaactatgccacaacagctagggcaccgaggcggctcgggagttggtgttgcctagatccggcctctcctcgaccggtactgatgaggagactgatggacatcaggaggccggcgtagtagaggacgtggtggcggtgtgcgatggagtggcacacggtagagttcagacacggaggaggcaatgagggagagccggagagggccagagccactagatctgatgcctcttgggcagttccaatgccctcccgctgtctggatctaaagcctcccgggctgttgcgaacgtggaccgacgatggagatgatgtgcattgggaccagaaacgaggcaacggggtgccgccgagcaagggtcgttgtatccgcagcaggggaagggtggatgcggtgagcaagggcctgcgacggcgtggtgacacggcatgagaggagaggggccttgcggtggctcggagacatggtggatgtgaccctgtggtggcatagcaatattaatgtaggagacagtggtgctcgttgcttcgtgtctacagaaagggtggcgtagacttttggggtgagggggccgcgggaggaggggtgctgcaaaggagccgacgaagggtcatcgatgcagtggagctccttgtccgatgagaaatagcaggtggagtagcatcggtgtggcagagaagggcatatggcagaattcggtttgtggtgcaacgtcgaggttacaacaacaatgagaggtatgttataggcgccttgatgacatttcatgttcgggctgataacggtggtgctctaggcaatgcgatccctcttgagggcgtacgttgttgtgatgcctccttctctctctggcggtatgagtccaagtttgacaagcagcgggacctccttggagacgtcatctaggagatcctgcttttcttgcctgttccatcttcgatcaattcaattttcggcgacatcttggatgttaccatcggatctattcgagagagaagcagaacttctcatctctcgtcccctccctcgacaattctttctacatggtgatggccgagagcccatatgtatcttttattgggctagcggtatccagcctcgcatagcatcgacttgattggtgtccattcctttccctgtgagagtgtataggagttgttagcacacaatggtgctttttttcccctccttgattattgcctcccgcggtggattgatactgttcgttcaacaaaaatttccaaaattcgaaaccaacgtcgattcaacaatccgtgacaatggaaactaatggctaattaagaacagttaccccactattggaacccctatcattaagtgggtacagtacaatgttttgtcacgatagttacgcacgcacagtacgcgtgtcacgggccaccgctcgccggcgcgagcgcatgcagcagcaagcgtgcgcgcgtacaaaaccgccgctgtctggcttgtcgatgggcggcgatcgatcgcccgactttgacacaaagactagattcccctgcgacttccacatcgaaacgacgaaaccacacaccgctacgcactggagaagactaatatccatgtcaatttctgcacgatttcctcgttttgctcttattaattaatcctccgatttcttcatatcatatggttccgtccatagtggtgggcagaactgtggatgtatgtaaggctatcttgttatccaattccatggatatagttagttaattaatcacacgcacgtgcggcagaagccatggacggccgtgtgtgagtacgattcgcctctacccccatgcaaattaatatggattattaccttattttattaatattatgcgtgcttagccagtaaaaaaaagtgttggatgattcgatgcctggagagcaccggattccggaggagccgtgcactccgcgagcggcggcagcagcaacgccggcgcgcgcggagcgcgagtatcatcgtggctgcttcctcccatcgctttccagctcgacgtacgtacgtacgccgcgttggcgacgtggtgtataaaaaaggcatctgctctacgttagatcggatatttgatatttggacactaattaaaagtattaaatatagactaatgataaaatacaatctataatcttagactaatttacgagacaaatctattgagcctaattaatccataattaacctatgtgatgctacagtacacatgtactaattatgaattaattaggcttagaaaatttgtcttgtgaattagcttttatttatgcaattagctttattattagtttacgtttaatacttctaattagtgtcaaacatccgatgtgatatagaataaaatttagtcccagatccgaacatcaccttagctgcggggcctcggcctcctctcgctctcgttgtgttacacatcgtttctgccgttctggctaggggtcgatggggtctccgcgcgcgacgatggtgacggcgccgacgacgagtcgacgtcgatttttctgttgcccgctgcggctgcgagtgctctgtgggcggcagcggccagcgccggggggattcagatcaggtgaagttgtatattgactgcaactttagcagtcgcgtgatccaccacgtacaaaattaatgtaacggccaaacgttaaggcaaccctgcacatcgtcatctacctcagcccaacaccaacacaccaaagccaagaggccagagcatgtcgacacgacggcgctgtgctaccggaccttgcggccggcgcgcgcctgagcatgctgctagctagccgctccttgcccggcgccttaccgccgctctcgctcctcaacatgccaaccccaagcacccgcttgcccgcttccgtcatcaactatatattcatctccccatcaagcagaccttgaacatatgctgatatgcgtgcgtgaagtagaagctcaccattccttaaaaataaaattgaagcagaacacagcctcaattaattagcagcttattaaattcgccttcatcttcgtcatgcatctccatcgatcgatcgatctccaacctcacagatgcattactatctcgattgagagcggacggatccgtagtaagaacccagtgctgcccggattaaggaacatatatattacattcctctttcatttcaccatgcacgggatcctcaagagctgggcaactcattttttagttcaccagcctttccccgaccgccgttcgctggcgcgctactgccggccagatcagcccctttgtgctcaagtggagccatgacgaacctcttttcagtgaacaccgtttgattcaatttggacgctatggatgacgcgactgccaaagttacagtcgatatagagactgcacctgatcccaatccgcggcggggttggatggggatgatgtcgcggtttggtcgctaaagattgctgtcgctgctgttcgccttgtaggcccaggcctgtaaaccagtgttcggcccagtgccagtggcacttcttcttcttgcgaatgggttgggcggccatatgccatgggccaccacacggaccagagagtggagtgccggtacaaatttggtggaataagtccactttgacttcctgataagtgacccgaatctaatccataaccctaaccctaaaaccggatatcttgacccccgaactatttaaatcggtacaatttgattcccttggtgatttttagagaggttttgctgacgtggcgctgacgtagcggtgttgaccagtctatggggttgacatggcgcttaggtggcatttgaattaaagccatatatgcgggacccgttagtcattcacacacataaaaaattgtgggtcccactgacttgtgggccccacatgtcatcctctctctttctttttcctcccctcttcctcccttctctctttctttctcactgtccccttcagccggcggcgggcataggccggagtggtggtggcgggcggcggcgggagctgacgtaggagctagctggagcggcggtccccggagtggaggagtcgacaatggcgaggcagcgctcggtgagatggggtcggcgtcgtggaggaagtcgaccgacgagggttgtctttggccaacgacggccggcgcatggggtcggcgtcgtggaggaagtcgaccgacgagggttgtctttggccaacgacggccggcgcgcgccggcggaccgcagcttcggcctccacctcagtggcggccacctcacggcgccgaggatggcagccaccggggagagatggagctcgccggcgctcctctgctaccactcaaatctgactgaggcatgtgttagattcttaggattgctatgtgagatctaggggttcaactctagcttataggaataatgggtgattgccttggagagtgaacggtagagaaagagagagagagaacccatacctttgccggtcttagagcttgacacagccatggcgatggtgcggtgatgtgagggcgtcggtgaggacgacggtgtcggtgtcagtgatggtggtggcgacacccggcggcgggcttcccctcacttcagcgcttcccagatcggagggacttctagggtttgtggggagtccgtgtgtgcggcgaccaaccttggttcgcgcgcccgccagctccctctctttatatattagcgctgcgtgagaggggcccactgccaatagatcggctggcgcccccgatcagggagcgtaggcggagtggggaatcgttttcccgattccccccaggatcgcaactaatattctcccattcgatctccgcctttcttacttctcttactcaacatttacttctcaatggattgacgcatagagtacgcttcatcatgacagtcaccattgaaccatcagacgcaacgactacaatgcacctctccatctcgaaataaacactaggccctttcttttgtaatccaaggataataggctttcctgtaaaaacccatgcctgccaagtgttctctgaacacactgggcggtaagccttttgcatgcagatctgctaacatttcctttgttcttatatgctcgagactaattgtctgatcctggattttcactttcacaacataaaacttactgtcaatgtgtttggcagcaccacttgacttattgttgtgagtacatcttgaatggcctttgaatgctgtcgaccactttcaactcgggaacaaacttctttaaccattttttgcctgccccgtggcctcataactagctacaaactcggcatacatcgtcgatgatgctacgacggtttgcttggagcttttccacgaaatagccccttttgcgagagtgaatatgtagcatgatgtgaactttttatcatctacatctcctgcaaaatctgcatctgaatacccttctatctctagggaatcagatcttctgtacgttagcatgaggccttttgtgccttgcacaagctttctttaccattcttcagtgacctaatcctgaatttcctttatatctgctaagtatcccggtaacaaatgctaagtcagggcacatacatacttgagcatactgtaagcttccgacagctgaagcatatggaaccgctttcttttgatcgaactcatactggttcctgggacattgaaatttcccaaaactatcgcccttgactatgggagcagatgtaggcttacttgcatgcatagacatgccttttgcgataatcctaaccccttttcttctatctcggtgaatctctattcctagaacaaatgagactttactaagatctttcatatcgaaattcgaggacaaaactttttcgtctccaatcaacatcactactagtgagtaggatgtcattaggacttgctgaatatacacttgctggtcaatggagggtctcgtatgacgttggggttaagttctcatacacacacgtgacttttgccaaccaaagggtttgtatgtttatttctttgttgtggatggcctaagagttaacttttgtcaagcatataagagagcttcacaagttggcaatttgatatctgacacctcaacctaagcatccaactgtgatatttataagggctaaaaacaaagaagcaagagacaaagcggtatggactatgatcaaactaaatacctgtgccactgcaaaagttcaggcaactacactggattcaggcagctgttttctctcaataggataaaatgcacagagcttattgcttatttgttaaaggggaaaagcaggataattcatatagaaataagttcttctagctcgggaaataggatatggtcatacacaattgttacctactacaaatagcagtaatttcctcgtcccttgtataaggaaaacaaattgagacgataaacgtcacaggggctacttgtgttctttgaaactcctggtgatgagactaattttagtacatagtagcatccagcagttttacagcagaaatagcaaaatgaaatataggaagttgagttataacttgagcatttctttcagctcaaactagaaaacttggcgcagctttgccgcgccctcacagtgattggcctagtgttcttgcagagtggccttaaatcaggaaattatgtgcatacacagttacatggtaatgcatttcgtttccgaaaatactccaatatctgatgttcattaaaatgtttgaaaatattaaattacacagctcacatgtgtatgatgcttccattttaaaaaaaaaaaagcttataacaaaagacaataagtataactatacaagtcatcgttgaggcacatagaagaattgcaccatatcttgtcgtaccaactttgataaaaccaataaaccatagcccaatcaacctcattctcattcatcggattcatctcagcaatcttagcgtccattttgggatcaaaataaatccattcctgatatagagtgcacatcataacggcatagcaattgtatgcattgatacggactttagtgtacatgatatgttcgtagtaacgttccctcaaaatattttcttgcagcacccctgatacagcctgccatgtagatgcataatctttatgtctcgatgctcacagtaaataaacgaactttttctagaaaacaaattgagtaaagcagttataacttgatatattgttatgttcacagacaaagcaaaatgagagaaaaataaagtaaaacggtaggacttgatataccattagtctcacaatgaaagagcaaatctatgaaaaaaaagggggggcaaaagtcagacgatgcttcttgattatgcatacctaatgtttttttagcaaatactacatcaagataattgtatcagttactcagatgatcagatcacatgatccatgttctttgctgatactagtgttttcttttataagaagttgttaaccaaatattgaaagaaatatttttttttcggttgatgtggtaacgctatctgtgaacctaaagttatatacatgcatatatatgtgtaacatggttgcagtgcagtgtaaagctaagttttcgctctttttaagactaagagaggaggaggaaaggtgacaaattgaggttatatttggtgtgtcaagataaagtatatggagcttggatcaaagcaagacgagttccaaacagagggaaataatttctcgtctttacttggtcttgtccatactatttttcctggttacaaacatgtatattatttcacttcacagtcaatgtgacctttgacttgaattagtacactttagctctagcttttatcatgtggataagaggaggacaatatcagattctttgcatttgagctaagaatctcaatgttctcactttgtgtatgtgcacagacacagtgactggctgcctgctagcccatctatgacaaatggattgaaagctgcttatcataaagctagttgatatctctaaccaaacatcgtatagctatgttcttgatatactgcaatataaataatctgaagctacacgactggcgtttgttatattaagagcaacaatgcaaagatatgtagggcaaccgatccacagtatcttcgcatcaggatacttcagcagatgagctgcctttgtcttggcaagctgctccacagttgtcaaagaaccaatatcaaaatgcaatttcaatatagcagcatcaatgaagacagtagaaaaggagagagaggaaatgatgggtgataagcttaggctgttcttcagagtgctactaacaggcagagataaagtgcagagctgtagaacatctctttccgctgaagattattaagaacatcaaagtaaaatgtgaaactggattaataaaatggatactgaattaatgtcgatagtattgagagatgatgatgctagtctggaggtttcaaaatgttacagaagattaattcaatcaaaggacacatttgaacttcagaaaagatagctgaagagaacatttgcttttcattcctcaaagatcaatttatattttgaactcatgaaacagtaaaagctgaagtactcctataacacatttaacctgtcatgaccaaagtagcaactgagaagaattcagaaatcatggtttgcaaagaaatagagcatcaattcaccaaatatactgaacatttcaacattggcacaataacaactaacttcaatgcctcaaggaatattcactgtaaaatgaagaacacttttcttctgtgaggaataaaatgaaccatatttttgtgaagctatgtttagaaaattgcatgatatattgtattgccaatattctatttcttaacctatccaactaggtcaaagctagttggataggtcaaagctaggtcaaagctataactatacaagtgaactgacaacaacaggaataatgcctgcgagtagctttaactgataggacctatactgaactaaattagtttgatgacataaacttggcaggtcaagatactctctgggctatcataggaagaaccaaagagtataatctttcttacaacaaagctatgaccattgacaaaagataggctgctctagttgcataaaaaactcaccaacaaggataatcatataatagactatttgtcatatttcagacaataatagacatatatacatgttttttccgatacttctatgatatcatttgtgtctttgtgtattcagcttattattttttgcatttacatcgttgacctggttctggttactaaataggacaaattttatgcttgtagatatatatgaaatacacctaattgaacttgatttgtgttgaaagtatagcacagctagaaggcagagccaaacagagatgtaattaacatgcctgggtccagattgaagaccctatcgaacaaatagaggaaaggacagaaaggggaaaaagtaaagtctaagcgacatatggcacgaaaaggaaatccaatttcggtaagacttgatctgaatcgtagttcagatccaagtcggttcagtgagggcaaccgcgaaagtcaccgaatgggttcggtccgtcttttcctgatctttgtttgtccccccaaaaaaaggcgtgagaggacgttgcagatgtccgggacggacacgacttcttctaacgctagaagaccacaggaagaaacccgggaccagagcatgtcgtgaaagacgcacacggggcgggcgtgcttcgttgttcaaagatgttccagatgattggtcttctgccaccctcagctgcaccacccttgtactgcatgtcaagaatggccaactcatcagatttcagaccaagacaaaacatgtgagtgtgacaattaattttgacaaccaatccattccttggagccaatcttatcaatattcagtagcatcgtgtatcacgcaaaaaccaccaagagcaaaagaaaatcctttttttcttaattatcggtggaaattaatcacatgtggcgtgaacacgtaggggaccatgtgagggaactcctacatcgcggcgtccaacggcggctgccatagcgtggtcctcggcactacgccctttgctgcacggcgaacggcctccgtctgaggcggccggcgaatcaaaaggcggctgggtagacgggcacggcgatggatgtgaattttctcctcccccatccccgcgcacagcaaccgagctcgttgccctatctggcgaggatctgcaccgccaccgctcgaggagcccctttgccatgccgccgccaagcttgaggggagaggcagcgtcctcaccggagctcgtcgctgacaccgagctcctcttcacatatagcgacgaggaggggatcagaggacagaggactgaacggcgcgccaacgcgtgggaggctcggcctcgggcgccggaggcggagcagcgggaggaagaggcggcgacgtcggcgtaggacggcgggtcgaataacaaggaggcggcggtgacgtcggcgcaggtcggaggggagagcggcgaggtggcggataagagggggtcgaaggtggaggaatagagtggtggcgaaggggagagaagggcctgactttttttttgcaaaaaaatgcacctaaaatcttctatattacaacgaggtccaccacagagatccgtcactgtacatctgcgatccgacggctataggagggggtctaactctggattcgtatgacgctacgtggagggtctatttgcatgagaatccgcgaagatttcgatattgagagatagatagctttgtaagcactaaattgatcattgtgggtaacttaagaacgggcggctcctgaatgggatctataatcaacgtgttggttcctactaaagaatcttaacgttcaaaccacataaaccacctgtgaattgcacaatggtgtatttgttgtccactcctgaagtgtcttcaaagacctgaaaatcaagtaacccaataataaaacttcaagtgttctgaataatgcaacaaccatagggttaatgcaaatcaaaatacaatcccaagaaaacaatattttcataagaatagagaagtgatgacctgcacaacagcctctttcaccatcaacttccagaatttggccacaccgagtggttccatctcccaatcggatgtttacaatttcctagtactttgcgccatgaacatagttacatgaagaaagaaatgttcagtataacttgctaggagtaccatattagtcagttgaaaatttgtaccataatactaacacatacctttactttatccaagataaacagaggtcctggcacaccagacacaatcgaacatttctattatcgagaaaaaaaaagatacatgaggtaactatctctacctttttattatctccttaaatcccttgttattctgtctctaaatccaagatgcaaacacaaatcaattagtaaaaaaaaatgcattcattgccagaatcatctttttttttaaatgaacccattcccagattcataatttcaaaagagaattttgaggccaacaagagcatgcacttactctttgaggcaagcgatacaattggcatcaatccacacggactacaattttctcttcagttgtgcctcggatggctgcagcaccagtcatcccctaaaaaaacagcaaacaaatcatggttagagaagaggatgacatgggagagatgaaaggagaatgattgaggggaggcaaggtacagtcgatagtctgagacgacgaggagaagatggaccggaccctcgttgatggatgtgccatggatttgtgtcctcctcgttgaaggctcaagaagacacggcgacgtagagcaggttcgccaacacaccacctcgtggagggatcaaggcaccgcctgagacctagtgttggatgaaaggggaaaagggtgtgcggtggggaggagggatgggtagatggcgaaggggatgccgccggatccagagggagaagtggcgccagccacggggctacaacgacaagaatggaaaggggaggagcgggtggttgacgtagactcgaaaggagaaagaggagccgtgtgcgagggaggcggagcggcaggagttggaggagacgcagggggagggcggcgttgtggagaggtgaggacgggaggaggagcaggcggccaggatgcgggagaagaaaggggaagggagcaccgacgccggctctgccgccaaggtagggggatatgaagggggaggaggcaccgggccatctgcccgtcccatgtcccactccccaccgcctgtcctactcgtcccgcccgtaacacctccttcttagccgccgtcaccaccggtgctgctccagatctgaagagggaggaaggctagcgccgggtcgaactacgcaacgagatgagtgagaataggggtgaaccggcgccgactccgacaccgccgcaggcacagacgccgccacaagggagagagtacaagggggagggggcgccgagctccgacgggcaggagggagagggaggggaggagggtcgtcgtcgacggcggcggcggtgggatggcgcacggaggcggcagggggagggcggaaggtggcggcggggggagagcggacgacggcatcgtggggaggacgaacggcggagacaggtccccgccgccggtgcggggcgcggtggggaggagatggggagacggccgggtagggtttgggccttggttaattggatccatgccactgcaaaagtgcaaatatggcatatcaaaataatgccactcttattcgtcatatcggctacgtactactgaaatctaggaaaattggaaccatgccactacatcacattttccatcaaaaatccccgttagccccaaactgcacgtgggccccacatccctcccctctcttctctttccccttcctctctctcctccaccgtagatgcaacaggaggtgtcgtcatcatcgtatgagggaggtccggctgcgcctgcgtcgtcgtcgtcgtcaagcgccgaggatgtagtccacctgtgaccgagcggacgcagtgaactgcgccggcggccgccgccgccatcgcactggagcgaggccgccctcgtcgccatcaggtggtcgacgtgcacagcgaggacgagggacgccagggtcacgtcaagggcggatctacccattaggcagggtgggtcgaccgactcagctacgacacgtgtcaccccacaacctctagacctacttacctccttatagtagtcatgggacattaaaatgtataacaaggtgtaaacacccaacagattaaggcaattatgcgaatgaactattaatacgatatgtgttgttttcgattgctcttatcgagtgtacatcttcgttctctgccccatctttcgattgccgccggagtgctgcatgaggttgcagatgaactggtctaggttggtcttcatctcggtgtgactaccatcggccgggagcttcccttggaggaaagcggcaggaatacaagattaattgtataatgttaacatccacaatccaaattaagcagaaatttggattcacatgaacaagaacgaatcagaaggaggataggttttagtgccttggtgaccaatgcttgcgctttgacgaacttgtcatcccagctgaatatggagcgcctcgtctcggagccggcgggcaggactgcgccagtatcgtcgtcgcccactccccgggcgaggtccccggccatcgcccccgcgccggtcgccaccccgcccaccgccgcaccgccatccccaacactcgttgctgcagctaccaacctcctcccggcgcgcttgctttctgctcctgaaccgaagaaaggaagagggagagagatgacggaggttgacaaaaaactggacggaattggcatagttccaatttccccaaattccagtggcacatagccgatatcgcaaatagtagtggtatttttttaatatgcagtggcatggatccaattaacccttgggcctttgaggtagatatgactgcttttcatgaaagcccgtgtctttttcatgtttatagcactacccctataaacagaattttcttttcatcgggtgtgtttagttcacgctaaaattgtaaatttggttgaaattggaacgatgttatggaaaagttgaaagtttatgtgtagaaaagttttgatgtgatggaaaagttgaaagtttaaagaaatagtttggaactaaacttggcatttgtattgtatttctattcaaaccgaggggttttccaaataaaacataacagggtgtcagtcggttcgaggatatatacgatattccgtgaaaagcgaggagtttttttttgcaaaaatactcaacataaaaaaactcaaaaaagggggaaaaacgcagcatacacactactatcatcgatattttgtttgagatgtgcaacagacaaagcccgaccgaagaaccctaacaatggcgtcgaagctcgtgacggcggtcgcccgtcaagcggcggccacatctcgcgccgcccgcttagctgcggtggcgcgccatgacgcggcggccgcatctcgctccgccggcttagctgcggcggccgcatctcgcgccgcccgcttagctgcggcggccgcatctcgcgccgcccgcttgaagcctcgtcccccactggacgacgctgcccgcctctccttccgctacagcagtgaacctccaggtaaatcataaccaatccctccctgatccctccctgtcctcatggtgcagctctccaatttagcatagtctagataggcaggcagggggattaggatttaggaggaatacatccatctctggtctgtattaaattcattcaattgttgcatgctattcgtacaattcactgttttcttgagcacttttactgatgtaatgtttgcaaaattgttgatttgtttgtgatatatagatgatggaaagtgcgtgacaaaagaggaccttgagtcggacgaagccgtgtgggccttatttgagcgctattgcaagtcatacaacaggaagtatgatcatgctcagatggttcgccgcttccgtatattcaagttcaatgcaaagagaacatattgctggaaccagtatcttcataaagacgtaaaggaattagctcgcgccaaaaaggatagggatttaggactacctgtcgactcttggtacctacaaaaagagttaggcgaatacgacgatgggggggagccacttactgaatattggcggaaattttgatggaaaaccatctgccgctggtgtgtcctgcatcactccacatgttactgcagtaagagcagtttgctccccaaatcacttcactgtaataactagtagtcctttgacgttccgtgtttcttactaaggatgcgttcgtttgggtgatagggagtgagaatgcacatcgttttccgcacgcacgcttcccaaactactaaacgttgtggttttttgcaaaaattttctatatgaaagttgctttaaaaaatcatattaatccatttttaaaatttaaaatagttaatactcaattaatcatgagttaatggcttacctcgttttacgtatctttctaatctcctcaatccccttctcctcaaacacaccctaagttatgcttgtgtaccatctacttaattatctaagaggtcatgatatcttgcatatggttccacgtatgggagtgtgtgcgtgtctttttttttttttagcctttttggtttacaagcacaagttttctagcagaccaagatcaagtgtgatgattctggtaatgtatgcagctgtttgtgcacattaatttgttgagcatttattatgacgaaactaaaggttagtatatattgttatgtctcaaaaaattcaacagtttaaccgttatcatttactcattgttcgttcattgatgtatacaatatcaattatatccagtggtaggacctttattaactaataacacatgaatcttacttgaatatatatccagtgatggaactaaaatttgttatttggattagttggcacattggacaaacgaacggctgttaactacctatgtgaaaaattacttagattgatcatgtggctgttaattcagtttatctagaaaatatttttgcaacctacttgtttggtgcttgcattgtttggcaacccaatgagcaagctctaggtgcgcagccttgatctctagttacatgtacagtagttgcgctgcctcaaggcaccatgttaaatgcagaaatctagacaaaattttgtaatatatcctgaataacttcaatgttcagactctttcctatgattcttttgcaatgtaaagaacttcatcaagttgtatatataaacgaacatataatccaggacaacaagacacattctttctgatctagatttgtgcacatcaactagattcaattcatatagaccaaaagaaggaatatatatatatatatgcttgtgtacaaagaaaataacataaccagtataggagaataagcccacaaaacaaaaacaaataatatagttagaggcattaactttgagcatactctctcttaagtctcaactttaattggtctgttgtataaatggtcagtaactggtctgttgtacttgtactattttctcgatgcaaccatttgccttgtatggcatattgtatatataaacaccatggattggtgagctagcctatgttactacatgtgtgcttggcattgactgggcgctttgagtagggactgaaaggttgattgtttgaaccgtagctcggatggacgagcgattggagaccgtggatttgtagacctcatcgagatgtaaatccattttagtctggccgtttggacttcagatgaacacattgttgtttggttcattttgtttttaagtaaagactgaattgccgccacaagaacaacttgtgaagtgggtgcaaatatagatcatataaaacttgaaaattgctgaaacagaccattgtgcgctagattggatttcctgtttattttactggtgacaggtcgttattgctgtgcatggagagtttgaaggtcagtttcaagtttatgaataaaagtttttctttttcttttttgtttggaacaattaagctcttattattctcttactgtctgcaataaacagttgataactccagcaaactgaagagtaatgttgcagcatctaagacttttgcatgtctccatatcctaaaagttattctgatgagaggcatgttcactgacagcttgatccatgtgtcatgtatttcagtgtttaaaaaatgcataccccaggttatgtttgccattagagcaagttcaataatatagccaactactagctccaatttatctatagccaatttaatagctcattcatacaatagttatatactacactattaatacctagtcccacctgtcatagacacgttgcgttttggagtccgtgctacagctggctacaaatctgtagcccgctgctctcctctctcctaatttatcttcttaaaatatgtttgcccgctgctctcctctctcctaatttatcttcttaaaatatgtttgcagttggcttatagcctgctattgtacctgctcttatatacttcgctttatcgaatctaactttactgaatttaactttggtgctgaaaatgaggcaataaagtaattattttattacagttggcaggaacttggaaaggcaaatcggtgtctaaacttggtcttgcgatgtttctgcttaatgcttataaattaacacattgatctatgattacgtggactgctaggtgaagccaatagttatacttgctctttacctggctataggcccctttgccacctttctcgagggttgcagggggactgcctatgaagtgtcattcttatggccgtgtttagttacatcccaaatgcccctaacttttcatcacatcacatcacatccaaaacttttctacacacgtaaacttttaacttttttttcaaacgaactagacacaccttattccgcgtgaccgttataataaaccagcatacattgagtgaggaactttgacaaaaaagaacacactgaactcccaaattttgccacggaggatctagcataacttgtcagagacgagatgtgattagcttgccgtattaagacatgcacgcaaacaattacaattacatgacagaaaattactgggtagtttattccagaaaaagcaaagaaaacaacaggaacatggtaaaaagtactcctacagaaagaatggaagaacaagtaaaagtgctgaatgaatgggttaagacaagaaaaaagaatgcatagtccagccgaaatgtcaggttggttgggcctggcagcaagcataaaaacctaacgtggtaaatgtcatgtcaggttggttgggcctgccagcaagcataaaaacctaacatggtaaaatctcatatcaggtagggttggtcctgccagccagctcaaaaacgtaacatggaggtgtatttcttatactatacaattgtatgctaatcacatctggtttattcctgatcatcgtcagtccttcaaatactcacagacgatggaacgtaaggaacaaaacatggagtacacccttcattggttaggggcccaaagttgccagtaacgaggccttcaaggtccatggcgacgacgcgctcctccaagggttcccagacaacgacctctgcggcgccttgtgagcggagcaacatagcccttttgccaaccttctccccggagaatgagccgacaactgtccagagtgcagcaaccttatcatcaaacagtcgcttgtttattttaagcacgcccaatgtgaggaaaccgtcaacatccttgaagcaggtcacagtaagatctccctccatttgcccaagctcccatacggtatcttggtttaccactcgaggggcagggatgactttaaggaggtccttccccgggtcatagcagaggatagacccaagggaagtgcgccagaaggcgcagcccagtgtaccaacaccagactccgccttcacctccacagcaggaggggcatctttagcaatagtccacctcccagtcctggaggagtatgactcagatgtccagacgctgcccttgaggtggaaggcagcgacgacatgataatgctcaacagcaccgtcgaagcaggatgtcaggggttcctcgaatgtgatgacaactgctggttctccatgatcacaactgtggcgtggtagctgaacccacttgaaggtggtcgtgttggttacatagtacaagcctgttgtctttccacagacgcagacaaggccacgcgtggatgcaaggaaagatacgggctctggtaatgcagcaaagcgtgactcagggtaaagaagcttgccgcagcgtatggtgtcaaatgcgagatacccaggctccttacataatgtgttgaaaaagaagcctgagagcggcctgcacagcggtgagagaaaaatttaaaggaagagctacaaaatgacactagatgtttaaatcatcacaaaatagtcagtaaaggatctcctatatctaaggagaattgcatcaaatgctgatgtttaaaacatcacgaaatcaaatgagatgcagtagatctaaaaataactaccttgaagcggtactttccagtggagcatcctcatcacacagtttatttatcatcaattcatttctgaggacataaatatgagcaaaagcacaattgttagtggataacacatcaacaacattgcaatctgtgaccaacgaatagtgatcatataactgcagaaaaaaatcagctaaaaagcactacaaatttgttattctgttaaatatgtatgaaacaagtttagtaaatacacttacttttcaagcaaacttctcagcacatcctgtagaggtcctcctttcgagtttggagcaatttcaatgacctttccatccctaattatgttaccaatcgcagcagcttcaattgaagctaactgatactctaaataaacaaaaaaaataatgaaatgtaaatttataattagttcagatttcatcaatataaaatgcatacctgtccaattaattctacaagataaagcagcaacttccatctcatccagaatttcatcaatataaaatgcatacctgtccaattgattctagaagctaaagcagcaacttccatctcgtctagaatatcatcccttctgttagctctactttgaattatagcacaatttctgttagctctaccttgaattatagcacaattttctggagtgttaagaccacctatataaacaaaaatatataaataagattaacaaaacatacaaaatgggactatctatcctattcataccacaaaactagttaattaagtcgtatatcattgaacattgaaattaacatttatagcgcctcaattcaatccctttatcaactaacaatgagaaattgtgtcatgcttgcatcacaaacaaggccataatgttattttaccatgtcggtcaggaggcgacggcgcgggctccgaccgttccgtcgatgcgcctgtgccggcacaccgatgagacgtcggacgccggcggtcggacctcgatctgtcggtcaggaggcgacagcgcgggctccgaccgttccgccgatgcgcctgtgccggcgatatggacgtcaggaggccggcgtcggaggcccgtcgatgcccctgcgccgacgggcggcgggagaatgcccctgcgccggcggccggcaggatcgaagcgctccggcatcgtcgggaatgagcctggcggacggtcgctggcggctggaacggtgggagagaagagtgggtttttatagctatctattagggtttcttaataagcgctaataatcagaaaaaataatttacgacgctccattatccgaagcgttaggcgctaataagtaataaccaggaaaataatttatgagccccgctaatatcgaggtttatactccgtaccaagcaaggaaatgaatttaggttctgattgattcagcttagaattattataatttggattattagaagtaagttgaaacaaacatatagcttattatgatagattaatataatatactagtaaaagtgtccgtgcgttacaacgggaagcgtacagatcaaaaaatatgcaattatttaaaatacaaattcgttgaaatttttggtatttttaagtaggtatgtgtataattaaataaatttacaagtaaagcaaatgcgagaaataaaataacatggttaaatttaattttattaaattctccatgattagtcacactctttagaattttattggaattttcataacttaattgctaattttaataatacaaacatcatttaacaaattgtttaattggaaaaagaaagaaaatcctttcttttaggtttgattcgaaataaacacattcaataactataattgtaaatgcttctaaaaaaagaagcactaaaaatgaactacttctctttttcttcggctagagggacctaaaatagacttcttccagacccttgccggtcggcccacggccttttgcgcatgcgcgggtgcacttcccctccccaggccgcaaccttggcttgggccggaaaagtggcctcgctctcgatcccatttcgggccgaaatcggcccggtcgacgctgtccgtccgatctctagggttttgatcggacggccaagcctcgagatcggggaaacaaaaccccctcagccgccgaaactgatgaggacatcaacaccatcgatacatccacgtccccccatatacagcatgatggtcctattacccacgttcgtgcacgtcaactaaattatcaggtgagttctttcttgagttcatattcctcgtctttatacctcggagacgcgtgcactcgtgttttactcaggaacgatggagaggatccaaagggaagaggattcgcgcggggtggattcggactgcagggcagcgccaacttctgacggccgccacgacttcatgcgaactccgatttgggcgtgcaagtacttcatggaaagcttatcaagtctattttcaaatggatccagccacatgtccatatctgttctggagcggccgcaattgtcattttactcccgactattttttgtccatggtgctgcgtcacctcttttggcccaatgggctgtgtatccatgttgggcccattaggggcgcgtcctagggttggagcacgaccctatggtcgttcttcccctctttttatacctctagtcgccgccaagaacaggcaggttttgatgatagagatagcttcttgctaccggctcgcagcgcgcgtgttggctaaaccgcccgtctgcctgtaatcggaaccccaccatattgtgtttgatagtgaaactttcatctttatctagcaatctcagcgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggccgtgaacgtcgacttcatctaatcgagttatcccttacctctcatcgaaagatcgggccacaaaccctagcgggttcgcatcagaaaccctagcccatttccttcccacctatctctctcttcgccgccctcccctcagcgcctctgagcggcggcggcggtggtaccccacgagcagcggcgacggcgcccctcctcccgcgagcggtggcgactgcggcggcggtggcgcctctccccccgagcccaagcggcggcggcggcgccctcccctcgagcagcggcggcggcgacggcgcctctctcaccgagcccaagcggcagcggcggtgccctccccccgccagcggcgacgacggctcccccatcaccggcggtgcggccgtgtcctccctcaccaccggcagcgcggcgacgtcctcccccaccaccggcggcggcgcccggggaggcgtcggcggctcgccagcatcccaacggcggtggcgcccctcccctctgtcggatccagcgggaggggagctgcggcggcctggcgtccctatgacaacggcggcggttcgacggcgacttccccttcgatttttttttggatatatttgtgtgtataatacttcctccgattttattttatttgtgtgattgattgaattccgattaggatttttttttgggtggtggtgatggaattccaactgggatttggggggaggcgagggggacgaaaaatcactgcacctatgaggtgacgaccggaaaaatacgaatatttatattagttatagataagccagattaatataatctggtaagccactataaatgtgtttttttagattattgggtggctaacaactaacaaacagataataatccagagaaacaaacagctagcaacttattctatgttggcttattataatccagcttatagtaatctagttctataatctagattacaataatcttaagctgaaacaaacagggccttaatcgccgggatcgccattagtaatttaatcgcctggatccctattagagcaagtttaatagtatagccaactactggctccaaatcatctatagctaagagcaggtacaataccaggctataagctagctgt

SEQ ID NO: 17262 - DNA, 912 bp, Oryza sativa
  unsure (1)..(912): unsure at all n locations
gttcctccaggtgaatgtattagcatagctttatttaaattatctttaggtaaagactgatttcaactggcttttgcagataaaaaggaatgagaggcaccagaatcaaataaaacagtaactggtttagagtttatggtgaacatacccatcaatatattaggatcttgttgcgcttcttctgctttaatatgatgtacttgaccacgtccaagattaggtccactcttaataattggaggatttttctttataaaacctgtagcagatggtttctgataagaagtttggccacccatattttgacgattagggcaaagtcttgcaaaatgtccaattttcccacaaacataacatggagagtcttccatttttaatccaggtcttggtagtattggtggcatgcctggtcttgcattgggtaaagatggcttaaatagataaggcctccgaacttgtagtgaacccctagttggtgattgtcgttgtaaattcattcttctcttacgaagtccttcgaccattctacgatcattttctagcctaaccactttattgactaggctttgaaaattttcatgatcttgactaatcattggtcctcgaagttcatcacgtagtccttctataaacctttcaatcttttccttttcatcttgaatatcagaggcagcatattgagcaagttgcgtaaattattcaaatattcttgtactgtcataaagccttgcctcaatcttcgaaattcattctttttcattctaatcacagctgtaggtataaaagcatctctaaaagctgtagtaaattccatccatgtaataatatgtgtaggatcttctatagnnnnnnnnnnnnnnnnnnnnnnnnnnnnnnnnnnnnnnnnnnnnnnnnnnnnnnnnnnnnnnnnnn

SEQ ID NO: 17263 - DNA, 2953 bp, Oryza sativa
gtaactccttaatccaacgttgatatattggtattaacataataaaatggtggcccagcataagagaagagttatcattacagataagtaactccttgatataatagctaattttatactaaacatgatcaaatggataaggattactcgtgatgtgtagctaaatataggtggagaggaggggtacagatcacaaatgaacgcggataagtaaatgattcatccaacgtttgataagtaccccccctccccaaggtagcgacagcaacactatggaaaacgctttatatcgcacgtccgacgaaacagaaatatcggacgcctcatctaccacactaaaaatgctgcaaatcagcggcctgatggatcggacgaaccctatcactgtaacatgtatgcctagctatttcttttcattctttcctcctctctttaaatattttttcttctaaattacttatccaatctacgaaccaatcacactattgtattcgttgcaattaaatatttacaacaagatatcatataattatattatgtcaaaagaaaaacatgtgtttcaaaccgttaaaactaaatgtttcatgcgtgatagtgatatgtttcaatgtgcgtcttccgtgtgtttcataaagagcaatgctacacgtactaaatttttctgactaaacttttactaacaatcatttcaaccgtttgatttaagtagatagaagttataaaaaaatctagatgcactcatagcatgacacatcagtattagtaagaatttagtaagaaaaagttagtacgtatagccttttcctttcataaattttttgaaactaactgctactactttctctccatctcatccatgcacacatgcatgtattttagcaaacttcaaaataatttttctcttaaattatttatccaatctatgatccgatcgcaccattgtattcgttttaattaaatctttacaacaagatattgcatgattatattttgttgaaagaaaaacacatgtatccgttaatacttgctgtttcatatgtgacagcgacctgtttcaacgtgcatcttcaccatgtttcataaaatatttaaatgtttcagttgctgatttttttgtttcaccatatataacttaatgtttgacttgttggccaactgcaatatttgaccatccgtttttttttcatcggacgtccgatgggtagctttctcccaacactacgagtcaactacccatcccagtgccatccatccatacatcatcgtctcctccgaccacagatcacacacacccaaaaaaaacaaatactccctctgtttcacaatggaagactttctagcattacccacattcatatagatgtgtctcgattcactaacatctatatgaatatggacaatactagaaagtcttacattgtgaaacgaagtagtagccacgagctcttttttctcgcggccattcttggctgcctcggttgctacctcctgcatgtgccgcgcaatggaaatgaggcctcgtgatctcgccgccgtcctgggtatgtcctgcctattgctcctcccactactcgtctcctcggtgcccgtgtcgggtaaagcttcgtcgtcatagatctcctggaattcttgatatgtgttttgactagttgataattataatttgcgtgtcgatgcgttcttgcaggaatcgtgcacttgagcagccaacaacaacacccgtcatctcgaaacatctatgcagatgtagttaatctttctcatgtccttcaatttctgaattcccgtaagatttaaattaatttgttggcatgttactacaaaatctcgtagacagttcatagccacctttacaaaccaattctaaaatgaatatgtactttctgaaggctaaattctgaaacaattagtaatgttggtgatagtgattctgaacatggctttgtgtatgtccatgcagggatatggtggcagcggcgacggacgtggaggtgaatgactatccagcgctaagagccaatcctcgccataaccctaaacgtccactggggagagaaatgtccgtccaggacatggtggcggcaacgacgaatgcggaggtgaatgactacccgacgccaggagccaaccaccgccataaccctaaacgtccaccaagaagagaatgaaatcaatcaagctactactggaactagctagcatgtagttctgcattatttctgctagatgtcagtgactctcagaattaataaagtatataattacataagtcaagtgcactattacgaaacaagattttttttcgaggtggtcaaaacgcgatttgcacatggccacacaccctgcctatgattgaaggcttgagaagatctacagttttcgaaggcaagcatcctaagagacccacttgcaaaaatcaattttttataggtggcacacttaatttacccacatacaaaaagaatttctagtgtaaaaaatgaaaatctagattttaatatcctccaatttgaaaatcagaatgcaattccaccatcacaaatttaaaaaagaattgacatatcaaatgcaattccgccaagaacttcgtcggtggcatcccagtggcagagtcatcctttgcgcagtggcagagtcatcctttgcagtgtctttttcagggagaagccgatgcagcacaccatcactggcgttgacggtggaaggcgaatgccagccgcaatgaggtctgcattattttggtcaaaacaatatatgtcacggggaggtggaactataaaggtcatgagaagatgctactatcaaggtattattaaggaaaaagcccaaattagccccctaaactattgtggcagttgaaattaccccctcaattcaaaaactgcaccctcaactttttatatggacgaattacccctgacaaacttcggaacagttttggtcttacgtgtcg

SEQ ID NO: 17264 - DNA, 2787 bp, Oryza sativa
cagtagaagagatgactaatgagcacatataagtaactccttaatcaaatggttgactgttttatactaacatattcaaatggcttagataagagacgaccggtaaatatagatatgcaactcctctatccaacggttcataatatcatactgacataatcaaatatgtttcgatttacttgtgatgtgtatctaattgaaggtggagagaaggggtagaaattactaaaaattaatgtggataagtaactgccttatccaatgattgatgattttatactaacatgataaaatggcatagtatgattcatgatgtgtatttggataatggtgtcgaggaggggtaaggatgactaatgaatggggataagtatctccttgatccatcggttgatatatttgtattaacataatgaaatggttcggcataagaggcaacttataattacggataagtaactccttgatctaacaactagttttatgctaacatgatcaattggataaggattactcatgatgtgtagctaaatataggtggagaggaggggctaaggagatcacagatgaatgttgataagtaaatgcttcatccaacgtttgataagtaccccaaggcagcggcagcaacactgcgagtccactactcatcccagtgccatcaatccatccatcattgtctcctcctaacacagatcacactacacaaagaacaacaagtagccacgagctcttctttcttgcagccgttcttggctgcctcggttgctacccctgatgcgccgcgtaatggaaatgaggtctcgtgatctcgtcgccgtcttggctatgtccagcctactccttctcccactactcgtctcctcggtgcccatgtcgggtaagcttcgtcgtcattgatctcctggagttcttgatatgtgtttttactatatgctaattataatttgtgccttgattcattcttgcaggaagcctgcacttgagcagccaacagcaacacctgtcgtctccaaacatctctgcagatgtagttaatctttctcaagtcctccaatctctatattcccctaatatttaaatttgccggcctgttaataaaatatcatagacagttcatagctaccttcacaaaccaattctaaaatgaatatgtacgttctggaggctaaatactgaaacaaatagtaatgttgatagtgattctgaacatggctttgtgtatgtccgtgcaggacatggtggcggcgacgacgacggacgtggaggtgaatgactacccagcgccaggagccaatccccgccataaccctaaacgtccaccaggaagagaaatgtccgtccagggcatggtggcggcggcaacgaataatgtggaggtgaatgactacccggcgccgggagccaacccccgccataaccctaaaagtccaccagggagagaaatgtccgtccagggcatggtggcagcggcgacggacgtggaggtgaatgactacccagcgccaggagccaatccccgccataaccctaaacgtccaccagggagagaaatgtccgtccagggcatggtggcggcgacgaccgatgtggaggtgaatgactacctggcgccaggagccaacccccgccataaccctaaacgtccacctgggagagaatgaaatcaatcaagctgctgctggaactagctagcttgtagtttcgcattatctctgctagttgtcagcaactctcataattaataaagtatctaattacataagttgagtgcactactacaaatcaagatttttcgaggtggccaaaatgcaattttgcacattgccagacgccccgtctgcgattgaaggcttgtgaaaatcgacggttttcaaaggtgggcaccctaagagatccgcttgtgaaaattgatttttcacaggcgacatgcttaattcacccacatgcaaaaataatttctagtgtaaaaaaaaagaaaatccagatttgaatatcctctaataagaaaattcacagttcaattccaccatcacaaatttaaaaaacatttggcatgtcaaatgcaattccaaaaagggctttgtcgtcgtatcccagcgtcggagtcatcctctgcagcgtcttcttcagggagaagccgacacagcacaccatcattggcattggcgaggcagggcgaatgccacctgacggagcgtggggctcctcaccgggagaccgcgcaggtccccctttgccggttcggccgggggcgctaagtgaggttcttcgccctcgatctgaggaacgtcagcgagagaggaagtgcacaagacacgagcgacgtagacaggttcgggccgctgagaagcgtaacacccaactcctgtgttctggtggatctgtgtgtgaaggaatacaaagagccagagagcgagagagagttcaggctctagaaccccttcgctagagtcccaacccctctttctcttttttctctttttttcccctcctaggcctgggcctccttttgatctggtcaggggtcaccacatgggcctctagctgcctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcactgaagcctggaatggatctgaccgggactgacataccaactccaggagttagcaccccggctccggctagggac

SEQ ID NO: 17265 - DNA, 16603 bp, Oryza sativa
  unsure (1)..(16603): unsure at all n locations
ccccccccccccccgacggggtcaggccacgtgggtgaccgcggctacccaagcctctagtcacgatacccccggccccatgtcaccgacagtagcccccggcgttacgccatggtgatcgcccccctcgagggaagcgctcgggcgtgacgccactccttaggcccggtgacaggtggggccggtccctacaggtgggcagaaacccagcggtcgcaaatcgcgcgcatcggcaagggaaaaccgaccgacaataatgagcggcctctttaagaccgctacattactcgagcagcgcgcgaatcggaacgagccggctcgtttcgcctggagacatgatgatggcgcttttcacggttggcgagcgtagttaatgcgcgcacgatctgccccatctcaaccgccacggccgcacatctgccgcgtgcgccgcaaacgggcgagtggggttagtggaggcgtgggcgcgagaaacgagggggcgaggtagtgggcgcgggaagcgaggagccgggcatagcgttggcaagggtgtaaagacgccgaggaagggattcgtttccttcctctcgctactcttccccttgccttcgccacttgcgctctaactcttcgtttcctgtgccctacccttgccgcactcgctcgctctcaagctcctcctccgccggcgtcatggcacggggctccgcaccgctcgacggtagcgtgctgccgccttcccgcatcgtaagcgagaggcaggccgggctgccgcgccgattcatgccggaatctgccaccggccgggaggtggtcgcgctgggcgagggacgcccggcgccacactacccggggcggtccgtcttcttcctctctttcgcaatggcggggctggtcccgccattctctatttttttcatggatattctggagttttatgatctgcagatggcgcacctcacccccaacgcgataatgacgttggccatcttcgcgcacctgtgcgagatgtttatcggggtgcgcccatctctccgactgttccggtggttcttcaccgtacagccggtgtcgccgccgacggtagtcggtggctgctacttccagccgcgggggcaggtgctgaaccgctacattccctgcgtcctccgcaaaaagtgggacgactggaagagcgattggttctacacccccctcgccgacgaagcgcgcctccgacttccgagccagcccccggcgcaggcctccagctggcgggcggcggtagatctgggagacggctacgacgccgttcttgaccgcctggtgggtctgcgatcccaggggctcacgggggccatggtgttcggcgactaccttcgtcgccggatcgcgccgctccagcggcgcgcccggggcgcctgggagtacaccgggcccgaggactacatgaggacccaccaggggcgcaaatgggactgggaccctgaggacttcaggatggtgatccaacgggtgctgaatctcagctccgtggaggcatccctcatcccccaaggggtcctccccctctgctgcgatccagagcgcgccaagatcctggccataatgcaggtggtcggggcgtcgggggagcgggccccccgaggccacgatggcgcgggcgggagccgcaggggggaacaatctaccccgggagggggtcgtgcttctgggccccttgacgggggcccggggggcagccgccctgccgacgcccgggggaagaggaagcaggagggtacccctcccccatctcctccccgagggggcggggcggtgcgtgccagcagcaggcgcccggagggtgccctgccgacgccacagcccgagggggagcgaaagaagaaacggctccgcaagatgggggggaccgagccatgccgggggaacctcatctcgcccccgaggtggtcgtttagccgacctccccgcaggttcgtccccgcacccaccgcggccgtattcattctcccatctcccaaggcgagttttcactcacccgtttctttttgtcttctggtttttcttctgcctcagcgagatcccgtcgcgccccccccccctccccccccgccattccaagtccagccggtctgaggccgaggagacggcgaccgcggaggcccggaggcgggaagctgaccagcgagaagccgcggaccgcctccgggaagccgaggaggctgcccaagaggccgtccgggttcgccaggctgaggaggccgctcgggaggaggccagactccgccgggccggggagtccgtccgggaggcagaggcggcccgcgcgcgccaggcgacctgccaagcccccgacccgactccgcccgaggcgacgacgacttccgaggctacccacgacgaggccgcgggcgcgccgctcgggcccgacccctcgggcgacgcttgggacaagccagcttcgggggacgccctcgagtccagctcgtcgatcggcgggccgagccgcgcggcacccacaccgaggcggctctcccctctgccttccgctgccccactgagcgcggagcccctcctgcaggccttggccgccgcgaacagcacggtgctggacgggttaagtgcccagatggaggccctgcaggcggagcgggcggagctcgacgcggcgtgggcgcgtgtcgaggaggggcggcgctcggtggaggccatggtggaggcgggccgcaaggcacaccgccggcacgcctcacagctcgaggcccgtcgtagggacctggcggagatcgccagggaggtggaggaggagcgggagactgccctcatcgccaccgccgtgcttgacgaggcgcgggacgacctccgcctccaatacgggagccgggcggcggagctagaggagaagctcgacgccgcccggggagtccttgacgccgccgctgcccgggaacggcgggcggcggagaacgaggcggcgtcccggcagcgcgaagaggcccttgaggctcgcgccacggcactggaggagcgcgcccacgccctggacgtgaaggagagagacctggcggaccgcgaggccgccgttgccacccgggaggcaacactggcggcgcacgaggccgcctgcgccgaagaggagtccggactctgcctccgcgaggacgcgctcaccgagcgggggcaagctctcgaggaggccgaggccgcggcgcagcggctggcggacagcctgttcctccgcgaggcagcgcgggaggagcaggcgcgccgcaatctggaaggcgcccgcgccgagagggccgcactggatcagcgggccgctgagctcgaggcgcgggcaaaggagctggacgcgagagcgcacagcggcggggcggccgcgggccacggcgacctagccgcatgcctcgcagccgctgaacacaccatcgccgagctgcagggcgcgctggactcgtccgccggggaggtcgaggccctccgcatggcgagcgaggtagggcccggcatgcttcgggacgccgtctcccatctagaccgcgccgggcggcaggcggacctctgggcgggcggtacgcgaagtacgccgccaaccaggggggcctcgcccagcgcctctcagagatggccggggccctcgagcggctccccgaggagctcgaggagacgatcaagtcatcctcgagggacctcgcccggggggcggtggagctcgtactggcaagctaccaggccagggaccctgacttctccccatgggcagcgctggaagagttccctcctggaaccgaggacggcgcgcgcgcgcaggtccgggacgccgctgaccacatcgtccacagcttcgagggtacggcccctcggctcgcattcgcgctcgactccgacgaggagggcggtgacgacggtgcggacgacagcgacgacgaggccggcgacccgggcgcgtcggagtgagcccccaggcccccgccaatcttaataacttttccttcttcttccgaggccttcgggcccccttcttgtatagactgatttaatctgcaatcaagtaaagaggaaatttctgcgtcagttctgtttgttgtgtgtatgagacgaggatggtttgtgccgcggtccttctgtgtcttggcttgaacaagggctcgtgcccaggtcccagcctcaaacggcgcgggtcggggctagtgcctggggagatcctcgtgtcgagactggccaggccgggagcgcggtgaccgagggttatggatgacccgattgtgggcctttgccgattcccccccggagttcaccacgccccggggcacggctcggttctgggccccggttggcgattttagccggctcgggccaccgagggcagggtcgagcacgagcgtgctaattcaagccaagattcttcaaaaggaaacgatggcacaaacacagtcctcaggaaatcaaaaatgcttttattgaaatacggaagagaaaaaaggtaagtatatgcatgtggtagcccccggccaaccctgcacgcccgggggggtgcggggttggcccgagcctgagacatgacacccgacccccactaggggtagaagcgacgaaggtgctcgatgttccacgggttaggcagctctgtgccgtcgcccgtggccagccgaacggagcccggccgggggacgccgatcactcgatacggaccctcccacattggtgagagcttgctagtccagcacgcgtttggacgcggcgtaggacgaggtcgtcaacgcagagtgatcgggtccggacgtggcgctgatggtagcgccgcaggctctgctggtagcgcgcggctcggagggccgcgcgccgccttcgctcttccagatagtcgaggtcgtctcgacgaagctaatcttgatcagcctcgcaatacatggtgacccgaggggacctcagggtgagctcagatgggaggaccgcctccgcgccgtagacgaggaagaaaggcgtttccccggttgctcggcttggcgtggttcggttcgcccagagcaccgctggcagttcctcgatccacgagtcgccgtgcttcttgaggatgttgaaggtcttggttttgaggcccttgaggatttccgcgttggcgcgctccacttggccattgcttctggggtgggcgggggaggcgaagcagagcttgatgcccatgtgttcgcagtagtcaccgaagagctcactagtgaactgggtgccgttatccgtaatgatacggttaggcaccccaaaccgagcagtgatgcccctgatgaatttaagcgcggagtgcttatcgatcttgatgaccggataagcctcgggccacttagtgaacttgtcgacagcaacatacagatactcgaacccgcccggggcccgcctgaacggacccaggatatcgagcccccagacagcaaacggccacgaaagaggtatggtctgcagggcctgggccggctgatgggtttgcctggcgtggaactggcacgccctgcaccgccggaccaggtcgaccgcatcgctgagagccgtcggccaatagaaaccctggcgaaaggccttgccaaccaaggtgcgtgaggcggagtgggctccgcactcgccttcatggacatcggcaagaagctcgacgccttgttcccgaggaatgcacttcaggaggactccgttagccgcgcgccgatagagggtcccttccaccagcacgtagcgcttggagatgcgccggacgcgttcactcctttcgcggtcctcgggtagagtctcatctgcgaggtacgcctggatctcagtgatccaagcaatcaatctaggggagctgggagcgctcccctcgggtcccgaggcttggactccgacgggccgtgggggccgttcaggcgcgtccgtctcccctagggggtcgggtcgcgccgacggctgggcaagcctttcttcaaaggcgcccggtggggtctgggctcgcgaggaagcgagccttgagagttcgtcggcgaccgcgttatcccgtctgggcatgtgccaaagctctatcccgtcgaaatggcgctccatacgccgtacctggcgcacgtaagcgtccatctgcgggtcagagcactggtactccttacagacctggttaacgaccaactgggagtcgcctaacaccaggaggcggcggatccccagtccagctgccactctgagtcccgcaaggagtccctcgtactccgccatattgttggtcgcccgaaagtcgaggcggaccaggtatctgaggacgtctccgctcggcgaggtcaacgtgacccccgcacaggcgccctgaagagacagggaaccgtcgaactgcatcacccagtaggcggtgtgaggcagctgcgaggggcccgagctggcctcgggggcggagacgggctcgggagctggggtccactccgccacaaagtcggcgagggcctggctcttgatcgcgtggcgtggttcaaagcgcaaatcgaattcagagagttcgattgcccatctcaccacccgtccagtaccctctcggttatgcaagatttggccgagggggtaagacgtaaccaccgtgacccgatgcgcctggaaataatggcgcaacttcctcgaagccatcagaatagcgtaaagcatcttctgggcctgagggtatcgggtcttggcgtcccggagggcctcactaacgaagtagatgggccgctgcacctttcggcggggccgatcctcttcgccaggggccgcatctccagggcgctcttcgtctgagaggccacgcggggcgcactcggcttctgtgccgacgacctcggggtcagagggcgacaggcgcggccttcccgcagtggccctggggccatcctgggggtcgggggtgcctggcaccgtcggacaagcaggtggagggccagctccggccgtcgggggccttgggccgccgtttggctcgggggcctctcctccctgctctctcccgggtcgagccgatacagggtggggatgcgcggagtgagggttgtcctcgtcgcgctccacgaccaatgccgcgctgaccacctgcggggttgccgccaggtagagtagcaacggctcatctggcttcggggcgaccaggaccgggggagaactgatgtacgccttcaactgagtgaaggcccgctcagcctcctccgtccaggtaaacggcccggagcgtttgaggagcttaaataagggtagtgccttctctcccagcctcgatatgaaccgacttagggcggccatgcagccggtgatgcactgcacatccctaagcttgctggtggggcgcatccgctctatagctcgtatcttctcggggttggcctcgatgcctcgggcagagaccaagaacccgagaagcttgcccgcaggcacgccgaacacgcacttatcggggttcagctttatgcgggcggagcggagactttcgaaagtttccgctagatccgagagtaaggtatcttggttgcgcgacttcacaaccaagtcatcaacataggcctcaacattgcgtcctatctggctactcaaagaaattcgagtagtacgttgaaaagtaggacctgcattctttaacccgaaaggcattgtcgtataacaataagttcctatgggggtaatgaatgcagttttttcctcatcctccctagccatgcgactctgatgataaccagagtatgcatctagaaaacacaaaaggtcgcaccccgcggtggagtcgacaatctgatctatgcgtggcagggggtaagggtccttaggacatgccttgttaaggtcggtgtagtcgatgcacatccgaagcttgccgttcgccttgggaacgacgaccgggttcgccagccactccggatggatgacctctcacggatgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccgccggtctccaggcgaagacgtcggcgtttgcccgcaggaaggagacgagcgcgtcttcctatttgtcgtccagaagaccaccgattcgtgtggtcttggacgggccatcgcccagggcaacctccttgaccgggacctcgtcgcacgtgaccatccgctgccttggggcggccgggacggaggtgctgagcctctcgtcgccacccgcgggcttggacgccgcggcgaggtggtctgcgcgctgctccatacaagcaagcgcgactttgaggtcgccatggacggtgatggggccaccggggcccgacatcttcatctggagataggcgtagtggaccgccgccatgaacttcaccaacgcgggcctcccaggaccgcgttgtagggcagactgaggtccgccacatcgaagtccacccgctccgtgcggaagttggcggaaccaccgaaggtgaccgggaggtcgatatgacccagcggccaggtgtgccccggcgtcacaccgatgatcggctgggacggccggagcaccatccccggggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcggtctagtcaaaggtgagggcaacctccgaccaccgcacccgccgtgtcgcctcatgggtaggggccgcagccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcgccggttgccggcgggagccgccggggtcttgccctcacggcgctcctgtctcttctcctcctcccacttcctcgtccgctcagccaaacttttgaccgcgcggcagtccgcgaggtcgtggagggaggtgttgtgcacggtacaccacttgccggtcgggcgctccctgctgggagcgccggcctccttctttttgtcgctcgcaggcctcccctttcggggggcccgcgaagcgccctcgacggcgaggacatgaccctcgtcgtcggaacgggccgaccccttcttcctcctcctgtcccgccgccctgaccgagcggcggacccgggggcggccggagctgccacaccagaaccggaggagttccaggcccaggcctcctccttgcgagccacacggtccgcgagctcaaaaagctacgcggtggtctggggctccttggaggcgatcttctcgagcatgcggttgtgccgcacgccccccctgaacgcgtagatcaccgcgtgtgcggggatgcacggtatggtgttgcggacttgacagaaccgctgaatgtacgagcgaagagactcatcgtcccttcgctgtaccgcatgcaagtccgcttcttcgcctgggcgcggatatatgccctggaagttcgtggtgaactactggcacaaatcctcccaagagtggaccgacgcgggtggcaagttcattagccaaccccgcgcctgacccttcagggccatggggaagaaattcgccatgaccctgtcgtcacccccggcggcctcgatcccggtcgtgtagatctggagaaactcggcggggttgacgcttccatcgtatttttcggtgatggtgggccggaaccttgggggccaacggacgttccgaaggctcgacagccggcaccgccaaccggggacacggggggccggcccccgtgtccggaccgaagtggcgctccggacgaggaagcgccctccgttggttggggggcgcgacgaacgtcgcgccggcgctcgatatcgaggcgggcatccggccccccacgcacatcttcttgggtcggaggcgttgacgagggaatggcggacgaacggcgggttacggccgccgctcgccgcgccctccgcctcgacgacatggagccggcggcggcagcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcacccgcagcctggagcgcgccctggggcgtgccgccatcgccgtagacgaggcagcgacgcgccccgtctcgccgtcctcccccgtcgcccgcgggcggcgaagtcacggatcctccgacctccccgagcgcctccccccgcccaagatttcggcgagagggggacggtggggtgcgagcccgacggcgcgggttctgctccccgtcgtcaccgctagcgttcggagagaggctgtgcgccactgcccgtccggccattgggctgagcgggagaagcttggcgcacacgaaagaggacgagggcttagaaagacacgcgcaccccctacctggcgcgccagatgacggagcgtggggctcctcaccgggagaccgcgcaggcccccctttgccggttcggccgggggcgctaagtgaggttcttcgccctcgatctgaggaacgtcagcgagagaggaagtgcacaagacacgggcgacgtagacaggttcgggccgctgagaagcgtaacaccctactcctgtgttctggtggatctgtgtgtgaaggaatacaaagagccggagagcgagagagagttcaggctctagaaccccttcgctagagtcccaacccctctttctcttttttctctttttttcccctcctaggcctgggcctccttttgatctggtcaggggtcaccacatgggcctctagctgcctaagaaaggaaacatgctttttacaatgagggctagtctacagccggaagtgacctctgacaagcagagcacacgcctcctgccccgcttgccagctttcccggtggacgcccatttcaaccttcattcaatggccagcgacttccttgccatgcttgcactgaagcctggaatggatctgaccgggactgacataccaactccaggagttagcacgccggctccggctagggacgagagccaggaagctctcatcattccgacgggacggggcgaggcgtgtgacaggccgcctgttgccacctaacccgcgatctgactggtctgtgaccggtcacacaccgcgaccggtcacggaccggataagcgtgcgctgcgccgcattaaatgcggcgtggcgcgttcgtccatcctgctataaatgcggttaggtgagccccgctgtgctcacctaacccacacacgtggcgccaaaaccacagggggtcggggcgccccagccctcggggccgaaacgggggcgccccagccctcggggccgaaacgggagcggcccgacccctcggggagacagagggaggggtggccacgtcaccctcgggcccgaccccccccccccccgagggggtcaggccacgtgggtgaccgcggctacccaagcctctagtcacgatacccccggccccatgtcaccgacaccacccataaagaggtctaaattattttggtcagaactatattggtcacgagaaggtggtattatataggtcatgaggaggtgttaccatatagttattattaaaggtagagaggagaggatgagatgactaagaaatacagataagtaactccttgattattttatactaacatgatcaaatgacaggttactcatgatgtgtattagttaaaggtagataagaggggtagagatgactaatgagtacgaataaataactccttaatcaaatggttgactgttttatactaccataatcgaatggcttaggataagagacgactagtaaatatgtatatgcaactcctctatccaacggttaatcaaatatgtatctaattaaaggtggagagaaggggtagaaattactaaaatgtaatgtggataagtaactcccttatccaatggttgatgattttatactagcatgatcaaatggcttagtatgattcatgatgtgtatttggataaaggcgtcaaggagggatggggatgactaatgaatggggataagtatctccttgatccaacggttgatatatttgtactaacattatcaaatggctcaagataagagatgacttataattgcggagaagtaactccttgacccaacaactaattttatactaacattatcgaaggagcgattctctggcagcggggaagtgtagacccctccccaaaaataaagatccgaccaggagctagttgcgcacgatgctccagaaaacaagtttgtggggcccgagcaccccaccaagcatatgaacacaagatatttatacaggttcaggccactcagaggtgtaatacgctactcatgttctttttgttggtatctatatctggagaaatacaaactttgcctttttcaaaccagacacaagttagcccttttttctagcatgtcccttttctattatagtacaaggaggggctcacggtgctaccattctacatcctttttgcattgtcattcaaccgtcttgtcaatgccgtttggtttccttcaaatgtccccgagaaacctacctaaaaaataagattatagtgccccaggctccaagaataagatgaagtataaaaccatttctctgcttccaaatgtgccaagcaccatataaaaatttctccacaaaatgagatgaagtatatgaagcttttgctgcttgaagcatatctcccaaattgaaattctagtgccagactataaccacctgaagccaacattctttgctgaatgcacattcaaagaagagataaaagaaagtttgtattcctgtcacatagggcacaaattaattcacttcttcctagggcacattcaaagtccctggcctatccccttccacctagggatgaaaatggagcggatagtttccgtccattccaaagaaaaatagggatggcaacggggcggggcagagccgggttgggttgtaacggccccgctcccgctccattgcgggtccacccggcctaggccctgaagtggaggatgggtcgaaattaatccccaccgccggcccccccgaggccccgccactcgaccgggggcccgctgcacctgcaggagaggattcttggaggaggcggctggtggatgcgccgtcgtgtgacaggaggaggaggcgccgccaagcggaggcggcggcagcggtggcgcggcgacgaacaatgacagcgtggcaacgagcagaggcggaggcaagaggcagcgcgacgatgagcagaggcggagtggaaacaacggcgatgagcggaggtggaggtgacgcggtgacagccagccagcggcagctgtggaggatgggtgaggggagtgggagtaggggatgggggattgggagattaggatttaccttttatatgtctcacttactaggccaactgggcttgtattgttggaatggactacattttgagacatatctcatatcccgaggccccatcaggtcacacgcaaccgcgcaggtggtttacaatccctgccccagccccggaaatttgcggggccccgtccccgctcaaccccgggtgaaaatcatccctccccccaacccaccgtggccctatagggtccctggccccaatggggaaattgccacccccagagaaaaatgaatacagataccttccggagcggatagtttggatacatatattttcttccggataagaatacggatattgttaaggttatagataaggcatatcctatgatcttgggttaagctcggcaggacctaccatataccaagggcctgtttgggggagcttaagattctgagaagcagctgctgataagctagctggtgagaatctggagaaggtaggaaacccagcttctgggcttctagttcaattttcaaaattttataactacagattttcataatctgggtaaaaactggactgtttgggggancttntgncaactaaagattctaggagaacctgcaactggtaaaactcccccaaacaggccccaagtcttatacgaaatcatgcctcgcatacggaaggtgttccagataaggaagaagaagcagggtttaatattggaaactataaggagtactcagattgtatacattcttgtttccctagttctacatggacaagggaacatttgggtataaatacaagatccctgggaggagaaagtggaggcccaatcatcaatacacgccgccagacacaaacacagagataagcctagatatacccaatctggagccgcagaggctgacaagagggatctagtgttatctctgatctcgccaagttcatgttcgaggaagaagactacctgtcatcgaccatgtgtggagatccacgccatcaagttgacgatggctagataggttagcccaaatattatacttactagaaaaaatgcatgtgtgtcccaaatattcgcatggattttttttaaagaaaatcatgagctgcaattaggagttcaactttcgtctcaagttagcatccaagtttctttataaaaagtttcttatacaatttcttttgtattttcaaaagcgaatgaacttaaaaaccgactcaaacaataataatgcactaaagtactggcaaaagcatctttgatttttataatagtagagaagagatgccacgctattgtctcccatcagtaattttcagtttttatttcttttcacgataacaggaggtgaacagatatatttgctcgttgggatctattaattatacttgactgggctgaaaaagaaacgatgcagcgatgcacaggcaggccatctccatcagtatttccttccaatctaaccaggcgcacacctctcccatcgccacggagtacaagccaagtccatctcgcttgatcgtggcaacagtaaaaccgaatcggagggggcaaatgtgctgcagacgaagcaaaagtgaaacgcatgcgagcgcaggaaaaaaaaagcaacggaagcgtttggattcatgtcggcaatctttgaatcggtgatacccgacgtatcaaagctatagaacatcttttataatactctctccattttttaatatataacgtcgttgactttttcttatatatttgaccattcgttttatttaaaaattttatgcaaatgtataaaatataaatcacacttaaaatactatgagtgataaaacaactcataacaaaataaattataattacgtaattttttaataagataaatggtcaaacatgtgagaaaaagtcaacggcgtcatctattaaaaaacggaggtagtagtagagaagagatatagatagagatagagatagagatagagaagtagaggtagagaagacatagagacaataaatataataaaaaatgaagattagaaaaccaacttaaaaactaatttaaacacggatgaaatactaaaatcccggtgaaaatatcagtagagaagagatagagatatactactatataattcacgttgcaaatctgaaaaacgaagtacgtccatggctgctggacagctcgatcgatcggcacgtaccaagaaaatgtaagactcaaactccaaactgtcgtacatatatacgtgtatgtgacctcatcggcataaacaaattcgacgtccacgacacctcaccgtattcgtatttgatacaaatagttaattaattttcagcgatataaacggaccaaatggttaagcgactaaaaactcactcaaatacggataatgaacaaaaatctcgacaaaaacatctttaaattttataatagtaaagatgtgatacagatatataagagcatcattggcttcagccaacaggagtagagctattacctatcagttaagagatccgaacttgtataaaaattcttttatccatctctttatctcaatatcgtgtatatattggtcccaacgatcatcatactatgtaaatattgtagtcacgacctattccgccgatagatatggtatcggggtttccgacagataaggatattcgatgaccagtgctattcggatatctgctgaagtcgtgagacatacaccatttctttataactctacgaccttcaatctacctttttagattttaatagtagctcatctcttaacactaatacacactattaatattatttaaacttttaaatattttttataaattatactatattttatataaaacaagctaattatatatgatgatatttgtttttattagaagttaaggtggttttcatgttccaagaaaaaaaaaatatttccgtattcgtgtccgatcatattcaatcgttatttgtattcaagataattcatatttattttcgtatccgagctattcgtattcgttttcatatctagcaaaaaaaaatgaaaacaaatatgatatgagcattacccgtctatattcgctccattttcatcc

SEQ ID NO: 17266 - DNA, 691 bp, Oryza sativa
tcatgtaagtggctgataggtttccagttttccgctctagggctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagccgtttttgctcacggatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaaggcgtggcaagccaacgttaagctgttgagtcgttttaagtgtaattcggggcagaattggtaaagagagtcgtgtaaaatatcgagttcgcacattttgttgtctgattatcgatttttggcgaaaccatttgatcatatgacaagatgtgtatctaccttaacttaatgatt

SEQ ID NO: 17267 - DNA, 894 bp, Oryza sativa
attattgcattattgcttggcacatggacatcacaccatttctttaaatttgtgtggaggaaacccagtagtcccagaagtatttggggacctattttgggttaattgcttgaaactctcatatactggtgatgaatttagatatagtttagatacagcgtgtggataattaaaatgtcccttttttatagtaatcttgaaaacttcacttggattccaaagattctaatatctgatatgatggtaaatttcttgatactggatgaaaatttggaagtttatcacattgtatgttttatcagttaagagagttgtatttgtctacgcaatatacattattatttggaaagaaacattgtttacacatcagattgagctgcattttatcaatcctgattggagatgctgtatttaacggactgcaaacacagtatattttgcaaagtgaacttatcagaccatttcctcatttttcctaattgcatttctatcaccaggttttgcagtccagagagctttagcaaacgcatgcatgagatatcattggattctgatggcaagaggctgttggttacatcgggtcttgtccgggctcctatatatcaggtctccacaatcacccaaacttccaggttcattttgcagaagtgataccaatgcaaatcatctataatttttcctcaggtacaaggccatgaaagtgggctgaggacacttgctcatagtgcatctattacaagtgtggattggcacccgacgctaccaatgtacattactgggtctgcagacaactctgtccgggtcacatccattgtatgaatcaatctgtgagtgtgacaggcagattgctctcgaggccttgttgatttctcgatgcaaccacatacgccattc

SEQ ID NO: 17268 - DNA, 5522 bp, Oryza sativa
acataaaagattaagataactatcacatcgcctaataaaacaactgttacaatgttttgctggttacgcaaaattatgccttaaggacttggatgtttggtctataacagaagaaataaattataaactcgcacagaaaagaataagcttcgctatcacttactccctcgttccaaaatataagcatttccgttcaggtaaatagtcagaaatgcttatattttggaacagatggaatagatagttgttttgctcagaagtttgaactttgctcaaactatgtgtaaaacaatggagctttatacataccttttgcaagagatattgtataggatgaaacataactttggtagtttccttaaaaaaaaaactttaaaacatagctttggtagttcagttgaacacgcagcctatcacaaataaaaaaattcgacagaacataataacatttaatttgggttatatgaaagctactacatggcttaaattacaaaccaagaaatataattggaaggtttcgaccagtttatcaatgttaacatgtatatcatatggacaagaagtgccatgcaataaaaaagaaacctcataattacaaataggaactcgaatattgtacacattaaagggcaattaacagatagcctgtatctaggtgttagcatgttgcacgcagagaaatcgcatccatttaatgcgtacaatgaactcaacaggtagtcatatatttccttttgcccatttgctgtcacccggtcaccccaccatctccctctccaaattctaatccgaatacctattccctttatgatttgtatcccatcatggcattgcatgccttacctacataaacacatagatatgattccaaacttgtaggaagctctaatatcaacacttcggtgcttaccagtaaaagcattttttacattgtcatacttcataccaaaacataacatgcatcagacatgtaaatagaaaaaaaaaactcgatctattattctcttgcaaatgctagtaagatattactctgacaaggcatgtgcaatcatactattaaatatccttgatctttctttcgtaactacctcagcaaatgtgcggcagaattcgaagaactgaagtgcaagaccaacatcttcaggctcccactctgcaccggcaacactagtgactggagtgcccttgggcagaacaacttgttccttgggagcatcagggctttcatccttcgtcagagccacaccattacccaccttcctgcttctcttctgcttcttcactggagcagcattgaaatcaatgcatacattctcatccccttcagccaaaggttcatcagcagcagcatctggctgtatggccctctttgggctcttctgcttgttcataaaaaaaggatcagcaaaacatatcaaacatagtgaacaatcgtaccatgcaacagcgaattgtaatgtgacaaaggatcgtgccaatcctgaacaccacacaccttcacaggtgtagatctcactttctgggtgctcctctgcgcggcagccaccgcttctttcccctttttcagtaaatgatggaccgaagcacaacctgaagccttagcagcatgggcaagtattccggtgggcggcagccccttcttcttcctgccaaacaaatcaaagtccatccatcacttctgacaacaaaacgcgagccacagataatcagcatgaccggtagagcatcaggtttggtcagctcacatgcagaagctgcaattgcagatatccttgcacttggggcaagtccaggtgccgtcattggccaccttctcggcttcctggccgtacctgcgccacgaatcactcagaaatcacatggtcagccagccttgctctgcctcctgaagctaagaaagaagacgagaagaaattcccccctcacctgttaaagagacacttgcggcagtactggatcgtgcactgcttgttgttcttcttgatcttgtggcatgacgcggcgaagtccatcgtcttctgacggcactgcgagggagcaagaaacagagcaaccgctaaacccaagggtgagcaagaattccccgcaaaaacaagggggggcgagcaagaattcctcagatccaacccgacccaaccaccggggaggaagaacagggacgcacgactcctcataggacaccggctagacacggtgtcgaacagatggtaggcaggcaggtaggtgggaggaggaggaggggttacctggtggcaggtcttgccgttctccggatcatagatccggccgccgacgacgcggacccccttggattcgacggacttccccttcgccgccgccgccgccgccgcctgcttcgccgccacctcatgctgctgcggcaccaccaccacgacgtcgcctcctcctcctccgttcacctccactccagctgcttccatggtcggcggacggcggcgggcgacggcgagcgcgctggaacgaggggaagaggaggagggatcgagagggggggagaggaggaggaaactgaatccggggacgcggaagaaaccgagaggattggtatgaatgatgatgaaatgggatttctgctcgttggcctcgtgaggaaggtgattaatgtgggcgagagagattgaaaaatttttgggcagcgaggcgaggggggggatcatgacggcatcgcgcccagcgggttggggaaaatttttttcaaaaacttccctccacgacgcgtctcctcaagtcctctctccccgcttcgatccaaattgggtttttttcggtttcagccgcgcggagcggaggtgaagcaatgcgcggcgccgcgcggcccgctaacgcgcgtggaaggaagaggagggggtgtcaattgtcaaagggggaggaggtgtgtgtctgtgtgagctgttgttgctgctgttatttcctactatttcctttgacagcttgcttggtttgacggtagagcggccaaaggtccagctaaagcggatgggtgggtgtgcggggtgcgagaggtatatgagtgggtcccaccgtttgctcttcctcgtcatgactcatgaggtgtgagggggtgtgcgtcagtgggcctaccaactatctacttatttaaagtaggtagatagaaatttatttttgacttatctttagtgaagaattattgtttttatatatcgggaccatttgaaaaaatatatatatataatatgtgaagatattgcatcaattatacagcaaagatattaatacaaagataaagtagatgagtatatctaattgttaaataacataggtttcaacgagaggggttggactacccccttattaatactctaggtccactcgattcaggggaaggtgtttactactacctccgtcacaaaataagtgcagccgtgaaaatccgtgtccaacgtttgaccatccgtcttatttgaaaaatttataaattttttttaaaaaattagtcacacataaagtactattcatgttttatcatctaataacaataaaaatagtaatcataagtttttttcaaataagacgaacggtcaaacgttggagatgaatagtacaaaactgcactttttttgggacggagggagtattgttatttcttaatttagaatatattaggcagccaaaggtttttctagactagataagtgggtatgctagttataataggcatatgatcaagacatgatatcctgctcatgacacgtcatggaatatttactatttcttttaatagcagaatgacaaaaattccggctaaaacatacggggcgggtgtgcagggtgtgagaagcatatgagtggaccccaccgttcgctctgattcatgaggtttgaggggtgcatcggtggtcctaccaatcgtccactttttcaccttcttaagtaggtggatagaaatgaattttggactaatctttagaaacaaattgctagtaacctttatatatttggatctttaaaaaattctgttagtgaatagttggtttactttagaattaactataaaaaaaattaacacaaagaataagatatatgaatataccataggtttgaataaaggaattgaactacttcttaccatggacttccttataccacataagtctcgggctactctattcggggaaagtgtttgttaacattgtttctttatttgagattgctaggcagccaaaggtttgtctagactacatgagtgggtaattagttgtcagaggcatatgactgggatcaaccgtccactcttcctcattgactcatgaggtgtgaagggctatattggtgggacaaccagccatccgctttcccaccttaaatgggtggatggaaattttgttttggattcatatgtagtgaaaaattattgttagactttatattttgatctattgaaaaattatattcaatataagaatcacgcgtttaattatattcaatataagaatcacgcgtttactttggaatacaacgactatagagaaaaatataaatacaacattaatgtggttgaatagatatagtatttaataacatgggttataataggggttgcactacttctccattttaatagtatagcggccaaaggtccagctaaaacagatgggtgggagtgcagggtgcgagaggcatacgagtgggccccatcgttcgctctttatcatcatgtctcatgaggtgtgaggggggcacatcgatgagcctaccaaccgtccacttgtccgccttcttaaataggtggatgggaatttgtttttgacttatcttcaacgacagattggtagtaacgtttatatatttggatctttcaaaaaaaaatcaatatttgaatcgctggtttacattgaaatgcgtcaactatacggcaaatatattaatacaaaggtaaaataggtgagtacatctaatagttaatagcatatgtttcttcctttctttaaaaaaaactaataacatagcaacttgtttggtaactcgagggaaggggattgggagtttacacgagggaattgatgatgagattaagatgggaatttgatttttaatcccaatatcttgtttggtagaggtgatggaaattgatagggagtttagttggagattatgtcattaataaaaacggatggctgatatttgcttagacaaagtaaaggaggaattccctcccaattacttgcccctacccaggtattgaaaaggagggagttccttcctcaattacccatctccatcccatcaaaattcacatgtcttccaaccaaacaaaacacttaatagcctcatccctgttaaactcccaatccctcctaaaaactccctccaaccaaacgggccataggttcaatatagggattggactacctcctcatcatgggcttctttgtaccacctaaggctctggctactaggtccactcaattcaaggcaaggtgtttgttattgttgtttcttactttaagaatgcaataggcagccaaaggttcgtttagagt

SEQ ID NO: 17269 - DNA, 7626 bp, Oryza sativa
ttcgccctttcttaaatgattagatgaaaaattattttggattcatatgtagtttcaaattactagtagagactttatatttgaatcaactaaaaaaatatattcaatatatgaatcactggtttactttaggatgcatcgactatagaacaaagatattactaagttagtcgaatagatattaacatgagtttaatagggagttgtactgcctctcccttttgctattgtcttcattgtaccacctaatcaataattaatgtaaatatgctaccttaggccctagccactaggtttcctcgattttgggaatgtgtttttggccctgtttagatcccacctcaaaatttttcaccctgtcacatcaaacgtttaaacacatgcatgaagtattaaatataggctaaaaaataactaattacatagattgcggctaatttgcgagatgaatcttttaagcctaattgctctatgatttgacaatgtggttctacagtaaacatttgctaatgacagattaattaggtttaataaattcttctcgcggtttactgacggattctgtaattattatttttttgttagtgcccaaacactccatgcaacacactatataatacctgatgtgacacgccaaaactttacacccctggatctaaacatcccttttgttgttgatgcatatttcttactttgacaaggtggtaggcagccaaagatcagtttagagcagatgggcatgtaggatgtgagaggcttattagtagatcccaccgtttgctcttcctcctcatgatacacgaggtgtgtgagggcctccaaaccgtccaattgtccaccttcttaagtagggtggatggaaatttgtattggacgcagctgtagtaccaaattactagtattttttagtaaagtacacgactagtccctaaacttgttcgtatatgtcatcgaagtccctgaattctcaaaatgcactttcagatcccataaattcttcttctatttagccggattgccataacatttacagatgtaggttggtgaacttctttgacatagatatagttatcattggttaaaaacaattcatgcttattgtggatatagctaaagaaagtagcattagattaaagctagctttcttgatgtggatagaaggccattgattgcaatgcagatcaagaaaaaagaagtggtattagatacccaccccaatgtattataaataatatataattctaatctattatataatagtattttctaaagataaggtcttaatttatatttggcacaggccccaaattgctagggacggccctgcaccgaacatccttacaatcatatgtacgccacaaaaaaaacatgtctctcctgtcccatttcaaccgatctttttttttcattggagtagaagggatcaaaattgaactctgaatgacatcatgaaaattatttttttatgcatcaacccttcaagtatgagttgtatactgtgcatcatcactggtcaaaaactagcccctgatccgctccatgagacaacgtgggcatatgccacatggatccctcatggacttgatctggatccaagacgaggatagggccacatgttagcctctttctcatctctccctcaccctcccaatcggtaatgtcgttagggagtgtggcgtttgtggtagactgggagttcgtgtgcatggagcggtgctcgtgttgttgagcctgagccagccgtgtgccagctcaagttcaccgttccacagtcacacccccttacccagtcaccttcctacaccgccgccaacccctccatcaaaccaagcccctgccaagatcgtccctacttatcgcagtagagcttaccccgcctgtaggctctagttgccaccacctgtaggttctccggatcatagattcggctgccgatgacgtggactcccttggattcgacggacgccgcctcctcctgctgcggcaacaccaccatggcatcgcctcctcctcctcctcctcctcctccagtccagctgcttccatggttggcgggcggcgggcgacggcgagcgcgctggagcgagggaaagaggaggagggatcgagacgggggaggaggaggaaacagaatccggggacgtggaagaaatcgagaggattgatatgaatgatgatgaaatgggatttttgctcgttagactcgtgaggaaggtgattaatgtgggtgagatattgaaatttttttggcagtgaggtaaggggggatcatgacggcatcgtgcccaacgggttggggaaattttttgttcaaaaacttccctccacgacacctctctcctctctctctctctctctctctctccctgcttcactccaaattgagtttttcggtttcaggtgtgcagaggtgaagcaatgcgcggtgcagcgcggcccactgacgcgcgtggaagaggaggaggaggaggtgtgtgagcttttacggctgtgagctgttgttgctgctgttatttcctactttgatagagggtagagcggccaaaggtccagctaaagtggatgggtgggtgtgcggggtgcgagaggcatatgagtgggtcccagcgtttgcatttcctcatcatgactcatgacgtgtgagggggcgtgcatcagtggacctatcaactgtctacttgtttatcttttaaaatagggacaattgcttattttatcccattttgaagtctaactaccaatttaaccctacttttttagtttgcttatttgaccatgtttttcaaaaacgaaccttccgcttgaccctgtttccactacaccgttaagatttgatttaaaaaaacaaagaaatataaataaaattcgtaatgccaaaatacccttgaggaaaccatatccatccctaaccctatccacatgtgtatctctctctctcctgccagcgagttgcggtggtggcactcggtgtctgaagggaggaagggggcggcgccggcgggaagcacgcggaggggatccgcggcggcgcccgctcgtggaggcaggggccgcggtgatgggaagcgcgtggaggggatcctcgctggcacacgcttgtgaagggaaggagcggcggtggtgggaaacggatggagggatctgcaccggcgtcggcttgcggaggaagggagcggctgcgccgagcctctgcgacggcggcgacagttcccctgcggtggtggcggcagcatgcagtggagctgcgcgcaccgtcgggtgaggcggcggcgcgtgcagcgaggagggaggcagaggccggcgcgcggcgaagggagggaggggagccgggcctggcggtggcggtgataggcgtgctgaaggagggaggaggccgcggcggcagcggcaggcgcacggaaggagggaggtagcagcggcggtcagcgcgcggagggaagaggaggcgccaccggcatgcactaagaaaggaaggtggcgaacccagcgatggagctgtgatggctggatccggcaagggaggggcaacgacggctcggcggtgacgaggagtggaggcggtgctccacagctgctggtcggcgctggctcgccctctcgctgctcgcggccttctccctgcgtgtggagctgtggaggagaggacaagagagaactgacgcgtgggtcccacatgtaatagggtcaaatgagtaagggcagaagggacattttgtgcttcagttaacatcgttagatgcccttaatagaatagggtcataccatatcttcaatttttaagaaaagggttaaataattaaagttgataaaagagggtcaaattgatagttagctttcaaaagagagtcaatgtgcaattaccccttttagttaggtagatagaaatttcttttgggacttatctttagtgacggattgttgtctttatatattgggaccttttgaaaaatatatatatacaatatgtgatgattgcatcaattatacagtaaagatattaatacaaaggtaaagtaggtgagtatatctaattgttaaataacataggtttcaacgagaggggttggactacctccttattaatacgctaggtcttcaagggaagttgtttactattgttacttatttcttaatttagaatgtaataggcagccaaaggtttttctagactagataagtgtgtatgctagttataataggcatatgattagtacatgccatcctgcttatgacacgtcgtggaagatttactctttcttttaatagcagaacagccaaaaagtccggctaaaacatatgggcgggtgtgcagggtatgagaagcatatgagtgggccccaccgttcactcttcctaatcataggccgtatttagttgcaaaatttttcttcaaacttccaacttttccatcacatcaaaactttcctacacacataaacttccaatttttctgtcacatcgtcccaatttcaatcaaacttccaattttggtgtgaactaaacacaaccataattcatgaggttcgaggggtgtgtcggtgggcctaccaaccgtccactttttcaacttcttaaataggtgattaattttggactaatctttagcaacaaattactagtatcctttatatatttggatctttcaaaaaaaatctgttagtgaatcgttggtttactttcatcaattataaaaaaattaacacaaagataagatacatgaatatacctaatagtgaataacataggtttgactagaggaattggtctacctctttcttaccatggacttccttataccacctaataagtatttggctactaggtccactctattcagggaatgtatttgttaacattgtttctttattttgatattgctaggcagccaaaggtttatctaaactacatgagtgggtatgttagttgtcggagtcatatgactgggatccaccatccactcttcctcattgactcatgaggtgtgaaggccatgttggtggggcaaccagccatccgcttttccaccttaaatgggtggatgaaaattttgttttggattcatatgtagtgacaaattattgttagactttatatttggatctattgaaaaattatattcaatttatgaatcactcgtttactttagaatacaacgactatagagaaaaatataaatacaacattaatgtggttgaatagacatagtatttaataacatgggttttaataggggttgcactacttctacattttaatagtgcagcggccaaaggtccggctaaaacagatgggttgtgttgtgtgtgcaaggtgtgagaagtgtatgagtaggctccatcgttcgctctttatccttgtgactcaggaggtgtgagggggcacgttggtgggcctaccaaccatccacttgtccaccttcttaaataggtggatgggaatttgtttttgacttatcttcaacgacagattggtagtaacgtttgtatatttggatctttcaaaaaaatcaatatttgaatcgctggtttacattgaaatgcgtcaactatacggcaaatatattaatacaaaggtaaaataggtgagtacatctaatagttaatagcatatgtttcttccttttttttaaaaaaaaactaataacataggtttcaatacagggattggactacctcctcctcatcatgggcttctttgtaccatctaagactctggctactaggtccactcgattcagggaaggtgtttgttattgttgtttcttactttaagaatgcaataggcagccaaaggttcgtttagagtagatgagggggtatgctagttgtgagaatcatatgattgggacccatcatccgctctttctcctcatgactcatgagctgtgagagggcatacccacctaatgtattataaataatatataattctaatctattatataatagtattttctaaaggtaaggccttattttatattaggcacgaggccccaaattactagggacaaccctgcactgaacatccttacaatcatatgtacgcaacaaaagaaacatcctcagccagttcattgtctgaccatgttgactagagtagtggaaatgaactggctagactgtccggcagctctcgattgtctgatgcctagttaatttggcaactagcggacagttcgacacgacgtcggttaatctggcatgttcattcgattgttactggtcattggtttttgaacattgcggattgtccgacaccgtgtggacaaaggggtcctgggcaatctacgagatgttggattgtcctatgctttatggcccaacaactacttgcccagttacaatcagaaaagtatgaagggcagaatagttcgggtcggtgccatactgtttgacgatttgcagttttggctgcttctttacgatggctgcaaaccgctagggagcttgattggggctttatacatcccttggcttgactccccggtggtcctttggaaccctattgagctgagcaattgatgggagagtctaagagcatcattgagctaattgtgataattttcttcactaatttagtgctagtttgagttgagagtatgcttttttctggtgcttgccaccctccctgtaaattatattttcctactgtttcacgtcaaaaaagagtggcttagtgtgcaccaacaagaatcctgttcttaacaggaggagtggctctcttcctgttaactattggcatcttggcatgcctagccagtctcgaaggcaacccggtgatctgtcaagaagattgtgggagagccggtgtggttgtggaggtttcggggttcacctttcagagcggagaagaaccaccatgatgagagcgccaatggacttcgtgactatcagagacagtgtactctttgtgtagagtgctccaacgagtattagtggagattgccgaatctcttatacctcagagaaaactcgccggatctatgtttgaatttcctatcgtttttctctctttacttttaattcgtattcctttcaatacttagcttacttccttatagcagtggacagcaatatattttgcattcaactgtactagcgaattactagtaacgaggaattatgatcaatatatgaatcatatattggttttatggaggaatgcatggactataagacagataataatcttttactcttggcttcatagatttggtggctgacaaacatgggcttcaatggatgggctgaaccacctccctcttctttttggccttctactgccacctatttcctccgttctaagaaaactcaatctctaaggggatacgacccctcttagaataacgaatctagactacccgttgtctagattcgttgtattgatgacaagatatgctatatcttttttgttaaacaatgtgtgcactaattaaaattgatgagtgtttggggcaccgtgtaaatacgttcctagacttcctacatgatgcccgacacacagaggaggacggaagcgactggttttcatgggccacggacacggggtaatttgggctatagcaacaaaaaggctcacaagcaagtacttcctccgtcccaaaaaaaatagacaactagggcctgt

SEQ ID NO: 17270 - DNA, 6650 bp, Oryza sativa
cccccactgtgcatttagtttttttaaaataatctataattaatgttccatgcatgtgtcaaagattcgatgtaatgtttttgggaaaaaaattggggaactaacgaggccctagtactataatgtgactagtacaatgaatctgaacactccctccattccaaaaaaaaaagacaaactctggtgtcgaaacatgaattatgcaataataaaagggggtagcgcacgagatctaaaagtggatggatgcggagacaaaggatttagacaggttcaggtcctctcaatgagaggtaataccctactcctgtttgaggatttgaatccgccgggtgtagtatagatatgacgatctagttgtgtctcatgccccctagagggcctcctgtccaccttatataggatggggggcaggattacaagatagaaaccttaaccaatacggtatcggtttcctaaatctactttacaatcttatcaaaccaggactttaggccgttccataatatacagggaaacgtaatacccaagtcatgatctgttacatatttcatagatataagttatcccctataaccagtcggataaccacgccgtgtgggtatggggtacccataatctccatagtagcccttgagaccttcatagtcgaaaagataatcttcgactagactgtggagggttggaaaataaagttaggtgcatcgactagatgcacctaataggtgtagcctccgactatgtggttagctgaacacactaagcgtatagtcaaggaataaataatccacccacccgagtggttttgataattgtaatcaaccaaatgacttgatatatagcatatgcggtgtgaatccccgaataacatgatccaagtgatataccgattgctttgtaaaaattgatgagagcaacctaaagttgactacatcattgaaaatacacatagcaaaacagctataaaaaagcttgaatgttgtgaataaagaaatttccaaagtattgggcatacgccatgcgcacactgctttaacagatgtgcttaagtccctaaaagacacatggtttcaccacacccggaaatatacggcatatgtggtgtaaaatccgagtaaataaactcataaaggatttaccaaccgcctggaaaatgaccaagatatataatcagcctaagccataatattggtcaataaaaacgcacacttacgtggcaaaaagcaatgatattgtatccaatcgattgcttaaaaacccaaacaacaccttgacttatataaaaaagtcagcggaacagctattttaagctttactggttgacaccttttaagatgcattggaccaacttctaaaaagttgaggtactgcggtataaaaggattttaagatattgggcacttgatcacgcacactttggcctaagcaaaaagtgcctaagtccctaaaagaacgtgacaggccacacatgaaaatatgggctgcaaacatattaggcctaggccaaaaaaaaatgccttcgacaccctttaaaggatgacgcatataacatgctcccgagtaataaatcttccgggtaatataaaccaagtgtagctcatatgaatagcttctgatctgagtgattatcccttatgggatactccaaaatagatataaaaatggaatcccgactggcgcaagtattcggttgatagcccttacggagaataatgatgggttcagtcttcgagcatagaaaataatctcagaacaaaatccaacttgaaggtatgatcctagtgtttgagttgataagcccctgagaatatatagcttgtccttctgtcatagtcaaaattgtccattggcaatagctgatgcagtcgacatggagacgaaatgactaacatgaagatgatatcacccatcaaagctgacgaagatgttggtggtggtaaagacaatgataccaatcaaaggtaatgaagtcgcatagccatggaggcgaagaaaccagtcggcggcagacagatcaactaacaattaagatgaaggcacccagcaatagcgacggagttttgtagccatggtgacgaaataattagtcggagacagacgagacagccggtgaagaagacaaagacgcccatcagtaaaggcataataagccagccgtgaaagcgaagacaccatgggcggcggcggaggcaagccggtggtgaaaacgtagacgctcatcaatggcaatggcgaaatccatcaatcatgaagatgaagaaaatagtcggcgacggcaaatgcaaccgacggtaatgacgattagcagcaacagacatgatcgactatgatgacgaagttgcccatcgatagtagtagagtaggctatgtcgaagaagcttgacaggatggtgatgaagatgacaagtcggtgatccagtcaatagcagtgtagcagctaatgataatgacgaagacgctcatcagcgtttgcgtagtaggtcaaccgtgaaggcgaaataacaagtcggcaatgacgtaagcaaccgaaggcgaagacgtagtcacccattagcaatggcgtagacgtcagggccgataaagtagaggcgttggtaatgaggtcagtgacaataatccatcaaactgttgagaagatatcgaagctcgagtaatttcgttgacgctagagtgcgcgtaatgtagattgatgcaacgcctcttgatttatgaagatgacagtagaacttggtgttgtagctgtagaagatgcttcacttgaagaaaaatagatgatgttgtccaactcgttgaatcgacgaaataactagagtcgctgaagtaaaatgtcggctctgaagcgaagaccaagataataactcccaaaatttacttgttgattcattgattgcttcattttgacaaaaaacatgtcaaattttgagccttgtatttgtgtagcccccgactctttggttagttggaaaacaactgaacatagagtcgagaactctagcttgtcgtcgagtagccattgcttgagtgaagatacgtgttgaagatgtccgagtagaaatattgatgattagaacaccacttgctatagtaaaataataaggcatcatatttggtgacgcatgtcgagatgtcgaagctcttgtagatgtcgtgattggtgaagtagcaaatcttgcgaacggtagcgaaggcgtgtagttgtgaagataaacacaccagtcagcggcgacataaccagtcggcgacggaagaagtagtatgatgatgaaaacgaagatgtccatgaacggtggcaaaataggccagctattaaagtgaaaacactatggacggcggcgaaggcaaaccggcgatgatgacgccagttaatgatgacgaagacgcgcagccatggaggcgaacaaaccagtcggcagtagtttagtggtgagaattccacgttgtggtcgtggagacctgggctcgaatcccagcagacgagacgaccggcggtgaagacgataaggccaatcaacagtatcagaatcatgcagccatgtaagtgaagagaccagtcagcagcagacgtagacagcttacgttgaagatgatgacgcctattagcggcggcgatatggccagccgtgaatacgatagctccagtcggtgtcatacgaggtggccggtcggtgaagatgtagacgcccagtaacgacggcataataggccagccatgcaggcgaggacactagtcggtggcaatgaaggcaagccgatggtgaagacatagacgcccagcaacggcggcataataggccagccgtgcaggcagagacactagtcggcggcggcgaaggcaagccggtcggtgaagatatagatgcccaacaacggcggcataataggccagccgtgcaggcagagacaccagtcggcggcggcgaaggcaagcaggcggtgaagacgtagacgcccaacaacggcggcataataggccagcggtgcaggcggagacaccagtcggcggcgacgaaggcaagctggtcggtgaagacgtagacgcccaacaacggtggcataataggccagccgtgcaggcggagacaccagtcgacatcggcgaaggcaagtcggcggtgaagacgatgacgtccaacaacggtgatgtgaccacccaaccgtataggcgaggacaccagtcggcgacgacgacagcaagccaatggtgatattctgactaatccattcctgaagcgtaggagataagcttaaagctataaatccctattatgcatatctggatctggatcctgcagaacaaacatatagaatgagtagtatctgatgcaagcacagtacttgagaaaaattcaagtattttaaaatatttataaatatgtatttctcctcttgtcaattttgatttccccgagcagatgactccgtacgtttaaacactctgcccgactagtcatagcccccaagcatcgggagttggtttaggcacttcccaaacatgcatatgagtgacatgagttcgtcattaatggaacaaagtttcacgaatcaaaatttactactcgggtacttttgcaattgtaagagcagaaaataaatttatcttatctctatgcttttgatttattccgaataatacttaggaccttgcgttactcggtccatccaacgagcccccgggtgctaggaatcggcccaaaggcaactatccatcgacaaaccaaatggaaagcataggaaaatagaactccataactcgataggaactttattgttactcggattatttcgcaagcaatcaagataaatattatgaaaaattgttaaaaaatatgatatgacatctatagtcccccgactcactagtcaacggcgaaccagttgatgtagtgaggcagaggaaaaggaaaatatcatataaagaaaattaatgatgacttagctttgtaatattccccttggtgatggcagaggtggccaatgtgggaacaaagtcgtccatcaataacagtaaagacaccagtcggcagcgacgaaggtggtcgatggtgaaagcgaagatgcccaccaaatgcagcataataggccagccgtgtaggcagagacaccagtcggcgacggcgaaggcacgccggtcggtgaagacgtggatgcccatgaacggtggtgtgaccaaccaactgtataggcaaggacaccagtcggcggcgacggaggtaggccggcggtgaagtcgtagacgcccaacaacggcggcataataggccggctgtgcaggcggaaacaccagtcagcggtggtgaaggccagccggtcggtgaaaacgtggacgcccatgaacggtggtgtgaccaaccaaccgtataggcgaggacaccagtcggcggcgacggaggcaggccggcggtgaagacgttgacgcccaacaacggcggcataataggccggccgtgcaggcggaaacaccagtcggcggcggcaaaggccagccggtcgatgaagacgtagacgtccatgaacggtggtgtgaccaaccaatcgtataggcgaggacaccagtcggcggcgacggaggcaggccggcggtgaagacgttgttgccattagcaacggcagtggtgaaggcaagccggtggagtagactcatggccaactaatcgcatagcgagacacctcgagtccatgaccaacgccaatcgcctcagtagtgccgtgtaattatatgcaaacaacaacaaaaatagcaagagattaatctgaaattagaaatcaatctaataatatagaataataagttggaagagataaaactcgatgagttgacggcgccagttgcgggcatgacgatatttgtcatatgatcaccatctggtaaattgtaggcagctgctccaatgtgtggccggtgatgaagacaacccacccagtaatagtagaaggattgctttaccggcttgttggatcagaacgatatctcagggccatggccatcgatccatggaagtacatgtaaatacgagtcaaatcagattagtaaacaaaagaagatgcatgcatacaactacatacactcctatatattaattgactcatatgtgtcgatagctgcttattgaataattggattcaagcctgtgcatgttggtagcagcctataaacgcaggactcctgattggttggcctattggccagcatgtatacttgcatatatggcggtgatcagtagatgcatgcgatcaacgcagctgttccggtgcccctgattacgtcgccgcgaggagaagcgtgctagactgttactttggcaatcaaagcagtcggccgggccaaaacattcgcaaccaaccggcaaccgcacactacgcctgttctgaggacaggggttgcagcatgccgtgtatactcccaggtggctccatatgctatcgcgatctcgtcgacagtagtactacaataataatagtacaccaggaaatcaatctgtcatagacattgttaaaaaacactagatagattgaaacgacaaacccggttgaagagttgagccatcgacgtcggtgagattgatctcgccgtttcttctgcagttgattccattgcacttttcgatgggtaattcgacgcacccctacctgccgcgccaactgtcgaaaca

SEQ ID NO: 17271 - DNA, 1967 bp, Oryza sativa
aaaggggtagcgcacgagacctaaaagtggatggatgcggagacaaaggatttagacaggtttaggccctctcaatgagaggtaataccctactcctgtttggggatttgaatccgccgggtgtagtatagatctgacgatctagttgtatctcatgctccctagagggcctcctacccaccttatataggatgggggcaggattacaagatagaaaccttaatcaatacggtatcggtttcctaaatctactttacaatcttatcaaaccaggactttaggccattccataatatacgggaaaacgtaatacccaagtcatgatctgttacatatttcatagatataagttatcccctataaccagtcggataaccatgccgtgtgggtatgtggtacccataatctccacacctgggattccgtatccaacgtttgaccgtccgtattatttgaaaaaaattatgaaaaaaattaaaaagacaagtcacgcataaagtattaatcatgttttatcatctaacaacaatgaaaatactaattataaaaaaatttcatataagacggatagtcaaacgttggatacgaaaacccagtatttgccttttttttcgatggagggagtatatgatatgtcacatcgtactacgagtttgattttttttacggagagagtgctagcaagaaaaactcacgcacaagggtaggatcgcagttgcgttgcgcgattcttttttttcttgaaaagacgcgtacgggagaactgcatcagttttattttttggatgtgcgctcgttagcactcacgcgatagtacaacgcacgacgtacgcaaaccacgaagaatccgatgaaatcgatcggctgcggcagattcttgagaattttgcatttgacacacgagccgacatctaagtcgtggagtttagctggacgcaacggcacgcacacgcctgatcgaactggaaattggctgttgcattgttgtactactatatactccctccataaaaaaaaaaaaataaacgctgagtctccgtatccaatgtttgactctctctcttatatgaattttttttataattagtatttttattattgttagatgataaaatatgattgatattttatgtgtgacttgtttttttaatttttttcataattttttcaaataagacggacggtcaaacgttggacacgaaaacacatggtttggtttgtttttttgggacggagggagtaccacattgactgatagatatatgcttaaattcttatctctactttcccaactcactttcctcgattttcacgcatatgtttttcaaaccgttaaatagtgtattttttataaaaatctatattaaagttgttttaaaaaacatattaatcatttttaaaaattattttagttaatacttaattaattatgcgctaaatgcggctttgtttagagtgctactccctaacacagccatagttgacgtgaataacgtcttgccataaataaatgttatattttctcatgaaaaataaataagatcgatcaatatatatgctctccacccagagcagtgcgcacagtcacagcccggtccatcgtatgaatgagcactcatattagtctaatcgaagctttaaaaatagtacatatctataatgaaatataacgaaataccgaatactaggtcttcctcaaaaataaaaaaaggagccaccgaacagcccgtccctggtcacgtgtgtattaatttaagctaattcgttccgatatatttagaatctcttggttttgttttttaaaatttaattctttttctccactaagtcagctagaaggagctacttcttttatctactatggtaagtattcgatggcagtcatgaatatatataaaaaaactatatctcgtgataatgtaaacataccttctaggtaataaggactccattttgggctgcaggaa

SEQ ID NO: 17272 - DNA, 23334 bp, Oryza sativa
ccatgctaaacactactgtgcattctattatctttaataacttttaaaatttcatgttagcaaaaagtattttatatgatctgggcaattgagttttaattaattttatgtcgtatatcaaatatatttcacgcaattataataatatgatattgggtgggtagaataaatcttggccagaattaataacatataatcacttcaatatacaatatacgagggcgatttacgtttgaaaatatgttaaagttctaaaaaaatgttaaaagtatagagttattccattaaatagttatgggtataaacaagtacaaaaataaagcatttgatacatatatagaatataccccgtagataaataactaccctaatgtttatcatttaggatacacttaagaaattctcattgtcgacaagtgatgctcgtggaccggataagttgagtattggggtatgtttgaaagagggtctacgtagtacgacatcaagcaaatagaagacaaggattatactggatcaggccccctaacacgtaatagccttagtctagtttatatgagattgatgacgatgatatacagagtccaaagagagtagatggaacagacgataccgacgagatcgtagttgatggattcgacgagatctcccggcgacttggctccgaatactctggcttcgtaagctatggtgggtgtgttggcgatgatattagatgtccttcacctccccctaggggtccacttttataccgtggattatcttgaccccgcaagtaaggcctgggggtatgtaatatgatacaatataccagagattctatcccctccgagtaggactttggtagtttcttaaactcgtagggatattttccgtaattaaagacaaattcctaacgacgtatagggaaacaatccatgtacgtgaaggtatgcctattgggtatattccataagtcgtaggataaaaggtatgcttatcgggtaaccttgacagtagcccccgacttcaatttaaatggattcatgtgggtggccaacgatttttcttattaccgtttcgtcgggctcgttaggtcaatctcggttactgaccgtaaaaacatggacttatcgacaaccctaaagggagtccaacggtgcaaaatttgaatttaaattgaagtctgaacaactacctccaacgggccttaaaaattttcggcggcaatctttctcctttcctcaaaatacgaaccgttaggtggtgcgcctatttaatggaattctgggatccatttcaagtctgtttgccaaaaaaccctcactgttcctcggcttcctcggactttccatttccctaaaatccctaatcttccacgtctcccactggcgatcttgttccgacgatcttcttccgatggcggacctcgaccaatctttctccgatgcggcgcgctgaagaagctgtacaccgagggggccgtccctctgaagcagaccatggcttgggaagcaagaggtattgatccttcccccatcctaggtcgcatggtagctctagaggatttcgtccgctgtggttttttgcctcctccttctaaattccttttattgatcttgaacttttacggcctttctctcttgcatctaaaccccaactccactgcctttttgagcatatttgctcacctttgcgaggcctacatcgaggtagtgcctttcttagatcttttttgctttttctatgaactccggtggatggaagccaatcgggtttcaagatgttgatggtttcgccttcgtgatggcatgaaggcaagatacatctctttccaatgccacacatcccggagccaatggaggtcgagatggttctatctagagctcaaagaacttgaaccggttcttgtcatacccgaggttcagccggagcattccgagaactggacttctaaacctccgttgacaccctctctccaagcctttgtcaacgctgtgagcgaccttcgagagcaaggattgaccggctatgaagtcattaaggactttgtcagcggtcggatccaaccgctacaagcccgtgctcaccccgtgttcgactacacgggagcagaggatataactcgaatctcttcgcggggtatttgtccttatgttgtaatcttcttcctgctttcgacgatgatttcgaggccaaagcctaactcatcctctcatatcttcatttatttcagatctccccgccaacatcgtggcgcagcgggtcaaggaagtcttgatcagtccttcctctacggtcgatgaaacaccggctccgcgttgcggcaagtcggcagtctacaaggcggctgctatcaatgtaaatgagaaccagacctcctcatgtttctattccctgaaggcgcaaagtgacttcaactcctgtaggttctgccgttgacggacgttatcggcccccttgtcaaccaccaggcctccgcctcgttgaaggacaaggatgccgacgaagtcgccaacatcccctccgttccagccatcgcaggaggcagcgggacccagaggaagccttgggcgaggtcgagcgctcccgccggttctcgacagaaatctagtggctccgaggtaaggcgtatcattgtcgtcctttagcttctttcttgaagtgttagaatgaggtcataatttgccatcttactcaggatacgagcagtctcgctcctcctccgaagagaagggtgctaaagctgctcgccggcaagtaagtgaaactcttgactcctttcgtcgtcacatctgtaagttttactaatgatgtcccctgacattggcaggaaagcctcggcgatctccgcgcaaagcggggactaggcggtgaccagtgggtttcctgccgttgtcattccttgcgtggaggtcgctcctgttgtcactgagtccgccgggcctgccgtcgcgcctgtggccgcgtcgtcgcccgaactaacaacttggtccgatatgatggccgagtgccgccgcctcctcgagaacacttctcgggaggtggcggcccagatggatcgcgcggtggcccgtgcaacagcgtcggacggaaaggtggcccggctggagattgaactcgaagtcgccaacgacgaccttcaaaagatgaaggagatcgtggccagtaacaagatgcagcaccagggcttggagaagaagatgaacgacctgcaggaccacctcttctccctccgcgactccctccgcaagagcttcataggccttcaccagctagccttggcgtgtggtgtgatgtcttctatcccgacgcacctcgacgagacgtccttgacgttggcgttgtcggagctggcgggcgagatggaggtcatcccgtcgcggcatactgccaaggtctcgaaggaaatctccaacgggattcacacagggcgtgtcacgtcctcgcgtgcgtgaagctggctctccctgtcaccgatctcaaggagatcttgtcgaagggggcagcagatgccacgcgcgaggacatgtctctagtgtgatggatctcggggagtgcgtcctccccctttatgaggagtaaacttttttttaccttgtattgtagtttttgtacaagtacttctgttaatctcctaggcggagtgacttccttctcttcacgtcacttgttaatctgtagcgtcttttattcttcatagctgtgtggattccgaggatgtccagcaatgcggatgtcccgatgtcgcgatgatcgacttgccctctttgggcgatatgcctgctcccgatgtcgttacggatgcggttgtgctcggaggcgtgggcgcggcctctggcccgtttagtccgggcatagtcgggctccctcgcgagaactcaggtgtgatgtcatagagaaattgtccctttgagcttattatcttattaaggaggcaacatctcctacatccttgtccttcgcagatctcgaaggtgtcatcgccgaacgagacaaacgcatcgcttcttggaggacaaagtttgaggtcaccgaacttgggctatcgctcgtggtcgtgaaaaaagacaaggccgtggaggctctccgaggtcgcgaggtctggatgaactcgtacctcaagagctgttgtaatgccatggccgacatctaccaccagctgagggtcgatcgcgcggaccccgaggagaacacgacgggctacttgttctagctgaggggggcgtgtgtgttggtatttcttaacgacattactagaaatataattcccagcaatggcgcagaaatacttctggtatattatggttacagagttcatccgcaagcgcatggatataccattgtagcatttcgcctgagagtattccaagggtatcgtattcattttatcccgtgggaagatcacgtagagagaactcaactaataatttatataatacttgtgataatcatattctaagtaggggttaagataatccaagggtagagtgacacacatgcattactactcataataaataatctaagctaggcgaaaagaaaagagaaagagaatctatttctatacttttaatatacatagtatacatacattctagttaactgatatactagctaataccttctatccgatgccctcctggtacttcgagaagccacccctgactgcctagttccttacgacagctcgtcatgaccatccaactggggctaaatatggaggagtaccctccccaggaaattaacttaggattatatataggcgtggaggaatacccgtactgagctgtcaccatcagaggcccacctctcatccgcaatatataaccccaaataatgatatcctgtaatctagacaccacgtctaaactaccagatactactctaatatcatcgtcatgacatagagtaattgcataagcaaacactatacccgcaccaaagcatgcatctcccagacaagctagcaatatattcagtataacaagaacataatgtaaagttggtactcatatactcggaaagtatttcaataccagaaatgtatttagaagagtattctaataaaagtacaaagcttacaaaagaggaaaggaaagctactagagccatacccgaactcttccgaaggcttccggactcctgattcctattctaattctattccaccagctatatactactaaactaaacttgagaggaacgagagagctcttgcttgaggtgtgtgagtgaagtgagaaggtgaggggtttatatagcctcccaatgacggttgtgacggttggaatggtcggaaataccctccaaccgtcattgggagctaatccacactgtccagaagaaaccctgcatccagcggcgaagaggggggttcggccgaaccaccaggttcggccgaaccaccaggttcggccgatcctggggccggcccaataaacccaaggtttggctggcagcctcctctgttgttcttctccgcagacttgtgaattttggcccagtttgtcgtgtcaattctgagttcttggcccattcatacacaagtttggttctcgacatcgtccgattgatttatcattggagttgatctcgattctccttcactttattgttattctctgcaaaaggttagtaaacctaatactagtggaatattattattctaacaagcatatgcattgcaaccatcactagttctcctctattttggtaatattgacggtcgaaactgattgataacgactatcaacagtgtgctcagcttgaaggcattggacagtggatcgacatcagcctaaaagaggagtgtcgccgcgccagccgttacgccggaggtcacgtcctcgcctgcatccaagatcgccgctcgcaaatgtacctcagattcttgcgcgggggttttcgccgttctcggttatcggcggatgagatcgaccagttggcgtgatcccttgctcctttagccgaggacgttttcgcttccatgaactggcagtggccgtcgtggtaggcttcattccctatagaaaaatatctaaaagggggtttataatacattgttatctctattaagaacttgtaatcaaagtagaaatctatctagtaaatgcttaaacaggttgtgttgtgagcgagtactactctttttacaggctgcctttggcccgttgtcgagtgaggtactctccctagccctaagccttgtcctcggggaaacctgttctcggaggggaaggctcgatgacccgtaacctgcctagctgaaaatgcaatttacctagcccctagccgtgaagttggaaaaatcaatttccgattacacggcttagttaatacaccttttgagaactcttacatgactaggtcttacatggtcgttcggctcttagaatctgacaagaccttatctgctctgggcgtccccagtcgaaattctcgtaggtttctcggaagcttgtcgaaacagcgtaaagggtcagtaggttcgatttcaagagtaggtgttatcgtggtaagggatctccgggaagaacactaatgtatttcatgaagaaatcaaaatacctttggatagtcgggttgtatatatttgagatacattgactttacacatagaatttacgtaattgatcaatgttccaagagttggataactcacggccatcgccgtctacaatcttgaacgcacctggtcgcaggacttgcaccatcgtgtatggtccttcccacttaggcgagagtttgttacgccctgcctggttttgaactcgtaggagggcataatcaccgatggcaagtgtgcgagctctgatgtgtttctcgtgatatcgacgtagggcctactgatatgtggctgcttggatggcaactcgttctcgatgttcctcgagtagattcacatcgtcgcttcgcctttcatcctgttcctcgtcagcatacttctgtactcgtgtactctgatgttgtagctccgttgggagcatggcttcagatccatatacgagaaagaagggtgtttccttgttggatgtcgttggtgtagttcgtacggcccatagaaccgacgagagttcttcaacccactttgcgtcgtagccaataagctatcatacacgtgagttttgatcccctggagtactattctgttagcccgttcgacttgtccattgctctgaggatgagatactgaggcaaagctgatcttgactctgagtttgatgcagtaatcttggagatcaccgctggtgaactgggaaccgttatctgtgaggatgcggtgaggcaatccatatctgcagaatattcccttgataaattttatggcgttgtcgactttgatttctcttgtcggctctgcttcaatccacttggtgaatttgtcgatcgccacaaacaggaatttgtagcccccttgtcctcgtgggaatggcccgagtatatcgagcccccagcatgagaacagacatgttaaggggatagtctggagcgctcgtgctgtcaacttggtgtgtttgctaaagaattgacaagcttcacatcgttgcactatttcacaggcgtctttgagagttattggccagaaaaaaccttgtctaaaagcttttccgaccagagtacgcgcgccggcgtgtgatccgcaaatgccttagtggatgtcgaggaggagagcttttccgtcgtcggatgatacgcacttgaggagaattccgtttggttcctttttgtatagatcgttgccgatcatacaatatatcttggcctgacgagacagtttctctgcatctgtgtcgtccggtagctcgtctgactccaagaatctgattagcggagtgcgccagtcgtttgtcgtctctgcatttgtgatgacgtttgtgacctctgcagccccctgcgggacgccggtatcagttgtggtgctttcgttgtccgtgtccttgatggatggttttgttaggacgtccaaaaactttccaggctcaagcggttcttgcctggaagcgtgttgtgcgaggtcgtctggttcgacgttgtcttttcggtagacatgtcgaacttcgatcccatcgaatctgcgttccagttttctaacctcggcgagatatttggctaactcagggctagagcatttgtagcctttgtgcacttggcgccaagcgactaatcgtgatgggagactccgaattggttgtggcgggcgggttgggagtatgctcgaccatgttgagactccgcttgtcgcactataccgccaacttggcgttctcctagatagcgattgtcccttttggtcccggcattttgagcacttggtaagcataatgtgacgctaccataaacttcgcgagcgcagttctcccaatgatggcattataggcggtgtcgaattctgcgacatcaaaggtgatctgctatgttcggaagttctcagcttgtctgaaggtgacgggtagcgtgattttgcccaatggtttagacgatgattccagggtaattccatggaagggctgatctgtgggcgtcagttcgcttcgaggtattcccatcgcgtctaaggtgctggcaaagagtaggttgattgagctcccgctgtcaacgaggactctcgccactttgatgttccgtatagtgggttcaaccacagttggatatctgtcaggcgtagtcgcgatcttggggtgatccaaaagacctcgatcttgtgttgagaccacttcatcttggttgtactcgtctgcgacgtgaagcagacttcgcgttccacttttttgtactccctctttgaggtgtacaacgtggaaccgccgaagatgtgggagacatgtaggtcatactctaggaaggcggagtcagagtcaccggtggcggcttcttccgccgtttcaacaacacgtactcgcttccccctttcgattgcatgttgtctcgcgagctcctttttgataacgtaacaatcctccatggtgtgattgctagtcttgtggattggacaccaagtcttgcgtgagtcgtcgttctgggggttagggcgcctaggtgattccttttgctcagtggcgaggacctctcctgaggacttgcacttcccactcttgcgatttctctttttgcttgactctggtgcatccttattggtcgatttcttctcctctcccgctttgctttttccctccttgcgcctcagagcattgtctgcatgagcgcacctatcaatgatctcgaacaactttagggcagacgtaattcggcgcgtcgtcagcttctttgtggtatatcgatctcggacgcctgatttgaatgctcgaatgacagaagcatcggtgatcttggggatcgtattcctgcactcgttaaagcgtcgaatatagtccctcaatgactcgctcgggttctaagttagagcgtgcaggtcgtcttcgatcgcgtggcgcttgtatgtcccttgaaagttggtgacgaactgttgccataagtcttcccacgaagagattgagcagggcgggaggtggacaagccatgaacgagcagagcctttcaacgcggctcgcaaataattagccaatgcgttgtcgtctgcgccagcggtgtagtgaattgtggagtagacttgcagaaattcttctgggtccgtacttctgtcatatttctccatcgctcccagtcggaacttctcaggccatcgcacgttttggagcatgggcgtgaatgccctgcatccacttcctgggacgggggggtggcccgtggttgcgacgccgttgaggaggccgatctgatgaagaagatgacaaagatgaggacgaggggctgcttggctcaggagctcggcttctcgagtgatgatcgcgtcctcaatcttgactcgggtgtggagattgggagtttcgatctcgctggttgtcaccgtcccgctcttggccttggcgatcattcccctgatctcggtggttgtcgttgttgcgtcggtcattgtggagtcgacagtctcggtcttcattgggggtgttccctcggccgtctttcctttcttgccacggaggagagcaatgacggtgttgtcgatgcgtggtgtcgccctcacgacgagaaggagagcgatgtcgatggcagtcgttgttgtcacgatccctcctgctcacggagatcgcgattttcgcggcatggcggagtaggatctcattcctgccgaggtgagtggtcaccggtgagacgtcctctggcgatattttctccatccgcgtcctcggtaggttgttcttcgtacctgcgcggttctgggccacctgctgcttcggcaaacgcggcattgaggttggtcacggtctctcgcagtcgctctacccattggccggcgtctgggtttgtcgctggatcaaaaggactttccctcaatatcgcgtctagatttcgcaactggtgagcgggcgttctctctgccgcggacgcgcttgtctcagtgttgtcgaccacgtttacatctcgtgttgactccgaagaggattcgtagccttccaagaggtgtaaaacagatggctcgttatcaccgatgtatcccacgaaccgatacgggattggggctgcatctggttccttggcaacgcacggagtttgaactcgtggttgttggacacgatgatgcggtggtttgagggtcctgaggaagattctgcagcttgtgagatcatgagatctggatctatgtttcggacagtaggtggctcctgtcgatgaagtacgctgaatcccacgttcccaataggcgtagagttcagcttgcacatggagtatcaccgaacagtcctcaagagtatgcttggatgtcttatgcacaagacaccaagatctcggtcttagggtggtcatccttgtcggctctgatcttttgtatgggggacaaaattcagccgcctgaggattcctcccgagtgttggggccatcgatgttccattctccacctgagtgggaggaattatcggcggggcgtcgtttctctgagtcgttaccgtgcctttctcattcccgatgatgattgggccagccgagattggcgtaacggtatagaccggaaagacaatggatccgacttgagtccaaaccaacgatgtcgaggtagaagctccttgattgacgttggagatggttctgttgtcgggaagtcttgaagtcatactggtagatccttgagcaccaagtccccctacctggcgcgccactgtcgacgagtgatactcgtggaccggataagttgagtattggggtacattggaacgagggtctacgtagtacaacatcaagcaaacagaagacaaggattatactggttcaggccccctaacaggtaatagccctagtccagtttatataagattgatgacgatgagaacagattacaaagagagtagatggaacagacgataccgacgagatcgtagtcgatggattcgacgagatctcccggtgacttggctccgaatactccggcttcgtaagctatggtgggtgtgttggcgatgatattcgatgtccttcacctccccctaggggtccccttttataccgtggattatcttgaaccccaagtaaggcctggaggtatgtaatctgatacgatataacagagattctatccccctccgagtaggactttggtagtttcttaactcatagggatattttccgtaatttaagataaattcctaacgacgtatacggaaacaatccatgtacgtgaaggtatgccttattggtatattccataagtcgtaggatagaaggtatgccttatccgtaaccctgacactcatgtatcgctaggaatgttgctttcgcactcattttgttggtacatttgtatatgtagcaaaaattgttgccttagcttattaatatcctacaaatgcatttatttataaaataaataaaaataatataaagtaattttcaaggcacgcataaagagatgtatgatacaacccgacaaggtactaagaaatttgaatagttagctaccttgcattagacaaataaatttattggttcgaagagttatacataaaaaaaattaaaatggaatatccattttaatatgaatacaaactaatactgaaataaactatttatcaaacacaaggcaaaaaaaaaaagagatgtgtgatattaaccttaaaaaacatgcctaacatgaatcataatccagagtttcgcacaggaaaagtccatctgatctctacacatagcttttttttcccaatatgtaacaaaaggttagggcatatagaccgttcatactgcccatccaacaaatttaaatttaaaccatcctcgagattatttaatgccatataagaagatgaacgattgacaacatcctcgatattaccatcctcatcatacgtgacatactgtatgttaggaagatgaagttggagctgcaaaatagttggatagatatcgaactgtgggaaaccaagaatcctatatagcctctggcgatgatacgtacctggcatcattgtactgtcctatctcatttatttccccaaatggatcaacaaagcaaaattactattagtggttttagatttacccaaacaaatagttaagccaagacactacaaaaacctagtattcatattagcgtactgagtatcacgcagaacaagtttcagacaatgtggatctcatcaagcagtgtgccattttggagaattcttgtgttacacaaattcaatccccactacttgttaaaattgtaatttttgtccatcgagacaaaaaagaaaaataaatatgtgaaaaattggactcttgtgtgtccgcaagatttgagtgaagaaacactggatgtccataccagcaacttgcaaagcacaggctttgttgctatagttcatgcaaatgtactcaagtgtccatagcagccctaatgattcatttcacttaatttaaaatggaaaaggtcaatcatcgttaccagaagataccgtgcatagaaaactcaactaaaccaaaaaccatcgccaattaatgtagtccattaattatccatgctaatccagttcttccataattatgcctactaacataagataccacaagtaattgctttcatctggatgacagaaaagatagattgcttttagcaataaaactataacatttttttaacacaacaaattgcaagatacaataaaccaatccaatcacttaagcccaaatgagaaaactgtatgccagttgaataccttattggtctgatcacaatataaaacattcaagaaatctaaaacgctcaagatgtgctcaatgaaatgcgtatgtgctgccaacttccccgtcgcaccagagctgctcccctacatgaaaaagatagcacaaaatagaaaaggaatcagaaaaaaggaggccacaatttccttcagcggatgtcagcttagaacgaaagaggttccacactttttggttgtttccaaccttaatttcattcttgttatgtgcatacacaaacagcactgtgttgcacactgcaatacagaaacaatagatgcaattatagtagtagatggatttcgttactgcttaaggcctcaacggacttggattcaccagggaccattctccttgcccgcacttcctgagattttcgtgccgaacagactacctcctctgacctcttcctccactccctccgcgtcccgcatgaagcatgaatcttggacaagatattgataatggtgaatcgtatggttcttatatgcttacctcttgtaagattgaattgatctcagggtgtcagatgtgctgccgtgcttgaagaactcgccgccgccatggatgcacgagagggaggggagacagagatgatgtaggagagagaggacaccgggggcaacgtggtcatgacagatagcgactggcgcgcggcggggcgtggacgcggtcgaggcaaggttaccttgttgcctggatcgtgtcaacgctaactggacgcctccctttcgaccaccgcatccttctctcgccgcttcacggccgcccgcctgaccgaacaaaatccatcctacacatatgccgctgccgcatacttggaccttggtcctataaccggccactgcctccgctagcacaaggggaacaatgacgctagggtagaggggggcgccgatgtgtggaggggctcacgggcgaggtggcgcaccgaatccgagtggtggtgacggcggcatcatttttgcagttagtgttcatgtgaaaacatgaggcctgggggatctgcttaacttcagtgcaggtccaaaagctttcctttagatgtgtgagcgtgccagttaatttgatcctgcaatcaacaagaaataaagacaaagagaccgcggttaaatccataaatgatagccgatcggctagttgccgattacatatcatctatctctaggccgatgtcatatgtgaatcgatcggcaatcatgaatgaataagaaagaactaaatctactcgatcggctatagatattaataatatataatccttatgtcaatatatacttacatcaagtgattgggatagatcgatcaccatgccgagacagtataaatcacttagatcgaaatatatattaacaactagactatatatattcatagcatagccgatcagatagatctagcatgtatcggctaatactccgatactactctatattaagatattaaagcaagtagaatatactaaacaaaagcctaatatacttaaatgcaacaagatcttaatataaagggcagatttaacatgtcaatcaagcatatgagatgaaagtagttaaatcaggtaaggtcggctgaaatcccgatgctacactaatcggcaaccaaaagcaggctagagattgagattctaatcacgacttataaggttaaactcaactgatgcagctataagtatgaaaagaagaacaatatctagacaatcaagccgttggatgtttcatagagtggtaaatatcatatataatctaagtcaacgttggtattaagccgttggatgtttcatagagtggtaaatatcatatataatctaagtcaacgttggtattcaacctaatcggctgccttctagcaaaagatgttagccgactagaggttagataacaatattgtcaaagattatatagaatatatggtaactcgatgaattacataaacaagattagagtatcgtaaagatggaagcactaatctcgagaacgcaagccgccacaacaagttttacctctagttgaagatcgaaaccgatgtagctcaacccgaaagcgagaacttgtcgaaacaaaacgaaagtaaaatggtggcgatgctctgagattgtattgaatgtgtattgttgtattacatggggctcggggtctatttatacccaagattacaatatatgtccgtgtcggatacaactcttatctctaacaaactctaagatacgcagacttttgcccaaacatatctctaaggaaattacatgaaatatcctaattaatagatacaattgccttctcaggactcaatccgtgcgtagcaatcctcatgaagcacgttaactcaacccgacaacgtgtaccgtgtcacattgtcggattcggctcaatcggctaactttgtccaattcggactctgccgatcccagtcgcagccgattcggactccagccaatccttactctgtttccggaacaatttccatctcaaattctgcttcgatcctatctttatttcggatacttggattaccaaatttggttgttaacagttagacgtgattttgcgtgatttcaggggaatgagatcgaagggagggagggagcgtggcgagctatgtgatgtcggatgcaactcacagaatgattttggatcattggatatgtcacacgatgaatgagtaaaaccatttatttaactatatgatagatagatcagtgaacttctttgatatagctatagttataattggttaaaaacaatttatgtttgtttgataataggatatagctaaagaaagtagtgttagattaatgacggctttcctgccgtggttagaaggccattgactgcattcgatcaagcaaaataacagtagttgcagatatccaacccaatgtgttataaataatactatataattataatatattatataatagtattttctaaagataaggctcttcctttatatttggcacagaccccaaaatgctaaggatggctctgtagcaaacatcctcccaatcacatgcacgccactaaaaaacctctctcctgtcgcattgcaaccgatcttttttttcaatggagtagaagagatcaaaattgaactctgaatgacatcatgaaaactctttttttatgcatcagcccttcaagtataagctatgtagtatctaaatttatgcataaactcacatcatcacatgcaaaccacccacacatacgccactacaagtaagccagtgctaaacggtgtttttgaaaaaaaaatgtaaaaaagttgctttaaaaatcatattgatctatttttaaagaaattaataatactcaattaatcatgcgttaatggtttatctcattttacgtatttttttaatctttttttctttcccctcctctcaaacacagcgtaaggaaataaagcgaaggcagaggacgttttatcgccgctacaacaaaaaccacagcataaggaaataaagcgaaggcagagaacgtttcatcgccgctacaacaaaagcccaacccgcagcaaaactgccctctttgggcctcctcaaggcctcaacactggcttggcatgaatgaatcgtatttctttctggtccttcggccatcaccaccagcgcaagcggtagcgaactagtagcgactgcttgtgcttctttcatcttctgttgcgcttgcgcggggcggggtggtccacaaaaggctgcaggctcagcaggggaggacggacggacgaggacacgagagcatttttgcgaggagctcttttttccagcgtcccactgccttttcaccggtccctgtcacttttatttttctttattttttgctgctgctgcttttccctggatatactacccgcttgtaccgccggggtggcgctgcggcaggcggcgctggctgacggctgaccgactggctcactgcagcagcacgtgcggggttttatttccgcccgttcctcggtctcctcacatcggcggcggagaaaggattttgaggccctggggtttacttgtactaatgtcatgtttgaaactctaattattctcaaagctagatatctttagctcaaaatttttatatttgaacgaaaagagtactattatgatttttgaacaggggagttttttagatttatagggctagatgtgttatatcatgtcttatgttttatttttttagacggagtactcccattttcgttgagatatttcagttgtagggtttcttctggaaaaaaatgtttttaaaatttatgtcggctgtgaattctaggaatattttttatatactttgggacttaatgagtcttttgaaatcccattggaataacaaaagaacgatcatttgtatttcatcttataaaccgctgttagaaatttgaaatataaggtcttgtttagttcgtgaaaagaaaatttttgaatgtcacatcggatgtttgaccggatatctgaaggggttctcagacacaaatgaaaaatttcataactccctgaaaaccgcgaaaagaatcttttgagcctaattaatccgtcattagcacatgtgggttaccgtagcatttatggctaatcatagtctaattaggctcaaatgattcgtttcgccatttccatgcaaacaatgtagttatttttttaatttatctatatatataatactccatgcgtgtgtcaaagattcgatgtgacatttttgggaaaaagattttgggaactaaatagggcctaaatttaatttgaaaattttgattttgagttttttttttcaaatcgttgttggcaacattagattttaaattgctaaaaatatagatataaaaaaattactgacaaatacaaaatataaaatttatgcataaaactttatgctgaaaaatagattatgatgaaagatacctatattaactctaaaattaaattttagttaccgcagataaaccaaggagtagacaatgagacccgtctgcatcctcaaaattataaatttcattttcgattgctagaagtcatctatcctcatgcacaaaacagagggacaatgaagtaccataggcatgcgatattcaatctatcgtgcatggctcaattcacctatatgtttatttcttgatctttaattgtagaatttagtgtgatttatagcaatttggatttggttctttggtgaaaatcaccaagttgcagatagcctgaaaaagcaagatcgtgaatagaaaaaaaaaagaaaccggtgaaatgacaaaaagacaggcactgggtattaggtggtgtttgaatctcctaaagatgaagatgtgttggaattaatagatgggtcttaggccactcgaagattaattctttggaaaatcataaaaacccaccttatgaggtagcatgcataggaagtttagtaccacattacttattctaggagagggtgacctccttaaaagggaggatgccctcctagccacttgaagcaaatgaggtggagagaagagggggaacacacgcgcgcacgcccttgcctggcagggcgtgcacgatgtacgcgtcaaatggtccgcaaaattggttcctcacctttgcgctgatgtagcctccttttgcagttttgttttgctgcgggaaattcggatttgtttgttttggaaacattccgaaaaatccgttgcgtgaaaacggcgtggagtccggataagttacgcgcgacttatccggttcggttacgtggagtggagatcgtgcgggcaccctgatcaagtgacctttctctatataaaccgagccaccgccttcacgcaacatacgcgaaatcaatctaaggtttgcctcctactctatgccgtgccatcgctcgtagactactccatcccgctcgctggcgtacaccggcgatcgggaaagcaggtctccggaacctctgccttcgacatcctgcaccgagaaaagaaggcaataaggtttttgggaagcgcttcacgcgactgctccctgttcgtacatgacggctcgtcttcctgttcgctcgcgtgttgcgcactttcatcaacgcccgcaaccgcaagtaattcctgctgagcaaccgatgtttcggcaacctcggtatgcgcatatttgatctgttcatatttttttacttagtttatatgtgtagatgcaatgatgcattcatgctagtttacatatgcaatgtcatgatttatttatgaaataaattaaatcattatgtgcttattatttcaacaagatgaagataaagattaagcgtgaatgtgttaacggttaaaatgaggctcttattgatgtgtgtgactctgtggactgtggtggtgcgcccaggtgccttccacagaataaaaacaaaaaacaaaaacattaaccgaatacgtaggtgagcccaactaaagaaacaagatttctagtgcaatccagctgagggagtgggcaactttagccctgttaagagaatttaagattttgagaagtagtcaattagctggtaataagctagctagtgaaagtgtgaaaaagctgggtttttcttttctggtttctagtttattttctaaattctataattttggattctcagaatcggtataacaatctaaattgtttagagaagattttaatgatcaacgattttgaaataagctacagctaaacttctctaaataaagcctttgtttctgatgatccaagaaggccaatgttttatttatttttatcaagttttctaacgccgattaatcaggagtttcaagtttcactagcttatcatttgctatctaaaatccaatataaaaaataaactacgatgaaaaaaacttataatcaattgtaaagttaagttttagtagaatttaaatttttcaccaataagtctataagcaaacgatggatctgtaggttcacatgggacgacaaaagcgacttaattttctataaatgttccagttctgaacggccgacaatccctttcgtttttacttctgctgacaacccctggtttgccccctcaattccctttagtagtactaagcaagattaatacatctagtactaccattgtcactactactaacataaccctgtaacatattaatagatgtgctgctaggaaatatcacagtaacacatcatatgtgctacaagagtagtctgtaacacattggaataagaaagaaaatttttttccaggaatgcactagtaggatcacaaaatatatgttacaaaggatatgtcccaaaggcacattatatcaattatgaagatcgaaaggctaaaccattcgtcatatgtcagagccaataaatatttactccagcatgttaaaccttgagatataataacaataagttttaaaacgtggtgcgcacttgacattcatgtaaaccaaaacaaaataaatgcatacatgtgaaaatacaaatttctaactaagaataacaaatagtttaagaaataacctatagttcccatgatagaatacaaaaatgtgctcatattgggaaaaaaaaagaatcttctgaaactatctgtagattaaaacttgtgccacatatctgcacagaacaaatacacaggctacaaataaagcttgtggcattctcctcattttgtttgctgcaaggatctcttcacaacttatataagcttgcatctggagagttgtacagcacaggcgttgacagtgaacctagttatgatcaatggattagtgaatcagaagcaagtttgggtagccccacgacaagcactattaaaaattcaggataccagaatcagtataatgtaaaaatagttaggatgcactatattcatcaatatatttatctatgaaagcaagaactaaaccttgttcactttcgctgttatatattaagcatggtcaattgatgcgtttgaggcatatcaccattttataagaatgtaatttacagcttggactaattcttcggtaggtcttgttttcagttttagcaaaatgcaaattgggacttaatgctagtgttatctatctatctaaactgctactcttaaggaaaataagaagctttcacaaaatagaaaatacatatgtatttctttgacagttgaggtacaaattggtagaaaccatcaaatgctttgtaggaagagcatttcaatcatgtaagaaaaataccgattaattgaagcatgtgggtagttgatagcaccaagggccaatttagtgccagtattacataaggcagtttcgagacatcttgtgctctgctgaaagcaccttggtccacatttgttatagtcatgagaaaaacatgcatctggtacaagcagttagaaccaaactatgcacaagtataacagttccccaactctccaaaggtctgcaagccaaattatgcttgatctccatggtcctgcaggccaaaaatattccagcttaccaacaaacataaacccaagaatcacccatgatcagggttctcaagcagaatatatttcaaagagcatgctcgcttgtatatgcaaaactagtgtttattttattagagcatattacaaattaatctaacatatggtaaatgcctttttggtcagtactagttcaataaaaaactgagattatatttatcactcactagaagtcgatgaccatgctccatacaaaaccgatttagtttacctagtatttttttaactaaatcttaacgtaccatgttgtcaatctagacatgtgaatatggtcaacagtacagagtgacttccatacaaaaagaatattgcagagtgaccatcggaaatgtagaacttccatctgtatgatatatgagccaacatagatcatgatcatactctatagtatataaaaaaagaaatggaagggaatgaccagttaaccaactgatactctagtgttgctgtggataagtaaaggaagcacagatattatctgatcatacaatttagagcagactttgtttttttagatgtaaaatgttatattttttagcaaacattttaactaatataagcctttgttaggcaagcaatgggcaatcaaatgctgaaacacagcatgaacgtatatatgaattcaaaagataaaaaaaaattacctacacacgttttaagggctgtagtagcacatagctgtgttacaagaacctagttctgctgtagtatgtctatgacagaaatgtatccatggtcttacgtggacgatgtagtgaaacatactgaggttacaaattaaccatccgactaagatatggatggttcaagttatctggtacaatttggaagtgactagggacccgatcgaaaacttcaaaaaatcgggcgcacgacgtcagcgcccaatttacgtgtaaaactactttaaactaatttttctcttaaattacttatccaaatcatgatcagattgcaattaaatcttcaaaacaagaccacacgtggatatattccgacgaaaaaaaatttagcttattattggattatttttaaattggtgcacgatgttccaccaggtatatcggaattgttccagtaagtaaatcgaaaatgtttcactcgtttaaatcggatgttgtttcaccttatataaaaacaatattttagcaaatagcgaagaatgtttcagttcactgcaacattagatctatacatagtgaaacattgtaagtatactaggtgaaacatttttcggtggaacaaaaaataaaccgaattcccttaatagggggtttctaaaatatgtgggtttttttgttgcaatggaatgtttcgttcactgcaacattagatctatacatagtgaaacattgtgagtacactaggtgaaacatttttggtggaccaaaaaataaaccaaattcccttaatagattgtttccaaaatatatgggttttttgttgcaatagagttgtttgtgtgtggacacgtggtgggccagggggagtgcagacatgcacacgcgcggggggctgggggagtgcccgatttttcctcccccacccggtcgcccgaggataatcatatccctacaatcttgatgttacagttacaattttatttttttcacacggtagaattacgggcttgtt

SEQ ID NO: 17273 - DNA, 4349 bp, Oryza sativa
tacatacctttgatacatttatatatgtgtgtgcatttaaacaatgtgccagactcattttcacgtagctacctctgcagtactaatgtactagatcgatactgaatccgtctatgatatgtgagataggacttactatcattactaatataggggtgtttagatttaagggtgtaaagttctggcgtatcacatcgggtattatatagggtatcacatgaggtgttcgggcactaataaaaaaactaattacagaatccgtaagtaaactgcgagacgaatttaagcctaattaatccgttattagtaaatatttactgtagcaccacattgtcaaatcatggaggcttaaaagattcgtctcgcaattagtcgcaatctgtataattagttatttttaaacctatatttaatacttgatgtaggtgttaaatgttcgatgtgatctggtgtaaagttttgggatgagatctaaccagggccataatataggtaatgatagtaaacaaaatataggtaacatcattactaggacatgccacagtttgaggtgacaaactaacataaatgaaaaatattgtatggcatcattacagtatcctctcccagatcaccagctggcgagctaacaaaaaccagtcaaaatattcatattttcctctatctttgttctcaatcatcttttgacgattcgatcgttcgttccgtcatgcggctttcttgtttgctgtcaacagccttctagtttggtcaagacaatcatcagaatcaaatatagttccaactatatatgttgattatatagatttatatactaaaatcaaatttgccacagatccccttgaactttttttctaaatgtatgaaaaaaaaaaggcgcacaatactgtagttcgaatcttgtcctgttacttaaaattgatcccatcttctaccaaaatttccaactagtgctatgcaattatacaagcgagtacttgtttaatcctttgcacacgatatggcaccaccgatcacctttaatttctattggtgttcttcatgccacatggtggctctccttttaatgaagtatataaaactagacaactttattatgatcagtacaaatttagttattgggttatcttacttttctactctctcgcttctaaaatatatcggtctaagctttgtttttactgtagtttcgaaactaatccccacgcatgaaaaatagagtggtagattaacacatgattaattaagtattagctaaaaaacttaaaaattggattaatgtgacttttaaagtgactttcctatagattcttttttttttttgcaaaatacgtatcatttagcagtttgggaaatatacgtgctgaaaacgagggagtgaaggttgggaaccttgataaataaatttggctctaatattgaattaaatataacctaatactacaagtctggacactatatacatgtgctatggctaggtcatcatagaatacacgcaccacttataaccacagcagaggagctaagtgagaggagatgaggagagaaggacaaggagaggaagaaaatgaacggagctttgtttgtttatgataatggaagataaaggatggattgagagttttgagaaaattttcatgagacgataaaaaatttaaatttgtaatataatatactagcacatcattagagacatgtctggaattctaaaaactcctctcccgcgtcgctccttacggggtgacacgggcggtgctccatcccaccggctgccatccttctcccttcccctccctcgctgccgccggagcaagcctccaggaaccacacggccgcaaggacagcaacgacggggccttttcttcttcctcgagcaagtgacagtgggcagccgatgcatggcgagctgcgggggcaccacaccggggcagcttaatgtgagagccggtgtccaccacggtggtagtgggagttgcgacaagatgcgacgatgacggatggacagcggttggatctggagtttcctcacctagatctagcgctgcaacatgtatctaggacctgttatccctcccatggtgatgatggtggttggggtggtgaggagatggccatggactcgacccagcagtggccgcaggcgagcaagcacttggtcaaaggagggttttggtccaggcctcaggtcgggagaggtagcacggaccgactaacgatgcgggcaagcaaacatgaggtgatgctacgagttagttgctctgctagggaagaaaggtcggcggaggccggcttaacctaggaagcctgagcgggtggtagccaagaagttgtggtgaggtggccgttgggaagttggggtgggcgccacttcgaggaagcttcttgcattgggtctgagatggacttgagggtgtttgctcagtgcagatgtggtgcagttggtgtaggccgcccctagagacagttagatgggccggatgatggcgaggcactaacacaagcagcatcggtggtgttgtggttttgatgcagtgccgttggagctcatggcctacggtgttacttgtaggctaatcgatcgcttggtggctcgatcagttggacatggcggtcatcagtacggttggcggcatggatgacagcgagctagtcctcttttggccagctaggctgcctccctcttcttggtgctccttcccctctaatggctagtttgctttcaaacttcgatcgtgggaagcactgagggatgtaaggggactaccgttagactgagaggatttccatgtggtggaggacaggtggtctatgacactgatattgctttcacgaggcttgtggcagcgagggatcccgtgtgggttttctctcccatatgagagaggtggcgatgcaagcagttccgattgagcaaccatgcattaatgtgttgggggcgaaagcggagccgcttggccgatgtggcaagcttgacaacgataactctcaactattttcgttctggctgtgtggcaagggttttttaggtggagtggtgctgatggcttctgtagagcaattgagttgtcgtgaaggcggagctactgcgccgggtggcaagctgagcaacgataacccgcaatacctttgttctggcaacactagaggtgttcgacaaatgtgagagctttgggtgaaagccatgcttggtatatgaccattgccggcaatgtcgacgtttgtggacgtcgtttcctccttggaggcatccctagtctagttctcgatgggtgttggcaacgtctttgacattgtttttctcccttggaggcttggcttagaaggtccaacttaataataagtgtgttaggtggttttaagccagtaattggtcaaagaaagtaagagcttcttgtccggtaatagcttggtaacgataatttgtgtcgggtctcagtagtggtgttgccacaggctcttttttttcctgctttccatgtgtgtttttgccgactatttagtttcatatccggttttcttcataaactgggtcgattccttattcttcttaatataaactaggaacacaatgcccccgttctcaaaaaaaaaaatagagacatgtgtaagtgaattgcctttcctagaaagtaaaagaaaactatctatctattatgtactaaaagttcattaaactccctataaaagctctcaagctgtcacgtagctccctcaaaacgctctcatattgccacatggcactctaataaaatagagaaatctaatcatcgattttcatttaaatcggtggaaccattattttacattgttagatctatcttcaaaaccaaaacctcccaccggccccacctccgtgcagtacgcacatactactccatctgtccattctctttttttttccctttgttcctttcttttctttttccaacacaattaaaattgaacttatctttatcgaaaagaatacccccacaaaagacatcaaacgcgtgtgtggcactcttaaattagagaaacatccaaacattggtttccactaaaatcgatgaacacaatattttacgtcgttattagatttgtattaattaaaagtccacgaaactttctacaaacactcgtaagtcgtcacgtggcatcctagaaatgttcctaagttgccacatgccactctaacaaataaccgttgattttcattatatttgatggacccattatttacaaccactagatttatcttaaagaaaaagttaacaacccaaacctaaccccacccagccctgtagatcgtacgtacgtacttatatctcatatacaaccacctattatatatgaaaataataataatatac

SEQ ID NO: 17274 - DNA, 1353 bp, Oryza sativa
tattattattatattattattataattattattattataattattattattattattattattattattattattattagtactactactactattactattattactattattactattactattattattattattattattattattattattattataatatacctcagatacattagatttatctttagtaacaaacttaagatcaatctggcggtacgagtccacccacgcacgtacatgtttccatccatacgcatgataagagtctgtgtgattttttcctcgctcgccacccatttttttccaaggtaattaagttaatttcatcgcactttcaaagactgcatgcacttgcaaatatagacatagataatatacctcatacatattgatcttggtatgtttttataaataaataaagaatcttcaatagctgtaaattttaaattatatattcaatttatgatctgtttgaaccattgtattttttaattaaatcaatagtttaatatctataccaactatatttaattgcttataaaattattatattttggacccacatccataccaaaaaaaaatcctaaaagttatcattaaaaatcaaaatatccaccttatttttttaataaaatcaaaataacctataaaccattaaccttaactttaattatagcatcaatggacctattgactcataaccaacttaattatatcttcaacgtttatgtggatgctatttacttaatcccaatgccttgataaaagatatgatctttttttaaggataaatgaacgatcttatgctgtgttcggcgctgaaggttgggaaaccttaatcccttggaagttggacattaacttatagcccaaaatacctatatcacgttgctcaaatccaactaatacaccaagaaaagaagaaggagagatggtgtctacagagctgtccttatggatattttactaataaaaattgattttagatacttattatccttattaaattatctaatcactagaacaaaggaacataatgtccatggagtgaacaaattggagggctggctggtgcatcccggtgtgcatgcatgggtatataatattttttctcagatgaaaaaaggggcatgagatagttacatgtattatgcatatacatgcagggcacttttttttcttctaagtatggtgatgcgagcatgttgccggaggcacgaattaacatgtccaccgtccgtggtgaggaaagacgaataatttggttagtttgactctgcacaatatgttagatcatctacatatccaatggttagaaataatggtctaaaattgagggtcatatat

SEQ ID NO: 17275 - DNA, 5341 bp, Oryza sativa
atctctaataggtaattttataattcgtcatgcaattctaatgaagaaaattcatgaaaaaaaacacaattttgaaacgttgcagatattatttcgctgctataccacctttataggtttttcaaatctaccttcctagtttgtataaaaggccatctctagaaagcactcatttatgggacaattttagatgggcactgacgcactgaagtagagacaagcatcataactaacctactctggtattcttatattcttgttcttattcttatgatatattggtaactttaaactctctctatcctataggacatgattctctacagcaatggatcataatttggtactgtgaacttgaaattatttagtatcacattttaacctcaaaacaatgcaatatattatgctgagtttcaggatatattatgatggtgaaaatccattttggccaagtgcatttctcaaacatacagatagatctctttgatgatcaaaacgaaccaaactcgatatgcaactattttgtatgaaatcgttgaaagagcatgtcactggaaacgactacagttgtggaattgtggtcaccaagttgatgcatgtttatttgggagggtgttttgagtagctacaactaccctaaaataacaatctgaatcctctctttagattgtgaaacccgatagttctaggatccagtaatgagctaatagctagaggctagggaacctagagcttcaacatattaccactagttggatgcttgtttatagcggcttcttgtaatctccagctccctaacatagcctagcaaagtcaatgataaacgtaaaaaggccatgattgtttgagaaatgaaaagtcaaagtgtttgtccagatgaaaaaaaatcctggccgccagaatttttcgagtaatattaaggctgagttctttccccaactttcccaactcacatccctcgtgctccacgcacacactttttaaactgataaagggtatttttttgcaaaaaaaaaatctaaaaagttgctttaaaaaataatattaatccccttttcaagttttttacctaatacttaattaatcatgcattaaacagatgctttgttttatgtgttcccaacccatgctaacgaacgcagcctatgaggagaacataatgtatgcagcatgtccaaacatgataacaatgtaaacaatagaaaggtagggaaaacatgtgaaatgcctttaatgcgtcatattttatatgaaatttgcatcagtttacaatacttcagtttctaaaagaaaatgaaaatccaataggtggaatgcatatttcttttctttgttacaaagacaacataactaaaagcaacataaatgaaagaaaaaaagactatttaaaacacaaggaacagatgacaaccattttataaaaaaaacatttagacttttgcaaaactagtattcaaaactgatgaagatgcaaattaagttagcacacgtaaaatgagaaagatattgacacatgaataattaaattttaattattacaaacttgataaattgatatatttgatattttaaagtaatttctatatagaaagtttttacacaaaatacaccatttagtagtttcaaaaacgtgctaacgaaactaagataaaatctgaatctttatcagaaaagaacagcgcaaaccatgtagacttcgaaaggtacaccatggaacaacaatactctctaaaatattaatataccttcttcgagcaatagaggaatactacgaaaatgctctctatcggtcgaccggggagaggtgggaaaatcagtcgctccccctccccccacgcgcgcaccatgctggacccacctacttgtccctccccttgtccataaaagatgtttcacctagtgtacttataatgtttcactatgtatagatcaaatgttgcagtgaactgaaacattctttcgctatttgctgaaatattgtttttatataaggtgaaacaacacccgattaaacaagtgaaacatttttaatctacttagtgaaacaattccgatatacctggtggaacatcgtgcaacattttaaaaaaattcaatagtaagctaaaaaaattttcgtcggaatatattcatgtgtggtcttgttttaaagatttagttgcaacgaattttaatggtgcaatcggattatgatttggataagtaatttaagagaaaaatcagtttaaaatagttttgcatgtaaatcgggcgctgatgtcgtgctgccatcagcgctcgatttttctctaaaccgatcgggcgtccgacccatggactcatccggaatactttgatataataacgtgattttgagggattttcgtaggtattgaactaactcttacaaaattcctgatttctttccctataaaatgagccaaattctccaaatgcgataagtatttttttaattggaatcctatatgcgttacttccctccaaggagcacaaactccaccagcagccagcctgaccagattttctccagctaggagtagaaaagaatgaaagatacagctacaatagactagtactactaccaccagtatacatcccccattctcgttggtagtaaaacacatgtggtcattaaaagaagctagggagaaacagcaggtgaggtgagccataagaaaaaaaaaactaataaaaaaagatggcgtcgtgtgacacccaaaatccacacacacaaaaccctttcacacaaataaaaataaaataaaacaaaataatagaaaaaaagaataaactatagatagataagtatagaggaggagtaaataaatacttttctccactacctcccttccctttggcctttcgggacctcaacagagacgcacctcggtctctctcctcctccacccaaagctcccacctttcccttcctcctccctcctgcgctcgcctcctcgcccaattccgtccccaattcggcgctctcccgcggcgcgatccgtcgaatctgcccggattcggtgtcgattccacgcggccgccgggggagcccccctcccgccgatttgtttcggagcttttctttttcttcggattcttccttccccaatcctttggttcttgttctttggtctctccttcgaaattcgatccctcgccggcagcttagccggcgcggcgcggcgcggcggcgatccatctcccgcggtttcgatttgggtttatttgggcggtggggagaaatccgtggttcggtgcgtttggtatgagctgaaaaggtcgtcctttttttttttgggttttttccccctgatctgcgcgtgttctcttctcctggctcgattgcgtgttgtagattttgtgtttttgttcttgcgtttaaatcaggggggaaaattcctactctgtaaacatttcagcccgattttctgttcatttccacgtttgatttggtgcaggaaaagctagaatttttacccttcttttttccgaataatatttctctgatttctacctgcgtagatctcgttttcctctttggttttgggtctaaggcctgcaccgattcgatcaaggaataaaaaaaaagccattgatttcccatttccgaaccttttatttacctcaacaaactccatttcttgctgttcctacgcccaattcgtcctgatctggttgtccaagcttgggattcgcctccacttcccttgatttgttcgtccgcgttaaatccgatggcgcaggagagctgtgatctcaacaaggacgaggctgagatcttgaagccatcatcatcatcctcaccttctccttccccaaccacagcctccccatcgccaccaacagcacaaatgacagaaccaccgcctccgcaatcgacaccaccaacaccaccggcagcagcagcagcggcatcggcagcagcagctcctcaattctcagccaagaactgcgaaggtattctcatagaggtttccaagaagaggaaactagccgaagccaccgccaccgatgctaatgccgtggtcgtggcggcggtagccgagccattatctccggtgctgtttgttaaccggtgcaacgtgtgccgcaagagggtcggtttgaccggattccggtgccgctgcggggagctcttctgtcctcgccaccggcattccgagacccatgagtgctccttcgattataaaaccgcgggcagggaggagattgcccgcgcgaatcctgtgatcagggctgccaagatcattaagatctgaggtataaacacttctgtggtggagtcatattaagatctgaggtataaacccatgatcatacatcattatttgtaattttttgttatgattccctgcttgcttagttcctataagatgtaaaatgccatacactcaaggtagcattttgtttggcagataagaattgtcattttaacagttatacatcgtgatgtgatgcttgtttccaatgtatagtatttctaaatgatatatttctttaagttgcaaattgatttacttatttgcattccaaactgtgagattatttgactcagctggattaacttctgagattattttcttgttgctggttcctgtctcatcatttgcacaatgctgcatttcatttttcctagttcctagggtgttcttggcatttgcacatccttgtttcatgtatatatattttttccatttctccatagtttctgtagatgttatacattaattgacctcaactatttccattcattgaaaccttgtaggttgtatgatctatgaactatatggaagactaatcctggagatgctgcaagtgaatcatgctgtaactacatgagctattcaagagcatgatatctgcatgtttgtgaagtaattcccatacagccgaggccatagtaggatagcagtctacatcaagcgaaaaatctatgggtcggctgatgtgggagaaagcttcactcttgttcatcgtccgccttcgatgcacaccatagctccttctcaagctaccacgcacacggatgatagcaagtgtactgtccagtcataattttattggatccaacaatttattgtagtatattgtaatctttcttttttaagtcttgttcggtttcgttcaacacaattgtgtgttactgaaaacatgtgtgatgtttggaatttcagttcaaggtggagataatcacctcctaccctgttgctattgcgatctgtctggctgaccgataattagtctgtcatgccacaaattacatgatgttcctatcaacgattgagaaacctctagtttgctcatgctgcaatttataaatgccaaccttatggtcattttt

SEQ ID NO: 17276 - DNA, 683 bp, Oryza sativa
tttggagaatgaagctttaataaggattttctgaaaatgagattaaggaggctattttccaaatggaacataacaaaactccaggtccagatggatttcctgctgagttttaccaagtgttctggaatgtaattaaatttgactttttacaactttttaaggattttcattctgggagtttgcctttatattcacttaaccttggtactattattcttttgcctaaagtgtgctgaggcccatgaagattcaacagtatagacctatatgcctacttaatgtcagctttaaaatttttacccaaagttgctacaaatagattaatggattttgctcaaaaggtaattagtcctactcaacagcgttcattctgggagggaatattaggaaaggagtggttattttacaataaaccttgccataaataccttgccaaaaaaaaagtgggggtaatttttaaaatcgattttgaaaaagcttaagaccaagttaaaaggttttttttaccaccaaccttgaaaaagaaaagcctttttcctaaaaggggggaagggaaagccttctttggtccaagttggccaggtgggaaaaaagtaagaaccaaatgggaaatggtttccaaccttccaaagttttaagaaaagggaccccttaatccccaattctttttaaaatagaagctg

SEQ ID NO: 17277 - DNA, 3556 bp, Oryza sativa
acaaaaacaacatcattcaatctcttgtgtactaactggttcattttctttggtagggatctgcagggatgcaaataccaagggaagaaaaaaagggataaataatttgctgatatagtaaagaaatttaagcaaaactacagataaactgactcgcaaatccaaatgttctccaattgagctcacaactggataaaaaagctcaattggaatgcatgctgattggtatgctggataaaaaagctcaatttatttggatttatttttatctattataaatcaggaatgcatgctgattggtatgctggataagtcaccaaaatattttggtagaaacactatttgatattttatctgcaaacaaaattcgtgtttttaataaaattttccaatgattgaaccacctgtacattgtgatgtacttgatgggtatatcctttgaaggagcatcctaagtaatatgcactggggatattatttcctgaaaatgtagtgtattgtgattccacaaagctcaaatatctcaactgaatcattccaatatgcttagttatgatcaagaaactttagtagcataaaatggtcggtgaagcactttgtccagacatctgactaactgaagtgatgtactgcattaaataaagtttattttatatatcatacttgcattttcaatgttccatggccatattactggatatggatgaatatatctgtgtttttgtgtacctcactactataacttgcactgtccacacattttcctagctgaagtgatgcaccacattaattaattatagcttgcattgtccacatattttcctagctgaagtgatgcaccgcattagttaagagtttattttgcatatcaagctagtggttccttattttctacttgactgaaacttttgtataatacagggtttagtatgataattgataatgaagtgagatattgagatgtaacatctttgttccccactagttttatgttggaatttcaggaaatattttaaaaaaataatcaaaatttgacatcagaagtttagacgagtatgcagagaattactgccaagattggatgaccatcactggcttaactattaaggaattagtttatttattactatcataataatgcaatcagttatctttttaataacagaatccaaactatcagttctgatgttttcactgttgatctaaaggtgctatacaaatgtttcaagaatcaagattatataggttacaaaaaaattgccatgtatgttgacatgctgaagtttcatcttgtccttgtgatgaatgcaatgatacttgttgctcattgattaaaactaacgtattagcatattctacttccaacttctgaaatagcatatcagtaacttgttatcgctttcctcaattggcaatgtttaatacctaatattgctttcaataactttctctctttactcttatatcagatcacacaagctaactaagttcactttgtttttgtcaactccatgaatagtagaaattgtctttgtcgacacagtttgtcactgatctgacatgtgattttaactggtaatacaggcctaaacgcagggggagaaaagctgcacaatagtctactgatcatactctctaggttcctcacctggctgaaggtacccttttaattcagcacaccccttttcatttctttagtttattattaccattttgagtttagttttgtatgggtcctgcatctagactacgctaggagttcccatatcattttgtttatgtgacactgcctacatcaatcttcttacttttacatgttatcaatcggatagttgtatttttgttgatttaattttgagtagataatttggaatgcgatacatgctatgatctatgatttggtattttgctactttttacggaaattggagcctgctagatgttcttacaaagatatgagaatccatgtgaggacatgccctcatggatactcaactaattaacatgagtttagttgcggttattaatatgatcattttttaaccagtcataacaattgataaatgtaccatgagcttgttattgtgttgaagtggtatcactattttgttaggacttgaaactgtgaaataatatttctgttcttttttggcaggtggggggactatgctagttgagataaggcaacctctgttgaggccagaagggccattttttgctacagaaaatttgcgcaattacagaagaaccaagaattgttggatcattcacagaaattgaatcagaagcttgaacaagttttgtccagatggcaaagccggcaacttttgtaacacctttgcagtttcctagatgatactgacggaaaatgtttcagtatgatcgcgttatactgaaatgttgcactatagcaagagtttgctatagtcagtcaacccccgttaccgtggtgtggttaaagttaaactgttgtgtgtaacatgtgactgtcgataatgactatccatccattcagttcagtgctttagatgcctttgatttttccccccttcagggctttactgggttatctgtgttagctcacttgcagcacgggtgactttcacaaacaagtgacaatggcaattccttgccttgtcacaattggagaaattgacatgattttccagatggtccggatattattatgctccaattattcttgattggtttagtgatttgccctttccagattgcggactaggggttaggattacatgagtactcataggaaaaagtaaggggcaaaacctacgtgaagtctagcgtcagcttggtatagtttggttctgataatttgttgttggtcactatggtctctacagatagtattctactgtagaaaagtaccattggtttatgtatttgattagtagaaaattccactgccatatttgaggtagtagtagtatggatagatatagcctattggacgaggaaagatagaaagtctagacttaataaattttggtccaaaactttcttctgtattaggtaaggcatcttccatcattttggttttgtgtttttttttatgaagcacacaaactatgtttgttttaactctctaggattccatgaacatgtggtccaaagattctatcatacttttgtcaagtcaaaaaaagttgctagttttgtagcggcttgcaccacacctccacagtgtggccaaagaagaaaaatctatggacaaactcctattatcttcacccataggatgtactaaatcaccccctaagaatgcctttagagtctagggggtcactagtaaacacctacatactggtggatcgaaatgggcatcacttctagtttggaaccagtggtgagaaagaaatagtgatgttttacggtaataaaattgaaggaaaaaaaatagcacctaggccagctccagttcatactttgagttaccttctagttccttgcacgacaccttgtgcgcacggtggccccttgaggtgcttgcgggtcccgtcttcattggaccctatttgtcgttgggctgcaggaa

SEQ ID NO: 17278 - DNA, 4226 bp, Oryza sativa
  unsure (1)..(4226): unsure at all n locations
atagatttgattgttcaagggcaagtgtgggtggagagaaagagagggggcggagggtaggggagggagatcaagggcgagtgtggatggagagaaagagagggggcggcgggcagggaagagaggggatgtgaatcagtaagggttgagggagactaggtatttaacgatagtgtaggaaagtggctcaatttggccttactcggctgttactatcacttcttgtttctatcttgaacatgtggtgataaattttgttattagtggatcaaaatgaattaatacttatagaaggttaggctatgtgtttgctcacaagtgggtcatagatcaatctattgttatgccaaccataacattctaaggtatggtgacaaaagtgctagcagactgagcttttaagaaccaaagtagacggacacacatccttttgttatactacgagcacctttaatttgtaggaaaatataggaattttggaggattataatcctattggaaaatttccaattcctctctcatccaattatatctctttcatccaatttctacgtttttccagcggtctaatcaaacagtcattcttatattttttctacgttttacaatcctctgtttgtttgcacttgtattcctattagaattctgtgttttttctattctttcgttttttccattcctatgattcaaaaatgcccgacatatgcataaggtgtcattgatagatggatcccacttgctctaggaccatatgtcagtaacacatactgcatatgcagtacaagcaaaggatctcatttaaggccttgtttagttcgcgaaaaaaaaatttttgtgtcacatcggacgtttgaccggatgtcggaaggagttttcggacacgaatgaaaaaactaatttcataactcgcctggaaaccacgagatgaatttattaagcctaattaatccatcattagtacatgtgggttactgtagcacttatggctaatcatggactaattaggctcaaaagattcgtctcacgatttccatgcaaactgtgcaagtaaatttttttgtttatctatatttaatacttcatgcatgcgtccaaagattcgatataacgtttttgagaaaaaaaatttggaaactaaacaaggcctaaattagatctggtagtagcagaccctagtgcaaaagtgcacccaataacatgtatcagtagtactcacggttatgtgctaaaaggtagaatttcactgattgtgtattttgccacatgttacaaatttccgttttttcttgttatttttcttgcaaatgcaggtgcatactgtcaatattgtaatttattaaagaatttttcataacttctaatgtggggtttctgggcatgggaccaccgatagtaatgtttacctagtacgtactcccttcgtcccaaaatataaaggattttgaatggatgaatatttcctagtattacgaatctggataggctaggaaatatccaatccgtccaaaatcccttatattttgggacggagggagtatattatgggccatataattgacaataaggatacattacttttgagctaggcaggtgaagagggagatgagaccaagaagagagagaatattattttaaacaacatgtgttgtaggcctacggatttgtgcatggaattaacgaatatgcaatactacacaaatggcttttgttaaaaccacctcatcacaaggtctggatcatcctgcctattgagtgttgaactggtaattatagtttttttaataaaaaagttagataatttttcatataaagtcagataaaaataaactttatatccataagtattgttgtagaacttaagaatatttacaatctatagttgacaacctttatatttaagatcattcatatgtctgtatacgtgttagaaggtctagagactattttgttgaggccaaaatttgactttactacacggctttgtatggtgattggagacaaactttatatcatggtttttaaggtggtaaggtgaccccggactaccttacaggtaaggcttaaggcgagatgacgtcttaggcacatcaaagctgcattttaagagcagtacgacacacatatataccttgttcttggcaactcttaagcccatgtagcatccaatacctacatggcagcatccacccccttagaagcatcaccattttttgtgttatgaagataataatagatgcataattgtaaacaatagttaataaattgcttccatttacttgagtagcataccttgttgatgacctgaaagcagcaaggcacattattgatgagcaagatgataatataaagccataaattcaaagacaacaaagtaagcatttgagcacgagtaaattgcatattggaccactatattttacaactctatcagcttggactattggtagatctacatttccctattggactgggtaaatttacaaaggtttcagtttggggctgttcttgtacctgtagctccctctctcctctctttgggtactctctctctctctcgctctctctctctctctcttcctttgggggcaagaaaagaaccaccggtgggctcaaaactgtacatggaacttcccgcccgacctaacttaaatgccatgcccgaacttttggggctaaagcccanaactgagcttgctgcttacttggcctcaaggttgacctgacactgagccacccatgactctcgaggccgagcatggtgtaagccctgacagggctccaggtcatggtcaagtgcgtaatctgcttcgagcggatgccaaccagtggacgtgctactagtggagaggggtggaggggctaccataggttgttgcttcgctaaagcatggctactacagggaaatcatcatcatcatgggtggtgttatccaatttgccacaacaacttgcgtgatggctctcaccgtggtcagcggcgctcggcctcttgcctccacttgccaacgcatggcatgaagtacgtctctgacatgtcacagtccacacaacaaacaaaccaaattatacaatcggtatgcactgacggactaaccatccatttattcgcctcggccacattgatctccacattgttgggtaaaggaccggcttgctggtcatcttcgtgatggagagggtcagaccatttactagcggtcaccaggttcatcaccttcttgatggggtggtgtagttcggtgatggctctgagatatggagaagagggaggagcgctagaggttgaagaactagcccaagctgaagcaactggtaaagataaagtggtctaaagtgaaaaagtttgtttgtccttagtccaatttgcaacaatggtaaaaaagagcggctcaaggtgcaatttactctaaacataataaactatcaagcaggctaacctagcaggcaagtaaacataataacaaagcaaaatagtgggagctatcatatacctaatggcgtataaagataatagtggtccataactccacactccacactccacactctaaacaaatatactataagtccaactccttgtctcttagtattcatcatcaaactcatcgaaattgccattggcatccaaattctcttagccatcttcaatacctgcgtgagcttcatcacaattgctcacatttgcatcattaggtggatcttcctccttatcttcttcttggtcagattgcatatcttcctcatcttcttcaaacattgttgtattccttgggtgcctttgaaaggttattggaacaacaaggttgtgaactctccttagaacatgcgattgttgtcggtagataagtgcaaactttcaccgtcaactcctgcataaaagaatacaaaatataatatcaaacttagtggtaggggtttattactaaccatttccactagtctttgtaaatattggtatgcaggtgatttttgaaagaaaatgcactcgccatgagactaaatgtacctccgaccaaccatacgcaagcacaaggatcggagagcccacatgtcagtcaaaactaactgaatttgagctaatccaccgtcaactgccaaaggggtccactgtcatacaccggagaatgtcggtggccaatggcggtgtgcctggttcggctgatccaaggttggcgcccccagccacctccttgcacgtggcgaccccctattggttggtgatggcg

SEQ ID NO: 17279 - DNA, 1987 bp, Oryza sativa
  unsure (1)..(1987): unsure at all n locations
accgccatttcaagcgtcatatgaaggctataaaaggaggagttcaactcacttccgaaacacacatctcaagtggagtacaactcactttcatattttaggcatctctttagtgtgtggaattaggtaaagagtgaggtaaagctccggaaggagtgccccaaatatcggagttcttcttccactggagtttcggagaagtgatggagttatcggccttcttctctcgtttgtatcttaacggatgcttcttaagtaagtatttgagatctccttatggtatttaatttagttgcttgaatgacatatattcccatcgttgcgggttcgtcgcttagttgaattattaagtgctctagtactaggattctagataaagaaggaagttcctgcgtggggctagagtagtaatcaataacttaggtgtggtgtttaggttagcggttacctttttttgttgtgtgctccatagaaagtgaggtaggcggaaggtggtgatagccttgtccatcctttgtatccctccatgttcaggtacatcatagagccgtaggctggattcagcttgcagaccagcggagggctagtgccagaagcaatcgatagggttttacctttaactcaagtctagtaaattaatccataggaatcctctttagccttagcctaccattagttgttgtccttggatagaattatgttcctagatatatgcacatgttttctgtgattcgatacccttggaatactctgaggtgaagtgctacagcggtattcgtgcgcttgcggatttatctgtgaccgtatcaaataccaacagcgagctcaaagagatcgtgatgcaccaacaacttcatcaacatcatcctatgtaatgtcacatccacgaaaaccttcaactggttcatgtaaggaattatcccactcattgttccaatcaaactcctcaatgacttaaggatctggccttttcctgctttctcacgcctaagctgaaacctagtttccatcttccagttataggcaacaaaaacaacatcattcaatctcttgtgtactaactggttcattttctttgtatggatctgcagggatgcaaataacaagggaagaaaaaaaaggataaataacttgctgatatagtaaagaaatttaaagcaaaactacagataaactgactcgcaaatccaaatgttctccaattgagctcacaactggataaaaaagctcaattggatcttctctttggcatgcgtcattagtcttgaaacctctagcatagcgggcttctcatcgccatcaacaactcttagcacaataagtaatggggttgaagctctgatacaatcttcaatagaggaccaaaatttcttagagagaacaatgccagtcacttatattattggctttgtttttgctaatttgatcccagtccattgttcactcacaaataggcttctcaattcatctctttggctataattgctcttcaaagtaagataagttgtggcaaatcgagtgacagctggtcttaaaagattctttccacttgtcttctccctcattgcactaagaagcctcccatgtctataaatgaaagtggtgacacgcttagcacgggcaatggggtttttaaattccttcagtttccctatgtccttcaacataagatccaaacaatgtgcagcacaaggagtcctatacaatgtgagaattctctccattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntt

SEQ ID NO: 17280 - DNA, 1003 bp, Oryza sativa
tagagccaatacagaaaagggcctcgacattactccctccataatgtaaggaattttgggtagctaacttcaatagtgcaggttatgggtccaattgcagaatttcaatccaccgaaatactccctccgtttcaggttacaagacgttttaactttagtcaaagtcaaactactctaaatttgactaactctgtagaaaaaaaagtagtaatatttacaacaccagcataatttcattaaatctataattgaataaattttcataatatatttgtctttggttaaaaatattactatttttttctataaaattagtcaaacttagagtagtttaacttttactggagtcaaaacgtcttatgagtagtattgcttctcgtaatgtttgactatccacctcagtttcaatcttaacaggccaaaaggaacaaaggatagagcagcaacctgtggttctgatttattcagacaggatatctccgcatgttagagataaccattggcccacatggagactacacgcattcatgtatataaactcacaatgttgagatatatagttttacacacaataaaagcagcagggaagaacaggacacctttttagaggtcaatttggtcccaaccacacaaacaatgctcatgtcgatgcaacaaatgtagtaatacttgggccctgtacttgtttggttcaaatgctaggctacaatgttgttgcaataaacaaatggctgacaccacacacactgatactgttcatcaccagctgccgttacaaggattacaaaactgttttgctttaggacgaaacctgctgctacgattttaattcccaaaccctgttgtaaagattgcataactcatgcagttttacagcaaaaaggttatagaagctcaccatcgcaggacaccttcaacgcaaaaatgtatcctgaaccaaaggccactaatctgcacatgacaactgagtcggtatatggtaggaaaagaagcagggctgcag

SEQ ID NO: 17281 - DNA, 1604 bp, Oryza sativa
aaccctattagcattagttgccatttgagaatcagcaatgatttataccaagtgccacatattcttacctactgcaatctcttgaccaaagaatctggccttgattgtgcaggctccactcaaatatctaagaaccatatagttaacattagataaaataatgggactatgaaaaataacaaaagaaataattgtacaagtaaaaaatgaattcatggacttgtgacgtcaacattaaccttaacaaacgctagagcagttaattttcttacactgattaagtattgaaaaaataagaaaattgtttttataaccaaagagtccagtccttcataagaacgtaccacagtgctatacaatgttagaatcaacgtgattactaaaaggggctacatacctttccatctgagcccaaactaaatatactagtttcagcaggcccgaaaagaacagagctgacaggggaatcatgggcaggccatccagtgatctgaagaccagcagacatgtctttgtgcagttaagtaaactattgatatgggatctcatacaaacaatgcaccaggtagtgataccatattccagatcaaaagcaaataacttaatatatacgtatgatgctgaatgactattaataaaataattaaaataaaaaaggataccaaacatgtgaatcatcccatctgttgcagaagctgccaagatttttccattatgattgaagcaaactgaagtaatagcaggtgggtcctccccaagtggtagaactgtcttcataatagaagaaaaagatattatcatggaggaagagcttactagccgaatccacacataggtttaagacaaggggataagcaatagaagtaccagaggtttccatgttttcatatgccatacagtcaaggaagcaaatcctgttctgtcaaatatagttgatccaggcctgaaagtaattcaaagctcaaaataagcaaatgccacctagattttaatcatacagtggtgtaggaaatctagaagatacaacatgataaaagcttttataaagttaaatggcatgtacaatgaaaatataaccaaagcttttgtcacaaaacagaaatgcagtggtccctgctattgtaggaaaaggaagctatcaatttgaaataactggaaatggatttcttatgaaaataaggattcaaaaagtaccgtctagatgcagctgcagagacaaacacaggttctacagggctacacttcaaatctaacacactgcaagagatcaagaagctccattagcataaacttaagtgataagcaagaaagtaacagttgtaacctgggaaagtcttttgatgtactgaggtcgcaaacaactctctttgcatcagcattccaagctttaatgccaccattagctgtgcctatgagcagctattgtcaagagaaatgggtgataaaatgaaatgtcttaaatatgttttttcaaaggtcaaatgctgtaaaaaatgatataacaaaaaaaatccaatatagacatcacataccaagcggtcagatctgcattcccaagaaagagcactgacttcagacccacagtatataagtggcatttttgg

SEQ ID NO: 17282 - DNA, 19813 bp, Oryza sativa
  unsure (1)..(19813): unsure at all n locations
ttatgaaaatgggagtaagttttggtgtaagtgaaataacaccagaacattgctcattttgcataaccaatggtaaagagacttatatgtgccattgaaagaatatagaactaagacgtaacctgcattgcttatttgaaaagatttgtgcaatttctcatctcttgtagaagatttcactgagctcgaagactgtgaatcaaaaccctgtgcagcgcttctcgaagctgaggattcttcgaaaactcctggcatatcttgtccttcaagagaagagtcagctgcactagtgttgggaacattcatgttgcccaaatcaacaccagtactattcctgtatttatcaattgagacataaattcctttgggcagaaggtagcgtaatgttgacatttatgtgaaatccaagaaatgagtttgaagtgctctgaatctaaatgcttgacgcttgaatatcgagtttgaactgttcagccactgcgaaactaacttggtaaggcaagcgagggcatgaaaacaaatgaaacacagcagtttctagtttccgagtgtgaggctgtgtatgtatgtgggtggaggttagaaatcatattttacttcatgctttacattaactggatactgaacgtaataagaaatgaaggtactgttagattaattagtgaacataattttcctagtttcatccaatctccacaaaagctacgcatgcatgtgcaaacagattagttatgctgcagtgtaatgtataaagagcatagatttaccttctcaactgagatatttcagtctccttcatctctaacaatgcttgtagctctgataatttgttattcagttgctttatgtcgttctttaggcatttaatggtattcttttcagtgctaattttgagaagagctggaattcgtggaaaaattaaggagaaaacattgttgagcaaaacataatatgtttgtaacccaaatataggtaacaatcacattaacaaacatacaatacaatttacttgatgatcaactagaatgtggataaaggtgttatgcacttatgttgtatcccatttagggagttcttgcatattatagaaagcaaacatgtttactaccaacttgaggaagaatagaagaataaaacaaataacatgttgttcaaggatatgaagaccattaaatatcccgctcaaaaaatttcggaatgaaagaatcaaagtgtccgaccattctttggagaaatatacacggaattgtggatccaagcttgggctcgtgatatatggcatagctgtgtatcacaattaagaacaagaagataagaatgaggttgacacttgatggaatatagcaaaaggaactaagaatacgcaccaaaccatgcttgccagtcttcacgcttctgcagcagataattgccattagcaccgaagaattcaactactttgtcttgtcttccagatttcaatgcattgacaacataataccgtaacaccgacagctccaatttaatgagagccgagaaaagctccgcatccgcaggtgaagtgaagcactgcttaaaaaaggtaaacagaccttgcaacctatccaattggtactttggtatatacaccgagaaaaccaaatctaggatcttgtctacttgaaagttcctcccgatctcggtagacaattccgactcgtacgattgcagagtactcgtgaagcctctgaacacaagaaattccttgactagttcttcagcatactgcatgttctccattcttgtccagtttcactgaaaaaataggaggaaaaccgttcaaaaataggacaaagagtaaaagcgcgaaatgaagctaatgcaactgccatcgttgcttcctctcgctggagcatgtgatttgcaaccaacgatcaatactatatgtatctgcaagcagtgaagcctaaattggcatgggtggacctagaccaaattttcttgggaacaaactaaactgggtattagtactagagctaaggcataaggcaacgagagaagcagcttccagatctactcctggaagacaagctgctagggctaactcaaaatcgagcagaaagagatgagaaggaggatttttgtgcggaacggatggatggatgctcaccggcggggcaggctagcgaggatgcggtggaagcagcagacgccggcacaggtggagctccggtcgcgggatggagatcgacgcaggcgaggcggcggcggcggcggcggcgggccaactccgggagtcgagtccgaggggtgggtgattgcgactatggtgcaaggagtcatgggccaagtatgggctttttctctagcttggtcttggatcggccgactagtggaccagctgaaaccaaaaaaaacgtaagtctatttaacctccctattctcttcgttaaaccacatcctcggtcgcaaatcacgtgtactcaacttgggcaaactgccttcctgtggcactcgccgactctgcagggagctggctttcggggcttccgcgggaatccatttcgttccgggggcgaggttcgggagcggttcattgccaacttccaaggcatttacgtctcgtcaggtcaggttctcattcaacaacgaaaaaacgagtcattgaaggactacatcagggccgagttcagttccaaaatttttcttcaaacttttaattttcatcacatcaaaacttttctatatacataaatttcaacttttccgtcacattgtttcaatttcaattaaacttttagtttactaattttaacgtgaactaaacatacccctagtgtttctcggaggcacgcaacatgatcctgaaagtaaggatgagatcgttctcactgcttttcaaaacgggatttgtgatgagtagctgatttgaacattttcaaggaaaccatcgacaactgtcgagaaacattttgagatgaagctgagaaacccagcttttccagattcttagaagctggcttccaaccagctgcttctcagaatcttaagctctctcaaataggcccctagaccctcccttaaatagagaggcatacctgttataaccgcatggtaatttagtataggcgaaaggtagcggttgccaacgtcgtccgaccgagggtcgtttataactctgatacattataattattcaggatccgggaggagcactcataattagtaccttgcagatgtaggtttcgactaaatttcgttagtaaatactccctccttttcaggttataagatgttttgactttggtcaaagtcaaactactttaagtttaaccaagtgtaatattgtcaacccaagataaacttattataaaaatataattaattattaatttaataaaactaatttggtaatgtaaatattactccctccatctacttttgatagtcatattttatcttggcacatagaccaaggataagtaattctacttatcatccatttaaatatgctactagtcattcctcgtaaataagcgattcattaatatttacatttctcaatgcccatgtagccaatcatgtgtggaagaacgaagagtcatgcattaaatccaagaaagtcattaagatgataagttgttggattgaaatatgcctatcaaaaataaaattttcagatttggaaatatgactatcaaaagtagatggagggagtattatattttactataaacttagtcaaacttcaaacaatttgactttaaccaaagtcaaaatatcttataagatgaaacggagggagtatcatacatcgctatcgtcatcctgcttgaatctcttatgacattcttacgtttagctaccaatgttgattttgaggtagcctcgagctattttagtagccctaatttcatccgacggctcctctgtcgactgaagccagtttgagcaacggcgtgtgttgacgaaaaaaatcgaacacaccggcctgggagatttgcttagctcctgtgtaggcccaaatcttgatgagatgcggacgtgctagttagtttgatcctgcaactgacaagatatgcaaatagtatatcaaaacagccgattggctgacaagccgatggagtagttcaagccgataaccgataatagccgatgccaataccagccgatagcgatagggttcaagcaatcggctatatgtccaatgtagataatgatataaaggcaatcggatgatgatgatgatgtaataaaataacaatataatccagtataaaccaatcggcaaataatgatatgataaataagcatcgatccgaaggttaaagcacaaatcggctggatgtccgatgtcataaaatccacaagattagattaaacagtgaaacctttattgtcatcggctaaatccaacttatatgtatatgtaatccttatgagccgatgcaacgtcgagataactcaccggctgaaaccccgatgaaacccttattggcaatcaagaagcaggctagagattatggttctaagcacgacttagtagatcaaacttaactgatgcagcactaaatatgaaaagaaacataatatctagataatcaagccgttgactgagttttcagagtggtagatgtctaagctaatctaatctagcaacgcgatttagtcgataccggcagaaatcctaaaacgagaagcagccgataaagctaaattgatatgctaagactagattaacagagacatatgataaataggtaggcaaatatatcatccaaaccagagcaatccaagaggtcgaatgtactgatgcagccttgaacgacgtcaacgtaaatgatacaattgcctgggccggcggatcattggacttaccccttagccagagatcgaacaccgatgcagccccatgtcaggtgccaagtcccgtcggacgataaaataaagtagaaaagataaaaggtggcgatgcgccgaattgtattgatcgtgaagataaattacatagaccacgagtgtacatatttatacctgtgggttgatacaagtccttgtcggacaagaaagaaactttcctaaagataaaaggaaaacataaagtccctatcggacactaaacacaccttcctaaagataaaggaaactaataaactattcctaattaatagataaactgacatgccacatccttcttgaactcggactcttctggataaattccctttagttgatccgactccatcaagaacacggttgctggcgatttgatgactcccatcggctaattccataactctgaagccgatactgactctaagccgatgatgactttgggcttaccaaatttcgtcgttaacagcgtgttattttggctgtgttcggtggtgggtgttgggaacccatcacccacgtacgaaaaacggagtagtccattaacgcgtgattaattaagtattagctactacctctgtttcaggttataagattttctagcattgctcgtattcatatagatgttaatgaatctaggcacacatatatgtctagattcattagcatatatatgaatgtgtgtaatgctagaaagtcttataatatgaaacgaaggaagtattttttttaaaaaataagtagtttgaaaagcgtgcacacggaaaaggagaaaaaggagagggggggggggggggagttggtaactcctgctagcgaacacactcaccacccgaaaaataaaaacgatagagtcagagacacaataatcaaaattcggccacatagacagccacattaggcaggcactcggctgatctggtcagcgccgctactcgccggacgcgatgcctttagggagttcagcgcgtagggcccgccgcggcggacggacgacaatgttttgaggctattcgctcacggcagccgttgattccccgaccgcatcatttctacccaaaaacaaagttacagcactcagtttctttttcctaaagagaaaaatgaacagaacttgatagaagaacaacgtgatcgtttctaactttctatttctcggggacacgtaactgttaagggcactcttaaccctccaccttagctaatttctatagcattaaggacatgtacaatgattatttataacaatgtcttagctttcctaattaaaaatgcttgttgacataaaatagagagaaagagaatagataaaacatcattgttgcgggtaacaataactcttagcctctataatatgaaagcatggctgcatgaggggaaaaaatggaaagaatagaatcaaaagaatattttttgaggtaatggttagagcttttgtcatcttactgttgtaaagatacgatctctaaataatcttgtattgtataagaaactatacttattcaccctaattacactgccacataagtaaagagcaaagatggcaagagagttaatgaagagagagggaaaaatatgaggaaactaattcttaggaaaaaaactgctctacacgtaaacgaaaaatgaaaataaaggataggtgggtaaaaggagagagaagaaggtgattggacgagaatttattttgaataaaccacccattgggcaaatagttctcatgcataatatctatatgatatggcaagtatgaaaattataatattttttggagtaaattgcactcatggtacaccaactttacaagtgggtgcgatatagtataagaagttgagaattgaacgtccgagtgcaacaacttgacaaataggtgcgttctagtataagaacttgataatttagaattttggtgcattaatttggctaagcatacgctaggtgattttttttcacgatgtcaatacgccattacatagtaatcctacggatattaccttataatattgaatttaatctttaaaaattatactgcacatataatttacatccaatttgtcagggttacggataaggtataccctctacccttggatgtatgctatacggaaatacgatatagcggtgcatatacggacgttatctggacacgctaaggaaatccatcacggagtctaccaatggaaaggttcctacccgtgtaggactgggtcgttactatatcgtacagggtctgatgtctccgagttcctacctggagaccgcttgaccagcgatataaaaggaaccccccgagggaacttaggggatcgaatctcatagcctacacaacgaccacagcctacgaagccggagactacaggagccaagtcgccgggtgatctagtcgaatcaactcgactacgatctcgtcggtaccaccgagttctattattccctttgtaatctgtggttctctcaatataatcccacatcaactggattagggctattacctgctaaggggcctgaaccagtataatctttgtctcttgtttccttgatgtcgtactacgtagatcctcgtaccagtgtaccccaataccctctatatccggtctacgggtacccaccgtcgacacaattaccttttaagaattttttgttttcttcaccttctcaaatatcaaccaaatataataatttctacattcagtttaattgaaattcagttactagttactatgataaaaatataaataagcttcaaataattaagttgccacataacttcttaattattgtatcaaaatcgtacctaccttgcaagttggtgcatttatgtgatcacttataaaatttttatactaaattacacctatctaccaagttgttacactagattgctcatttctcaagttcttgcactattttgcacccacatgccaagttgatacaccggcgatgcaatttactctattttttgggttggattgccctaatactttgctttcttgatgatttatttatcttgactcaattaacaagctttgatcgatggtgtttgaaagttctaagtgtttaggacagcttaattttctcataaagaaaactaaaatactaatattctacagttacggtattttgtgcttataatgaaacggtcaaaactttaatcaacatcgatcaggtataactggcatccggagtattcacaaacactaatggagtttctattttaggacaagaagaaaggacaatatgtatgtcgcatttttttttaaaaaaagagaactgctacatgaacttttaataaaaatcttatactccataacacaaacaaagttcacaatcatttgatcaactagatattcatccacagcgagatatatatcagactttatcaatctcaagttaccaactcagtcttccgaagttactcttgagggtagggtacatgtacatgcacatgttcacagtgatgagcgtaacacgttgtgaatgtctgtgtttttaaaagaaaataaaatctatatttagtcacggcataccaaatgaaagttttgtaagaaaaaaaggtatcgtataagcgaatagcctcttctttttaaaacccgtcttcttggaagaagagtaagagattagagaaaatcctttactatggaatcctaccgaaaaaggttttgaacaaaggtttggttctcccttcgccgagcatctctcgtgtcatgctcactgtgctttccagcaaaaaagggtaatatttcaaaagctcaaaggcggttaaaggtagtccttaagcattaattcttcaacctgaatgaactcggtgtgtagtctttttatctgatcatctgactttttaattaatacattttgtgggcacaaataaatgaattaaatactacaaagttgaaagttaatttaaatactattaataagaaactgatatattttttcaaaaaaaccatactgtacttanatatgctcgtaaatctatagcatgtaataggcgctgttagaataaatgggttaggcccgatttatttctattaaatctcaagggcccataataaatattaaagataataataccaccttgggaattaaaagtggagtaactcaacttaaatagggagttattggaggctccatattgaccggttgagatggggatcggaaagccccgcgcgcgcgccgagccgtggtgtggcgtctcgtctctctctccttttgcatcggttcagaattcaactccacgagattacctctgtaacgggcacgggcaggcgattcaatactcattgattgcgtcgttactgcggtaacggaagcgaatcctcctccgtgcattctttccaccgcttggttcatcttcctctgtgtttttggggagtgcttccgcacgattgctccgctcgttttcttcgtctatgttctgcatcacgatgtctactggtggtggcgtttccggtgtggcaggaagtggtgcgccaggagcaggaggtggcgcgccgatcgataacaccaacggaggcactgcatcgcgatgtctactggtggtggcgtttccggtgcaccaggaggtggtgcgccaggagcaggaggtggcgcaccgatcgacaacaccaacggagacaattctgcctcataatccagcagagagactttcacagggtataacatccttctgctacctttcattcggttaaatatgttagtcgcaatgttattgcgttgtcttatagttgatacttattttaccttaagcatactcatggttatgtttagttttagttttatcactagatcatttcacactgtgcaagttatgtttattatcttaatattttggattaaaatataccgatttatgatcatatttccaaccggcgcttcacttccaattggtgaaattgaggggaaaattgatcggctgtgtacaagaaaacagaaaaagaaaaagatcacaccaacgaaagaaaaatgataactaccggtcccaccatgtttgcctacgtgccccataaactaattttggatctaaatttccttttgcctctcttgaagatgagaaaggtttttgggcctactttttttttcctaatccattgtttataatttttgttatctgtcttggagatgctccaactcacttatatacatacttaggtataaggttgtcaacaaagccgaggctcgagagcatttcaagctcgagccaacatagaagaaatgtaagtaggctaacccgtgaacctgtatataggtaaaattagtggtaagtcgcggattgacccgtgagttacctattaatttgatctataaataagtttatgagttaacatatttatatcttgcagcaagccggaccacgacgcgaaaacccacgggttaccacttatttgatctataagtagactcgcaggtaggcccgcttgcatcctgctacgtagtcacatggttagttgacagctgtatttaggtaccaccgttacagaacccatccaaagcgaagtcaactacatacataaatcaagtagggcaatcaatttatgtatcttagataaataatggacaaatgcatttccagatactagcgtggttttagcctaaaatctgtccacaaaacaacgtagtttagagtgatgcagtagatctttttagccactccaccagtaggattctttcctcctttttttttccgcattaataaggtaaattttgctatatgacacttaatgggttggtaatgaataataacactttcaaaaacttattatttggtgcaagataataccaccaattttagagaccaattttacctttttaattggttttaaattaaaaagagggaaggttttcaaaaagcaagaataccccttagggccccaggtttttgctaggggttcaattgtactaatgtgtaatgtgtagaaatgatgtataataacaatacttggagcgtcaacggtatattgggagttgcatcatatgtagtttgaaaatttggggaagaaaacaaaatttttgatctggtttagaatttggacaagttgcaaaatgtagttattactgcggctctagggtttttgaggtagaatttggacaagttgtaaaatatagttgtcactgcggctctagggtttttgaggggagacggggagaaagcctggttcgaccaaacaagccgaataacatgtgctggcccgtgaggcaaaatcatcatttaacatggtttctctttttcattggattggaaataataaaataagagttgcggtatcatctagtaaattattagttttttgaaaatgtccttgttggtatttcttatggtcacacgtaaatacacgagcgcacggatactgctgtagcattttacccaagagtattccaaggatatcgtatttatatttccgtagggaaaacaacggtgtaaagatagagttcatatattccttaatcagactataattatttcaccatggtttgacatgggttaattcataaatgataatgggatagcatgacacacaggagattcatctttaataatgatacactaggcaatggagaagaactatagaaagctaagattcatatgtatgtctatatttgtaatgtttagtttacatttagcacacacatacttaaggctaggacttagttctaggcacccaggtactatcgagagaccactcagtgctggtatgccaatatagttatgtcattgtatgaactcttacgtaatacccggacatggaggaatacaaaagacggacagagctgtcactacttgccacctacctcacttttcataaggcatacccacatccaacaacatttacctaacctaatcaccatgcttatattaataaataatgtcactaattcccccgagactcccacccttcgcatggataagttagaactagtgcaatccattaagatcattaaaccattactgtagcatagattgactagcttagtcgtgtgaagcatataaatgaagtataatatattcatagagcacataattaatgaactatgaacacaatataataaagaagataattcaattattgcaactattatcttacaagaaaagtaaagtactaaaaacgtaccggaatctcagagaagaccataggactgaagactatttataagccaaactccactactaatagagagaatataacgtatgaaatgagagaattactccttgaaatgtgtgttgcaagtgaagaagctctcctcctttaatagcacctgatgacgattgcttatgatgtttgtttgtcggtaaccacccacaaccaccatcaggagtgcaggaggaagtgctttcggcctagggaaggcaatgtcatatatgctcgtatcctacatgaactgttcgatttctacttggacaagaaatggcctacacgtataaatatatagccctcaggaagagggcatggaatcatgatccatagccacaaaccacatcgaatacaagctaggatgaagccaatagctagtcactgactcttaagtcatcggattagttctcgacgaatactagttggtaggctagattagctagctttctcccccattgtaattgatgtgagatacatttaagagccattcatataatttggattaagaatattacccccctcaggggcttgaacaagtataaaaatcactgtctcccatctactttaccgctttctggggtatatcctggtattaacgtcccctatatttaaaaaaaataccgttggcaaggatagcccgtcaataatactcttttagggacggaggaaatatgtattaagaaaagcgacattggtatgagttagaatttagttacacataccaaaggaacagaaactcaggctatgggggttacattgcaacataagttataacaatgtgacttaatgtagtttctgtgtgtgtatgactttacctgacaaagtcaaaaaccatagaaaccataaacgaatttagggtgtgttcggaacccctggttcccaacactaagtgcccgcacgaaaaatggagcagcgattagcgggtgattaattaaatatttgctaattttttttccaaatatggattaatttgatttttttaagaaactttagtatataaatctttaacaaaaaacgcagcgtttagcagtttgaaaagcgtgcgcgcagaaaacgagggagatgggttgggaagaggagctgccaaacacagccttagtgaggttcactatagaaattagttgtatatatgcacaacaaaaagaaaaatggcatggtgttaacgacgaaatttggtaagcccagagtcatcatcggcttagagtcagtatcggctttagcatctcggaatcagccgacgagagttattaagtcgccagcagtcggattcttggaggatttggttaaggaaattgatctattcaaggaagcttatctagaagagaccgagttcaagaaggatgcggcatggcaagttatctattaattaggaatagtttgttagtttccttttatctttaggaaagtatgtttagtgtccgataaggactttatgttttccttttatctttaggatagtttctttcttgtccgacaaggacttgtatcaacccatgtgtataaatatgtacacccagggtctatgtaatttatcaatctctcgatcaatgtaactattctcggcgcatcgccaccctctttcctgagatttttactttatcaaccggcggaatttggcacctgacgctgggctgcatcggctttcgatctctggcgaaggggtaagtcctacgttccgccggccctggtgaatttatcggctacgttggtgttattcaaggctgcatcgattcgatctcttggatcgctctggtttggttgatatatttgcctacctaatatttcaattctatctctagttgcattgtgtttagagacgcatcggtttagttgggactgtctcagttaggtccgatcttctatcttagccgatatatctctacaatcacaatgctgttataaatagatttgttatatccatcatattagacagatctatcggctcatcgagtattagattatcatatacaatctcgtgctgcatcggttaggttcgacctactagattgttgttgataatataagtcttgttaagccgataggttcatgctgatgttttatcggagtgctagccgataagttatctggatgttgcatcggcttatagagattacatataagttggacttagccgatcgcaacaaaggtttcattgtttatctaatcctgtggatttaatgacatcggacctctagccgatgtatgctttaaccttcagatcagtgcttattatatcttgtttctagccgattggtttctactggattatattgttatttcattacatcatcatcagccgattgcctttatatcagccgattgcttaaaccctatcgctatcggctggtatcggcatcggctattatcagttatcggctggaactactccatcggcttatcagccaatcggccgttttatctgttgtttgcatatcttgtcagttgcaggatcaaactgactggcatgcccgcatctcatcaagatttggacttgcacaggagctaagcagatctcccatgccggtgtgtttgatttttttcgtcaacacacggtagcaacaatccataggagagtgtatcagcgagttggtaacgccaaatgaactcaggcatacaaacaaattagcagatttgtatatgaatcatgaaatttgtgaagtacatcactattattgccaatttaggctttgtcggaacacttgagttttctgcttcagatattgtgatatcaaactatttgttttaagaaactaactataaaattataatgtgccctagtgaaatcaagaggtagacctccttttgaactgtgaagaggttttatatagaaatatatactataggaattttcataaataatcatatgaaataaaggattgggcttctttgaatcgtataaaattcatacatgacttattagggctcctttgaaagatagcattgaaaaaaaaaggaaggatagaaaaaaaaaggattttgatagaaatataagtgcataacacactaaaaacataggaatcggatcaaagaaattttttcaagaggttgaagcctttcataaattttctccaaaatctctatcgggatgtccattccaaagtaaatgaaaggatttaatcatttgtttcaaaggtcttcatagaaattttgttgtataagattgaaatcttccaaatttcctatattttttctacaaatcaaagggattaaaggggaccttaatctataggaaatttaaagtattgttcagcatcatgcaaaaaattattttggatatttttctctccttgtattcatgtacctttgatatggagtatatccaaatggccatttcaatacttatttcttgttaattatttgttgtgcgcttttattttgagtaaatttttatgagtacttagttatatctttatgttttaatatttttaaggagttcatgaaggtttgcgagtactttctctctcatatcataagatgttttagttttgttgcaagtcaaaattttctaactttcatcaagttcatagaaaaaataattatcatcaacaataccaataaataaaatatgaagatataatttatgatgaagtttaatgaaattaatttaatattatacgtgttgattcaactcttttataaagttggtcacacttaggccgcatttcagagaaagcattttggctgaaaatttttatagcatgtaaaacgagataatccattagtatgtattaattgagtattgtctattacaaacttgaaatatagatttatttaatttttaaaacaacttctatatagaaaacttttaatatttaaaaaatcgtgctaacgaaaaacagggagtagcttcctccaaccggagaaacaaacgcattcttagagaaatttgactcatgacaaaacaacatcatctttcacagtatggaacaaaaactttactagaaaaaaagagagtaaattgtattagcggtacataaacttatcaggtgtgtgcgatttagtgtatgaatttataaaatgctcgttttgatacatgaatttgtttggtacgtgcaaactaagactaaaatggcgcgacaagtccgatttttctatgttcaacattataaattacaaattagtagatgacttgcatgtacatagtagaaatgttatatttgtaaacttagaatccactttatctttctttgtttgtcccttgcatcattactcatatttttattttttatgcaatcattatgccttattatatgtttatccttcttagactaatgtttacatagagtttaaatcaacaacagaattaataagattaaccttgcaatgcgattttaatcttgttcgcacgcaccaaacaagttcgtgcaccaaaacgagcgttttacaagtttatgtactagattacacccacctgataagttggtgtaccgccgatgcaatttacttaaaaaaaaaacaaagttacacaacaacccctgaatcagagtgaaaaatatcggaaaacaatagggatgttactgcaattcaccgctggctacaaattgtaaccgaaccagacgagtccacgcccccactctccctcctcttcctcgcctgctctgctcgcggcggcggcggcggcggcggcggagcaatggcgcggtcggttggcggcgggtggtggcggtcccggaagaccctggtcgggctggggctgggccaactcgtctccctcctcgtcaccgccaccggcttcgcctcctccgagctctcccgccgaggtccgccccgttgccttgccccccaatcgctgtttctttctttgctctgattctttccgcgattcatcttcttctatctgctctattgttttccttttcttttccgattctctgcttctttctttttctagaggcgtgtgttcttcttctgatccttttcagactacttcactgcagttcaatttcttctctctctgtttttttttggtggatttttgtggagattgagcagtcatttccttggccatttctttaaatttttattcgatcacgcaatgtttcttctccctttttctgctattttggtggttgtagttttccttaatcacttgcttgttggaactgctctcttctgctgtcaatcagtcaatgtacaggctgatcttgcgtgccgttcgcaagctttcttgccgtgttatcgcccagagaaattaattaacacaattctcaatgtaacggtggtgctacttgtttacacttgcaggtatcaatgtgccaacgtcacagtcgctgctcaactacgtgctgcttggggtcgtgtacgggagcatactgctatacagaaggaagtctttgcaggttcagcaatctttgcattttcatatcaatttcacaatttttaggtttaatcgccgaatctttggagtatggcaattaaagaaatgttgggttggcaaaatgtttgagtgaaacttggtcaatggccttaccaaaaagctacccatcgtgagtgccgtatatagtgaaccagaggcatatctatgtttgggcatcaagaattcaagttcatttggttcagcagtacctctgttttaaaatatatgatgctgttggcatttggatatgatgtttgaccattcgtcttattggaaaaaataaactatgtaaatatcatttattttgttgtgacttgttttgtcattttagatactacttattttggttcagcagtacctctgttttaaaatatatgatgctgttggattttggattttatgtttgatcactcgtcttattggaaaaaataaactatgtaaatattatttattttgttgtgacttgttttgtcattgaagatactacttatattttttttcatatttactagccaaagcgcgacttttgatcctgtttaagaacttttatatatggtctattaatttaccttagctcttaataaggttttgatataagttaatttgtttacaaagtatctatacttagctagggcaatagataccaaaaacctccgtaaatttccatatgtttagcccatttgtgattttttttaatacatgcactctttcaatccaatgaccattatttatccgaactctttatccgacggctaaaatatttctgatgatgtggcacatcctcgtgcaagaaagcttgctgctttcactatataagaaggataagataagataaggtactaaagttttgaataagaaaattggttaaacgtaatgttcaaaagccaacagcatcatgcatttaaaaacattttaaaacggagggggttattgttatttagttaaattagcgtttataacttcaaaagcacacgtgcctagtgccttagtgttactgctctattcacttgtaacaacagtttgcttccttttgaaaaatacatctatttgtacataaactgttctcaaaattttaaataagcaattacatatattttgtggaacgtaatatccataactttatataatttcctactgatgctgtagtatttcaatttgtattctactgtggaactgatttatgcatgaactaactcttgcagatgaaatggtactactacttagtactagccttggtcgatgtagaggcaaattatctaggtatgtgcaatactttgttggttatttgttggataattcagcagcgtgttgaccaaaagttcctggtcatctatgctgaaataacaagacagtccttcctgtctactgaatagacagatggtgttacaatgttatactaactccctctattcttttctagttgtcaaggcttaccagtacacatctctgacaagcgttatgcttcttgattgctgggctattcctgctgtgatattccttacatggatgtttttgaagaccaactacagattcagaaaatatagtggtgtggcgatttgtgtctcaggacttgtgctagttgtattttctgatgtccatgcaggtgatagggcaggtaatagttcggtgattagtatttatatatgtctttgttgtttcatttcttcttcacttaccacaaaaaagtgcaataaaaccttttgtattgcagaccatttataattatggtaacaaaatgaaccttgagttcacattagcaaaaataactagtctgttttctgaagtaaggagtaaagactattccacagtttaatatgttgctagattaatggatttttttttaaaaaaatacagtactccagtcatgcttgacgaatatgtggagaataatttaagttttgcgtggaattttggaagtcatctttatgaccagttaaatcctaaatgaagtacaactgaaatgttcatggtcatgttgttctatgcagggggtacaagcccagttaaaggtgatatacttgtaattgctggtgctactctttatgccatcagtaacgttagtgaggtaaagcattgatctcaactgcacaggaaacacattattttgagatattatttttaatacatattaaaaaaactttgttaatagtctgtgccaaaagctattcatatttcacttctttattgtcaaaaaagactaatccaaagaaatggtgaaaatgactctcacgtatcacctgtttccatatgtttctcatccttcgggcttaataagtgcaagctttgtggtgtaaggtgtaaaactagcttcactaagagaccaaatccctcaatatatttatcttttgcatttcaggagttccttgtgaaagtcggtgatcgagttgagttgatggggatgctgggactatttggagctatcatcagtgcttgtcagatgtaaaatgatcctttgttttaaccatgtttaaacattttt

SEQ ID NO: 17283 - DNA, 848 bp, Oryza sativa
  unsure (1)..(848): unsure at all n locations
cagtgagcgcgcgtaatacgactcactatagcccgaattnnnnnnnnnnnnnnnnnnnnnnnnnnnnnnnnnnnnnnnnnnnnnnnnnnnnnnnnnnnnnnnnnaactaatacttaattaatcatgtgttaatgaactgttccgttttccgtgcggagggaaagagtttccatccatgatctccaaacaatactgccggtgcttacgtactcaccggacagcaaggagaggacgttggcgacgctctcgttggccaccggcgccggcgacgcgccgacggtggcgaccgggcacaccgccactaagctgatgccgttctcctccgccagcttgctcgcttccttctccgagagaaccttggcgatcgcgtaagcctgcagcgcaaacaccaccgctgtgctctcacgcaagcgactgtactatcaactctgactgaacatgtaaaattttgtaagtttgtgtgtacctgagcaggagatatcccgttggttgatctgaggtagtcgaggtcggaccaggacgactcgtccaggacatggctgctgccgttgccgtctccttgcagcggctggccggagacggcggccgccgacgatgtgaggatcacgcgcttaaccgtgccggctttcacgcacgacctcagaacgttcagagtgccttggacgccggcttccaacagttctttctgccattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17284 - DNA, 3234 bp, Oryza sativa
atttggaatggtagcttgaggtgttcgttttgtttgaagaatgagtctattcaacatctctttttcgattgtcatttggcgaagtttctgtggagagcagttcagttttctttggatttaatcttccagttagcgtatctcatatttttgatgggtggcttttgggagttgataagaaaatgagtaaactgatacttgttggagcttctgccatttattgggcaatatggctgagtaggaacaatatagtttttgacaaatcaccatcattttcctatatgcaggtcattttcagagcaacccattggcttcggttttgggcacaactataaaggtgtgaagatgatgaagagtttctgaaagttgcatgtcggaagctggagactacggttatgcaactttttgccaattatgggtggagatttacaaatagacttgaataattgtaatctcctttgttagactggattctttattgttgcttgcggtgtgttctattcaattagatctacactatgttcggcaaacgcttctatgtaataattggctgtagctcttttaagtaaaggccgggatatttatttattccattatctaaaaaaagatgatgctgcaccctggcattttggatgaacagcagcctcctcctcatcaggtagctttccctcaacatcagtggcctcagcaacttgcccacttctgccatcgtcgctgttggaatcgctgcatcgacatgtcagcattagtgaacagaaagaacagctgtgatagtgtaatttggaagatggatttttttacatagtggaatttattcctgcctttatttttcagtcgctcattataaagtttgcaggacgaataaccgctaattacaaaattacagcttgattaaaaacatataattaatgttccaatgattaacgtcaaacttcagaatggtgtcttgcaactaataaagctagagtattgagttttttcatggagaaggacaacagaaagtaaaacaggtgagtaccctgagtaaataaccagcccaattgcaactgcaccgaatgccacatagtacatccagtcgacctggaaagcgaaagcgcattcaattgctggttacatgtaagacaataaactgcagtatgcttgatgcagaattgcagattgagggcccgatgatcagaccttttcatggtaggcaaacacacggatgagaatagcccacatgtctgaggttagcaatgaaaggtttagcattgttgaaccactgatctgcacaagttaatatagatatgagaaacttaaagagcaaaaaccatgtgcttaatgtggcagtgccatttcgtagtacaacaatatcccttttgtcgggttttccttttttccatttttaaggagatgggcaaggaacagtaagtgaacttgggatgtaagaactgagaagtcatgaataaggaaattagtaggtacacacttgcacaaaggaaacattgtttgctgatataccttcagtaaaattggaactagagagtaaaacatgaacattgcgactgcaaacccaataaatggtaccacctgacaagtggtaagaaagtaatattagatgtgtttggtgtaaaaaaaacggataccaatgtcacaatgaggggatttttagaaggaaaataaaagaggaggacagaggaggacttacagcaccaacactccattgtatagattttttctcgttgtgttcaaatatgcttctgaataagcaaataaagaaaaaaaacagcttatgaactgtttgaatgaataagaacatgttgcaggaggtaaaaaggccacaatacgattttaacaaaatagcaaaaaactcttctgtaaacaagagaagtctactaaactgcctaaagcactttggtccgtctgttaatccccttaagtacgggtattcaccctcaaaggtatgaaagttgtttgaaataaccacttggaatggttttgtagtgattttgctgtgtacaagatgacacggcaagcacaatagggcaaaattacccaacccaacccaacccaaccactccttttctctctccaatcagcaggcccaagaatcactttataagcactaatgtgcttcttttccaaccgtcccaataattaaaatgttatttaaccgaatacatcggcatgtcacagtgtccatgtaagccaaccatttataaaaccactatttgcacttatttgaactggttttcatattttagagggtagaatacctagtttcatacttgaggggttgcaggacaaccataacattttagggggttaactttgattttttccttaaacattctagagtaaatttcacattgggctaggttttttttacccaagttttacattggaccaggtcccactcaagtttttcacttaacaccacatgtttttacatttgattgcactttggactaggattggcgatttggggtgctttgctggctttggcccattcatgcaagcaagcaatactttgattctcttctccaacaccggaggtcttgcccagtcggagttgccgcaagcaaaaatggagtttctgcaagattcagggtcctgccgtgcgggtgcaaagcttgggaggtgttcttcgtgcatcatgaccaagagcgagtgcgtgcagggagaaaagaacagctccggccagaccagcctccgagagcaaggtcattgaggtggtgagagaaaattgatctcccattgacggggatgtgatagaaatagcaaggttgtgtagagatcagcggcgacggctgagtcgcagacggtagctcgtgcctccttcctcatggatgggctggcccaaataatagaccccacccaaagtgaaatcaagtgtagaaatatgtggtgttaagtgaaaaggaaaaagtataaattaccccccctccccggggaactatcgcggtcgtctgaattatctccctgaaccacaaaaccggacatttttcacctgaactatacaaaccgaacgaattacccccctcgacccaatccgcggtggttttggtctacgtggcgtacgcgtggcagtccagtcagcattctatatttaaaaaatatggggcctacatgtcatacgctcttctctctcactctcctcactcttctcactcttcttctctctctcacggtcgagcactcgggcaggcggggcagcggctgagggcggcggcctcggcgcggaggcggcggcggcga

SEQ ID NO: 17285 - DNA, 4815 bp, Oryza sativa
ccatgagagagagaggaagagtgagaagagttaggagagtgagagagagaagagagagaagagcgtatgacatgtaggccccacaattttttatatatatagaatgctgactggactgccacatgtacgtcacgtagaccaaaaccaccgcagattgggtcgaggggagtaattcgtccggtttgtatagttcgggatgaaaaatgtccggttttgtggttcagggggtaattcatacgaccgcgatagttcgaggggtaattcgtactttttactaagtgaaaactttaagttagatatggtccaatgtgaaacttaggtaagaaaaagtagtccaatgtggaatttactcaaaattctattataataagagaaacaaaaatggttaaacacggttaaaacaaaggagcattttacatctgacaagcattctagatggatttttttagatagtggaatttattcctgacaatgtggtgcctttatttgttcctcgtagcggtcggacaagccatcggaggaagccgaagaggaccgggacgggaacgggaaccgccggctgtggctgcagcgacgttgttgttgtccccctggtcggacgccgcggcggcggcggcggcggggagaagccgcagcggcggcattgcttggtggccgcggagtggtccccgtcgcccctcggcatgttgacgccggcgctagccatcaccatcaccaatcatgtcatgcgagcagcagcagaagcagcatccaccatgggaagagagatgcgttggaggaggcgagaggaagaagaagaggtggccgtgtggctaaggcccaaacacaagggcccatgagcataaccagttccttccgttacattaaaccctagacgctcctcctctcctgcccgcgcgcagttctgctgcttgctgctccggcgctggccctctcttctcccttctccgaccttgcgcctccctcaggttccccgcttgttgatctgcctcatcttcttcctatttgatcgaaagccaatttgcttatctgtgaatttatttcgctagccttttctgatgccatctttggctcttggatttgaaggctgaagatcgattacatcgcaggacaggacgcgcaatcgactttgcaggtactcttccttccttcctcacaattgtctcctggatcttggtatgtactactgcttaaatcgcctctcgacaaacggatcccctcgtttccttctgctctgcaaataatccacccgctttttttttaattatttccctagctttgaagatattttaagtatgtctccgtcgacgattgatttctcgcggcggtttcttaatctgatcgtgggcaaccgcacccctggtgtcaaatcgctatggtgcttcgacctgatgcgccagcagctgttctatccggcaacacctccaccgccacacaaggttgaggaattctggcaaaagtttagaccgccgggcacaatgatggacagcatggggcttcccttctcctgcttcaccttccgagcttcagctctcaacgtcaacggccaatcgaggatggactgtttcccgcttgctggcggcgaggtgatttgcatggatcagtctggccgcgcgttcctcgtcgacgctgatgcgtgccaggtaggaaccatgcccagtcttcacaagcccaagtcgatgcccttggccgtcttcgtccccaatgccaaggctgacaatgactatgaccatgatggctatggcagcagcctctttgtcatggagaggattcccaaaccggagttgggcttcaacagcgatcagtttgaggccttcatataccgcaagcctacaatatccaactacacaaaggcctggcactgccatcaactcccacccccgccttttgtccgtgaacccaagcactggcacagctgcagcaacccagagatcagctcctacgctgtgcttggcggtggctcacacatttgcttatctgtcaatggcatcggcacctactgcctggagacagcaagccacacatggagccaagttggcaagtggacactgccgttccatggcaggattgattatgtgcctgagttcaacctctggtttggcctctctgctgaggcccgtcgcttggctgcggctgacctctctgccatggactcctagccacagctagtgggcccttggaaggaactcaacctgccagaggaatggagggaatgcaaggatcctcaacttgttaaccttggctcaggcaggttctgcatcgctaggttcttccgcagcaacagtgactttggggatgaacaaattaccgtgtttacaggtgtggaggtagtgccacacgtcggcgatgccaatggctatgcaaataagggcagcaatgggaaagtgcaactccaaatgatccctcactgatcaaaatgtcacatatctaatgctactaccatcgatgttgtgttctgactaatattagtgctggcatccttttttatttgtttatattttatctgaataagagatgacttagaatattgttgtaagagatggtctccctatgatctctatttactagtagtgcggtattgtatcctgcaatggtagattctaaaattaactgaatttagtcccctttcctaagctcaacgagtggccaggagggctgaggtagaagaacccgactgaaggggtatattggtcaacccaagtgaaaaaatggtggaaatccagtgaattggcaaatatggcaaagaaaaggtttggtatcgcctagggatggccttttaacgaatccaatccgtggaatggcatttgagcgaaaccctcttttggtagtggcagaatgtccaatttctcgtttcgttcaacacaattgtgtgttactgaaaacatgtgtgatgtttggaatttcagttcaaggtgttgataatcacctcctaccctgttgctattgtgacctgtctggctgacagataattaatctgtcatgccacaaattacatgatgttcctgtcaacgattgagaaacccctaagttgctgatatgctgcaatttataaatgccaaccttatggtcaatttttttaaaaaagaaaatttataggaaatgaacacttcccctatgtaaggttcgtatgtgtggcaatttggttatgcagccctctaaagttatggctgttaaagaaacagtttgctcatctatgctttcagtcttcaagtatgaaaaaataaaatgagaaaaatcataataatatgcttgtttatcacctgatacatcaaatcttcggtacccagttacatggcagagaatttccccaatacaacattttgcactcaaatactttctggctaactggaacttcctttagaagcaccaaagagaagacaagaatacattgcaaaattacattacagcaaattgcatgaatatgctgacctaccacacatgtttattccaatactatgattctataatcctaatttctagtcattcccgagataactctcagctcagctcctcgttgctgagggcatgataggggccatttccttcaacacaaacataattatccgcgttaacaaaatctctccttgttcgatttttttctgtttcctctatattctgtagtccatagttactttcatgtttgagcatgtggctcgttaggtctaatagtgggagaagtttttttggaattgtgacgggttcaaggacccgaaaaaaacataagtttgtttctgatttaaccaaagaacatcaacttgattttattgttttatctgagacggttaagaaggaattttctacatctgctctgaataatctttgtgttagtaaagattttttgtggcactgtaatctcctagaggcagatctggtggtcttctttaggaattaatcttctaaattttgacattggtttgattgatgagggggatttttaaatccaattttctttacggaattaggcttgatatttttaaatgggcttaagttttggtgatgggcccggcccagaatgagcttaaagatcaatcccttgaagaattagttaacatgtgcagtcatgagactataccaattcttattggtggtgattttaatattcttcgtagtcctaatgataagagtaataccaattatgatgatagatggccctttttgtttaatgctgttattgatgggttgtgccttagggagatacagttgtctggtaggaactttacttgggcaaataatctagcaaacccaacctatgagaaattggatagagtgttagtatcaacggaatgggagcaaaagtatcctttatcttctgttgttgctctaaacagagatttatcagatcacgttcctttgcttctaaatacaaaatcttcctcttttagtgacgctcaacattgttttcagtttgaacttggttggctgttacgtgatggttttgtggatatggtaaaggaggtttggtctgggttgatgaaggcaatactcctatggagcgttggcaggcaaaaattcgccgcttaagacaacatcttaggggctgggctaaacacactagtggtttatgcaaaaaagagaaaaagcagatcttaaataagttggatgcgctagataaaaaggctgagactgttgttttgtctcaagaggaggttgatcttagatggtttttaaggaataggttatctgcgatcttaagggaagaagaaattaaatggtatcagcgggctaagactaaggatattatggacggtgactctaatacaaagtattttcatttaatggcaaatggaaaacacaggaaaactaggatttatccaa

SEQ ID NO: 17286 - DNA, 878 bp, Oryza sativa
actagttacctgtgacgggtcgtagctggatgcctcaccgatgacggcatcccgtatgacccgtcagaggtgacggtcatcagtgaccatttcgtttgcccgtcacaggtatcccgtcatagatgtgaggatctggtgtagtgagatatggttaaattttgaagtggaggagaaagtgagtgagtattatttctcctaattcttgatctatcggttgagatatgagtagcactctacaaaattatcagattcaatctgatggtgtatccgatcccaatgcccgaaaactacgcctacatggttccttttcagaacgagtagcagaagaaacttgcgatagatcgatcgggatggccgatgcaaacggcaaggcgctagctgctcgctatactccgtgctccataaatcaagagctagctagctagctactcatacctgcaggggggtggtggttagtgggagtacagggaattggctctcctactgatactgtaattattcggagaaaggcgccatgaatcaatccatccatcgatggagctagctagtgcaggtagccgtccacgccaccggtgcgtggccaatgcatggactcgccccgcccgcgcgaagtcaatggctgccgttttgtggcccgcgcgcgcgtattaatcacctcatcattagctctctactccgatcgatccaccaacacacctgcaggaggatcgaagtcagcgcgcggccacacacgcgtcgtacgtacgtacgggtcgcgttcgcgtgcacacaggcgcacagcccccgtgcgcgcggtctcatgaacggtgagccatagagccagcgcggtgatgcaggcgatcgatccaccgttagaggtcgtactccctccgtttcgt

SEQ ID NO: 17287 - DNA, 5683 bp, Oryza sativa
atttgtctcatcccattttagatgtgttatattctaggacggaggtagtatgatacataatcggtatcagccgacaactactaggtatcaggtgatacttacgaggtatcatgtgatacttatcaggtatcaatcgatacctagtaggtgtcgcctgatatcagttaggacatgatacaaatggcagccgtctcatagcattcccattttaaaaaggtagcttatttttgtgaaaaataaacatttatcacgtgttcattttttaaaaaaggtcattttagattcacctttcgtatttatacgttgatctattttgggactgagaaaataccactacatcgcaatctggcttagcgctgtcgagggtcccacaagtctggagttgcacccccatcatccaattgcagggcagggaactggattggggggataaagctacggctagaagctaaaaaaaacctccgttctgaaagaacacggccatctcacagacatggccgcgccaccgtcacctctcggcctcgcgcgccgcgtatccggcgccggcgccgccaccccggccgcggcgtggtcctcttcctgccgctccaggcgcctccgtcctcgtctcccttccttcaaaggtgcggtcattttcctttcttggctttccctccccttctcctttgctctcatttccactgatcggacgacaacggacgggtagtattaattttgttgttctatcccaacgagctaggcgccggcccggtcatcgatctgccacgaaccaacgcgtacggtaacgttttggcacgggttcgctaaaaaatatcgttactgactaccattagcacaagaccagcaattacgtttataatatgttcggattgagtaaaatgaatatactactcgtaaataacgtgaggttatatccaaacgccaggccccgttcgaatccaagccaaggggtggataaacttttggatttctgtggtacgctttttaaactgttaaacggtgtttttcgtgcgaaatatataaaagttgttttaaaatatcggattaatcaatttttcaactttttaataatttaaaattaattaatcacatattattaccacctcattttgtgtgaaatacttaattttcatcttcatgagattcaaacaccaccttacattgaaattacaatataaacttagaatttatagcgtaattacaatataatataagtgtagggaatatacagtgttaaaataatttgattattttttggaactagtaatatgagatgttgtaagagatcatgcccatatatatagttagagatgggctagtagtgtgattgaagataaaacattgtacccaatgataatttttcgtgtatgaatgtgatacacacagtagaagggaaggtggacgacttcgttttaagatagtataaaaatagcgtgataatgtagctactcccctttgacaatgcttgtatatggtggctataggggtatacacaattcattgaaaccaaactaagcgagatcgaaaactcagtcgtcaattgtaatgaaccaaaattaatatggtcgttttgccttgtcacctctatcattcccctgtcgtccacctctgcttccaacctccccatcaccatcgcccactgctatttcggtcatgactgaagaccaaccagaactgaccgaaacaaaatagttcggtcttaactatcatgtgatgcattttagtatttggtttgaaatgacctctttgtagtggatcgtcgacgaaattaatttctacacggatggttacgtccacaaatcgctgttttcactaacgcctgcgtccacgcggggcggccggccgcctatatagggtctgttcgggggagtttctagctgctgcagcttctcacagaatcagaaactcttctaaacaatccagcttttgatctagattctgaaaagctgtagttgtagaattcaggaaataaactagaagtcagaagctgagaaattcagcttttccagattctgagaagctgctaccatccagttgcttatcagacttttaagttctcccaaacaagcctatagtaggtgtagggcaggcattgaccgatccgttgtcgctctaaaagaaaaggaaaaggttgactgtgcagaaatggaaaggcctcaggcgaggtacgacgtgctccggccctacctagggagcatgtcttctgcacacaagcaggaacagaagaaagggcagggcgacgcagaagccatcatggcgcctttcatcaggcagctttctttcggttccggatcgtgcccgatctccttgtccaccccccccccccccccccccccggggcggcgcgcgtccccgccgccgcatgctgtacttcccatagttccctgggctcggcaccggcaccgcacgaccaggcatacatcccctcattttttcgcttatatttataattatcaatcaaattttaattttttaattttttatttgaagctgattttaagatttttcatcgaaatttatttttatatatgtatatatatatatataagttttattcacaagttactttttatttgtaaatacgacggttcggctccgtgtcggaatactacaactatagaagcctctcttcatctctctctgtctgaatacagatcagagccgtcagagcatgcgtccagtactctcctctccggccatgcatgccgtgacaacaagaaggctccaaaacacagccttccctcctagtatagctcctactagctccatttaatatcggaccggtggacagtagcttactgctcgatcagaggcatgcacagtgtgtgagtgagatgaggtgcatggccgtgccatatcctatagtaggactaccttccaaaataagtgcagccatagatattagtatttagcgctttgaccatccgtcttatttaaaaaatttatagaaaatatttaaaaaattagtcacacataaaatactatttatgttttatcatctaataacaataaaaatattaatcgtaattttttttaaataagacgaatggtcaaacgttgaatataaataatactaaaactatacttattttgagaaggagagagcagtacgagtaatacgcatgctgtcatgcaatgcatgcatgcgaatatatgcaacgcaaccgctctcgcccgctgatccgctacccgctgcatgctacatgcggctgggctggcgtggtggccggccagcgtactgtgtactgtaccatgatttcgacgtacgtccgtggcgccgtgtttgcatccgtggatgcttgcatggcctgccgcgcgtgcagccatgcaagcgaagcgagagcaaaagaaagaaagcgcatgcatgcgtgtatccgtgcatgcgtctgatggtcgctggccggagttgggcatgcacgcgcctagcttaagcttagctgacggatacagggctatgaccatgcagatcgatgcaggcggcacgtctcgatccggcgcgacacgatctgatccttccccggccgcttgggagtacgtaaacgtacgtacggttcgtgccgatcgacggggtgtgtgggcgtgggtgcatgtttggaggcatcctcttgtcctacctacttaccccgaccgagtacaaattaatgtatacatgcatgtgaggtgttcttgaggctttcttaaaattttattgaaatttcataaaactatacatactttgcacaatttatcaaactacagatttaaaaacttattttataaaactacagatttaatatcttcatttatcataaaaccacaggtttaatgtcttcattaccacaaaactacaggtttagcattgttaaatctgtagttttatgataatggagacactaaatttgtagttttgtgataaatgaagacactaaaatctgtagttctgtgataaacgaatacactaaatctgtagttttgtgaaacaagtttttaaatctgtagttttgtgataaattgtataaaatatctgtagttttgtgataaatggacatactaaatatgtagttttgtgaaacaagatcttaaatctatagttttgtgataaattatgcaaaatgcctatagttttgtgaattttacacaattttatttgatcgatctgcaccgttggatgcgaatcagatgcctcgtatttagcttctctgaatgaactgcgcggcacatttctctctaagctcagtcattaagggcaccagtcgtccattatctagctaggatagttttaacactcgcgcgccaatggacggctggatcttgatcaacagctaaaacatgggactaatgttatatgataaattgataattcaggttattgttaaatagctaacggtgtgctcaacttatatgcgatatgcacatgtaatacacttttggtacaacaatttcgtttgcaacttgcaactctaacaaatatgctgactaaccgccactgccttttcaccccatccggacatgcatgatgacgcccacttttatactgtctgtatatatagtaccagtcacacccatgtcattgcgacggtacattaggtggtgtatggatccataagtcctggggacttatttcagtcctagaactaatcactttagtccatggctgttttgttatagagactaaaagggactaaagttcattaaatacgctgcacaatgaccatgttacccctaaaatcatacaaagagaaatgcaccatacccatgcatgagggcagcaggtggaaaagagctactttagtcccaataagctactcccttagggacttatactaaagcactttagtccctcctgtttgggactctacagatttaaagggacttaaagtggagggacttcttttttagacctaaaaaaacagggccttagtaaactgtgcgggggatccgcgcactaaccgtgcgtggctacttttattcaccgtgtggaggagataagcaataacgagtttctatagcctaaggtatacgtatagaacacaccacgagcacacaactagtaacaaccctttgaaaggattaccatagaaattctgaatgatttaatttcctaaggaaattttcctatgaaatactttgattcataggaaagtataaggttcttatcggttgctcatatttcctactaattaagtcaaaatgacttattagaaaataaaaaaacatctttttgtaaaaaatttttatgcatgttcttagcgacttaaaaactaatgctaaaagaaactatattgaaaatatcttaaaattgcctttcaaattaagtttgaaaattcaagagattttctccagtccaataaaatgtacctcgaggtatcggtatcttatggtaccaaatcgtttccgatcgttatatctaacaatgcccatcctgcccagctagatccaacgattagaaatgatttggtaccgtgaggtactggtattgttggaccagagcaaatctcaaaatttaaattttaactttggctttggcttattagggcaaccaatgggactcttaagaatttttctatagaattatatttctatggctcaatttcataggaaaataagtaagggggtgtctagagccaggggtgtaaagttttgacgtgtcacatcgggtattatatagggtgtcgcatggggtgtttgggtactaatagaaaaa

SEQ ID NO: 17288 - DNA, 766 bp, Oryza sativa
attaaaaagtgatatatgtatacttttatgaaggtatttttcaagacaaatctattcatataattttaacattttcaaactcaacaacttgagagttatttatgatttatatttttaaagtttaacttaaacattgtcctaaacgacttcctttaccagtatggagggagtatttaattagttcttgatccgttcaatggttcagctcaagcgcactgttcagtaacagtacatggatacatcgaccacacatgaactgcagcttggcgcgcgccacgtgcgtgacacgaactctctaacttccatccaagatcaatgcaagtcagctagcagctagtatagtgttgtgttcgcggattttaaataagatttcgattctctgatgacgaatgcacggacacgatcgattgatcggtcgattttcacgcagcaattagccctcgcgccacggtggccgccgcggcggcgccggtggccggggacctcgtgctggtgacgagcttgaaccactgggtctctgggtcgcactcgccggcggcggcgtcgtcgaggcacctgcacgggttcgtcaccacgctccggccgtcgtcgccgacgtccaggcacagcagcccgccgccgccgtcccgagatggcgtcgtcgtcgtcgtcgcgttgacggccacgtgcatcgtcgagcccgacacgaggcgccacgtcgacagggcgtcgccgcggcagccgccggcgtcgctggtggcgagccgcgccggccggccgctcccct

SEQ ID NO: 17289 - DNA, 1303 bp, Oryza sativa
gaccgatgaccgccatatccggcctccacgaggtcgggggacgcggatccagcgtccgcggcctttcccctccgccaccgaccgccggccgccggatttgtttgtgcttgatgttgtttgggcctgatttgctcatgtttgttgcttgtgtggatgtgtagtttgttaaaatggacatggatacttgtgtgatgtatattgtcagattgcttcatgtgtagttgtttgttgagatgtatttgatttaaaatacaaagttgttgtatcatgtgcatcttgagatgtatttgatttttcttcatttcgtacatttgggctgaggcatttcttttttttctgggtgatttttgacgtctgtgacgggtgagaactaaaaccagtcacagctgttttgtcacctttgacgggttgcaaagagtcacccgtcacaggtgtgagtcacctgtgacggctatattttttagcccgtcaaaggttttaattaccagtgacgggctttcacccgtcaaaggtgaggtgtagtcatcagtgaccacttgtctctgaccagaaccaaatccgtcaaaggtgagggttagagtccgtcacagatgactggatccggcctagtgtctaacatttaaattttattctaaaatatctaatttatttcaccattactcctatctcaatcaatcacaaccaactttcatttaatttctcaacttcatctcaaattgagattcagcgcggttgcacaaaagcaactgcatgcaattacaaccattcaagacctaacacagacgcaaacaattgctacaacaggatattcacaatggcactctttgctactattgaccatatgtgttgctactatgactgcagtcataatagggatggcaaacgggcgcgacgggcacgggtagtgcctacctatacccgtgcggccgtgcccgtgatattatttgtacccgtgggtatgcccgttactacatgacgggcaatgattgttgcccatgcctatcgtccgcgtgcgccttgtgcccgcgggcgtgcccgtttacgggcaatgattgttgcccatgcccatcgcccgcgtgcgccttgtgcctgcgggcgtgcccgtttacccgccacaaaaaaagcagtggaaaaaaagtctacaagcttctaagttcaaatttgtcggtgacatgggaccggggatatcttgactagaggtttggggcagctgcggtcacccacgtggcctgaccccctcaggggggggtcgggcccgatggtgatgaggccgcccctccctctatctccccgaggggtcggg

SEQ ID NO: 17290 - DNA, 2400 bp, Oryza sativa
aggaagtcattgtatgaaaaagggcagacgtgtagcatgataaaatgacacgtggtggacaagaatgaccggtctgtgactggtctgacgccggtcgcgtcatcagcaaacaaccgtgcttccacgttgcacatgcttccgacggagtggaggttggtatgacccatcccatcggagggtcattcggacagcagccattgcaaatctccgcccattaatgaggaaggacagggttatcccggtgtcagacgatggtacaagccaagttttggtcaaagtaggatgggtccccacccaaaagaagggtaggtagaaatggtgtatgtggtatccccttgagatataaaaggaggaccatgcctaccaagagagaggagggagaaaaagaggagagaggaccggagctggtagacggagaaaagaggagggagaggggctctagagtttgaactctcttgctctccagctctttgtaactccttcatacacagatccaccagaacacaggagtagggtattacgcttctcagcggcccgaacatgtctacatcgctcgtgtcttgcgcatttgctctctcgcgaaccattccacagatcaagggcttagaacctcacttagcgcccccggccgaaccggcaaaggggggcccgcgcggtctcccggtgaggagccccacgctccgtcaaaatcgaacttaaaacatcaaatattctccgcctcggtgtggtgtctctcctctggcagcgatagaggaagggggagagaaataataagggaaataaaagggaaaccgtagaaaacaaagaacgtggcttctacatgtaagttagatttcgcgggtaaatgggcaaagcgggcatgggcagtgattacccatacccatgcccatttacccatcgggtatatcttttgatccaataagaaacccatgggtataaaatggagaacaaacccaactctaatagggtttttacccacgggtaaacgggcaaacggacacaattgtcatccctagtcataatagcaaatacatcggatctggattgactcacaaccaccactaattttattttagctctctccttagggtgtgttcaggtcctttaggaggaggggttaggaccctttcttttcgacacgcgaaacgaagcacgcattagtacatgattaattaagtattaaatatattttttaaaaaaatattaatatgattcttttaaaatcatttttttctatggagatttgtttttaaagttacattccgtttagctgttttgaaatcgcccatgttgaacacgagggatgtgaagctgggaacctcaaacaaacgatcgaattaagccctcgtttgttaaggttaacctcttcatgaaaaaaatccactgtgtttatattttataacaacgaattgaatgacgagtaatcgaacgtggcattccctttaattgaacttacattttgatgatgaatatcagtgctatcatctgcaatttgttcgggaaaataacagttttttttgcagtgataatttaggattatttaagatttgcacagtggctcctttctaggagcatgaaccatcgccattgacacggacaccttacctgtcacaaagaaaaatggggaaataactgctcccttgtccaaaaaaaacataatttagaataaaataagacataactagtactacatccgtcctaaaataagtgcagtcgtgggaatctatgtccaatgtttaaccgcctgtcttatttgaaaaatttaaaaaaagttagtcgcacataaagtactattcatgttttatcatctaataacaacaaaaatattaatcataaattttttttaaataagacgaacggtcaaacgttagacataaatagtgtaaaactgcatttattttgggacggagggagtataacgaatctaaactggagcagatttattatactaaattatgtcatattttattttaggttaggtttttcagtgacggcagagtgccaagagaagaaaatactagcagaggcagagacgatcagacgaatggctggcctctctacccacacccatgccaaggcatgaggatgatgttgtccttgtccacagtgcacagacactggtgcaccgtgatgcacagtcgcacacaggcacacagccttcttcacgaagccatatccctcattcccctctatatataagccagcaagctgcgccatgtcatatcccccgctaaactctccgcccgcgcagccttgcactcgcgtcgcacatatcgacccatccatccggcacgcatgcaggcgcagcaggccatggacgagcccgccaacgcgcagctgtacggccacgctcacgcgcactcgcaccaccaccggagcaagcgcccgtcgcccggtggc

SEQ ID NO: 17291 - DNA, 17446 bp, Oryza sativa
cgcgccggccaccacgacaggcgccgcagcgacgtccgcgccgggagcggacgacgacgcgtggggcttcctcatgcgacgtgagccgccggagacggggctcctgcaagacgtcctgcacgggttctacccgaccaggcggccgcacgacgacgcggggccggcgccgaagctggagcggccgtacgaggcgacgtcgtcgtaccgcgtgtcctccccctggggcgccgtcgaggactgcgacgacggcgacggcgacggcgacgacgactaccgcgggttcccgatgatgccgcaggggctcctcgaggacgtgatccagtgcccgccctacatggaggtcttggcggcgccgtcggccgccgtcggccgcgtcagccgcaggggctgagccgaaccggcgacgtcgagatctccgccgcgcgcagccgctcatggcgcgcgtgcatgcatgcgtcaatgcgggcgcattttgcttcgctatcctttgttactatctgcatcttctctaatcttgctgagattacggtggtgttctgtgtactagtttaacttgggatgattgatatcttggctagtactaattccatgcatggccttcttgaaacttgatcttgttgaaaaaatgaatcttgatcttattgaacaattaattcaatcttaatgaaaaaaaatctcgctcattagcatgcatgcatcaacagctagtttgctcatgcacagggagatttttcacaaccagtttgttgtttgcatagtgccatagttcgattaaaaccttttcaactttcagctcttttttgctaaaaaaaattcagctctgatatgatcgaaagctctttaatgccctgcacgtaaaagcagggatgggttatactaattgatggcccttattacatgcacaatctcatggttatttcatcagtgtgggttttcaaccacgtttcaacaaattactagtactacgaaattattatattgccgttttcaattaatagcaacgagcaaatgccatcgtagatcaattctttgaaaaaccgtcgtatagattgactagcaatcataaaaatgttgtgaaacatggggcattgttatagtcaaatctatatcagcacttttactttgaagcgcattatacagtcctactatgccacatccatccatcagtgagctcggcttcttaccaaacgacaagcagcagttgtaactttatatgcacgagttaaatgtaagttgtactcccttggttggacgagttatatctcggttggagtaccaactaaactgaggacacccacaatggttatttataggctctctataagagatccatgcccgcatattttcttacttggaagagattaaatgaagagagagagagagcaaagctatctactaacctggagatagtctatagagaaaaacgaggcaatgtattagagagctatagatacccatgtagatatactactattgaggtggtttactattaatctagtctattgctgagatgtacatgttttatagatagcaccttactttaccattgtgggttctctgagggtgtgtttagttcacgccaaacggaaaagttgaaagtttttgtgtgtagaaaagtttggtgggaactaaacttggcctgaacacaaaaaacgattcaaaggtaaatagtgacataacgaataaaaagagatttttgtaaaaccatctattattccagtatggaactaaggccttgtttagttactaattttttttcttaaaaacatgacatagaatctttgaatacatgtatggggcattaaatatagataaaaagaaaaaaaattaattgtacattttgcattaaaaagtgagacgaatcgtttgagcttaattagtccatgattagttataagtgctacagtaacccacatgtgctaatgatggattaattaggcttaataaatttatctcgcggttttcagacaagttatgtaattagtttttttcattcgtgtccgaaaaccccttccgatatccggtcaaacgtccgatgtgacaacaaaaatttcttttcgtgaactaaatggggcctaatatttcagtcacaacttaatgctttagattatcttcgtgacgcgacaaggttgcaattgcaagtactagccactaatagtgacatttcaatcagttgtaactttatatgcacgagttaaatgtaagttgtactcccttggttggacgagttatatctcggttggagtaccagctaaactgagggtgtgtttagttcacgtcaaacggaaaagctgaaagtttatatgtgtagaaaaagttagatgtgatggaaaagttgaaagtttaaaaaaaaaacttaggaactaaacttggcctgaacacaaaaaccgattcaaaggtaaatagtgacataacgaataaaaagagaattttgtaaaaccatctattattcgagtatgaaactaaggccttatttagttcctaaatttttttttcttaaaaacatgacatagtaatcccatggcatttcttgactctctacgcaaacgtgcgtagtcattgtgtttcttatgccatgtcttctttcatcttatcgtgcaagcctagtatggtggtgtttaaatctcctggagatgaaaatgaggataaagatttaagtgtttcacataaaatgatgtgataataatgtgtaactatttgggttttaattattacaaacttaaaaaatatattaatctgatattttagaacaacttttatataaaaagttttcacacgaaacacaccgcttagcagtttgaaaagtgtgtcacgagtatctaaattttcatccacctattacagaagaaactaacgggacaaaccatactcgctctttcagtccgctccttacatggctttgactctagcaagtgaccatgttatgttgcctttttccacattttcatcaagttgcaaagccagtgccgccgtcaaggccggtgaggcggtgactaatagcgtttgttagttactgactattttttcatacgtcgacaacaatcaacagagcaatagtggatacaaagctagagatggagctcgagcagttgcctgatccacctgagaggtgaacccgccatcgtttctgcctatgtggtggctcactatagaattggatgcaatcccatactttgcagcgggatatctagttaagaatggttgctaaacatatggcaaactaaatgtggtagaaattttagagattaaaaggtgggttgaaaagaaaatgaggtgggagtctatttgggcctatcttctagtttaggcctcactagttgttcctgtagacctaataatctaacagttgatgtttgagggacacattgatcaagcgactaaaatatgttgatgctgtggttcaacatggacaaaccaacaatatgaataatttctatgcttaagttcgatgatcggcctgctaatagttgtagccaaaatcggcttgagctggcccagttgggctagactagtagttcggccatgtttaggtctaaagtttttttttaaaatttttaattttccatcacatcaaatctttcatacacatatgatttttcagtcacatcgttccaatttcaaccaaattttcaaacttcagcgtgaactaaacttcgttgagcaattgagctcgatggaatggaatcgaagaacacgcacgcacgcgattctcgcagtacggccgcggggccccggcccggcgtctggttcattctctgcgcgtgcgcgcaaggatagagaggcgatatgtgtgatcgagctgagcagagtcgtcgcagtctgcatgcggccggtgataaatttcttgttcccttggtgcatgcgtgctgcatcttgcatgctgcgggcgcggattccggagttggtgcttcgctagctagccaaatctcccgtcacccctggcccaaatcaagcggttcaattgtcaattgccctgtcgaccaatccgtcgccaggaagacgtgagcaccggtggttaacagtgcaaagccggcgccaaacgataggtgcagacgtgcagcggagtactcctatctcggatgtcgttgttgtcgcggcggtgagccggcggcaacgcaggatgtgagggtaattaagaccgaacggttctgttgctgggagaggggagagagagagagagagagagggatagtatagcacgtctggattcgcgcgagagttcataacgctgtgcaggggcgcctggaacactgcatgtgtggcgctttccatcgacgatcttcgatggcgtattgtgcgggtatgatgggtatgatgggttgctgtgggttcaagtgaaaaaaccttgcttggccttatagcaagctgtgcgcaccggcgccggagaggtgtatgatcgacgagctcaccgaagaatggcacgtacataaacaagttcaaaccccccttgtaagcttgttgtacacttgtttgtactactattccactccagatacgtatagtacgtattattgtagattccagtacacgtattagtacgtattattgtacgcgcagcgtctcccgagtactaatacccagctaagagcaagtttaatagtatagctgactactggctccaaatgaactatagtctattttatagccaattcagggcctcattgtttgccgtatggcttataagccaaagccaaaatttgaattttaaaacttgatttttaatttgattttgatgctttttcagcacatattttcttagctttggcttttcaatcactacgaacatatatacaaaagttttactggcatatcattttataatcgcttataataagtcattgtcaaccgatggggacctcatacaatagttatctatatacatatactacacaattcgtatctggtcccacatgtcatacacacatgtatcttagagtccgtgctgtagctggctataaatctgtagcccgctgctcttctcttttatcttttatattctcaaaatatatttatagttggctacctgctctaacgggttgaccgccacttttgttgcaccacgcgctatcctacaggacttgcattgcaaaagtcatatcccgattcgtgaagatcttctagtactactactactccagtggtacggtgtagtaacagaaaaaagttcccatcggccatcgctgctacagcctacagcctcctccagctacagacctacagtacagtaggagtactacggtacagcagcggctcctctctcccccgtgccacgcgcatgcacgcatgactgcgcccacacacacacacacacacacaggtcctcacccatcttgtcatccccggcccgccggctggccacactgtgcgcgccactgtactgtccgcgggaagagcatgcgtgcagccgtactggttggttcccagctgctgcatgcatgccgtcgtgacgcgaaaaagggctccttgtcgcgggccgggctccgcgggcgcgcgcacgcacgcacgcacgtcctcctctgcccccgcggccgacgacggcacggcaggctgcacagcgaatccaggcggtggcgcggcagcaggcgctggctactagtaccacccggcacccggccctgcccgccgcgcgcatcccgacgttcgtgtaccgtacgtgcgcattccgctagctgcgcttccggtcgtcgtgccgccccccgcgattgctcgataggaaaacctgtgaatccggccacaacggaggtcggggggtgatctctgttgtgatcatgtcagctgggttgctgatggtccagttcttcacacacacatacacaaataaataatattatatacgtacagaatataattttttttagttgttaagaaagttgatagaattatatgagagaagattataattagatgagaaatgaaggtaggtagaaaaaatgaattgtgtagggttgtgattgattatgaagagaatgttggtaaaaaagttgttatattttttaataaatcttgaaggttaaaagctgttatattttgggacagagatggtactactgaatttgaagttctttgtctctgtcccgtgtaacccagccgtggctgaatatatgcatgcattgtgttctgaaaatcatacgtgccaaggaacacagacgctgccgggctcacaggatctcactgcaccatagcagcaagaatttgatatctcaaatcatggcagagtttgtttggcgctggcagtgcaaagaaaacaaatgcgctgtgccaaagtcagagtccataaattcccaagatatgcatgcatggaccgtgtagtttttttccttttcgcattttgaccgtgtagctcatgcttgggttgctctagcaattttgtgcagggtggtgtccgaacagggaagagaacagagtaggacaaataaactaatcaggcccggccaggccatggaatagaagctggtcagaatagctcgttgggcagggcaggatgcagcagaatgattgcagctggagtatccagaagatgtccccctctgctctcaaaaaggctcctttcttgtgtgtgccttcatcaatgtccatgcttatggctccagtgcacttcattggccaagatttcttcgctatagctgctctcagtaggggtgggcagaataagaccgaaccaaaaaactgaaccaaaaagaccgagatcgagaccgaaaagaccgagaccgagaaattcggttagtgattcggtgccagccatctaaagaccgatttttttcggttaattcggtcatatgcttcagttaaccgaattacccgagaaaatcgaaatttggcccaacaggtgtagtaggcccaataagcccactaaatagaacaaaccctagagggactcagggtggagcagccgagactagagctgctcactgcctccgtgcctcgtatccatcgcgccgcccccagcccccccacgcctctgccttcacctgcatcgcgccacctccgccgtccgcctccagcgccggcgccacctccgcctcggcgccgcctccgcatccactctccagtcagcccacctccaccttggcacctccatcccgccggcaagcaaatccaccaagtcgtcggcttctaaacctaaacctacatgatcttcaccaagttgaacacttttaactatttcccatcttctctgtcaatatttctgaattgtaatcaagttttgttttggttgcttgttttaaaatgtgtttcaggttgctgaaaagtggaggaagaagactaagatgggtacatgtcaagcctaaaacttatttactagttggctgttgctactgcttgatctgtgatgtaatgttatcaacctataacttgtactgtggcagtcgtgactcgtaacttgtgaggttcagacttgagacctatcctgtgataatttggtgcttgatgttgcctattttttggtatttttgtgatatatatgtctgtgaaaaaaagtctaaaaagagggaaaatgttgtcaaaatttttcattcccctcaaatttcggtctgaccgagatcgaaaagaccgagaccgaatttgccggtcataagttttttttatgaaattcggtccggactttccaaagacggaattacccaaataaccgaagaccgagaccgaatttttcagtctgaccgaatgcccacccctagctcccagcgcacacacacatacacagagtgtgtgtgccgtgcgtgtgtgttgtgggcatggcaatggcatgggtgtgactgggttggagtttacgagcaaacacaagacattcaattgcctgcagctgcagcagtgttctaaggtttggaaaccaaggacccttgtcacatggtcctgtccctcctatactgtccctataccactcctctgcctacgggtctcactcctgaccctgctggttgtaccaccattgccatactgcttgcagacgtgtactcgatccgtcaggacaaacatactcctacatacagtagttacagtagccgtatgtgtgtgtgcgtacaataccaccagtagtagtacatcagttataactagaaaatcagcgcgccagttggcgcgcatgatttatagcccgtatatattattttggggttattaattagcacattgttcataaaaaatatagaaatcaatttaatttctttgaaactcatgcaaaaatcatagttgaatggaattttctgagttccagtttaacataacagatcatattgttgagaaaatcatcaaattttctctttttttccacccatgctattgtttcttcctttgtttttctaaaattataattaagttattaactaattataaaattggtgttggtatttttttaaaaaaaacaaagtgtttcacccctcacattatttctacaatattttaacaaatatacatatcatcacattatttctacaatattttaacaaatatacatatcatttttataatatttaacatatacttatcaatatgctccacattaaaaacgggtatcatttgtttattttatgataagtaccgataaaacttcacgtttcattattttctattctttttactcttagtttacttgttgaacaaaatatattaaaaattgtttagtgatcccgtagcaaagcatggagaatcacctagcaatagaaagtggaagggccttgaatcttcgatgattcgtccccttcaccgctcatcgccatcgcggccccgggtcgttggatcctggcattggaactttatttgctgcgttggtgctgggagaaaggcgatggccattagggaagacgacacttgcgagaacaaggattgtcgcgtcggtgctgggagaaaggcgatggccattggggaagacgacacttgcgagaacaaggattgccgtgtcaatgctgggagaaaggcgacaaccgttggggaaaatggcgcttgcgagaacaaggattgtcgcgttggtgctgggagaaaggcatcagccgttgaggaagacaacgcttgcgagaacaaggagaaaaggaggaagatgatggtagcgaaggcaacatcgccctcgtcccttgattgtccaaagctgggtatcctcattgagcccttcttcatccctctctcttcttcctcctggatttggtcgagcttggggtcgtggttattgctaccgtggatggtgaggacgtgctcgacctcgatgctcgttggctggttggcgcatccacactcgcggactatcacagctggtatggctcgacgccctccacttgctccattgagtgagtggatcttgctcgttggcaacagcttccgtggatccggaaaatattgcggtaaatgtcttcctcgttgccgatttacgacagctaacatcggctcgctgtttatatttttttgggaattgctaaaaagttgtcacaagtttttttggcaaaaaaaaacttttaaatgttactgtagtatagttgtagtataactacaatgtaactacactatagttacattgtacataatagtgtaactgtactgtagtaatctctatataagtgatataaagttgcatatagtattttaatacttatatacaagttacaatattgttacggtatagttatagtggaattatattatagttagatttaaaagttgttcctttaaaaaacttgtggcagttttttggatactatttttttcttatccattgtttcctcagcatgcaatctttttcaccagttcttttcgtgttatcgtgtgatttttttcaaccgagtttagaatgctctggattttttcctttgttttatctagactcttcacacacgttcaaaatgaacgtgctcttctggacacgtggcacattttgatgatatgtgaacttggtttttggtttggccacgtggcccaatgatttggtagagtttgcaccctgcaaccagtattttagatttgtgtgcacgcatgttatagtaataatagtatatatagctctatcctattatataattaaaattagcataaatggaaaaaaacagtttgctcgtccacttgtatccctaaccacgtagtgtttgagagcccggcagggtttcccaaaccaccggggtcaggttaccgcgctctagcggtaagcacggttatcgtgtggtaaccgtggcaaaccgtatgaaaccgtataaaatttatcaaaatttcgaagtatattttaaatttatttgaatttaaagaggttatcgtagtttttcttttacagtacactcgcggagtcgcggtaagcgcggtaactctagagcccggcggcggtactgttttgctagcgtaagtaaagggacaacgagaaacaactccgacgcgcccattgtatatttacgtatatcacatgcggtacaagtagctgcacgtatttggggggtacgtatggcagtactgttctccagcacatttgtcgtatgccagttgacatgtctctcagagacaaattaaggagggtcgtagctagccagacacagccacaggcgcggtgtattgcatggagcagcttttctttttgtggaaaaataggggggtcgtagtgcatcatgccatattgccatgcatcggatgaattgaagatgatggggacgaaaatgcgtgttacatgatgcggcccttgtcgtctcctgcgatcttcatagctagagaatcataactccaagtctccaacgagttgtagctgctaacgatcgagtggtacgaacgaaaaaaaacgatccgccaaaaaaaaaaaacccaacgttgcgtaatgtgattaaacaaaaaaggaatttcagaaaacattgggcctgttcggtaggccaactgctgcggctgcgcacagtgagtgcgacactgttcatgccgactgcgccgcagccgcagccagggcagccggacaggcccattatttgaccgaaattagatcgtataaaaaaaattctaggagagaggttacaggaaatgaaaaactgacagaaattgctgggggatccaactgctgatcacctaagataggaaatggaaaacagtagtagtattgtattgtggacggacaacgactactgaaagtctataactatgaggccagcagtaaactaactctatgaacagtaaaatcataccgtgtgaggggaacagtatttgggagaacttaatttgggccgttacatgtgtaatcggatggtaaaggaagagcctaacgcaactcttgtgaaaacggcacagttgaagccgaatgttatagagagagcacatggcctcgtagaactaacggcccaggatccggtccatgtgggccatttacagattgttgggccttttgagcattaatagatgggctttgagttgtaccagattgggctaaaaacatggggaaaaagtccactttgactcccttaaatatacaccgaatctaattcgtacccatcaaccagaaaaccggttaggacgactcccccaattactaaaaccggtacaaattgactccctaagtggttttagagggtggttttgctgacgtggcatgctgacttggtctgttgtgctgacgtgtcagcccagtcaccaaaatacacatgaggcccacatgtaagtgataggagaaaatataaaaagcgtagggcctacttgtcagccatcttctccctctctattttttcccccaaatcccccaaaaagaaacagtagagcaagcggtcgaggaagccgagtgcgtagttgttgtgcgggcactgcactacacgttgtcgtaggtgtagacgagggtgtggttgttgctgctcagcatcagctctggctcgctcctctcttggtactgtgccgccgcgtcgccggacccggacggccccgctagcggcctcgcgcctggcggcgataggtccggcaagcacttcgccgaccgcttgctcccgaaccgccccggcgctgccgctgctgccggcttgagcgtgcccccgccgcggatgagccggtggattccgaggtccgccaatagcggctccatgtcggcgtcgagcaggatattgctcggccggacgttgccgcacgaacttcttgtcgtggaggaaggccagccctctcgccatgccgcgggcgatgcgtcgtcgctgccgatcctgcgcaccgccagcacggcgccgtcgtccaataccgccatgtacatgatgctgctgcccgccgcgcctaggatgtacgccgacgccttcagtagcgtctccatctccagctccacgtcgccgtccaccgtcaccagcaccgcgccgccgccgccaccgtccttggccttcttgccgccacgtcgtccgtcttggcggcgacgacgccctccttggcggcgaaggacgccgacgtgtcagtcacctcctccgtgtcgtcgctctcgtctctggcactgaactggcgccgcgcacggcaagaattataccatttctcccctcgtcgagtgtacaagaactcctcgggtgtcgagggacaactccggcgccctcccgatgaccttgaccttggccggcgccggtagccgcatccagcacccgaacttcccaccgctgccgccgccgccactaccggcggcggcggagtgttaacaacatcgcatcaacacggaggtggagctgtaccgccacggcagccgcacccggcacccgatcttcccaccgctgccgccgccgtcacctcactgtaggatacgcgacaggagcgaccgcggcgactggcagctctcgatgccgccgcttcgcccggccttcgcgccggccttctccacccaccgccgcccacggcttcacggcttcgtgcactcccttggcgccttccactccgctccctcgccgccctctgctccgccatccgtgccctcggcaagctctccgcgctactcgccgacgggaagagaaagagagaaataagggagagggagggaggcagaaaggttggaaagagaatgacatgtggaccccacaagtcagtggatcctattataatttttgtgtgtgagtgacaaattggtcccacatatatatttttaaatctaatcttacatcagtgccacgtcaacgccatgtgggacgaagaccaagtcaacaacgccacgtcagcaaaaccgcccttgaaaccgccgagggagtctatttgtaccggttttagtaattgggggagtcatcctaaccggttttctggttgagaggtacgaattagattcggtatacatttaagggtgtcaaagtggactttttccaaaacatggcactcagtccccttccgtgggctaccacaatgcacccgcagctaattaaaggaataagttcactttgtgacccttaaaagtgatcgaaatctaatccgtaaccctaaaccacaaaaccagatatttcgacccccaaactctcaaaaccggtgcaatttgactccctcgacggttttggaaggcggtttcgctgacgtggcgcctacgtggcagtattgactcggtctcctttttcacgtggtgttgacgtggcgtttaggtggcattagaaataaaaaatatgtgtgaaacccatttgtcatttatcaaaagtatggatgggcacactgacatgtagggcccactagctagctcgatcaatataaagagcaaatcatgcattcatcaaatcacatcagattaccacactaatcacgattagtgtaacaatactcacgtacatacactatacaccatgtcgccgcaggccaaatcccaaaggcaaactgcttctcttggtggtcatctccttcctctccgtgttgccatggcacacgctagcaagcggcagcggcaagcccctcgtcactgccatcaccaaggacggcgccaccaagctctacaccatcgccgtcaaggatggccaccccctcgccctcgacctctccggcgagctcgtctggtcgacctgcgatgcctcccactccaccgtcctcccctatgagcgcgagtgcgtggaaatcatcctctcttcatctttatggggcccacataaagcaaggagacggggaggaggaggaagggcggggtcgagccatgggtggtccatcaaattcggtatccgccgccccaatctcttcctccactggctcctccggtcttcctcacgcaccgatttgtgtcgccaccgccggccaactctcgagttcatcgtcttggctacggctggcgtggccgaggaagaggaggagacgacgaagccggcagtggcctcactgagactcggcgacgtctagggcagcgcctaacggtggctggagtgcgtgacggcgatggagcgagcgtggcgctcgagcggcacggggatgggaaagagcaagtcttggggattctctttatataggccggaggggagaaggtcgaccgcacggacggaaaacggcgccggcgacggtggagctccctattgaagacaccggtttaagaaatcgattgagggcgatttagtgcgggattaagcgggatttgttggggaaattgatgcccactacacaaggaaccgatttttctaattaatttagaggagaaacgatagggcagggagatcaatggaggcggcagtgcttgagttttacgggagagatgaacagacgacggacagaggtggaagaagctcctggcgagcggggcccacctgccagcgaacggaagagaaatagaggggaggatgaggagagaatgattttatgtgggccccacatatcagtgggtcccacccatacttttggtgaatgacaattgggtcccacacatattttttatttttaatgccacctaagcgctacgtcaacgtcacgtggaaaggagaccgagtcaatactgccacgtaggcgccacggcagcgaaaccgctctccaaaaccgccgagggagtcaaattgcaccggttttaagagttagggggtcgagatatccggttttatggtttagggtcatagattagatttcgatcaatattgagggtcacaaagtgaacttattccgttatagagagagcacatggcctcgtagaactaacggcccaggatccggtccatgtgggccatctactagattgttgggccctttgagcattaatagatgggctttgagttgtaccagattgggctgaaaacatagcactcagtccccttccgtgggctaccacaatacacccgcagctaattaaaggctgtaatggaccaaatgtccaatggagaccatgtcttgagctgggcctcatccagtcatcctggaccatttcaaccatagcaaagccctactcacagaaggtttttggttttccttatctctcgtgcctttgaatagtcccgatgcatttggattatctatagtgaatttgctgcagaaaagaggtgattgctttgataagatcacagaggctaataatttactattatattcattctagaatataagcatcgttttgctatatacctagatatttcttcataataaatagccagaagcgattatattttggaatggagagaatcacctaaacgtctgcaacggtgcaaaaagaattccgagtcaaagattctttagataaaccacctatactttaatactagtattacttatttgttcagtttagccttcgttaaaaaaaagctgcagttagccatggtttaggagaatacactgaagaaattaaggatgaaattaaggaggcagcagactggcccagctctttacgtactgcaagggcatgttcaccattcaagtgagcaagacatgctatttggcagatatgaatatatgaagcatatcttcagagagctgctagtattattttggtttcatgatagagtagtgcttctactatcattgctcctgaatggatggcaataaaaactgaacaggcagagtacaactaggttggctttgtgttgttttattaatcaccggattatttatttattttacacaagtgacctttttctccttttaatacaatagacttattattgttgtgtactatggctctgcaacgtcgcacaggacttggatcagactatgtaaccagggcatttatataacgtcagtcgtcagacatggccagcttcactattgctttcctcttgattatgtggcgccctacgcaattagatggagattttgaatttataatgccatgaaaagaaatgaaatgcaaatgtttagttgcacaaaagatagggaaaagaaagcctcaaacaaaaagaaaaggaaatggttgccctgcctttgtagagaagtagattgcaatgatgaacccttgaactccaaagcaagatttcaggtgccattcgcataaactaaaccggcttgagagatgttgagctcagcgtagggaatcagtattataaccaatgatggtctgcagccacactatcatggaagattaatactagattaacatgagggacagaattgacgaccttcaggtgttccattcaatcgtatcactcaagttttcctttcttaattatccacccataatcttcgtgtttgctcgccagatttgcagacagggcgtggcaagctctgataaaactaatgtgtttcagctcattaaccgatgagtttgtccagttaatggctataggaaattaaccatgcgtttctgaacctttgaacagctaggtcaaaccctcggactagtagtagagctcaagccatggagcagtttttaacatggacatttcgttagttatgggagtgcgagctctgaattttcctgaaacggaagaatcttgctgcctctatgtcagaaattcagaaagaggaaaaatcacaagtggcgggcaggcgcttgatccgatacaatggttatggaaataaacgggcagcctcaataattagcttgagccatgactaattgtatatacaatataaccaaacttctaacctgcattttaattcttttttcgaaacaacctgcattccaaatcttcatatttggtagtactagtcatttccaagggcggtatagaaattactagtactttggactcgtctaaccaaccaaacaacaaaaccatacaatttcactcctatgaaaaggcgatctatcttagtataaacacaatattttcttagataatgaaataaacctgatatcaagtgcagatgttcacatgttattttcatttaaacttccatatgggaaaaaaaagggaaaaatatacatttctcttaattaaagtagaacttttatggtcgcagacagtgcgacctttttcctttcgactggagttcagacccaccatttaatttactaattgctgcgtctttaattaagtggtgacaagaattggatagaaaaatttatccagaggtgctccacatccactccatttgatttaacaaacgctaagtagctaacctacctatgtcgcgcctaaccgtagctgctaatgaaaacacgaccaacgcaacgtagctaatt

SEQ ID NO: 17292 - DNA, 6752 bp, Oryza sativa
ttaattaagattataatggtaaattcagtttcccgtcggaggacgacggcgtctcccgttggcgttggtggccctaggggctgcggtggctctcatcggcaccggcagccctagggactgcgacggaagacgatggcggtttccgtcggcgccggcggcactaggggttgcggcagcccaggacggcggtggctcccgtcggtgccggtggccctagaggctgcggcggaggacggcggcagcttccgttggcgttggtggccctaggggcggtggtggctctcgtcggcgccggcaaccctaggggctacggtggcccaggacggcggcggctctaggggttgcggtggctcaagacggtggcggtctgagcactttggatagtagatccttaggaatccggtaaagtggaagccgatcccgtcggttcgtgtctagttggctagttccgactatacgacgaatgatggtggttgagagtgggcttataagcggcgtgtgacgtcagctcacctgaaactgatgaagatgacacaaatggaggttttcatcaacggtgcactaggggcgacagcgactagtagactttcactcgtcaaatctagctgttttaggagaatatggaagcagaaaagcaggatgtgctgaagtcgtttggttttcttttctattttggttgtgttcttttccttgttgagacgtgagtctaagtactattgtatccttttggctgtgtatatccttcgtggatatagaggccagattaatgaaaatccattattaaaaaaaatggtaaattcagttattgaccactgtatgacaatgatatttccaaaagaaaattatcagggccttcttagaatgcaagatgtttttttctcgattcagaatagaattaaactgatcgatgtgaaagtaactttggcctgcattagaagagaacatttaactagtgatccaaccgagtcctgtatctaggagcccatcatgctcatctgatccccagcaaaaacctgcaagatcctactcatttctgagcccctccatcctgacttttgcatgccactctggtccctgtttcacatgtccccttccaattcaagtcccaaatcctaatcaatacccttgctagcactcatcagagttcatcaatgacagtctggtatatgaatagtttgaattgcaaattcccactccctcgcccttgaatcccagaaaaaaaaacacctcatgttagtgtactaaattagtgaaattcttggcctttcaaaaaaaaaaaacattgttagcaaggctagggagttgccgctgatctctatctctccgagcatgtgttagtggacgcttttcacggatgtgagtgtggtgttgcatgtcgtacacgtaatcggaaaaaacattttgaatacttccattatccaaaaaaaaagattttttttcttttttgcatcttccttgtttggcccttgcttctctctctctctctctcctccccaaccacttgggcatcatgatataagtagagccaccaagaaaccatttccaagggctcacagaaagtcaggggcctagccagccagccaagccagtggttataaccaacctcccagtgaaactttcagaccctcccgttttagcaagtgagagaagccctgcgactctcgctcgctcgctcgcccaagatgaagtttatgaaacttggcacccggcctgacaccttcttctccaacgaatccgtgaggtgttttgttcttgagaaatcctgatttgtggaatcaatcaatcaatcaatcttggcatggttcagactttcagttcctgggattcttgcctgtcgtctgaggtgattgaatcgtggttgcctgatttttgtgggtgtttgttgtgatgttcacaggtctgtctgcacagaggtcgccactgacctgcaaatcttggtgggtgactgcttgtatcagcttcacaaggtaatgggacatgaaagattgttgttgttttttgtttcgctgtggttctagaacggatcttttctgcaacttttgtgataattagatcgtgaattttaggggaattttggatttggttgcatgtttggattgttttgatatcgaaggatttgttgatgatgtttgtttggaatttgttttgacagtttcctctgctgtcgaaatgcctgcttctgcaagcgctgtgcgccgagtccggatgcggcggcaatggcggcgacgtgatcgagctcccggggttcccgggcggcgtcgaggcgttcgacgcgtgcgccaagttctgctacggcatcaccgtcacggtgagcgcgcggaacctcgtcccgctccgctgcgccgcggcgcacctcggcatgtcggaggccgccgaccgcggcaacctcgccgccaagctcgacgcgttcctcgcctcctgcctcctccggcgatggaaggacgcgctcgccgtgctcaactcgacgcgccactgcgcgccgctctgcgaggacatcggcctcacctcccggtgcgtggacgccgtcgcggcgctcatcgcgagccccgccgccctccccggcgcactcctcgtcggcgtcgccgtggtgggcgcacgacgtcgccgagtctcggggttgacctgttctggcgcatcatggtggtccgctcaagggccatccggcagccagtccacggagtaagtacctgtcgggcgtatcgcgcctcaaggccgctacgcgtcgcccggtggtctgctccaacgtctgccaaggcacgggcatcgctcgtacggcgtccgtaccaagcccgttcgacgggtgctcggcactggtcggcgacggctggcaatgccagcgtcaagccagatcgccacgaggcaccgcctcctcctcgagaagatcgtgagcctgatcccggcggagagggacgccgtctcctgcagcttcctcctcaagctcctcaagcggcgaacatcctcagcgcgtccgccacgtccagggaaaagctggtgcggagggtggcgtggcagctcgaggaggccaccgtcggcgatctcctgatcccgtcgctgtcgtgcgtgtccgagacgctgtacgacgtggacgccgtggcggccatcctcgacgagttcgccctgcgccacgccgccgcgccgccgccgccggtggcgctggcagtgagccccgacgacgacgacgacagcccggcgcgttccggcgggcaccggcgctcgcggtcggccgagagcgtcgggttcgacggcgccgcgcggcggtcgtcgtcggccgcgcccgtgtcgcccgacgcgctcgtcagggtgggcaggctggtcgacggcttcttgatcgaggttgccagggaccccaacatgccgctcgacaagttgctcgccatggccgaggccgtcccggacaccgcccgccccgagcacgacggcctctacaaagtcgtcgacacttacctcaaggtgagaatatatttgaataccaccaccattacaaacttctactaatatttaacttgatatcaatcttgttctggtcttcgattcgaatgtgtggttcactttcgttttcgtgtttgtttttgggtgacaggtgcactcggagatgagcaagagcgcgagagagcggctgtgcagggtgatcacctgcaggaagctgtcggacaaggcgtgcgcgcacgcggcgcagaacgagctcctcccgctgcgggtggtggtgcaggtgctcttcttcgagcacgcgcgggcggcggcgatggcgggcggcgcgcacgccgcggccgagctgccgggcagcatcagggcgctgctgcagtccaagtcgtccgggtcggatcaggaggacgacgcggcggaccgcgtggacgagcagcggctgcgcgcgctcgccgcaggcgcgtcccccggggacgactggagcgtggagggcctgcggcgcgcggcgtccaagatcgccacgctgcggatgaagctggaggaggacgacgaccacgacggcggcggcggcgacgacgaggagttcgcgcgcaggcagcaggccgggctggcgcgcagcgcatcgctgcggttcagggcgttctgcgccatcccggcggcgaggccgaagcggatgctcagcaagctgtggccgctggccagaggcgtcaccaccgagcggcattagcgtcgcaaccagtagccattactactaggttttttgtacttcttcttcttgggtgtcttgcttgcattgcttgcccaaggcctgagaatgcaggtttctttgcttgtctcttcttcttgtttctccttttcaattacagtgtcaaggccaagtgtaccttccaggcttccatgtagttgtaatcttttctctctctccgttttttttttgggtgaggcatgtagttgtaagcttaattattaaaaataaataggaactgcacagtttatatacttatgtaaggagtaaggtgaatggatggagtgcaatttacttcatgcacatttcctcaataattttgctgaacatgctgatgcagggaactcatatatcaacgataatcgacattgtattcgcttcgtatctatattcaatgatattcgtttcgtttccattattatagtctaggtttctgtatttgtttatgattccggtatatatgaaaacaaatgtggtagaccgtagaactactgttcattcatatatgagtcgttttcacccctagttagaactattggccaccccaatttcctcttttatagagtatattatttgtgcgaacaaattgttcatgaaaaattatatattaacaaacaagacttttgtgattcaaaggcaccatattttgtagtgttaataaggtaaaaaaataatactaaaaataattgtaccttatggtgtgttcttaaggaccgtaaaaccacttgacaaaatgattttgcaagtatactcgctccattctaaaatataggaatttccaagtgtttagcaaaaattaaggtatagacaaaagattatcttgtagtcactttagtggttaaattttaaactttgagttgacaatatttttctttccaagcatctcattggttgaaaatgtatatatttgtgttcactgaaatcagcatctcttatgacaatagtgcacatcatagttttcatggtacaaatagcaaaagaggccatcaccatgcactatatatatctccctttctttaatgcgcgatcgagaagcaggcctatgattgttatccacttggcttgagaaaaattgcatcctgaagagacccaagagggagagagaaagagagagagaggaacaaagaagcatggaaaatccaggagggaatcaaatgcaccgcggatattattatttcatcttctttttacctgaaagatcccctttgttaggtcttcgcgtgtgtgtaggaggggtatatatgccccggccgcggcatgatgatttggtgatgagacctcgagctcgaaatgttgttgggtcagcaaccactataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcgggggaaatgggtcttcccaggcggacgctggctccgcctatacctcacaatcttcgcaggcaggccggcggtccgcctagtaagaccattatcgtaggcgaactggagctagaggtgccgcctaggaaaatagattcagtgcgccagaaaaaatgtgattgatctgcctgcgaaaataggtacaaaatttttttaaaaaaatgctacaataataatttgtgataaataattttccaaataattaattaattgatgcataaaaaatattagtaactaaaaaacatttgatattaacaaatatacatatattgcataagtgaaaagtgtcgtcaaaatgttacaatatttataacattgtcacttcgaataccctatctaattatattatggcaccgcgttgttccactcccaagattcttgtattcttatcttgtagccaggatgctctctgggtcgaagaactatcctttgatatgacagcactcacggtggatgaagtgacagagatcgcgctgcacatttgtaatgcatgtatcgtcaaagcttgtttgatattctattctaggcagctgcatgcatgaaagaaccaccatatatatattagtaggttctaaatgtgcatttttccaatgcacttatacgttgagtcgagagatttacatcctctgcgttaaccctttatttcccattaaccctgaggaattcgcatgcgtaatacctgcagaggaccgtgcctctagattgcttgtgacacttaatgacatatcatagaaggaaaaagttaaattttgtaattagtaaaacaattggagtacatttactgtgtggactattatatatatatatatataatatatatatatatatatgtattagcagcttctctcttgtttgaatctgctctccacccttcttcttgtagtagttgttcgaactgtatgaattttttaccgtttcgtattaaggaggagat

SEQ ID NO: 17293 - DNA, 13568 bp, Oryza sativa
acgtgctgatgatggcattaatcagcggccaggccgacaaataacgtggatgtcgatgtacaaattaatcactccacatcatcgccacatcaactgggaagttaatcaaatgacctcataatttgtcttgccttgctgcacaggggacacgctgcgagcaacgccacaatctcacacaaggcaaagggagacgcagatcgacaacctgattaaccctgatgcacaagtgtgcacaggcaacatggcacatttgcaaccaaccaaaaaaaagtcatcatcgcatcgactagaagcatcaatgctactactacatgcttagactaggtacaatagcgctataaatatattttaaagagataaaagaaaagagagaagagtagcacgctataaatctgtagctagctgcagcatggactccaacatgtaatgtgtgtatgatagatgggactaggtattacacagtatagtaaacaactattatatgaattggctattacattagtatagttatagatgatttggagttagtagttggctatactattaaacttgctgagtaggtaattaatcaatcaatctctctcacacacactctctctctctctccatgtactacatgatgcagagacagcatagctgcaaaggcataaatctccagaattgggttcaggaccacacatgcatgattaagcggcatcattgagggcctctggcgatttgtttatggatcttttttgtggttaattattctggagatgttagcaagatcctaggcaataacccaacacaaagccctcgtcacaggttgttttccaggctcgtttgtacttgtatctgtttgcttcttcagttagttatagtttaattatccgtgaaagcgcaaaagtacagtcctagtgcatgtgcacaagaaagaaaaattgtgtactagtgtacgtacgtgcaactagatacgaccagataaattaattttgcaaaattaaaaaaaacaaagagaaataaatcggcaatagatataaaacggtggtcacaagcattgaagtgaggccaacctgcattgcgctagtacaaattcaagggctaagctagctagatatcccaagcttccagcatggcaagtcaaaaaaaatgccaaaaaattgtcggagcttaagtttaatccaagcttttaagaagggacgaaacataattaggtggcataattgcattttgtatcaccctaacttaattcccctgaggttaactattgtggggttgcaaggaagatgcctggcaaaattaaaccttgacaggttgttttcctggaccatagctgttatctgtgaaaagcacaaaggacaagagtgtgcatgtgcacatacatatctggtgtacgtgcgagactaggcatgaccacaccaacatttatgtcacttttaagaatatatctataattatctatatgtgctttacatggttttatacaatgatacttaaaccaagtactcatctgatgtggaacgacaaagggtgccagcatgcgtgtctttaacaagttcatgcacacaaaaaaaaaaaaagtcttagccacccccctcacagtaagatgcgtttggtttcctacaaagggtcaagtcaagtctggcttgtatcattcgacctggtttagatgagtctctttgagatgtgtaaggacgtattcaatctgctactaagggtgtgttgagaatcccctttcccaactcacacctctctttttccacgcgcactcttttcaaactactaaacggtgtgttttttacaaaaagtttctatgtgaaagttgcttacaaaaatcatattgatccatttttttaaaaaaaataactaatacttaattaatcacgtactaatgaattactctgtttttcgtgcggagagtttagttccaaactccccccagcagcgaacaacacagacgctaggagaagaaaacctttatttttctccaagccggctcttcgcttggtggcacactacacccaccaccacttaggcaagtcaaggcatagttaggggtgaagacatgcataaaacagctaaggcattaattaaaataaaaatactatttaattttaaaaatattcactcttctatttattagctcatccctacacacgagaatttcttggctcttcccttggttttttagggtaccaaacatacaggggcgaagctagcatcaaaataagagggtgcgctaccattgagaatctagaaattttcagtgcaacactgtatattttagtctttttaagtgagaaattaggaatttgggggttcatgtgtaccctcaaacactataaaacttcgtcactgtaaacatgggctttcttactaaaagactctattacctgtacagttaaaatgcccccactaacattattacacagagtctcatttcctgcgcaaaatcgcaaaggaaaaggaaaaggaaaaggaaaaaccaaaattggaccttgggtccgatcggtagacgctggtgaggtggagccatctgggtcatgatatatacgtctgcacgcacgtacgcttagctccaccatcctccatccaagctggttgccctgtccctgtttgggctccctagctccacgagatattgtagagagtacatggatccaaagctatctcctgcacttatggtagaacacatgccactttggctcgttggctgcatcatggcacagggccttgcgatcgcagccatgagccatcgattagggtatatcttctctgttaatttgccccttgctagaatcgatcaaatcgatactattcgtcgaccggagaggcggcgacacgatcgaattgtccctctcctcgtcttatcctggatgagcaccggcctcgatcaactataattttgtggagccactcatagtttgttttggtgacagtagcgatgattatttgtggagacactcattgtttgttttggtggtagtggcgatgattatcttttttcttattttttttggtgaagggtatttttactcggactttacatctaacaggatatatgccatcaaactgtatgatcgaatagaaatagctaagccaaccagagggaggtgaatggttggtatacccaaaaaccaaaacttttagcggaattaaaagttaccctaaatttcgacgaaacacagtccgaccgaagtagacgcgctggtctgaccgcctggaagccgtcggtctgaccgggcttgatcctccggtcaaactgccgagatcaactgccgtcgcctgaaaccgccgccggtctgaccacccgtgatccaccggtctgaccgctggtgtctcgccggttagactgccgaacccgagcaaacacaaatcgaagaactcttgatgtagatgacaactttattacttctctctgtgtttacaaagtgcaacaacagcactcctcacgaaaatctcgactaaactcgaaaccctaactcaactatcaactcaatgctctcaaaagcgatatggggatgcctcacgctccctctctatttatacatgaggtagatagtctaaagccatgaaccaaactcatacaggaagtcctaatctacctaggaaatcttcccgtacaagaaacaaattttacaaactccaaacataccaaatttggactccttccaaattcgactccgcatctcgtacgcacacaatatctccatcatatggcatggaatcttcaccaaccacgtgcattgaactctagcctaagtatcccgcatgatatctgtccgtccggacattgccttatctccaagtcgactcccgatccattaccggcactactctcccgaggcatcaagtcacctacacatgaatcaaacaaagaaaccatattccgagaccaagctatctccaacttagctcattgtcagcaaacaatagtattacatacgtatagtatccatctagaagccataaacatgaaacatccacggatatccaaacaaaaaacccgaaaccgaaaccgacacagagtcggccggtctaaccgctcgatacacatcggtctgaccaacaacccatgtccggtctgaccggacccaaatctctagcagcacctatttaacacctgcaaatccattcatctccaaaaccacttcgccaataatctcccaatatcaaaaccaataattacagatgccaattgttcatcacagaataagaatcataaacactttgattttacacaaacaacttgatatgaaattcgttcctataaagatttaaacttaaaatcttggagcgctactcatgtcactgtaaccactgggctacatgccttttgcgatgattatctatctgatctgattggatgatgtagaactggagattacgtgtcgtgtgataacgctgcattatatgtatcatttcgtgccagttgcgaaacagtgatgctgagaccgatatggcagcaagagtagcagatgccggcgtgatgcaatggaagcaagcaatatatcattatctcaacaacagcaacaaaagaacagaaagaaagtagacaatagaaatatatcttttagataatgaggtagacaacacatacgctactgtttagttggaaactgatttcttggttagttaatttgtgatttgctgattacagagacgttgtaaaagcagatcgaaatgacgggagcaccggagcaaagagcaggcattcaccggtttttcttacatcagtctccaataatgatagtttttgcagactcactctcttttctccttgctaaaacctaaaagctttgaactttagaaaaggaccagacaaacccaagtacgaataacattttcctgaaagcactaaagcactcccactaatatgattatctgaatcggatttaagataacttaataaaattagtagtactatcacattaattttaaggtttggaggttgcttcagggtgagatcaaccgcatttctaacttgtaacatgacgagctacgtaatggaagtggttgtgtgatcgactaacgacagaggccaaactaaggcacataattttataattatctagaaaacctacaggatgatattagaggtttcttcctagcacgacttcttgtagctagaacttagggtaattttctcattcttaaaaaggtatcaggaggtgtcatattttctatgataaaatttggtacctttagatactacatcctccgtttcaggttataaaactttttagcattgcccatattcatatagatgttaataagtctaggcaacatctatatgaatgtggacaatactaaaaggtcttataacctgaaacggaggtagtaagtatcttaaggtatcaaaaattttttagtgtaaaatttagataactcaaaatgctttgtcaaaaaccataaaatttctctagtatgaatatgaacctactgtcaccttaaaaagagccactttgctctcatgtggaattacatgcaagttgttccttcttctgatatggttgcaaacccgcaactcagcttaacctcagcaacaaacacatgatcaagacttcagagcagagagctagtattagtacagatcagtgatcagtgttgataaaaaccaaccaccacatgagcaaaccatggtggcaccccaatcaagcagtactggcagagcccctaatgctgaccctgtgtgcatgcaacttgagagtgtactgttaggttcagagaagacctaaaaaaatgtggttggagcacggcaattgggcaagcaaaaaaggagattaagacactgacagttaggggaaaatggctgcattaaccctgagatggtgtgggccatgccctgccgggtggcctcccctgtggccagcatggacagctacccccaaactactagtgctcagtggcgacatgcctttttgcagcatcaaggccccagctagccgtccctttgacatcggacggccgaaaaatattttggtgacaacttgtgtgcatcagcaaagctttgggttgagaaaaaaaaaggaaaaagaaaaagaaaaagaaagttatgacttagtatgagactcatggcaatagcttatgttaatgacattattaaacagcaattagcctggtgatgactgcaagattccttttccatgctcctgtggtgacactggtgattccttttctatatgttttaattgtgtgtggtcacccctggctgatggattaaaagtacaaaagttactccattaacagctcactttggctagattagcagggggggtttagtgtaatgtaatctgggccgtatcaactttggtgaacacatacctcacacaatcccttagtttattagccataaactggcgcaatgatctccttgctgagaaaagtttgggcaaggcctcagggattaaagctgtaacgcgtaagtgcttatgcaatgttgacaaaatttgtatcccaagcaatcttgttctgctcagctcttggagttgtataatccgacaccgtttgacaatacacgtaggcatggagatcaatcagggcatctgaaaatctgatctgatcgttcccttgagatagagagagacggtatagagtgcggcaagttgcaatttttatccaaaatcaaggcagaacccatttggatttgatgatggttgtttagtgccaaatcattcgaggttagacagattcggatcgtttaggatccctcctagttgcagtctcttgcctttttgcccaacttccattgtctccagagcaggtgtctcttgcacatgctgttccctcttaaggacaaacggttttgcaagttcccaatattaattcaggcatctggattttgtggtaataataagggcctcaattaatcatgcagttacacgctatctatatgcaagtcctcttgtgtcgacgccttagcttatgcaagttggtcacatcgaaggatttagtggggagaacggttacattcttctctttcaccctctctccccgaatcccaaataggtggctagagtgggggtttggtgtcggttgttagggttaggttttgagtgaccttaattgtatttccttcgttggcctagcagcgaccggtcacgcttaacgatggtcggttcaatgctagtcttctccggaatatgtgtattggtgctgtcggtgcgtggggttgttctttttttcttcgttttcctgtttacgacctcctattggttgtaattttgtaattttttctgttttatcaatatgaactttacactatctagtgcgagtcgttaaaaaaaatacacgtgctttgccatgcataaaattgaatatacatgtgtcagtattgtttgaaataatttcgttccagtagatgactttgcatgattttatatttcaaagatgaaataaataattccgtttccgactacttctaattctgggaaatctcacataacccaagaagataaggcatattagattgttattctcatttagtacattccatcagttctctaaaatcagatgagctaataatgaagcgggaaaatcacctcaaatgtattagttagaatgtgagaacgacaagtattttgatacgagcaaaagatttaaatgctgtaacggcaagtaatacgaagatggaataaatttctggtgcggtttcttcgggaaggaaggaggaactgttcattatcttatcagctacagaaattaatttaaggtcgaaaggctcaactgaaccagaatatgttggggtgtctcctgtgccaatttgctctgttcttgtctgtacgtgcagcgtacgagtacatcagtacatgttcaagataggtaccccgaagagaccatggggaacaaatacataactctgatggcgtcgtcacagaaagaaaaaaaaaacaatccaacatggtcgcattctcccaggtggtccaaacccaactccaaacgcccaagtagagtccaacaaccacactggcgtagacgaagagaagctcggcccggtgggcttcgaggtccctgttacgcgatgccgcaacgcgtacgtgtttgtacgcgcgcgcgaagacacacgggaaagccaatgctgatcgacacgggtgactgacgcggtcgctacttgctaggcgaggcttgatgaggcgcgcgccgcgcccgcgtgcgtgacggacggtgaattgcacggtggaaaccgcgtgtgatgggcctgtgctgctggctgcgccttgcgcgcgcgtcggcccaaaattagggtatgttagttcgcgaaaaaaaaatatatgttacatcggatgtttgatcagaagacgcaaggggtttttagatatgaatgaaaaaactaatttcataactcgtctagaaaccgtaagacgaatcttctgagcctaattaatccatcgttagcacatatggattactgtagcacttatggataatcatggactaattatgctcaaaagatttgtcccgcgatttctctcctaactaggtaattattttttaatctatatttaacgctccaatacatatatctaaagatttgatgtgatgtttttgagaaagaaattaaggagctaaacgaggccttagctgggttagctggggcatggcgcacgggtgggggatcacgtactacgatggataagagacaggtctgtgacagagttattagtagccgtgcaatcaggtagatctctctcccggccagaacccaacacggttctatgggcagcggccgggcagccatgcagctctgccctgtacgttaagccactgttccgatcgagggagcgaactttcgtggaaaaagacgggtgcaggaccggccagccatgcatgcatgcaactatgcaagcaactcgtgcacgctgaaaacgtcttgatcgatccatcgatcgacctgcaaattaagtttctgcaaacgggtcctacttacatggctgaaaccaaaaccgctgtgtgtactagcaaagctagctgtgaagcaacgatgcacaggagctcccaatcatggcagcagcgccttcctcgacggaccgtacatattttttttatttttttagagaagttattttttaccaaacctatatatccaatcggatatatacaacatttttaaattagaaacttatcctataaaacatagaacttagccatcaaataatccactctgaatttcgctcctatgaagatttgaactcaggacctcatgtcgctgcaaccactaaattatatgcccattcacgcggccgtacatgtgccggactgttcggccgcatgtacgtacgcctcgcgtgtatagcatagcacattaccaatatactactacgtacgttcagggtacagtgtccgcggcctgcgcgccatctctcgatcggtgtcccggagcagtcgccgtcttgccggccggccggctggccgaccagcgatatgccgatctcgattcttcccggcctgccggtgtccgtacaccaatcgagctccctcctccgctacgcgcgtggccaagcaaccaccgtccgccgcgcgcggcccacgcgccctggtgggcgccggtgacggtgaatgcgtgtacgtgccgaaacttcgaagttagctcgatcgccggctgggcagccatggtctcaccaaccatggaccgaatcgcctacacaatatatgtgccgctcacacagtttcatttcctgcacgagtgtcaaagaagtacggcgatcgagcgctgccaaaaataatgccacagtttcatttagctggaaagaggggcatgcatgcttgcaggcaggaggagcaggctctggccggcggccgcgcaatcatggagctagccgaaccatctattgttgagttgtgctccaaatttatttatacataataaaggtcagcttctgtgggagcgaagcggaggcccatcaccggaggcttgggccggagcgaaacataggctgaagtggaacccccgcggtatggatcgttatccttttaaggtttcaccttcatatatacttctggtaagccgccgttcggcgttataacctcacctcgatatagtgaagatatttttttgttggtgtccgtggttttttctctcttattttgaaagggctttccacgttaaatctcgtatcttttgtgattgaattatttttttatcgtttatttgcttatcgttttctaacacccatgcacaatccaagtccacgcatcacacatgcgcgccatgccgccatgttttggacgagctagcccagccgagccgcgccgtgcaagcgccaggcgccacctgcatgcaagagtagtatgcagggtagctgatcgactagctgcagcctcgatcggctgcgttgatgcgcggcgcccgccgggaggcaggcggcgtgggcgagcccgggctaccagcgaggagtgccggcgccggcgggcgcagcgtctgacgcgcgttatggttcggatactgtgattcttggatagatttctttccagcttgattggcccagtgtccattcatgaattgtcctgctgcgtttctgaattatggatatatgattgctcctggctcgatcggaggccaaacaatagagagataaagttccattaggattggacttttatgcacgaaaagttcctaccctggggccagggaaaatgaatgaaagccgctactactatttctgctgaatcgctgaatggatcagtaattcattttttctagttattttcgacctttggaggtgcaaaatccaaaagatgccgaaccagatcctgggccagtgggcatttggtacggatttgtggcactgcattttgccaggccggcccatcaaaataacaaggaggcattctcatttctttatagggaaaacagagcggctcctcatcaccatgaacctgggaattatagactcacgaatggctcaaccatgggcaatagaaatgcatgggttctcatgatcatcttttaggaggaaccacgaaatatgcaagtttgtgacaaagagagtcgaactaagacatacctacacacctacatgctctcccatagagttaaatagctggaggtttccaccattacatggccccgaacaagccatcacataacatttcctttccagttttgaggcaaaatatgaggttcagatgaccctatctgagacggtttgatggttcagcacgacttcagctatgcagtttgatcccacaaaaagttcctgcagttcttcgccttacttcgaattctctatcgacctagatgctatccagccagttgccaatgctctcctgtgatccaaactgcaaatcctgtcacaacacagaaaaaacgaggcaggatcagaattggcagacatatgggcaccaagagagagccacgggataaacttacagcaagctgaaaatctggaggtgttccaaggtctacattgtagagatcaggtagtccatacaccgcattcaggttcctgtcaagaatctcattcccgccttgggacagaattgggcggtcagaaggaagcaacgtttcatgatagaaggaatccagaacttcatgacagcgcagggattcatccaagttaggacaggcctgaactgcttccctcgcggcctgggtttctccagcgcaccacgcaggattcccagcatcatccttcaggctaacaataggtatgttagactcctcttcgtcctataataattcgcaaatcaaagaacaaaattaatattttcaaatgatgaacaaatacagcaaaccaaaatatcatcgatgcttagatatgtcatttttcatcatctctcaaaagggaagcatacaactttccagaatgttgaaagtagtggtttgatactccattgaaaacaataatatacaaaactaaaataacctaaggattacagttatagttcgagttatttttagtgatccgttgagtgcagatctgaaaccagattatgaaatgtttcctgcttcagtggttacccaaattctgaccaaattggctttcaattcttcatttgcatcaatgataacagaagtaatgtacattacctggtcctccaagatgggatcgtaattttctgtttcacatggactgttttttaagcgacatggctgtggggtgtttgactttggagtttttggaccaacccttgcagcaaatgcatcagattcttcatcagcatttcctgtttcagacttgtctatctgttttccatgcaactggtaggagattttggagacaacaagctccccatccttttcatcttcttctgccccaagatggtactgatgcatcacccagttagccttatcaggtttggcaccgatgtgtgaactcttgtacagaaccattattttcttccaaccttttgtaacccccttttcaactatggctttggatttccctgtctgtgccatctcacatgttcaacagaaacaacatgatcacagttactgatctttcgacgcttgcgctgaccacaaccatatgcatttgaaactctatggaagaaatgaccactggttccatctttcttcatacctgttggccaaaaataagattttggtaaataacatggataaaccaataacttcgaaaacagccatatgccatcacaagacattaagtccataccaggaagattttccggatgtgaatagcatatcccttcatcattatctatagtcggaataaattcatcaatgaatgtatgtggctttgaaccccccaggccaatcttttgttccaaatgttcaagcaattccaaatcagatggatcaaacttgacaccagcaggcagcccaggccactgtatagcaacctgcatagaatgaaattcagcaaaatattgattagaacacataacttctattcaatgtgagctgaaagctaaagttacacttcaactgcttttacacatgcagagattctgtgattaaattctgggatgcattatattccaaagcccaatgtcaataggctctgaaactgagcaaatgatgcctatttctgccattaagataacccagtcagctcatacctcctttctcatcagcaataacctacctttttgcaactattggtaacaaataacaatcaacagattaatcatgtaccagaagaaggtttcagaaaatgggataccccaaaatttagaggaatatcgattttccaaagtatgaacttacaaaagtgtatagttgacaacaaatattgtagactaatacttacatcactgttatcaataacatgtttgcagtttggacattccatctgtgcttctgcacccaattcacttattgggcgactagagcaatgaggtgcatttcttattttcttagcaactcccctaccagttataagccaagacctgcagcaaaacaagcatgttggcatttgttactaaagtaacttgcaacgttagaataaaacgatgtatatgcgcatgacttaggggagttatacttgtgcataatcgattgaccgttccagcattgcttgttagtgaactatgtatagcaagatgagtactatatcattttgatgcccttttctaaatgaaaaccttgattgaaaagtttttttttttggtgtgtgtgtgtggggggg

SEQ ID NO: 17294 - DNA, 6221 bp, Oryza sativa
ccatccacccccatccgggtaacgatcagacgagccctaaaaacaacagcagaaaaatgggtgaaggaataggggaaagaaaatatcactagtcacctcgccatggcggcgcgggcggtgcgtcctgaccccaaccacgatcagcggcgagtccgcgaccgcgagcgagacgcggcaccaccggaccaccccctcccgaaccaagcaggctgctcctcctccctccgaacggcgaccaatgcagcggcggcggcggcggcgatcgatcgatcggcgcggggaggggaggatgcgccccccagcgacaccgcgcctccgcccttatccccctctctattgaaccccccgggattccggggcgctgcctgccgccgcaatggcggtttgctgctgcttttgcctttgctccgcttcctcctttcttcgcaagccacacgcgctccccaagagagagacaccactcgaggggaaatgcaaataaaaaggaggagcgtttgcttcggtagcgccgcgccaccgcgtcttccggtttctgatttgcgggcccattagggcccacttagaatgtgttcacgcctttggggccgtatgggcctgttgtgcggcccactgtaacttgggtatggaatatcggcacggcataacacatggccctctgttcggataaagttaagatctgattattggttggaagccagtttcaaagaatatgataatgttaaaaaaacagaacttgtggtttcttgtttattgtttgaatttttaactatagcttctcgaatctagatgaaaaatttatctatttagggaagtttttattctgaacgaagcaattgccgtaagctcgtcgaaaaggcttgacagaggaataatattgtttccttaaaaaaaaatgaaagacctaaatcatttgtaaatcattggtggtgttttttttttataaccgtataggattaactcatgaattaacgacaggacagttaacttgcacacaattgtatcgaaacaatcacggtagacgcggccgcgcacttagcgtgtggtgcggttgcacgaaacggactgtaaatgacgagccatctcagttaagtgatcagcccattaatctccctttttttacagctgacgcaaaaaaggttaaccatctttcaggttattacactttaacctgcagagaatttcgtagcttttccagtgatccatcacaatcacataacccgtccgccacgaaggccataaatccgcctatcaattgatcaatccaggtcattatcagcgtatcaggagaagtctagttagctctagccacatgccagcgccacccaaacgaccaggtcgccacagatattgttttatattttaatttggcaggaatttgctttcgtaaaggaaggaaaaatctaacgagctttttggttgcgcgcccatgcggtttgaatgacccggtaaaagcatccgggtcgtcaaacacacagcgctttgtggtcgtaattaattaacaactttgtggtctaattataatttgttaagaagaaaacaagaagatataataagatggtgcttaatccagcctgaaatgaccacgcggtgtatgttgccacggtctacgccgttgttagttcacgacatcaaacctgcattctctacgcgtctcgcagtggtgtaaaatatatagtgggtgagatcgtttgtggactccaaatgaaaactttctcattatctatttaatgttatgtttttttaaaaaaaatacatataggattacaagttttcttgaaggatcatattaatctgtttttaatgatatgttttttaaaaaatattacatataagattacaagtttttcttaaaaaatcttattaatctatttaatggtatatgtagaattacaagttttttttaaaaaaaatatatcttataatctatttttaaatttataataattaacatttgatcaatcattaatgtcaatggtttctcgtgccttgtgtgctgctaatttcctaaaccgaacggagcggtgggtgacgtacacccgcttccgtgcaaaacccaaaaaggaacttcggagttgcacaaaggttgtgtttagttcagcacaaagtttagattttggttgaaattgaaaatgatgtgactgaaaagttatgtgcgtatgacaggttgatatgatgaaaaatgactgaagtttggattcaaactttagatttaaacacagccacatttccgttcggaatccccccggtagagttccaacggtcactgcggctgaacgatctgcgttgctcgggtcagagccgtcacgaggaggaagaggaaaccgacgcggcgaagcaaccgagagacgcgacgcgctcccttgtccccgcgcccgcgccgcagttccatacgcccccacgaacgaatccgcgacgcacgcgcgcgccagcggcgagccaacccaaaccgaccaaacgaacgaaccaacacgagtcgacacgcttcatccgctcggggatgggaaatccctcgcccgcccatgccaaattgccaatgcggcgcccatgtcgtccctggtcagtcatggctggcactggcagcgccgccacccagccgcccgccatgatctcctcgaaatcagaaaaaaaagaaaatccgtgcagcgacgaagcgtgacagaaatagaatttcggttttgatatagttatgtcgccataaatcttctctaattacagtcagtttttagccctcaaagtttcgtttagattcgtacaggactgcttaatttgccatcgtgcgtgcaagcactagttcatactacatacacatgcatctgtgctgcttgctgtgatttatctgatcgatcacgttcctttgctatctacatgtaaaattacactctatataattacatatataatttaggaagttacaatgtaaatacatgctgactattttttggtgaaaaatatggcgccataaatatagccagaattttggttcagagatttttgtgccgataattctacagctatagtatgtgctcgtttgtttgcagggaccaggcaacgtgcgatgctgctgctgcctgccagcacggaacaacaaaaattaagcgcgtaggatcgcatcgcattcgctcgcatacaggggaggtgagtagaaaaatgagccaaatttgcagcgtgttcgtttgtcaatctggctgaggtggacgcccccgacaggaacagcctgttcccaccataaagaaatgccgcgttcacaggtcgcttaacggctcgcatacagggagtactatttcgttagcaaactagcaaagtctagtggtgatggattaccggattacccaactgaaactgccagcctgatgctgctcattgccaaggatgagaggacaactggagaaggccgaacaatagtagtagtgctgctgcgagctcagctcttgccaacctgcaactgccaccaacatgtcagtaaatgtctcagctgctttacctattattgggctcaaattgaaagggaaatatcctgcgtgttcttttgactcaaaacgtgttactactacagcaaatgcatcaaagggtaaacgaattaggaacacagggggacactgtcaacagttacaaggagatgaacatcatagtcggggtcaagaagagaaaaatggtactagtatctcatctgtaagtaaatgacgatgtacaccatggagttggaccagatctagagtgtcactcagttcacaatttacaaatagttttgaggtcatatatcaatcatgggagcaatgaataaactcgggtggtataagcacactctgccgagctcctctgcaaaacaagcacgcagcacgcccaagcatgcgctatgctgttaggccttccaactacacagtacaaaatcatgaactcaaaccaaccaccaattggtcgctcaactaagctagtcaatcgtatcagctacacgctgtggcgcgatgttcctccaaaggggcattgtgcatcagatcataatgcaaatcatcatccctagccactttctcgcatgcagttgcccggaagaagatagcggtactggtccattttctccaacagataagcaggaaggtgaacagctgaaaatgtgctagggattggccccaacttggcaatgatctcttggaatgtatactcttcgggaagcatgtcaaaaagatcagctccttggcatatcacatgctgaatccttttggggttcaagaagtacttaaatctaatccggtcaacatggctgtaagcttgcattttgaagacaaaatcatttatgtgccggaagcaaaagctgcagtgccaccctgagtcggccagaaggtcgtctgtttgccggaaatgcgcatacctcgtctttccagcccggtatctgtgtattgaagccctccaactcttgtcgtcaaggagaaactgaaatgagtaaagatagttcctgagctggagatgaagcacttcaggagtgtcatcacaccacctcaagaggttgattgtatggccactggggatctcatcaacatcagacatgatcaaaaggtcatcatctgtgattccagcaattttgataagctggtcaagagcaaccctttgatatgactcctcgacaaatgggttctcccccttcacaaatcttccacctatcataccataggtcaaccgtgattcagcaaattcaaagcgttgacggttttccttgaagtggagatcctttttcaggccagtgaaggttgagttggactcgagcagcacaaattctgacacatatgggctaagctcatgccaacggatatcaagaatgtcaagctcattgctgaaaagcacagcatcaaaaacacggcgtggagtttccctgactttccatccatgcaacttgcataggtttgccatcgagacattttcatgatagtagtgaggaagcacattgaagggctttggcggtttttcccagatcggtcgaagaaagtaagtcaccttctggccatgaacatatataatgaatattagagctggcacaccaatcaagaggatcagaagtgccctcaaatcaaacccccgaagcgcacacttcaaccttgacatgctcagaattgcctttgaaccatgctgcaaatgaatttcagaaaacaagtgagaaatcaggctgtcaactgaaaccaaaagaaacccatcttcttcacataattatttcaacaccaatcaactgcacaaaacacaaatgaaaattcaacagcattggttctaccaaaccagaggatcaggttatcagtacaaattgccaaaaattctaagttgtaacatccaccgtgaatctagtagcagcaataaccaaaggatagtaattttttttatttaacaacaacgttacaactacaggatcatagacagtagaatgtgtgcatattcccggttaaaaactcaatgttcatatccatgataagctaatgcatatccacccaaaaaggaaatcagctgattgtttatgttccatgaaattgttatctttggcggcatgaataatccctcgggaattttgcaaaaagtaaaaggcagatacttgtaacatccttatacaaaggaaaagaaaagaaagattccaggattaggctggacaaccaattcggccagctcgcgagattctaccggcgccagaagcatccaagcttgaacttcacctaatcccatctccagcacaaatagcccccaacaaatagaagattaaaatattccaatcagcaagcacttatgaattattatgatcccagagcaataaccaataaaaaatcgaagcagcaagcaagcagttctgcatccctacttttattcgatccaaacgcaataaaatagccaaaatcgaagcatcaagcaagcagttctgcatccctactttttattcgatccaaacgcaatagaatagccgaaaaaaagcaaggcaccaagaagaacgaggggtgcttgggctttttccgtggaccgagcaatccatcgcgaaaatcccaacgcggcgggagagaaagggatagatctgggtgggacgagagaggaaaacagaatctcacctcgctgccgccgcagacgcccccgcagatgccgccgtcgttcttcttgcagttgtagtagcccgccgcctccatcgcgtcggcaaacgcgcggagcagcaaaggtggggacgcgctgctcgccgccaatggcgacgcgtgcgtgcgtgcgcc

SEQ ID NO: 17295 - DNA, 3004 bp, Oryza sativa
attacgattttggaaggaaaaaaagggactactcgtacaatatattttttttaaaaaataaaagaatcttgtaaaggttcatgtggcgtattggtattgggtctatatttttcatctcggattgggatttgggaagccttttcaacaacggattgaagtataatttattaagtattataacatgaacaaaaaaaggattaacatgtttttctttctaaagcaccttttgtttataatttttttctcagaaaaaaacacactatttagctgttcgggatgcgggtgtgttagaaacgagcgagtagaagttagaaatgtgtagtatggaacaccctaactctcaaatcaggcaaatgagaatttagtcagcggaattatgaaataaattatggactgttcagattgtagccagaataaatcttactaaattttggcagtgtcaaaattgtgtcaatttggcaattttctcaagtttttgtaggatttcttatgtatttatcaaagtttataaaaaactaaatagatgcacatctttgataattttaccaaaaaaaatagtatggtttgaaatggcaccaatatgaacaatccgttagtgcatgtagctctgctcttatttaaattaacctgattatgatattaaacgagaaaattagaatttatttgagggtatgtgaattagtacttttttacatgtagagccaatgacaagatcaggaaaacacggacggtataaaaagctgaaaaggacactgcaaagatatggggtgtgtttggatgagctatggcttttgaaaaagtagctgtggcttttcgaaaagcagttgtgaaatatgtgttgtggcttttggaaaagctcgtttagttcaatagctgtagcttttgaaataaatagtcccacttacaagcgagccccacatgttatacacccattggaaaagaggggaaaaagagagagaaaaaacaaagacgcgcgcggcgtcggcctcggcggcggcggcggaggaggaggcctcggcggtggcagaggaggaggcatacgcgtgcggcggcagtggggaggcagacgcgggagttgaccttggcggtgttggagtcggcctcggcgtcgtcggagtcctcggtggcggcggagtcgtcctcgggcgtcggcggagtcagcctcgatggcgaggaggagcggcggcagcggaggcggacgtgcgcggtggcggggcgaggaggagcggtggcggcgacgaagtgagtaggaggaggtgcgacgcccgtggaaagcgatgggagaaaaaaaaacaagcgaaccgtttttttaatggcagaggtgggtaatttttttctcccaaaaataggtgaaagcaggggggtagatgtgcttttgatttgtactacaccaaaagctggctttgggtaaaagcagccgtagcttttgaaccctttggttggcttttggcttttccaagcaggttgaaaagtccaaccaaatacacccatagtataccattttttaaggaaaaaaatataaaatgagatgccggggttaatatcgatttgcgttaagaccataatacacactcaaatgtaaaagagccaaatggatgatccgcctctagatggggagattggcaaaattcatgagcaacactatttgttttcttctagttttgatgactcttttaactttaatttgtgattatagggaagatgaataatggttacgattggttgagaggaggagtatataaaaaatagttttgtttagaataaaattattgcgctagaaaccaaacgtgtttctacccatatctgtgtgtaagtatttcccatatttttattatatgaaagacatgtgcacgcatatcactatatatgcacatcgcacacactctccgtaaatgtgtccttaacacaccctcaaattaaaatgcacatggcaacgacaaattcataaccttcaattaatttcctttttatctctctctcattatatgataggtaaatcgatttttcagtgccaaatgtgtatctttggcacgctgttagtttgaaactaagtcgaaacaaatacacgctttctcaaatatctttggcacgaaggaaaaaaaaccctgtcctggttggattcgaatattttttgcatggatgataatgacgaggatctaggatgtaataacaaatcaggcatctcggcgagatgcttcctatatgctgatccatgtacttagtgccctgcactttttttttctctctctccattcattcttttcatgacatggaagtatggaactatgttagactggggctaaatcatggcagaccatgtgcaaattgccaactagcgtgtggccttttctccatattaataacatatgctaactgcttgaatgaaataaagtaatcccaaacgttaaaagcagctgagcatgttaaggtgtactactaagatatataaagtattgacaatctagtaagttttcttccaaagagaaagagaaggttatgaaccgataagaaaaacatacatttagtacgtcctccctccattcttatttccatacgaagttggttagttcaaattcaagtaaccaatgttacataagaagaaaaaaaaaagggagcatataacaaaaatactgcaacaatgtgaccaattctcatcgaggaaataagcgcgcgcacataataattttattacctgataatgaaaagaaaatcaacttagtactcacataagctaacagaacggccatctcgaagaaataatattagatattttctccggttttcaaaagatattgccgttaacttttaaaaatatgttcgatcatttatcttattcaaaagctatgaaaacatgtaaaaattataagtcatgtgaaagttacctttagtgataaactaaaccacaacaaaaataaatgataattattatgttttaatacgacaagtgtgtacttataatcccataactgattaagaaaaccattccaactgaatcattgagaaa

SEQ ID NO: 17296 - DNA, 1201 bp, Oryza sativa
aagagcaagtctaatagtacagtcctctactagctccaattcatctatagtcaatctaatagccaattatacaatagttcttattacattattaatatatggtcacgcctatcatacacacagtgtgtcttagaatccgtgctgcagctggctacagatctgtagcccctgcttttctctctcatcgtttatctcattaaaatatgtttatagctggctaatagtctgctattataccttctctaatggagacaatctgaattctacccacatgggcatgtaccccgggccacatggagtattatgtgggtattggcaagtgcccaagcacactgcattttgattcggcaagtgacgacttgagtgtttattcctcccaacatcttaaaaaaaatctaaaattaaatgtgatataacgaatatggatagaaacctgtctaaattcgttacgaatccgaacagactcctgtccagatttattatattaggatataccacttttaattataggtttatttttgggacggaagaagtatgatttagatgcaaaaaggtattgagccgttgctggggtcaccgtgatttcgtcgtcattgaatgatgggtacttagacgtagccatgtggataatttaagagcgcattttgcaataggattcaacttatctgtctatttccgtacgtggatgtgacctaagatatggtttacttagtttgatgtcgtaacaatgaaattcggtggtatcaaagccgggacaagtttttgcgattatgaaattcgttttagtcttggtacagttagaaaatgattgttgttttttttttcttaccagccctagcgcactccgataggaattactacatccgtttcacaatgtaaatcattctattattttccacattcatattaatgttaataaatctagatatatatatctatctagatttattaacatcaatatgaatgtgggaaatgctaaaataatttacagtgtgaaacgaaggaagtaccaaaataaaaataaaaaatcatactagtacattcgaaggaaacccggaagaactattaaaaaacaagcttgcgttgctgttcttgacttggaccaggcaagtcgtagccttttgacgtttggtaacgccgctgtctaagacgacttataaaaaaatttaacatctgtcgatgcatcgccattgggacgtgc

SEQ ID NO: 17297 - DNA, 2464 bp, Oryza sativa
cctgcagcccaataataataatctaaattaaaatgtgatacaatcttaatattatagatctgaacagaatgtctagatttatactattacgatgtcacactccgttttaagtttgtttattttggaacggaggggagaaattcgaatgaaatgtatacgttgtttcgtctgaatatatcagagaaatgagttcttagcaagcattttttttaagcacagtcccagtgcaaattctgaacatgaactctgaatctctgataatgccgctgttgtcttgagccagaataattaagctaagaagataagacaaatacggtatttaaggcttaatgtcactgaaatctactcccttcgtccatcggtccatattgtacatgaatctgtctcgctgtcatgagttcttaataaatgctaaaaaaacgcatgttgtttgtctgaaactctgaatatatcagaggaatgagttcttaacaatcatgctattttcagtgcattcgttgtgaaaaatctaaacatctctgatgttttcttgagctagaaagatacagttttggttctggctcttgacctgtactgcgagcttgaaaagtcggaggccatatccagatatatatgccatttgtcgcacagatttgaagagtattttgttccgttgcttctacctcagccgttaatcttatgtagaaagataaagccagagagaaacacaagctacaaagataagttgtgtgcgtacagcttaccaaagcaacaatacaaggagcaacaagaggaaagcacaagagaaatctgtggactctgaactttctgaacttttctgaagagatagtggactctgaacttccttgaaactgcttgatggcctgtaggcttatagttagcctgtggatcggtggatgttcagaaatacagaataatcagagaggtaactagcactagtataattcaactagggcatctcttaggcagtgcttatgtccaggaaattatatatcatggaacattaagagattattgctgcagagttttttttgtgccaaattggaaaaggagtagaatatgtaaacatatgcctgccagcgccaaagatgacttggaagcaagtcaatgaggcttactcatgcatagcttcaacaagttcaacaagagagatactccaaattcttgcattttggcacaatggccgttggctgctgggtatcagaaagcaatcccagtgtcatgtccaaactccaaattctccatcataaacctccaaatttccaaatctagtcaaaattctccggttgtactgccaaaccgacaacagtacaagcctgcattttctgtcatgctgatgtcgtaagactagtcatactgtacctgaagtctgcttctctgtcatcattctgcatcgtacgatccagtgacatgtatacgttgtttgtctgaatagtcatagagaaatcttgagataacggttatgcaactgtttattaattttggatgaagattcacaaacagaattcaataattgtatactccttatctttggttggtagtttttagtttgctttttcttcacggttggtgtcctcttttttatgtgtgaacctttttatttttgagtgttacgctgtaataattggctgtagctcgttgagcaaagccagaatattctattccattatctaaaaaaaagtcatcagagaaatgagttattatagcaagcttttcttttcttttagtatagtccctgtggaaattctgaacaagaactctgaatctctgacaatggtgatcttgaaccagaataattaaggtcagaagataagacaaatatggtattcaaggctttatctgtacattttggacatggctcttgactggctctacgagcttgaaaagtcggagccatatccagatatgccatttgtcgcagagctggagagtactttgttccgttgcttcgaattcacccgttaatcttctgtagatagatgaagccagagagagacagaagctacacaagttctgtaaagctaattaaaagccattgtgaggtatgagtgctgagtacccaatactcatacactgggaggaacaaccggacaagagctctttagtggtgatccagaaaaagtatatcaggatccaataatactaataataatataattatcatgtataagtttgtaattaatatattataggatagatagaaattgatatcttacccagtgtccggtacaataggataagttccggtacaataggataagtacatgaaggtatgcccctctctcagcacggttttattatcttgatgtaattaactgagtttaattaaagtttatatcatcttttaaaaacctagactatggctaaagaggaatctttggactctgaaatttctttgaactgcatgatggcctgtaggctgtaggatgtagtgagcctgtgaatattcagaaattcagaacaa

SEQ ID NO: 17298 - DNA, 460 bp, Oryza sativa
ccatcacctcgccgccaagccccttcgtctttcctacaacggcatagggacttccgttgttgagtcgacaagctccccctatccccactgagccgactatctcctccaccgctatgaaaccacatgtgtagcgccttcttccctaacctcaatgagctccaccattgagccgatgccgttgctcctaagcgctttccagcggttgcttcgtcgagggctctggcccaaaatgctccccttcgtgtagatatagctggtcatttccaaaccatatcatcgacgagtttgctggattttaaataatgtaggaggaatgaagtagattggatggaggggatgacgacaacaatggctatgacaagggaagagagggtcgattacgagctttgatggtgaacaaataatagcagagggctccagcaaccaaagggagagggctccagctacaatcgaggcatgc

SEQ ID NO: 17299 - DNA, 1110 bp, Oryza sativa
ttttcttcctggtagccaatcagtctgtaataatctctattccgtacttgtgcctaaacaattacaagtaaaatcaggaaaaaaaatacatgagctaaacacaaaaataattatgtgaataaaacatcattataattgttcaaaacacctaaatagaacacctcacttgttttttccattgctgctcatatataagcaagaatataaacaagctgcaaagatattgaggagtttagtggcatgaagacttacgtttaaagcatgcagatgctttggaactgtgtacatgcaaactctgtggaactcagctagaagataatccattgcatctggtacctgagcatttgtgttagtaaattattaaacttcattgaaagagcaaagccaggataggagtgtacagaaatattggaactagctatcgtcttagtggtcatgcagcaacgaattttgttttgagttccaaccatgataagaaaatcacaagattgtgcattatgtggttgcaaactaggctgcaaaaaagttgatcagtgtatgacaaaagatacacagtagccctatgttcatcggaatcaactggagtatctatcccagctactggcaaacagcatgtgagtttccatgctccataattattaaccttccactgtctattgccatgaaatttaatgtacacttaatatccacttcctctaaccatgacgaacagtgcaatagttcatcattgcatgccacttcatgtttaaatgaggtgtctaaagcagcttcaacttttaaacttaacatgaaacataacgaaaattagttactgtgggtttccattccacttattaaggatgagctgtcatgtaaggaagaaatagtcttttcctactataaactaattttaagtatcaatatacttccaccaatcaagaattcatgatcacaacatatgccttttgaaatatcagaagagagctataaagaaagaaaactgagtgcggtaaatgtccagaaagtgagcaccattcgatatgcacttattaaccaaaagtaatgcctagtaaaactaaaaaacacaaacatacctggctggtgactagaagcatgacatatccacaagca

SEQ ID NO: 17300 - DNA, 5553 bp, Oryza sativa
catgagaaggcgcaaaaattctagttagagttatgtgagcacacttaagttcatgttggcaacaacagaccagtactgcagaggtatacactacaatagagagactatgcaaagccaaaaagtgaagtggtaaatccatgtttctaaaaaaatgtaactgaagtttagatgattggtatgttaaatggtgacatgatgctattactttacatattctagacacattttttctattaaaaaaatgtgtctaaaaattgtaaggtcatcatgtaggcagttaacataccaattatctaaacacctatcaaacacagggcatcttgatggcttcaatgtttcagacttctcaacctatctgaccgcactaagtcagtctcatcaaagccaagctgtctggcgcctaacgtctatattacgcaagtatgcatcgtacttatattgaacatatggataaaaatattgcatggtcatgtcggtcaactcagactatttgacatttcacacatatttatgatgctactcggttgagaaaagaggccattaccacataaaagtaccttgtttgcaaatatacggcaagcaattggacgtgggcaatcctgtccatccaaagcttaataagctcaccagcccttgctctgcaacaaatgtttaggggtagatttcaaattaaataaatattcaaatcaaatactcactttaaaacccttcaaaaacaactatatgaccaaaaggcaattagttcttatcacgcgtcaaatgatggaaaaaggagaatagatgtagatcttttttatttaaatgtgcttatgtgcattgagctatacggatctaggcagataaaaatatgttttatatatatactcactttacactgtcagtagtcggcataagtttaccaatagattttgcaatttgtcggtcatatctgctgaactcctgcacaataaaaacaataatagtcaaatacaagcttaccacaattctcatccatatggcaaaagaactgaaaccagcagggtgaccatcattcatcatcaatgttaaaacaacaaatttgcagcaaattgtacaaatgcagttggaagaccttgctggaatgaatgttcgctggcacttgatcaagtaatgcacgcctccgcaattctgcttccagtgcagaatgatcagcaaagactttgatccctgttatgaatgagcaatcaacattaatatcacagtccttataaaatcaagctacgatagtcagccagtgaccagtgtagttaggaaattaacaccaaggctagaaattattcttgatacaaaaatggaatgtctgatgcagcgcatgaatgtgaaagcagaaccacagttttccctcgtgttatttatgtctgtatgcttttaagcgttgaaactgtgtatcccttcaagttttgcatggttcctggatcccactacaatggattttaattatatttcaaatattgctgttaggagtaggttgtctcagtaccacaacctttgtgctaattaaggaaacatggtaaagttctaggggctgaacatgggttttgcatagttgaagatcagttaggggtgattatccttctgacatgttataatacttttacatgatatatatggcccttcatgagcctaagcccacagtctaaataagtaaatatacaagaaaaatgagaaggttaatccttaaatttacgttttagattaatatccaccatttgatgttcataagcattaagctgtgataatggctgcctgacttagtatgaaaactagtttttaagaaatatgtatatagacacaacctgattctactaagcatatcaatcagcagatcttcagaatagctccataaaacattgcgatataaacttataatggttctgtaaaagcaagaaatacctggtaattcagatttaatttcactcttgtttgccctcattgttcctgcaacgttgttctgagaattttggctggatttggaaacctcagctgctgctttctgagcttctgctgcttcctttgcagcagcctcagctgctgctttctgtgcttccactgctaactttgcagctgccttctgtctggcctgcatcatagttcatgaaatttctggtaaactggttatgcatttaagcgactaccagtgaagtaaagaaaattaggtttctgaactacgtaggttgtaaagaagttcagtgaagaagtaacatgaataacaaggtattagatataactgaactagatggaactcaatggactaagtattatgataaataccagagccaaaagaaataacaatgaattaagtctcacatattgacatatatcaaaagaaatatatcagtttatgttaacaaaaacacaccaagtgaccagcacatctaggcaaacaaacctctgcttcttgtttggctctttcctgccttattttttcgtccttcatggcttgctcctttcttttagcttcttcaagagcagcatcatctcttattctacgttccacaatttgcgatttctgttcatgatccctttggaccatagacaaatgtttatcaagtacttctgcactgcaaaaaggcaacaattataacaaggtacagaatccaacaaaagatcatcagaaaatccaagtataacttataacgaaagatcatcagagtatatgtcctttatcctgtgagaactactacaaaggaaaacaaatacaaacgctaacatgcaaagtttctgaaaaaatatttacagtgctaatgattgaactggaacataaagttactacacaaagaagtacaaaaactatataattgtgtcacagatagttaattccttatataacacaaatagagcatttaaaaaatagtcaacccttagtctcagtcgctaatcatttgaccaaacaccacaggtataagtatggaatatttgtacgttaaacccacacgatttaatcagttgtgaatagaatatataaattgctgcaaaatgtaaagagctgaaaccttgggcttggaatttctcattgatcatttaagtagcaaatttaaccaaataacgatgaggataatagcaaatggtggaggaaacattaaggatcttagtattagtccacaatcacccaataaacctttatattggaatttgggcatataggagatgattgttttctcttcaaaactatgtgcactagaaataatccatgataaactgtgtagctactagcaaggtccgtcagccttcatgaatatataccttttccactcaggagtaataaactatattggaatgaaaaacttagcactttgtaagccctctttacaataaaataaattgagttatgacaaataaaaatggcataactttacaaagcaaccaccaataaaaattcagtcttgacaaactagtacaagaatatcttgatatgtgccacagaaaatcctccagtaacaaaagagaacaaactagtacagaagttaaccctagtcccagaaaattgcatcaccaaagaccttgtaaaacatacagtttcctcaaaatttgaaaaatcaacagtaatcatgaaatgtagatttaaaaagacacaggagaaacaattcaacaacaaaaacatacatttttctctggaagtggacatctagccttctgtctatctcttttcttgattctgcgtatttctgtagtcgagcaaatgcagaaactgttcgctggatttcactttggtggcatacctccaatgcagatagtttacttctgacttcctcctgaagaaaaaaaatcatatgaagaaaatgaacaaaaaggattcagcagatttaataaatccatcatggtaaaaaataaaggcatgcaacatcagccaaaaagataattagtactatgatacccaatacttagaaatttagtcatatgacatccctgttggctttctatgttaaacttcttggatcacaatatccaatttgaagtaaatgcagtattgtatttgaaaaatcttcttcaagtagcaactaacagaagtgatgtattgtttttcttgaaatttcatcatgtcattatccaaccatatcagtgtggcactacactaaccttaaagggaacaaacaaaagcttcattcaggaattcatatacagtataaccttagaaagatgaaagataatggaagcatccacatgcctggatagcttaaaatacctacataaaggtgaggaaaaagatataaagttgatccgtaaagtgtaacctaatgccatggtaaccctaaactagaatgaggattaatggtaatgaaaataattcaatggtctattgccaacacatcaaagaaaaatcagcccataagtactgcattcagtaagaaagatataacagtatagattgatgaatacacacttgaactttcagatgatgctcacgttccagctcaagcagaatgctcttctctaggctccgtttctccatcaggtgatatggtgcaatcctgccatccatttcatcctctgattcttcagcatcactaggaagaaaacaaaagaaggggatatctcacacaatacgccattcatttaaacttaattgcagataatgtaccgtacttcaaagcaaataaattgcaattgcagtggccaaatttcagcatcaaatcttcacctggattcaagatcattgcatgagaaccttgctccagtggccttggccacaagagcccgggactccccatcactgtcgtaatcgtcctcatccgtgtcatcttcctcttcaacccgcatcacaaaggccttctccctcacgctgccactgctagccctaaatgaaccaaaaaaaaatcatatagaagcaatgtagagggaaacgattgcagcttatcggcgaaaccataagcaaggagcgcaagggattggagaatagagataccactccggcggctgcttgaggggcgtgggctgcccggtgcggcaagtggcctcgagcgcgtcgagctcggtgaggacgtcgccgagggtccagctcgggcgggggtcgagggccctagggcaccgcagctccacgcgcgcgaagcccctgcgaggaggaggaggaagacgtagagatcagcctgcctgccattaacgaacaccaagcggtgacgagcggaaacggcgatggggggctcacatggcggccgtcgaccggcgaggtccgccccggagcggattggagccgcgccggcgcagcaaaaccccctaagttgcgggaggcggcggcggcggtggcggagaggcggtggacgctagttgggtctcccggctccagtcccacctccagccgctaatggagccgtgcagacaagacgcggtctcccttgctgccgcgcccggttggcttcctcgccgtcgccgctgcgccctgccctcccgtgccgcggtgccgctccgcctcagactggccgccgccgccggagcgcgaggccgggatgcgccgccgccggacgtagaggagagatgggccttgggccgaacactggttccggaggtttcgcttgcttattttggaagtacggttttctg

SEQ ID NO: 17301 - DNA, 1590 bp, Oryza sativa
tgggacccaattgtcagctccattcctcccttcttcaatttgtatgtgcttcaagccgcactatgacacgtcaaagtgcggcggtgtggcttgcggtgtgtacagattgaagaaggaggagtggggctgacaactaccccttcccctgtttttgtttattttcatccttaccacttacatgtgagacccatttatatttttaattcttttaatgactgagataccaccttaaccaagccaaattgctacatcagcaagaaccgctttcaaaaccaccgacggaatgaaaaactggtttttgaagttgggggaggtgttatatcctgttttgtggtttaaggatgtcatttgaccaacagcaagggatgagtgaggtgaaaatagacttattcctaaatgtatgatcggacttggatgtcccattaaagaaacatttcgggcctattcagattgtagccaaaataaaccttaccaattttttttcaatttggcaatattgccaaattttgatatgatatcttatgtatttatcagagtttggtaaaaattaaattgatgcacatatttaacaactttaccaaaaaaaatggtatgatttgaaatggcatcaatcttaacaacccattcatatgatcaattgatcatgttattacaagaagcaaaacaacttaaattttgtttaaaaacacataattatatattatcccaacaaataaaacgaaagaaaaattatttttcagagataacaaaactgaagagaaaaataataatgttacgtaacatggttaatcaacaagtctcggagatcgattagccactgcatccgaagttccgaacatccgtctcgcaaagtgcatgctcccagactgacagaagaaaaattattgtatgtttagttaacatcaaaattgaaagtttggttaaaattagaacgatgtgatggaaaagttgaaagtttgtgtgtaggaaagttttaatgtgattgaaaagttgaaagtttgaaatttttttttgcaacttatcacggcgtaaggcgcaagaagtatagttaaccaacaccagtaatatcgtacagtactactccaacatgtcaccaaacttctctcggcgcgcccggggtgaactccaatctacccgggatcctaactcgccaccaaacctcctcgtcgttcttcttttaccgcggccggacacggagcaggagcacgcacgcacgtacggcgcgcgctcgcctcactgcatttctatcccggccatcggtccggccgtcacgatgcgccgccgcgtcgctctgtgcctcgtgcttttcgccttcgccggcctgcacgcggcggcggtggaggccgtgacgctgtcgacgtcgtcgcggtggatcgtggacgacgaggccggcgggcggcgggtgaagctggcgtgcgtcaactggccgtcgcacctggagccggtggtgactgaggggctcgggatgcagcccgtggacgccatctccaagaaggtggcgtcgctcgggttcaactgcgtcaggctgacgtaccccatcgcgctggccaccaacgcgtcgctgtcgtctttcaccgtgcggcgctcgct

SEQ ID NO: 17302 - DNA, 863 bp, Oryza sativa
aaaacgactttctttagtagtacggagggagttttaattagttcttgatccgttcaatggttcagctcaaaaaagttaaagttgtacacaccagaggtcaccagctatattattactcgtatggtttaagagaacacacaccatattaagttttttttgcatgggttcgtgctggtcccacatgttcactgcaggaacgaccattgggagggtgttaattcgattagcgcgttaattaatttgggaacagtagccactagccacgcacgaacatgagatcgttgcacggtaggcattgccgcacacacgatcgacgacctaacaagcggctagacaagtcgaagaaagagctcgagatcacttttccggaaagtgttttcacatttaagggacactattcattttcttaaaaatacgcacaattgagtcatgaaatcctttttaaaaaagattaataatgttggtataatgactggctgtttgctgcatgcggctgcgctgcacagacgaacagaagaaatgctagttgggttcctgtagcagatggctgtggcgcaccgaacaagccctatagtaataaaacattccgactgagtttttacgttaataaaaaagatataggcataggttagtgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataagg

SEQ ID NO: 17303 - DNA, 6780 bp, Oryza sativa
  unsure (1)..(6780): unsure at all n locations
ctgcagcccagttctctcctcgactcggaatcagaccagtcgggagagaaccggctttcggccccgtttggattcccgaacgcggctgaaagctacttcaagcccctttcaaccgagtcggcttcaaaccactcggccgagatcgcatcttctacaacgacaccagatcaagatgatggggcttacccaccggtcctgatgaagctccccgacgatttagcggccgtcttcaccatgacagcgtcttcatcccgtaggcctaggcggaagtcggcttcaacaccgctttcgcctagcttcagggaagtcggcgtcatcctccaaccactcggcacggtttcgacggatcagctggatgactacaacagctctcccaccgtcgactcacgtcctactgacatcgtggagtacgacgaattcagttctcgctacgacgacttcgacgacttcgacggaagcctagatgacaattacacccctctctactttggcgttttcatggccaataatgagacggaggagcaacgccaagcccgggagactgaagaacgtcgccgactggaggaggagcatcaagtacaagaacaagaacggctacggcgtgagcagcaggaccgtgagcggatcgccaaggaggctgaagatcgacgtcagcgagctttggaagcagggcgccgagcgcgtgatctcatcggccaacaagatgtcgaagggacaccggttttccgcacccctcaacagaatgcggttgccgcgatcacccttctcgacaccctcctcaaccaaaacgagctcaatcgttccgaccacgtcgtcaacatcttgaaccagacgaagaccatgatcgcagcatcggtcccagttaactccgaaagcgtccacacgccgactggcagccgggtcccccacttccgatctcatgactaccgtcatccaagccccagcatcactggagcaggatccaatcgcaggagcaggggccacgacgagcggtctgttcactcgccctcccgaacttcatagggagcgccgagtggacgggcctcgctcaccactcggtcgccgccccatcgatcttcgcgacacaatcatacagcgccgagcagctcgaggctaccatcactcgccggatcggcacaagttatctcctctatgggaagggccatttattatctctgaagttacccgaccaggttcatatcgactcaagcgcgaagacggcactctcgtcgacaactcttggaacattgaacatcttcgtcgtttctacgcttaactttatcattgtatctccctattttgactgtcaacatcaagttttcttcttgccgttgtcagtcgggggctattatcacaataatggagtgtgattttttatcaattcagtttgcttacttggtttatcattgccttgtttggtttttctacttagtttgagaggactgaaagtttttaatagcttctttgggttttaggctcaacaaagcttagcaaaaacttttaagaaatcaaaaactttgcaagaatcatcaagcacagcataaatacaccagtattgtacaaattgagcctccatgtattacatccaaactcagtcagagtcagtcctttcatcatcagagtcatcattactcggctggaggtcgttgttgcgaaattgctccacaacatcactcgctattttgtcagccgcagtttgcgcactactgataagatcaagggcagcttcttcacttgtcccgtctgcaaatccatcaatggtgtcgacttcaattctcgggtacaaggattttgtcatcgccaaggccatgccagctcccatacttccagctttcttgatattcttgaaatacacttccggagcaacactcagcttgtcaaatatttcggttgcgtcgagtgcactcggaccaccattattgaggaacatggcttagatgattggagcagcagcattggcgacatcatctcttgctccttctagcctcttgatcttaccaaccaggacgtcgaattgagcttgagacttgatcttgcggtctacaaaacatatttatggtgagaatctgctgcattaaaaagagacaagttcaggccaatagctggcagtaccttcaacttccttcaaggccgagtccctctgcgcagccagttctacattgtctctctccagggcttcaacttgctttttcatttgttccattctggcggcttgcgctgtttgagatccagatggttgaggatacagttatgttggcctaaatcaatggaacagatctggatgattaccttttgatgaaccacttagttcgaagtttgcatcctggagctgagcgattcgatcccttaactccttctccgtcttcttggcgtgctccttggcctcatgtagctggtccctaaccgcttcaagagttcccaaatgaggaaccagcttttccaaagttgtggtcttggcttcattgcgaagatggattctctgcatgatggatcatagttcagttctgctaaaaagaaaaacaaagttaccgaaggctgtcgctcggaagacttacatttacaatacgagtggcctctccaagcgctttcttcagctggcacacttcttcatcttctttttgacggtttatgactataccggcggcttgtgagttctcgtcccaccatttgatcaagataggaggacgagagtcgtcggtcgcctttatgcgagggatttcttctccgtcatcacctgatggtcctgatgtgtttccaggacattagacggatacactgaggttatttaaatcaccgttgtatgagaagacaactaacctgaagatgtacctagctgagcgtgaggtgatctttgttctttgcctggagatccagttatcgagtcattaccagcttctggcccttgggaagctgtcgtctgcgcttctacttcagggatttcttgatcagggcttgcgtccaactggtttccagtcgggggctcttgagttgttgctgcttcagttgttgccgactggtttccagtcggcggctggtcactcggattggcctggtcacccgaagcatgggcgccggtcggctggcttttggcagtcggctggctttcggcagttggctcggggtctttggatatattttgctctgccatggctggatcggggtcttttccagatggatctatatcagatggtttcctgcaaagtattctttcagaatttagcatcattttcatgagagagcttaccaaagtgaaatcataccgagaggtcttatacctggaagatgttctaatttttagcattgcgcggccggccagttttttcctgggcatggtgcgctttgggggtttattaggcgagcccttatccccagatttatcatcgtcgccttcatcgtcatcaagcaccagtttcctcttgcgaggacccgtctgaccagttgatttggaggtctgaggttgcggatctggtctgatcgttggccctccacctccctgagcagtgtgttggcgaggagaccggcgctgagtgactggtggatctgatttcatcagtgcatattcctgaacaagatgcttccatagttagtcaattcagcatgaagacaaaattatgttctgatcatggtttgaagatttccgatacatacctgcggaggcggattgaatgcattatatggcacgactggcagctggtgtgagtagctgacgacgattgcatttgagaagattttatacatcctctccttcatgattctgaaatccagagagtctgattcttcacggttaggatcatacttgccgtcgaactcgaatgccgtgcgagatctttccttgattggcgctagtcggcatttgatgaaatgccgagtgatctgttctccctgtaagccttgttctttaagatttaacatacgatccaacaactccaaggcttgtactgcttcatctccgattggaagagagttccaagtatcttgatacactggaggaagacaagagtacccgggaagagcaggttcaggattctgaacatagaaccagtttgcatgccatcctttgttcgaagtcttgaagggcattgagaaatatttttggctcagagttccccttagttggaatcctgcccccccgactacacacggtttgttcttgtttggttggggcttgaggaagaagattcggcggaatagggcaaagtgaggtttgatccccaaaaaggcttcacaagcatggacgaaattggcgatatgcactatggaattcgggtttaggtgatgcaagctgattccatagaaattcaagatcccgcggaaaaattttgaggtcggaagagcaaagccgccgtagaagaaatgcgagaagaccacaatctcatgagtatccggagacgggaaagcctcaccgtgcgctggtcgccacccgatgatctccttggcagggagaacgccgtgcgccaccatctccttaagattctcctccgttacatcggatgacgcccattggccttcgaagctttctctctcttccgccatcggtttcactcaaatgtgctgatttgattcgagggatggcttgggagaggtgagggattgaggcggtggatcacgggaaggattttaatgcacttttcggaggtggatttggccggagtcgtgaaccctagttcgccggcgcagctttgcactgtagcagggaatggggaaaatggcggggaagacgaagcgtcgcttggatataggatttttcagttaagggtatcggaggtgctaatgggcctaggcctgaacagtacttcagcccaatacttttaacagcgtggcccattgtgttccttagggacttaggcatattttgctttggcaatattatgcgcacaacagtgttgcccaatgctgatgaaatcctttttatgcggtcatataattctttggaattattgcaatgcaaattaaaaaggtgcccgacagaaaggcgttatgctgtttttgcaagcttttttaggctacaaaagctgtttgggttaactagggatgacttgtttttattatagtcatttccttggcgtgttatatgcctgttttcatggtaaatagtcatggcctaggctatttgacttatttattaccataatctttatgatacttgatgggtaatctttagagtttgtatattcggatgcctgtcaagtgtgttcattcgtgaactttttagaatgtaaaccactcggatttcttttattgtggctaaaaagcagtcggctagcatgcctatttaggcgccgcgtatgcttttgtcatataatgcacaattgtgttattattttgtctttcaactatatgtttagtttgttaactaatcacatagttgggggctacacctaattaggtgcatctattcgatgcaccatattcttcatcttttcgccctttacagtccactcggcaggttttggcttgaagagtttgaagtactcgggttatcaactttgagaaggctacgatggtcgactgcaaaggactcgggggctactgtggagattatgggtatcccatatctacacggcgacggtattcgaactgggtaccggatacttaatgtagatagaatatcttatctgtatctcgggtttgtttcttaacttgtgtatcaaggaaacaccctgagacttagtcggttacgactgtattttacctctatcttcatattccgttaggaatatagattatcttttgtaatccggactccttcccatatataaggggggtccgggcgcctctaggggcatatgctgatttttcccgaatcatacaattaataatacactcggcggattcatccccggacaggagtagggtattacttcttttataagaaggcctgaacctgtataaatcctttgtctccaaacccatacactttccgagcttgatagccacccccttttattattgccgaaatctagtttcgacagttaggtacttaattaggtgggttgtattactatgaatgttgatcgaattaagaatccatgtataccatgctcgatctcttttaattacagttgttctgaaatttaataattttgaaattcagaatcaacaaatgtgagatgtactcttagtttattaatactcatgaattcaattctaaaaatctacaataaataattagcacgatgtaattgacatggacgtactcttctattaatctaagctcttatatttcagaaaaataataatcgatgtgttcatcatgattaacattttaatatttgtaacatcaataacaatagtttgtgtaagacatgattggtgactagcacatacatataatatcctagtagaacatttgaagtctaagtttgaccaacacatcaaagaaaatccaaactgcaaacagtatgtgcactgtgttaattaccaccgtatttaattaatttttcttctcactttatatacatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17304 - DNA, 1201 bp, Oryza sativa
aaagttttaaaaattttattctaaatgtcagatatttatgatcgaatgcagcacattttcgtagctaaaaacaagtattttcagttataacagcattctgttatgcaaacttcattaacttgaaaagtacctaaaaatgttgtcttttctccatccattgagcaggtatgatatccatcactaggacatgaaggtttcctcttttcttttcttcttttttcttttttacaggaaccaggacaagaaggttaactccaacgactacaagttcgtctctctgcagttgtctgagcagccttttcccgttttctctaatccattctgagtttctgacggctagcatctcttgtgtttctgtgtatgatgtgagcttgctttgcaggggatctcattcccttcctcttgcaactctgaaagggccaacgaaattctaaactaagcctctgacctgcttgggcatattccagataattagaatcgaacagtgtacatttctctcttgtaaaactcatattgttcgagaaaaattggctgcacatttactggaggattatcccaagcatcggtagtatttatttgattccgtggacggcaaagtcaggtcctccattaaaaaagatcaaaaaggcagaaatttccgtggactttctgctgaaggatgaaaaaaaaggcacctttgtaggaaaaaaaagaggagagatctcttgtgaaaaaaatgaagcaagaaaaggagaaagggacagaggagagcctctgaacgaagaagtgaactcgttggtgagccgaggagtgagatggtcgcccacagaatttccacgtgtctcacggtcagccgttgctgccgctgtcaccggaaagctacggattttctggcccccggcgccggcggccgtgctgatgcgatgcgtgcatgtctgtcaggcaaataggcaatcggccatgggcactgggaaaaatgttgagggcccatttgatttgtaaagaaaacatagaaattctagattattttaattctatagaaaaaaaatcctatgaacaccttagaaacaaatgattgaatcccatcacattctttaaaattcatgaacaattctatatagatgttagaaaaaaaaacttaacagtagcagtagcactgctcatgaagaatctacaggctattttcgttttcgttcagcatcatcccacgcgcaccaccccg

SEQ ID NO: 17305 - DNA, 10999 bp, Oryza sativa
ctacccgagcctcggctccggtggcggtggcggtggcttccgcgactcgcctacctcgaccgactccgaccgatggtcccgtgccgctcctctgcctccgcacaatggcgagcgtgagcggccacgcctagtgcttgatccgcccaagcgggatgcctcggctacccctacgccgcctcctgccgaggcggcacgcagccggccaagcccatttggcgccgcgaggccccgcgaggacattcttgctgaaaaagggctggactggaggaagatggagacagagattgatcataagactagccgcccaaccagctcacagtctagtaggccaggaagtgcgcattcgtctcttcctgggagccctggatcacagacatcagctgtgggtagtgaaggtgtgccgagggctcggccgaaggttaatccttttggggatgcgaagccaagagaggtagttcttcaggagaaaggcaaggattggagaaagattgatcttgagttggagcatcgtcgaattgataggtatgccataaatggatttgcctctttataacaaagtttaccttttatagtatgcacaactgtgcaattagcatttgtctttgaatgcaatactgatcaaaacaattgaatctttgggcctgtgaccttaacaattatagagtgtgtttagccatgacctttggctgctttatgcttgtgagttgtggtggtgcttaagtgaaatagctttttgcagaagcatttcggcagcaccttgcaatagttcaagtcagccagacattagttctaattcagctatgcactcttaagtagtttctatgcttctttaagcaaattaattttgcacagtgtttacgaaataagcgtggcattttttttttgtgcttgctggttatttcaatggttatataacaatgagcagttgtatgaattgaacggatataccttttttctttttttgctttgctttgagagattatgagaactgcatttacagcaataactagttatggtcttatggatagtaactataatgggaaacttgtattttttttcattaccttttccatttaaatgtcttcttattagtccatatactcccattgtaagaacctgggaggaaaaacttttattcctaatgaaaactggttgggacctgtgcatgcatttcctatttatatattaaccttttaaaggacatggtcaaattacaaaaaccataaagattccaagtatatgtaaatattaatattcaactgttagttatgccatctttttatattgcatatacaataccacactgtgctatttcgtcacatttggttgattaattggaatgcacgtaacaaactttaactcaatagtttatggaaatttcacttttagtagtttttttttggtgcgtgaatgtatagggtttgttcaacagtattctgttcaattattatggtaatctatactctattactaccatcgtgcattttactttaaaaatatagattcaatgatttatagttattgatgaagatgacaattgcttctggctttctgcaacgttttcctttcttactactttcacactatagcaaattgctcttgcttgcgtaactctgcgttttgaaatgtgtagtggtgttagtttattgaattacctcattggtcacccacttgctcatgcttgacactttgaatggttatggttgttacttgtcagaagcctgacagtttttaacctgtttgtgtcatgcatcaacaatcttgagtgaaatctctgtacaatggaaaagctatcgaccgtcaatagatatgttaaataaaataaatttcatctatgttcttgtgtatgttaattcctccagcattatctctaccttgttgtgtttttcacgaattttcaaatttactttcgaaatgttccagatctgtgtgaccaataattgttacctgccaggtgctgagattactgtggaactgaaattgtaatttctgaaccacccaagccctgatttgtaacaatacttgaactgtctttggtcctaatatgctatcatgtaggataatttatcacctctaccagatatatgtaactactaggaaagactagcaagatcatcggtaaactttttgaaccagcttttctttttgtggaaatttgtagcatgataatagaatattctggtggttcctggttatcaaatactttgactgttcatgcatgtttgcctttctttttaaccaatgccaatattctggtcgttgaagcatgcatgttcctatagtttgtcgtttcaactttcatatggtttgggcctttggggaatgattttcttcctgtctttatgctcagttcctggttcctacagtcaattgctttagcccttgccttgtggtttggacctatttacgtccctcgttccaataaccaatcaataattgctggtcatgcccaattgcaaaattaatcaattttacatttcaatagttatattgtgtagttttgatgttttaaaaatcgctggtcctactgaaatttactcgtgtaattttattgttttaaacatttgttcatggacttgaatgttgcagaccggagacaaacgaagagaaggatttgaaagaacagattaacctgcttagggtggatttgaaagaaactgaagcaaacataagtgacgaggataaaaaaggtttatcagaaaagttatcccagatggaaagggaactggagcgtcttacagttgagttggacaacaaggttcgatttgggcaaagacctggttctggatctggcaaggttactgcacatttaagtaattcaccagacgaatcacagattacagagtcaatggaacaaccacgttcccgtagcagcatagaccaaaatcctaaaccagcagaagaaaggtgggggtttcagggcaacagggacagaggctcatttggtggtaacagaaatacagacaggtttgtttgttcctactgtccatgatgcttattagcataaatccaactgaacgcgattaacattgatcacagtaactttgtcctgtattactagacatatctgtcaagtttagatcatttattaattttcagcagatggtagatgtgaactctttgtctacctgcttttcaggtcgttaacagggcagagatggtgaactcttctgccatccatggttttggccttttgagcacttctatcctcggacagatctttttttttcttcttttcctattttaaacaatgaacaaataagttgtcgcgttcttgttgctgcttgactcccattttgtttgccttggaagagtggaggggataatggaatacctcgcaggctcgctcaagggcccaagctattgtcacctccatggtgatgcttctgtttccttttatttttcctcttaattcccctttgcccctctcttccatgtcaaaacagtttgttaccaaactttaatacactaactattgttcttgctatttgcacaattatgtttcaacctccacatttaggcattgctgctatccattgttacatggaattctttattaggccagtgttcacatctgcctgtgcttgtgatttgttctgctgtttgtgtgtgccgtatgaacatataaaaaatatcgggttaaaatttccgttgcggttgtcattgttattttgccttctcatactacgtgtgaagctgaataatttagtgggaggttagctcattgctgtccctattaagtacccagaaaaactataatgtttagtcctcttggcctttcactacgctggaaggagtacaaattacaaacattaggaagcgtacacctgtttacaaagttgactatgagatggcaaatatatgttaggcaattagttagcttcctatcatgtttgctgcaaagttgtaaactgaacactccaacgagataattcccctggtaattggaagctctctggcaagaatgcatttgatttgatgctatgtttgggagtgggaccaattcatcaatttttgtttttcattttggatttgaatgcaaagataactttagaagctttcttgttccttttggcatccgctgctcacctgaccaagtgcacacaatgtacatgctgcccaatatactgtacatcaccataccagaaaaaagacaaactttgagttacagcaaccaatttattttcatattcgttgcacgtgaccaaacaaaaataagaaacaaaaggtacatataatttttataaaaaaggtaaaaacaaacacaaaattatatccgaggagaacatcactgtatacatttataacagcaagctaaagtacgcatttccttttttttttccgataacggaattcagtccactgaagctgcgaacttgcgtttgcagcaagacgatctacttgtccttcttgcgcttctcgacgacgaagaagaaggcgagcgcggcgatggagaaggtggagaagacgccggcggcgaccttgagggaggcgtggatgccggtgatcccggcgacgtcgaaggcggcgtccggcgagctctgcccgtaggccacctccgtgccggacgcgtccaccgcgtaggcgcgcacgaagtaggacgccgtcgggatgtcgcgcgccaccacgtagtcgaacctgccggcgccggcggcgtacggctgcacggtgaccttgaactggcacgccttgtccttgtgcaggtcgtcggaggccttgcgccacccgcggtccgtccggctcgccggcgcgtagcacagcttcaccttcacgctcttgaacgccgcgtcggcgcccgccggctccgacgtgttcagcgaccacgtcaccgtcaccgtgttctcgccggcgtgcacgactgctcaccaccggaataattttcccttgattagtgattagtaatagtagtactcttttcgtttcaggatataaaacgttttaactttgatcaaagttaaaagtttgacttagtttatagaaaaaattagtaaaatttttaacccaagacaaatttattataaaaatatattcaattattgatttgatgaaactaatttagtattaaaaatattactatatttatctataaacttagttaaacatatatttgtctataaatttagttaaacttgaaacagtttaactatgacggaagtcaaaacgtcttataacatgaaacggagagagtagtagccaaagtacatgtgacacttttaatctgattattttaacagccaaattcaacgaagcctaacgtgcacttatcatgattttttttaaaaaagaaaaagataaacgaaagtgagctaacaaaaaaaaaagattttgtagtacggccatgagaaaatgaagtgaacttgaaatgagaaaaaaaaatcttattattattattctttaaaataaaagaatagcataggccggcctggctatcactaggataggagtttcttagggacatattcttctcccttgctgttcatcccttttcggatgcatcgatcacaggcgacaaatcagacaaatcatcattcggagtttcagttgcgcaaatgggtatcggaacatattcttaaggctgattttacatcaaactttaggcgaaaaatactttttttttataatcgctagctaggtagccatgaagagcattttcggttcataatgctgcatgctaatcaagagcaatcttgggtggttcaaacacggtttcaaaatgcaacagtaaactgcctggttgtcggtcttgtcgagctggttcgaatttagaaaccgctggataaaccggccaagttcaaaaaaaaaatcaaaccaaataacttttggcaaaatgttaactgctcgatcagtaactgaatggtcaaacggtttttgtaagaaagaagcaagaaggtcatcatcatcagctactagttgttatataccttcaccgtgcttgggcgagacgccgacgacgagcgctttgggcagcttggagaggaacacctgcgtcttcgccgcggcggcggccgccggccggggcacgccggcgccgagcaagacgagcaccaacgagagagcagcaacgccggctagcctcgccattgctgacaaaccaaaccgactgattctggatatcaacccaaggacggagacggagacgaagaccaagaaatgaatctgctgctgctgctgatgctgagatcgatcgatcgatcgatcggtgaatttataggcgggagagcgaggctacgagctcggagagttgaccagctacttcgttggattcaagaggcaacttaattgttgtaatgatcaagttgattaagtttagtggggtcggggatatccaaagtcagaggctttgacgacgtgtgagaagagaagagaagagagagatcatgcggttttgggggtaattaagcttttggaggggtcccaagggttcaggcaaccggtgagaagcggcaaccgcgaatgatcttgagtgcctcggttgttgttaattaaattgtgagcatgacgttcatggtaggttcatttggcattaagataataacattggagttattaacgttgagaaggcgttcttaatggaggaaaatttgatgatataccagtgttttggcaaaaaaaaataaatttagatgttttcatatggaaaaaaactcaaaaagagtccatttcactcatccaaactattttaggttcattgagcattaagatatcacattggaattattaatattgagaaggcgttcttaatggatgaaaatttgatgatatactagtgttttggcaaaaaataaatttagatgtttttcatatgaaaaaaaaatcatttcgctcctccaaactattttgccacagcatttaacctcctaacaattcctcagcttagtttacaccctgaactattgaaaacagttcaacttactctctaataatattcctcaagtactgctgtactcctacttccgaagagatgacatgcatgagcgcaagagcaggacagccatccgtcgatcgaactcgaacacgaccaagtctgcactgtgttgatcatatcagctcagctcagctagctggtggccagctccgtctcttgattgcctagtgctgcaattatatcgacccagttctagctagctttgctcaagttgtccaagcagatcgatgctttgaaacaacagcctgccgaaaataggcaatcgattcttacttaccacgatgagagtaattatcctatgaaatggcatatgatcattgaaacttggtagcagtttcgccacgacacaccgcaaaaatcctttttttaaaagtactacctttaatttaaaatatctgacgatgttgattttgaacataacagctgaaagtttattttattttaaatttatcattaaatatactttaagtataataaattttaaagtttcactaaattttgacaaatgatcaaacgcatataactatataagttaacggtacgtacatttaaaatgagtacagtacaatggacatcggctcacacaacacaaccacacccatatcatcacaaacagctctatttttttccttctaacttttacatgatactcactctgtttcacaatataagtcattctagcatttcccatattcatatcgatgctaacgaatctaaacatatatatcaatctagattcaaacatcaatatgaatgtgaaaaatattagaatgacttacattgtgaaacggaggaagtactttcggcagaggactaggagtgaggtaggagtgaggtgggagaggtggggaatcgtgtgagatgccctagtgccctaggacacatttcctctcatatctgatatgttggtctagttgattaaagccaatgtttaaccccagctagttggtaacgataatgtattgagatccaatgcagttgtcactatgactgcacaatagcaactgcacacaatttgagcccacacaatttgagcccttcttgatccaatggtccaaatctattgatacagtaaaaatcaaaattttactatttgtcagagcaaatcgctgcagtatttagatgcgtctggaattctgaatcatgtgttttaaatctggtggtgctcgtgtgactgcttaacttgtggccacactagccactgcacctcaagcggatcaacggctattcatcttaaaataagtttatttttcacctattccacacatagtaattcaaaactaaaaagactataatactcatactttatcaaatctcaatacaactatttccactttatctactctcaatacaattatttcgtacttccacaaatttcaatgcaatgattattctacaaatgaacttattttgatacaaataaaatgagctaaaaatgaacttactaggagacgtaggaagtatgctattagttcttataaaacaattaatttatgatataccagttagacatgagccctagctatatttctatttaaataatagaggggaaaatgttattaataggaaaacgagtaaatttcggaaaagcacaactattttcgttaaaactactagtttgcgacaacttcacctggttttcttacaaagtggaatggaacaatagttgatgattttctgcaactttttttttgtcttattggttttggcctatatgtcagacatacatataaatatataatacttatactgttgcaagttgggtccacatgtcagacactcataccagttaaagttgtggggttttggtaaaattgttcacaatcgttgtagttttgttagatgtcctgctatagttacagctaactgataagctaactgataatttgcagttttacgaaatccactctaggaaatactactccctccgtttcaaaatgtttgacaccgttgacttttcagtacgtgtttgatcattcgtcttattcaaaaaatttaagtaattatttattctttttatatcatttgattcattgttaaatatactttcatgtacacatatagttttacatattttacaattttttttaataagacgaacggttaaacatgtgttaaaaagtcaacggtgagtattagggtatgcagagtccaggagcaaacggtcaaatttctcatttttagaacgcccagcagatggggtcaaatttatcatcaaggagtactactcaattgttgcaaaacccagtgtcatatatatgatcatcctcggtgtatctggtaatgttgcttgatggcatgatagcaacagcatgccggcattgacatggtaaaaacaaaaataactaataattaaaagaggacacacacttcatgtggggtcatgtggctcttaacaccggttaagagttacaagaaacatcattttgtttgacttgcctctatcgattagtgtgaaaatacagagaagacgtttggcttatcaactggcgtttagatgtcatgagactatgagagtgataggaggagagtggcaggtcaggaagaatgatcgacaccgggacagatcatacttaattatataatgtcgacatgattgttgagggaatgatacgtttttaggccttgtttggggcaaattcttgtgctggctgtcattgactaggagttgtgttcttcgccctggaatttaatctttcttgggtattgcttccttatcatttgatcacctatcttattaaaaattacaattatcatttactccctccgtctcaaaatataagcatttttagtatagtgacaagtcaaacatttttaacttttaccattaatagcaaaaaaataaaaaagattaatcatgtaaaattgatgttactagatttatcattaaacaaactatcataatatcataatatgtaactctttttatttaaaacatcttacttttatagatattgttagtcaaagtagcatattagagaccgtgttagggtctaaaaatgctatattttaggaactaccatttgtaaagaactaccattaatttccttgaaacttgatagcaatgatccaggcctgtttgggaacaataaatttgaccaaattgtatacgaaagaaagagattcctacggaaattctacctcccaaacgagatgaaacctagtaacctacaggctacagccataaattcaaaacatggaaagcttgatttttcccccatacatgtacaatgggcttacattacggagccgcaacaactcacagccggaggtgctcgaaaagcttggacgtcacaagagcagtttgctcatagaccgatattcgttagcgagattgcagttcttgaagcagagggccaatcctttgagcgccaagaaataatgcgtcgacaagcacgagtgctccaacctgttgttccaggaaggaacatataaaagcatttccattggagaaaagaattgatgtgtgcctctcttgaattcagagaattaccaaacggcctgtgaagatcagacggtagcccagcccttctttcacagcctgcgctcgttgctgatccgtccagctgaaatgaagtcgttgtcagtacacaaagcttaaagatttgtaatcagatggagtgctctggagtatggaggagcgatagtgcatgcttctgtggaagtctgaaacatatttctaataagaaaatcccattataatgctcatctgcctgtgtagacacaatctgaagttttaagttgttggcgagttctagcttgcctatctcattatcacattattctgttcttgtactcaaacaactgctttgattttaatacatgacttgtgtatgtagattggacagataataatagggataataaaccactaggaggggagaatagctggggtcttgaaacctacccgaaaaattccgaaaccccaccaataccagcaagcttgaaaggctggggaccttctcgctcaaagtcctgaaggggtaaaattataaaccataattcagtaaaaagaagtactccctccatcccctaatataagggattttgacattttgcttgcactgtttgacc

SEQ ID NO: 17306 - DNA, 1738 bp, Oryza sativa
tcccttatattaggggacgaagggagtagcatatatgaaataattatttcttttcccaattcctacctcctcttcagctgcttccagtcctccttgtacccagaataaattttggaaaccagcaccatagagttgctcacaagcggccaatgatctgaccgaattacgggcaaaagtgaacacaactaataaaattacacatccatgaagggcaacacaagaatgcattactgaattgactttctcaaaaggtaaacaacgcgataaagtattgatatgcaattatgcatatcaaattcagcattgataagatagtgaattacctcagtcccttctggcaaactactatgatatctgtatctttagaaaacttctcctcaacttgttgtacaaagttcctagcaatttgatctacgatcagtcaatcttactgttctgaaaatagcagatgaaagttctaaattcagtagatgttgagcgtacttgttaactgtcattgttgagctgccactccaccagccacctagggaagtcatgggagttcgatcatttggatgtcccgaattgtaggaggggtgatgtaagagttgaaaaataaattcacaggctcacagaggatagaacactaacataaaacagaaagctacacatgccttggttcaagtaattgtgtttcatgaactactactgtggttagtatgatggtaatctaaaagacgtatgtaaactggtcaaacagcccagagaaaatcatcattgcattatccattctagagtgtacacatggaaaacattccatgttacaatctcctgtgcttagtttaatgatgaacaatgagaacaaggtttgtaaagaaagcattcaagaacaagagattgacagtcaggtttgcatatggtgaccctgtttagcatacccatcacatagttggtgaatttcttgccggcgccacccaaatcaaacgatgtatccacatcaaatacaggaatccaggtagagcctttcacccaggcctaaaatgcgccaattcaaatacaatcaaggacaacgaataacagtcccatttcgcaataatctaacacccctttactttaagagtcttgacaggcagcgagacacaaccttttgacgctcaatcgaggggcctaacatcaaggaggacctagtcagtgagcttgaatgtatagccagcttccctgggtgtaagagtacttgatcttgtgctccataatcttcaggcagagcatcattcccacacacacatgaacagcagaagatcagcatttcaatagccatagatcacgcaagatgatactgaattgaaaccccaatgtgggggaaatcgtaagaagaatttgcaggcagggagggttagggtaaggtgaagggacacaccagagtctcccatcgcctccgggcggcggccatctccttggccagcttcacctcctcgtcctcgccctcctgctcccctcccacggccgctcccatcctcaccactccactccacctctgcacccaagaaaccactcacacagttgcagtcaccgctcagtggaaatgagagcaaaggagaaggggaggaaagccaagaaaggaaaatggccgcacctttgaaggaaggagacgagggcggaggcgcctggagcggcaggaagaggaccacgccgcggccggggtggcggcgccggcgccggatacgcggcgcgcgaggccgagaggtgacggtggcggggc

SEQ ID NO: 17307 - DNA, 1675 bp, Oryza sativa
aaggtcagccaaaggggcctcgttggcgctattgacgtcttcatactaatcgatggggtcgggcaatgacgcattggtgcagaggaggcatggttgagctgatgtcatgtgatgccatggagggaagagaaaaagaacaggagggttatggtttggagggatttacacgaatcttaaagcaacccgatgatctaaaatctacaagattgtaggggctcccaaaatttaactccaattaatcttggattagggccgaaacaattgatgatacttgttcatgctgatgttgctgaaacaatgtttctttgtagaaatgaatttacatcttatgttgcttgcttcatagagtagtgcgaaagagatgcgcacgatctcgcttcaatctgatcgcattgttgtccttggaaacaagacaacgctactagaacagggaaccaactcatttacctggcgaagtatgcaaggcgacaattaatggaggggatacactgaccaggattgggcatgcagaaatatgtgttcagagcacttcgggagatgctagcctttatggccatccagttcccaggctcccagctttgcgattggatcaggggagtgcaaatgcagtcatgtcgggccctggggtagagaggagcctgaagaacttgcatcactggctcactggctcactgcatcacaacacaatacaacgaccgcgaacatagttacacaatccacaagtactcagcaaatatgcaaaagccggatatggtgtaacactattgccttacgccagtaatctacgaagacttcattgttcccacaagagagattactagtttggcaacaagcgaacaacagattatataagacagcacatgtccagagtaacatttacttcgaataaattacaggctcgccctcaatacaggcgtacaacaaattgcatcgcatctaatctatagtattcgtacatggcatttatacattaatattggtggcttaaaaagggagaccttgggggcgcaatccaagacatttcttcagggcgattctggccttctctgccatcatataaccgtgcaggttgctccatttggacagtatgaaatgtcttgctgcacacatagagcattatctggcaacagccattgctaaccgcggtgacaaacttggccagtgtgcagtgccacatcgccatgctgatctggtgtctgatcctcacgtgaacaactctttagatagaagctgttgcgcaaggtactggccttctggttcctcaaggtaaaccttgtcagtcagataattctgtagattacttgcagcctcagcctgaattcgtgagccttgttccttcaaagcgggtaagaagcaccgcaatattacatctagaagtttcatgaactgtgatccgtatttcttgtgaagtgcaaaaccagcaacctgaacagaaacagaatccaagttggctacaacaaacctgctacaagcacacacgcataggagggatgggggtcttgaagcatatttttaccttgaggaaagcatgaagggcacaagcagttgctgtggtggccgggagagtattaaggaacatggcaagccatttccacccctcagctaagccatgtggatgccgcacgcccctaatttcggtctgtagaaaaaaattgcgggtgtatttcaattctaa

SEQ ID NO: 17308 - DNA, 987 bp, Oryza sativa
gctcaaattgcatacacctaattccaataggcaattaagcaacctcattataaatggcacataaagaacaatcacttggacgcaccaatttgttaaccaacagataattaatattagttccccaaagaaaaagaagataatgaaattgatatatatgtaagcatcagaactagcatcaagataggtttgtcaagcaagcaaaccacatcacagatgatgctaggctgatagcttatataatctgaagcaagaaatgtactacatccgtacatgtgtaactctacaattccatgtggcatcaagctcaatagatgaacaattgaacacatgacagtagatggcactgcatagccaaattagttgcaaacagatgtatctttgtcgtgaatatcacaaagtatgcaaattcacttgaagagaaaagtgccatactacaatttcacatgagcaacccctaaaactcaacgcgtaataacaactacagagcatttcgcaaagagtaaacaaggaaaattctcacggtggatatgctccatccagtttacttcaagatcgtattgatgacgccggcaccgacggtctttccaccctcacggatggcaaacctcattccctgctcacaagcgacgggctggatgagctccacaaccatcttgacacggtcaccaggcatgcacatcttcgcctcctcgtccttgtcgttcataatctttgtgacattccccgtcacatcggtagtccgcatgtagaactgagggcggtaaccagggaaaaacggtgagtgccgtccaccctcgtccttcttcaggacatacacaaccgcatcaaacttggtgtgtggcgtgatggaagcaggcttcgcaagcaccatgcctctctcgatatcatccttctgcatacctcggagaagcaggccgacattgtccccagccatcgcatcatccatggtcttctggaacatctcaacaccagtcaccgtgcagttgc

SEQ ID NO: 17309 - DNA, 9619 bp, Oryza sativa
gggatggataggggagagcggagaggggtttgcgcttgcttatctagaagagagggataaggggagggccacggattaggggaggtgcggcgaaatcgtgaggcgctgggcggcccgggggttgggtctcgcggaggcgtgtgcctgtgtcgtcgttgtggggaggtgaaaaatgacgggaaatctcggtggttttgcggcgtttgggccagaaaaaatggggttgaggcccaggtttggcctcgtcacccggaacgccaacctctcttttcgcgttgtctgttttgtttggtggcgctctcttctgccggtgcacgtaaaaccgcgcggccctggtcgttccattcccgcggatgttaaggggggtgatgtcgactgtgaagcgggaagagtgacggtgatggtgccgtgttcccgtgcaacgagcgttgttatttcaagatagtaaaaagaggtgatgttagtgcattgggcttaaccgttcccctaacaaatattgggcaccacgttagcttctaccgcatccacttgaagtccgcaataccaaacttggtaacgtgttcctcaatctgattcagggagagtggagtgtggagcgacaaagaacagtgcgttgtgggggtcgtgacctcgctgtgtaatcctccacccacgagctcggtccccacttcccaaatcgccctcagccatcctctcgcgcacgcgtcggctgccatttttcccatcatgtgcctgtcctcaccatcccttccctcattgccatcccaccatggctaggagtagccaataaaggaagcaacaaaattaaagttttccaacataaatacaggaccaaaacacgaaatcatcacctaatttctacatctacaagattctcaactcaccagcaaaccctaggtactattcaaatctacagctttcggtggtgcagcaactgacgttggggctggagcggtggcggtggcgctagagttaccggtggtggagccgtcggtcccgggaccatgatcacatcccgcatctccgttggggaaagcggcgacgccctaggtctcgacggtggcggcaccacaaccaactcctttcatactcgtagccactgcggagcttcatcttcagtactcttgacggcgaggactggcaacacacggagcatcacgaggcgaggatagaaattgcgagaggagggatggaaaagatgagtcgtgagaggaggcgataagtcacaatagaaaacataagggtagcaatgtcatttaacccacttgtagctattagtctacaaggccattaggccacgacgtggcctcgttcacacccactgtagggcaagtagtctccatgtgtgtcttcggattttatggatctgtataactctctttctgcgcacgtaaattagagcaactcattatcgcatgattaattaagtgttaacttaaaaacttaaaatagagtacatgccaaatactatatctataattcatgattaatcctccatttacagtttggtacaataaagtttgtttttctttacgaaattgactctaattgcaaatttatttttttttctaaatatggtacttaaaaataaacgagaaaacccattccctctctcttcctccccaatacccccgcttttggagtctctcctcgaagaccgatcgcatccgcctccaaaccctagacgcggcggccatggcgcggcgatccgcccctctcctccagcgcctcctctcccccactccctccccctccccctccccgccccatcctctcgccgccgccgccgtctcccgccgcaccgtcacctacatgccgcggccgggggacggcgccccgcgcgccgtcacgctcatcccgggcgacggcatcgggcccctcgtcaccggcgccgtgcggcaggtgatggaggccatgcacgcgccggctacttcgagtgctacgaagtccgcggcgacatgccgacggttccccccgaggtcatcgactccatccgccgcaacaaggtctgcctcaagggcgggctcgccaccccagtcggcgggggtgtctcctccctcaacgtgcagctccgcaaggagctcgacctctacgcctccctcgtcaactgcttcaacctcccggggctgcccaccaggcacgacaacgtcgacattgtcgtcatcagggagaacaccgagggcgagtactccgggcttgagcacgaggtcgtccctggcgtcgtggagagccttaaggtatggcgaattccgcttgctgctaactcacctagttgatgtagtgtttgccagggtgcttgggttaatgcgtgtgccgagagaaccccaaatgcaacttaggtttgccacttatcgagcaatttcgtctatatacttaggactgtttgttttacctactgcttgttactttactggattggtaggtttattgtccacatctagtaaccttagtattcagttgaattgatgaaacttaccatgtgtattgacgcttttctgagatgttagtggtttgcataatgagtattcgagatccatgtattgctgggttgtgcataaaacactttaggcatatgtaactggtaagttgtttgttgcaatgaagcatgcttgctgtagttgagatagtggttatgatcgaattatgtggactattcaatacagatttcgatggatgggcttcaaaatatcctcaaattaagtcagttttacaaaatttatgtaatcacctgtgtagaaattgataaatctctgagatgatccagaaggacttatgctaataagcaccaaatgaagcataaaaataatctgataacttgcggtatccaattatccatcctttgagaaagctataaaattattaggttaactatcattggtgtagttctgatttgaagaggaaacaagttccttttgggtcctgtgacaattttcttaggtgaatggatctcacagttgaagttttggttgctagctgcacattaggagcagtgctttgatttcaaacggctcttgatgttggttagatcctatattgttggaacagatgctatggtatgcgttagcattaacaattgacctgaatgtgtaaacagtttaatacttgatacatgttatattgacgcatgatgtatatctacatagtttatatctgatattgctaatctggtcactagtccatggtgatctgagtcaattagttatatttttaacacttttgcctccataaatggcctgttgatggcactctagctgattaggtcttggcaggcagtcctttactgcacatattcttttatactcctattttgcaaatttgcgtgagtaccgatttctgaaatagaacgtatgtaaatgtttttgtcacttttcatttcatcatctaaaggaatttttttctatatggtactgttactaaatggatttactaggtgatcacaaagttctgctctgaaaggattgccaagtatgcttttgagtacgcgtacctcaacaacagaaagaaagtgactgccgtgcataaagcaaacatcatgaagcttgctgatggtttattcttggagtcttgccgtgaggttgcaacaaagtatcctggaattcaatataatgaaatcatcgtggacaactgttgtatgcagcttgttgctaagcctgaacaatttgatgttatggtaagtatgttagttctatcattactatgcatcttaacaaatgcattctgtttgtaacgtcaccatattctatactcacctactgatctatgcttttatcatgtcataaaaacaaaaacaaagtaaagtttttagtttctgcttgatgtttacatatattgatcaaatgcacattatcagagtacttagtagattatctgcaatgaatgtgatagaatattaattccctttgcacttctgtctgaaggatgttttcttgattgtcacagagttttcagatcaagtttgtttgattaactaggaacttgtgatatagcatgctcttgttttgtgtgttcggaggtcacgccaaatctttatggcaatctggtggctaacacggctgcaggtattgctggaggcactggtgttatgcctggaggtaaactctgaactatcgtctgtaattctgtactttgacctgcacaaatagtcaatacggccatcaggagctggaaccagacaggcttgctttcgcagttgtctgttagttacaggctatgtgttgtgtgatattttgtgttgcattttatacactttcttggacccactcaattttgtatgctgccagaacctcttacaaatgtgttaactctcaacttgtgcatatttcatatttgtgcatatgcaaaaaacaaatacatacaatcctcatgaaatgcacaaattttaggtaatgtgggtcaggaccatgctgtcttcgagcaaggagcttctgcaggaaatgttggaaacgtcaaagttgtggagcagaagaaagctaaccccgttgctctgctcctctcatctgccatgatgttgcggcatttgcaattcccatcattcgctgaccggctggagacggcggtgaagcgtgtcatcgcagaaggcaagtacagaaccaaagacttgggcggcagcagcaccacgcaggaagtcacggatgcagtgatcgcgcatcttgattaattgctggccggctgcgttcttttgaaacaaaattttccctttggactaggtgtctagtcccgactgattttcgtttcttatagcgttagatcatcatttcgttcgtcacagccttgtacaatcttcaggtgtcttgtgtctggtggattttgcttcggaatgatggagcaaatcaccaggaatccaggatcgatttttaacgcaatgtttttgcggtcttaactggaaataagagagaacgattctcttaactgtaacactattgcgttgattacttctacttattattacatattctgatctttactataatgataatgtctgcctgatttccttgtagaaagagttgtgttgcagttaactggcaaaatactaattcttgttatatattctaagaactcgttctggtctcaaaataataagtttaaaatgcatgtagtgaacatgagtttactttaacaataaaaattattcaaaatatggattttggatgtataaatatgtaacttttaaaatttatgttaaaaggtagtaaaaaattgtataatgttgacaaaaaagtctaaaatgacttgtttttgcggtatggagtctaaattttgcaatgtaaaagaggatttattctcacattattggcggaaatagtacataaaaggaaaaaaaaagaaacaaggccgcgctaagctggcctggcccaaatatttgcaagctggcccatatggcccgccgcctcttgtgatgcaaaccctaataaaacttctccccttcgctcgcctccaacctctcttcctccccgacccgaggcggcggcgaccctagcttcccgattctcccatcccccccatggcgtcccacctcgacttccgctacctcgacgagggcctcggcggcgagcgcgggaagcgcaagcgccgcgaggcggaggaggcggccgccgccgactccatggacctcgacgccgacgccgacgcgccgaggccgtccaagctccgcgcggtgccctccctgtccgacccctccaagcccgcctccttcgggcagcccacctacgacggcgtcatcgccgggcgcgtctccgggcggcgctggaaggaggcccgcacccgccgcgcctccgcgctggcggcgtcccggaagccgaccccgctggagcagcgcgcccgcgacaagtccctgaagcgcgcgtaccaggcccgcgtggcggagctcaaggaggagatccggcagagcaaggcggcgaagcggaagcagcgggaggagcgggagaagcgcaagaaggagaacgtgctccgctcgggcaccaagctgcagcgggtcaccaaccccaagaccatccagaagatcgccaagtccaagaagcggaagcagctcaaggtcgtccccgacgagttcctcggcggcaagaagtcggacgccaaccgccgcatgcaggtgcccggcctagacaactgaagatcgccttaccaaacaaatccttttgttatctgtgatacccatgttacagtgcagcttactagtttttacattgcgcaacgagattttgtactaatgctttagcatgagattttaagtatggtcaatccagcaattatgttggtatgaatgatgttgggtgcaggttcgttgctgattttctgtgttccatgcattgctgattgcctgcttgaaattatcttaggattaattttaggtgttctctttgtgaatttcattgattgttattatctgttttgatgattgctgagaagagagggggaaaaaatccacccatcagaattcaaaatctctttggactgaaacaagcagggagcagtgattgtaaaacgacgagctgaatttcgggttggtcccaatgatcgattgtttctctgaagtgttttggtctgatgttcgattgtttctatgaagtgatcataccagggtttaccaaaccgtgtggaaataatggtatatctcgcagtaattgcaccagtcaaatcgtgaggtggcggtaaccctacccagaacagcttggtgaaccctggatcaactgtatttcctattgtttgctcccgagctgctttcatagctttcttgaagatcgtaagatgccgcgctgcttggtttggtttatgttctggaattttgagaccttggtcaccgagtcaccatctgtgctgggtgcttaactgcttattgctcttgatccatgtgacaattaattattaataccttgttgcagctgtgtggtggcgaggtgcaaagatttgtgaacgctcgattcttgcaaactgtaaactaaacatccatttttcactgacactgtttagggatggcacatcgatgcatgtaagtttttgccggcctttgatatatgcaaaccggtgatctccaattctccatacgccgcataacgtcgatttatgtctctcatgtctccccgcagaaacattcaggcccggtttagttaccataaatttttgttttggggtatcagtttatcacatcgaatatacggacatacatacggacgcacatttaaagtatattaaacattatctaataacaaaaacaagttacagattccgctaggaaaccgcgagacgactttattaagcctaattaatctgtcattagcaaatgtttactgtagcaccacattgtcaaatcatggcacaattaggcttaaaagattcgtctcacaatttacacgcaaactgtgtaataggtttttttttccacatttaatactccatgcatgtgtgcaaacaatcgatatgatgggtgaaaagtttttgttttaggaaataaacaagcctcagcctaaagatgttgctgacgatctgcccgttaatggtctcttcttgctactcgttcagtcccaaaaaatttcagtcctgaagattaatttgaatacgctactcgttctgtcccaaaaataaagattaatttgaatatggtgtatgtttagatttatttttagaattggaattttctccacgtgtcagtgagaaaaataataggttgaattggtccgccaatttctaagggactaggctaacttgatcttggtcttaggggaatattctgtgtcatggatcatcccatcttatttgtcctcaaaccaaacaaactgaaaaataggtttaatacccttaaataaggtaattaatctatacaattataaattcttcagttttaaaatgtacaattaatatttacttatttgtagtcatgccattataactgttggcgtatcaaaaaaaaatgccactgcataccccatcgatacatcgaacaaaatgtgtagactatattgttctcgtcttcttcctcagtctcctcccatcagccactttaagcctgcaactccctattgagcactggtctccccgtcgaggacgacggccatcgctgccgatggaggcagggtctagttcggcctccaccccctctttgttttccctagtcctctggtgaccaccgttgccagtagcagaagggtgcgactcagcctccgtcccccgccaccgccattgtcgtgacctccacctcccttggctgcctcctcgagagtgaccttgtcgccgccatggctgagctccagcgctatggccttttggttcctcaaggaaggaataagtcaagatgcacgatccagatgttgtttcatatattatgtctattttctctcacttttctcatttcctcccaatttttcaaaaaacggaaataagtaagaaggagcagtagtagtagttcggcctcacttgtcggagactgaactaccgctcgctttcttcaggagatcaagtagcagcaattggcttcacctgtaaccgacctagaagttattttctatttcccactacttttcgtcattttttctaatattttcacaaatttcaccttttcatcttcttttcacattttttatttattttcggcttcatattcaaattctgtgaggcaaacgtgctaatgggcctacaccagcctacgtgctatatttgggcccgtgcagcacggcccggcccgctacaggagccgtgccaccggcatgcccgtgccgtgctcggccggccgcccgttcggccagcactacgctctacggcctgacggacggcagtagagctgggacttgggccgtgccgggctagcacggcacggcccagcgtgcttcgtgccaaatcgggccgtgcttttatcaggcggaaaggagcgtggcgtcatggcaggcgcgtgtgttttccgccgttggatcgagccccgcggcgggtatcgagggctaggatgtgtccgtccccaacccgggatcgagcgcggaattgaactagagagtgaagacactggccgcgcaacctgtaccatcactccatcagattagctgattttttttttcagcgcagccgacacgcacgcacgcacgcgccccgccgagccgcggccacgattccgaattcgaatctgcatctctcccaaatctaaaccccccgaaaaaaccaaaaaaaaaaaaacccgaaacccaaatcgaaatcccttcctccctcacccacacgcgcgctcccccgccgccgccgtctacacgcgcacggatggccgccgccgacggcgacgaggactgggagatctgcaactgcgacggcttcgtctacaagcgccgccgggtcctccacccgcccgacctcgaggacgccgccgccaccgccgcgacctcctccgccccggggccgccacccgaggccgtactccgccgccgccgccgccaggcgctcctccggctccgcgccaggtacctcgacgagctctcccgctgggagtcgctctcctcggacgtcctcgcgccgctccccgccgcgccggccgcggaccttcctccccgaccgccttccgaccccgtcgccgcctcgccgcctcccggctcctcctcctcctcctccgacctcccgtcatcgacggcctcctcgccaggtactcaccgta

SEQ ID NO: 17310 - DNA, 3630 bp, Oryza sativa
tgtgcgacgagatcgatgagttctgccacgcgcacgaggcagccttggtggatgccgtcaccgacctgccggtatggggcgatccacgggagctcatgaactccttgtgcagccccgccgagctgccagtatgtggcgatccacgggaggtcatgagctccttgtgcagccccggcgagaagcctgtctctggtaccaattaggcatcccacctactctattggtgctttctatgcttacggcttacctagataatttgcgttattgtggtcatctaatttggtggctgaaattaggctcatatgtgaatgctgtagaatggctgagacggccgctgttgtactaaggatgggggcaaatcagcatgttgtaactaatttaatttaattagggtatcttgagttgagatgttaatttatttttctgtgggatgccatcagaactgttggaattgtagctatgtatggaagagctgttgtgccttgtttgcttatatgaaattcgtgcttttcaaaaatgatgatcttttacttcttggagttcagcacaatattggcataaatttatttttgcaccttccaaatacaacttgctgtgtagacaagttgaaaactcaaattcttatccaggatattgctactattgtacagttaagttatgccagtttgtggagaaattagtgtttcataccataactttgaatgcagttggcaccatggcatctacagagtaccatctcagtttactgaatctctgattatttttgctctacttggattggaggaagaggaattgtgaagccagtatactgtccaaaggagagctcatatagtcttcttaatatttgttgtctcagaggatgtgtcggcttcctgccaagtgccgaccaccaaaaaatcaattctccttcaaattcttcccgtgacatctctgtttcttgttgtattgttcctttgttgaaaatttgaagacatcaagctgatctctgaactggtgacatcatctgccactttgcattggctgttctgcaggtatgaccatatgaatattttgttttgacaaacaagtgcaatttatggtgctttttgttaggaaaatgccaacattctttatagaaagttaacatgcaggttgtggttagttctctgatgcctgaatataattgcaattcgattacaaccaagcctgcatatttcaatttttgtccctacatattccaagtaaaattatacccttatttttcatttgttaaaattgttgctgttagactgcagtgttgacgctcagttaaagtggaattccttaggcttgctaaaaaagatatgtccacattaagtgaagtgcatgttgtgcaaacaaatatagtaggtagatatccgtcatatcaagtatcaagatgcatttgtgaggtataatgggtgaagcaggtgaaatgaagtgagataaatcagtaagattagttgtaaaatgaagctataacctattgtttgtattgtagtgttgtatttcatgcttttaacgaccttggcactgaaatgtctggtggttattttgtgcttgataatgattgctggtttctcttctcttagatcattatgtgcaggtaaaactagttcttttggttgtcgatattacttctcattgaatctgaacatattgtcacttggcacataatcttattatcaccctacttatctttctatcttttgagtttgtaatgaaatatattgtatcgttgtatgattaactgataaaacaactgtgcttgaaaattgtggcagcaatgcagcatgagttcaattctgagactatgatttgattgaatgactacacatatagcataagttacaaatagagcttactgagaacaactattacactttgttaaatgcatgttctaaaaatgaaatattccaaggtatgcatccatcgtacaaaaatgcatttggtgagatataccagctgaagatttaagagagcaaaagaaaaggagaggaatcaacgaagaagatgagctgcggctgcgagcaacaggaagtgcctaggaagagatccttatctccggacaagttcgtgactaggaccaaatcaagtgtcttgacgatgatgtctttaatggttggcatttttagtctagtttgtgtaagtttacatgcttgagttacaatcttagcatgttgcaagttatactctggtgcagaactagtgaatggcaagaaacattccttgccagcatcgtacaattcttttcaacctgcttatgtccaactgccattttcactttttcagcttgcctggagtatctcccattgcaaagtttgatctagctacagtttggagattgttactataatatttccttcttctgtcctagtaatatttgccaatttgcatccccttaaaatgtgtcacagttgatgtgtattagtgtttgtgtgtcagtgctagtgtgtcagtttgtgagtgtgtgttttgagaatatgttctgttaacaattggtcatcaattcattgagccccactcttaagatgttcccttagcagataacaccatgattctaacatatttcatactttggttcttgaacaagcagatgcaatatggctaacagcggcacaagcaccaataggtcaatctgggatgccagtggcatcatgccacaagctcaagctgcaccagcatgtataaccccttttgcagcttcatgtaacaaccactctgacggttatcacttatcagcaaagagctcaagctgtgccttatcttcctgcagctgcatcctatcagcaaggagctcatgctgggccatattgtgctccaccttatgcatatgccaaccctatgtcttaccagcaggctcatgggaatgctggctaaccatctgcaggttatgatcagaatgccatctacaagaatcctgcctaccctgatgatcatgatcagaatgccatctccaacaatcctgcataccaccatgctggctatgatcagaaaatgccatctacaactatcatccctaccctgctgggtatgttcagaatgtctactccaactatcatggctaccaggcagcttatggtcgcggcggcgccgcgactgatgcggtgagcgtgattcagacaagcggtggagcggctaccgtcgtcgtcgcgcaagcagctgatcccccttcagtccttctgatggtgcacttcaccccaaatccactggaggagctcagatgatgtatccctatctaagaatttctgtttctgttaccattttctgactgaatggatgaagtagaggtgctttctgcaacaaggcatcttgaattatgcttatgatttgattgttcgatgattctctatctgaaaaaacaatggagaagatctgtgtttgggagagctttacacctgttaatggggagaacagattttttttttcacgattgcggaaaaggattgcacgtcaatataatggggaggaagagagagcactagctgcgtggttcgtcgaacctcctggacgatgaccacgatgaccggaggaatatgctcctcaggctgcggctgctctccctcgctcgcttcacccctcctcctcctcctcctccttcccgcgtggtggcggcgcgctcctgggcggcgg

SEQ ID NO: 17311 - DNA, 4746 bp, Oryza sativa
cgcgcgtgtcccggtcacggatcgccccggcctccagcttgaaccgtgacggcatgcgccgtcccgggcctcccactcccgcgcggcgcgtgcccgaggaagagacgccgccgccgccgccgtcgtcgtccgccccttgcgccgccgccgacgccaccgcgcgcgggttgcccgactgcgcgtgccacgcctgcgccaccgccttgagcagctccacgtcgtcctcgccgcccgccgccgccgagcccttcatgcccgccgccccgcgcgcgcgcgcgcgtcagcctctcgtttgcgctcgcatggatgtcccacttggcgcgttcttttcggattagtgtacgccgtttggcttattcaagattgagccggaacaagcacaacatatttgcaaataaaaaataatttattaataaaatttttatgcatgtattctaaataattttaaagcaaaatctgaaaaataaactacgatgaaaaaaatcccaaaattaacttaaattttaaggttgaaaattcaaattttagcttataagtataagcgaaaaaataggatgtattaggtttttggctaattagtcgcacgttaaacgagaaatatatttagtactccattcgtcttaaaatataagaagttctataattagacacggttattaagaaaataggtagaaatgagtagtgaagggttgtgattgaataagtagtggatgtatgtgagaaatgtgaatggtaaagggttgtgattggttgaaaatagaatgttggtggagatgctgttatattttaggacaaatcctgagtgctaaaagtttattttgggacggagggagtatatgattagttaaataataattattaatttttttaaaaatcgatttaattaattttgtaagcactttttttacaggacatacagtttaactgtttaaaagacgtgttaacaaaaatgaggagtaactaaccttaattagcactttagaacgcgggttgattttgacaaaaagaaaagtcagtaatccgctacaaaaattgtactacttccgttgatgcctgtgagaaaagcgtttttttgagtaaactctgacgaaacacaagaaaaggttcagagttgaaaacacaatcatgtgtaggtccacggtttttcagccatcggaggtggtgtgtgcacacactccacaaacagtggtaatggccactcactgtctctgctgctgacatgaacaccccagattcaagccacagaaatggaagatgctatggggatattccgaagctccaagtgactgtcaagtgtagactctgatgagcttttgttgcagaacctgcatccatggtccgtctaatgtctgctgctagtggctagataatcaaagttttgagaaatttcactattcgatatccaatttgcagtcatttcagtttccctgttctgtcatgcatggtgcaagtaaattcttgtgcagaaaaaaaaaagcagccaaacatttcctggcgaggaacaaaccagaccaaagaagaagagaaagatcaggcttctgaagaagtgatatttctggatactgtgatcagcactataaaaaacgctttggattgctacagaattggatatctgacacgcggcgaattgccatcctttaagtcatgtcaattgccatcaaatctttcttggtcagtcgagatggatctgcttcaaggtgtcctgggagataggcaaactggtggtagctcagccaaacatacacacatgtggtttggcattggcaaccggtggaggatgagcacatgatggcgaccactgcgtccatcacatttgagatattcagatcctagctagacgaattatccgtgcctttgtctcaagtcaaattgctctgctaatctgcttcttccaagtcgtcgtctcgtctctctcccggtggtctgaacttctgtccgctgcaccacacacacacacacacccggagaaaatcttgatttgcagtggtctcttatgtccatttttcttctcctttttgtcatctgtctgcactagctagctgtgtgtgcgtgctactgtggtgatcgccttttgatcgcaagaaaaagaagtggctgagctgaactgaaagtctgatgaaacgagtaggcaatagccatgcaatcgattggttatgaccagagaggcagagatgaactttgtttcagaacatgagaatttagcaagaatagcttgcaaattatacgattttgcagtaaaagctagtattgaaattccgccgttccaaacttgactgtcaaataaacacgagtcgatgttagtgagtttgacagaaacaacaggacttcctcctaaccatgatctcaacaacaactcattccatccaaatcaaactatagatttttcatattagcattgagtaggcaaaagcatacatgcgtgcgtgccaaatgtctctattactttgcgtcgtaatgacacatgcgtcttctctgaaatctcgatttgatgggcttaaatacattggaactttggaaatgtcaaggttaggcagccaagagagatcatcaatcacaaagatcgacctggaaaagaacacttaaaatttggacaagtgtctgatcacatagctaaattcatagttgttgaggaatcctaggtgacttttttccaagtcatgtgtagggcgagcatattccttaactgcatattctcttctctctctctctctctttttaaaaaattctatataagcatgtactcccccttcaaatgaatatgcttatctgtacttagtactacatctcttaatgccctctgttatgaataagaactacccataattaaggggctgtttggttggttgccacactttgccacgccacactttagccatgccatagttttttaaggcatgtgtttggttcgctgccgcaattatgttatgccacactttcttaactttgggatccacatgtcatgctctcaaaattagagataagcatgccacacttatggccaactatttctaagccacatttatgccaccataccacaactagtctaaacttagttatggcaatgttaggcatcaaccaaacattccctaaatcttctactgatacatataggacctggctgacataagagctgccctagttgaatggttcagcagattcctctgatcttctgtctgctcatatattaaacagagtattacgatgggtacatcttgcaccagttttatttacagaacttttgctgtcccttttttttttttacttctgggatatgtatatctacagaagataaataaatggttggtattgaagcgatggaacttccaagacactgttcaacacgtcagctctgtgtgcaaatgacttgtatggataggataggatcagttcagagatgcttttgttgctttatacttacagattttattttgttgcttttacttctggaccggatatgtatatttctacaaagataatggtgggtattgaaacagtagaacatccaatatactgttcaacactttgattctgtggtagtaactggcaagtgacatctggattggacggtagatgtttcgataaggctctgacctttcaagatcgcctcggactgagctcgatcaatgatctgcccaaaaagtgcaaaatagctagattttgatgactacttcctcaatcccaaaaaagagaattcctagcatcccaagacaaattcagtgaggagtaaaaatgatcaaaatgaccctcacaatggaaaaagtaatagtgatgataggtaggtaaagggtatttaaaaaataaaacttctcgttttatgagctgaaggtaagtaagatggtagaaattggttttctgtgggacaaaaatcaaactctagaaatttagtttttttttggatggagggagtacttctcttgtctcatctctgaattatactgaattaacagttagatgcttgttgctaagcacacattctaataacaaaacgatccattttatgtatgctaaattgctagtgtacataacggtttaatttgtatctccgattttggaagtagtactagctagtgtattacccagccatatatatgtgcccctgtctgatcagaacatgacgctttgtcattaatactgctggtgttgatcgagtccgagcatcactagacaagtggtctgagaaaattgcatttacttttagcgaattaaggtgtaagacttgcgttgtcgaggtcaactacacaggaatgtgatcaaggaatcacacgaccctcattaattctttttttttttgagaaacacagtacaaacgcaggcgctcacaacatgcgcacactcacccctatgaacgcacacacgcacaccctacccttcttgagattgacgaagtcaccacaggcgcctcgctgtcgacgggtacgtcgcctaccactgaaataataattagccgtaaatgcgagtacccgtgtcaaatctaggatttgaacccgggtgggctggttccaccacaaggaacctaaccagttgactatgctcacttcgcgaccctcattaattctttggtttcaaccacggaaatttcacgggaatcagtttatataggagttaacacttcacaagaaaaggagacaaaaatcgagtcttccgtgcttttcttgtttctgtcactcctcttcaaaagtacactgatagaggatttaataattaagttatgccgtgaaataatattttatgagtcactacatattc

SEQ ID NO: 17312 - DNA, 1823 bp, Oryza sativa
aatatccaaaaccaaaaggggaagcagccgttgacgactccggtttcagggaaacaaacaaagaaacgaacacaagaactgcaacttgatatgcgccgcaagagggattgataattgattgattgattggcctgataatccagctgccgaccgcctgaaagacctgtttaattctgattttccctgatttttttaaaaaattacgtacaaacacaaatttcactcaccgctatatacgcatgcacgcacatcctacccttataagcgtctccgaaagactgagctgacatatcttaagattgtcgaaatcaccacagacgtattgttgtctatgcgcacacttattcctataatcgatcccccatgcacgtacacattacctattacctcgatgtataccttcgaaagactggatcaacatatcttgagattgatgaagtcatcacatatgggcgtcttgttattaatgggtacgttgtctattattgaaaaaaataactatccataaattcgagcacatgtatcaagtttaggacgttaaacgtggatggacatattctaccacaagtaatctaccagttaagctatgctcacttcgatgtctgttccttgatttattggcatgtttaattatcttaatcttgtaatgggggacatgatctcatgagagcaagtttaatagtatagtcaactacgggctccaaatcatatatagctaatctaatagcctattcatacaatagttagctataaaaatatactacatcattaatacccggtcccacctctcatacacatataatgttttggagtccgtgttacagttggttataaatctgtagctcgctttcttctgtcttcttttttcttcttgatatatggttatagctggtttatagcctgctattgtacctgctctgaggctttgccaatttaactgcatgtatagctatgcatagttcctttggaggatctagcacttttttggcattgctacatgcttagttactttcaagtctataaagtatttatttccttaacaatgaaaagtttgcatggttagtaaacaactaacagcacatggtttgccatgattcagacacaactgtctttatatattatccaaatgagaaaaaaataaacggaggagagaaacccagaaacataaagcgtggagtacatggaccagaatactacctccttccctaaatgtttgacgccgttgacttttttaaacatgtttgaccgttcgtcttattcaaaaacttttgtgaaatatgtaaaactatatgtatacataaaagtatatttaacaatgaattaaatggtaggaaaagaattaataattgcttaaattttttgaataagacgaacggtcaaacatattttaaaaagtcaacggtgtcaaatatttagggatggagggagtatagaattgaaagcgtctcgccgagagatctcattgtcagttacatctcataaatatgctcctcaatcctcatcatcgttcatactcgaatccaacctagctagacagatagacagaaagacaggcaagctcattagtgtatagttttggactgccgatcatacgccttttccttgagaaagcaaaaaaaaagcgtatatttgttttcgataatgtagctaacaagtgctgaaatttcccacgaacatagcacggcaccacctaggacgcgattgaacgaaaatggatcatctacaacaccgtacaatacttcttacggttggcaatttttttttcacacacaatataaacgctcgtatatggattaggatcctctaacataaaggtagaggga

SEQ ID NO: 17313 - DNA, 1992 bp, Oryza sativa
atccgcgcgcagccttgtgaacacgtctctaagaggttgagctgatatgagttttgatgaaatcatatgcttttataattaaatatacaagcaccatcgttaagtttataacttacacgtgaatatattgtactataagaaacctaaccaactgaaatatataatcttgtgattgcacttgatcgtttgtgtttccaacaaagatgagttttatgtgtaagggtgtgcttccttcaagacattatatgctttattgaggatttgagattgtgtagcacaaccctccatttcaatttgatcatcccctaaacaaatgacactaagaccaaggaaaacaaaatatttattaatctcaaattaatcctcattggttaagctcattggttaaggtgattcatcgcttcgtatcatgtgaattgctcatgttttaagtatcgtatgccattgcactaatagaaattaatcttggttggttgtatgcaacacattaaatgatgcatatttaatctttgcacaaataaacaaagaaacacttgttagacgataatcatttttaggaaaacctcaaaacccttaagggatgatcaaaatatgatggagggagtagtgaacagaggaatacaacattgtgctttatttctacgcaacctcaaaaaaattcttacggaaaaggttgtaggtgcaaatatgcttgtgttttaaataaacttttacaattatgtatgtacggcacaattatcttggggtgatatgtatatgtaggtgtcgtacctatctacatcaaagcatctatggactacggtgacttcactaatcttaaaatactccaaaatataatagattatggttagatgagatatatactaatactacaaatattgacaggaagctgtttagatttatagtattaagatgacggaggaagtatgttggtcggtgtacatgtgtgtgtttataaagacgcctgtttgtgggtgcatggtatgttgtgtgtttccgaaagagagtacttgtaggtatacaatattgatatgtatctcttcatcctctccccatcgtcctcgatgaaaatatctatttcatcgtgagatgagtcacaaaaagttccataaaaggtgattttcagaagaggatgacagtatgacttaaaagaccttgacttaatcattcgtttcatcgagagagaagaatattgaaactagaaaactcattaccagatgattaaataaatattaattattataaacttaaaagttaatatatttagttttttaaaagacaatttttatatattattttacgaataaatatacagtatagcagtttgaaacagaaaatgagaaagttaaagcatttaggctgcgttcgggaggagggcacgtaaaacgaaatacgtattattgcatgagtaattaagttttagctttttataaaataggttaatatgatttttaaaataatttttatatagattttttttaataaaaaatacacggtctggcagtttcaaaaacgagaaagctgagttagaaaactgagaaataacacaggcaggcttaaccctgacggaagatgcccccgtttgcacgaggacaaaccaagacccgctccggctcctctcaatccagcctcccccccctccacccacaaacggctataactagtcgcttccaattatcccaccctctcgcccttctcgcaccgaacccaaccccaacaacactcttccgctcccaccccccgcacactccccgtatttcggaacacgtccccgacggcccgactgccgcacgcggcgaggaggccgcggtaattacgggcttagtccgagggggagaacgcaaaaagaccaggagaagacgaccagggagcgcacgcgcaccgcctcccccccacctcgccgccggcgaggtctcccgccgccgcctgccattgggagacgtgggctggagagaggcgggagcatctcgtcagccgattcccgttcccccc

SEQ ID NO: 17314 - DNA, 4195 bp, Oryza sativa
ttgctatgagaataaaagaaatttgctcctcaatctcaatctcgattagtggtggctttagctttctctcggagagctcaggttttcgattgatttagtcgcgaggtttgcttgattgctttcgaggaatcgggggcatctgctcgagattgggattaggtggagttcgaggcttggatgcatctggtgccggtagaatctcgcgagctggcagaattggctgtccagcctataattctggagctttattatttttcttggtagaaagtatctggaaatcatctctctttgtggcagtccagatttggatcattcatgccgtggaagaaaataattttgcaaataaatgattagatgattccccactttttctttgtttggtggatctgcattagcatgttattcatagggatgctgtttttttttaattaaaaaaataatccgacatggtaatgagtactttgctccagctatactttattgtcttaaagtacgcggtaacattgttaaacaaaataaattatcttttggatgctgccgcgaaattcacggtggatgctggaaaatcttgtgctttatgccgcggtgatgctatcttaggatattgattttttttaacttgctttctcaattctgtgccttgaatcactggaaagtgttcatgtactcctgcgtactaagttatgctgttttattgtctttccattgcttagtaccactgccaccctgtcatctctgataggactatattcataagcatctttgccaaaatcctcaattctgccatacacaacctgcatcgtttgtaactgtcatctctgataggactacattcataagcatctttgccaaaatcctcaattctgccatacaacctgcatcttttgtaagctttgctgtgctagtggttgataaaccaacgtcctgggtgttgtaaccgttgttgttgaaaatctttgtggtttttatatatatttcactggggtttctatggctgtggaaggatatcgacatagattgcctttttttacttttagctctattcaggttttggctccagttgacgatctgatttctcactttcttctgatttcatttgcagcatggttcaaaggcagtttttagtatgtcaaggctgaagtgcgcacttcgggggtttgatttaagagcacttttgatcctcttgattggtctgccaattctgatctttgttatataccttcatggccagaaagtcacttacttcctcagaccaatctgggaaaagcccccaaagcccttcaaagtacttcctcactactacaacgaaaatgtctcaatggccaacttatgcaagttacatggatggaaagtcagggaaacgccgcggcgtgtttttgatgctgtgcttttcagcaacgagcttgatattcttgatatccgttggcatgagcttagcccttatgtgtcagagtttgtgttgcttgagtccaactcaaccttcactggccttaaaaaggatctccacttcaaggaaaaccgtcaacgttttgaatttgctgaatcacggttgacctatggtatgataggtggtcggtttgtgaagggggagaacccatttgtcgaggagtcatatcagagggttgctcttgaccagcttattaaaattgccgggatcacagatgatgacctgttgatcatgtctgatgttgatgagattccaagtgggcatacgatcaacctcttgagatggtgtgatgacatacctgaagtactccatctccagctcaggaactatctgtactcatttgaatttttccttgatgacaaaagttggagggcttcaattcacagataccgggctggaaagacgaggtatgcacatttccggcaaacagatgaccttctggctgattcaggatggcactgcagcttttgttttcgctacattagtgattttgtcttcaaaatgcaagcttatagccatgttgatcggattagatttaagtacttcctgaaccccaaaagaattcagcatgtgatatgccgaggagccgatcttttcgacatgcttcctgaagaatacacattccaagaaatcattgccaagctgggtccaatcccaagcacattttctgccgttcatcttcctgcttatttgctagagaaagtagatcagtacagttatcttcttccagggcgatgcatgagagagagtggctaggcacttgcagcttgcataacctgatgcgcatggggatcgtggatgatgcccctttggagaacaacatgcgagatattggttgtacctgatacaatttggctgacttagttgagcgatcgcttggcgatttgggtgagttcatgattttgtactggtgtagccaaacattggaagaaggcctgacagcatagcgcatgcttgggcgctgcgttcttgtttttttagaggagctcagcagtgtgtgtgcttttacctcctgagttttacccattacttccatggttgatatatgaactcagaaactcttgtagattgtgaactggatgacatccagaatttttttttatcttgttctgtacagtatcatttacttaccagacgagttaccctgcattgattctccgggcaataatcatcctcctgtcatttgatatatttgctgtacactacagaaagcacatgtataatgcagttggtgtttggtctcagctaactgtttgcaaacaaccagagcaaacaaccagagtcgttgcaggttggcaagaaatgcagtgttttcactgccttttatcattttatcctcttggtaatggttaatgagctgcttggctggcaggttcagttgggtaaactatcacattctcttatatatatatttttagttattgtgagggttcgtctgttcgtgccgttaagcgacatgttaaggcggcattttgtgggacgaagtgggttggaacaggctgttcttgtcggacgtccgcttcagccagattgacaaacatcatgtacaggttcatctgcctgacgagctccagcaagtattcctttttaaaaaaaaatgaaatatttttttatggatttttattctgttaaaattatttcaaatattttttgaaaaaacattgcaagctacgaattccgcaggtttaccttttgctctcatacacgttgcattgcgttgaggcgaggtctctcatggtcaggttcttagcttatctaccgtaactaaaatttaaatttttaacttaattttggaattgatttcagagtttttcatcgtaatcattttataacattatccttttttaaatatagtacaaacgcatgtgtctataatgcgtacacacttactcctatgaacacacatgcatgttcttctcttatgagcatcttcggaagactgtgccgcaatatcttgagaaacgaagtcaccactagcacctcgcaccttttaaaccactagtaacatgtagatataaaagtcctattgataaattacttttaattgtttcattcaatttttcttcatttttctatggcttacccataaataattcaaacattagagcataaaagtgcaaagcgcatcgctgataattctaagtggaagactttcgcagggtcgacgattggctgcccggaaagtggtctgggacctcgagtgagcatccatccacgtccaattgaaaatcgtcgaggcacactaggacgaaacaaacaaaacccaaaaagatttcgtggttccaagaatcatggccgagtagatccccacttctaatgtaatgtcgctattaatctttgcgtcgcccatgcctccacttaaagagaaagaaaatctcaattctgatgggtcaagtaaaagaataccctgaatctgaaacgcatctctctcttcctaaataactttggaatttagacatacggagtgacagttttgtggtcgttttctttctgataaaaagattaatcaatttctgcctagtttccaagaaaagatttaaggttgtaaatatatcttgttgaagactgtgggtgagtcccttaggcttagttgttgataaagcctcattgacttgctttcaggtcatgtacggcagtcactgaagggcatatatgctttacatttacatgttctctttttaccaaaccggcaaaaaaatgcaataagaatattttaatgtcccgagccatatttaaaatttgctggtg

SEQ ID NO: 17315 - DNA, 421 bp, Oryza sativa
ctcctgcggcgtgagccccttgggctccgcggccgcggcggcgggccgcctcccggcggcggcgccgtaggtggtgaactcggagagcgagagggtggtccccttcttcttcttggacttgccggcggccgcacccgcggcggcctcgcggaggctggggaaccccgcggccggggcgggtgcggcggcgctctcccgctcctcctcctcggcgcgctcggcgtccagcgcccacgcgccggcgccgccgaggccgccccaggccttggacatggcggtggcggggacgagatctagggtttggcgctcggctagggtgaaggaggaatgatggcggggaggcggaggaggaggcggttgggttggcgatgccgatgcggagaggagacgagacgagacgagacggggacgagacgaggcg

SEQ ID NO: 17316 - DNA, 405 bp, Oryza sativa
cggtaaaaaattcatacagttcgaacaactactacaagaagaagggtggagagcagattcaaacaagagagaagctgctaatacatatatatatatatatatatatatatatatatatatatatatatatatatatatatatatatatatatatatatatatataatagcccacacagtaaatgtactccaagtgttttactaatcacaaaatttaactttttccttctatgatatgtcattaagtgtcacaagcaatctagaggcacggccctctgcaggtatcacgcatgcgaatccctcagggtaagggggaaatagagggttcacgcagaggatgtaaatctctcgactcaacgtataagcgcatgggaaaaacgcacatttagaacctacttatatatat

SEQ ID NO: 17317 - DNA, 763 bp, Oryza sativa
ctaaaatgcacatctacagttgttttgcttattgatatacctgcactccagttgtttttattgatggtaggtgcgaaccaatgctcatggagcattatgcatagtcatgccaactcttttcaaagtgtagcttctgctgatcaagaattcattattcatttactgaattcctttttattccccgcttgaaggtccattatgttatttgacttgtaccttcttcctttacgatttgacattagcagttcccaaacttgcacacactgctcagtgctgttttacttttattccccgatgttagttgaaatctttttgaaatattatcaaaatatcttgtaaatttctgaaaatcaccaagtgtcatataaaaaggaatctagaggtcaaatattgtttctatgtatgtatttttttaaaaaaactttttaatggtaaaatttactcacagagagatcttctcttgttattcaataaccactattctatttgcacaattatatggtccccaaaaattttgactttatgccactaatgctggtctcagctaagatcaatcatctggatatgcaggcaatgaatttctttgctggtctgttacttctcctaatgccagaggagaatgcattttggtaggttttgcagaagaacacccatggaatttctgtgttctctcaagttacatctcttgttgcattgtattagagctgaactaaaaagtttgttaaatctattatctgttcgcagggcattgacaggcattatg

SEQ ID NO: 17318 - DNA, 2027 bp, Oryza sativa
tcctgcagccctgtatcaactattatgcatggtcttttaattttaaaggtttatccaaggttaaatggtgatgcacaggctcatttctttgtccgctggacggtaagacaccttaattgtatgctttagtgactgcattaccctagtatgtttaattttaaataatctacagttatattgtagattgatggatatcggaagacaggctgctacaatttagactgccctggttatgtacctgaagcaggtataagtatagttccaggagttgccattgatacagtctcagagcctggaggaataaaacatattatcatcttcaaaattttcaaggtaatacaagattatgttttttaagagctaaaatagtaagtatgttcaaaattgtaagacatgtactcctctaatctcctcttctgattttgaacaaatctaggatggtgccggagattggttactacactgcggatgggactcagaaccatacctaattgggcgttttcctgcatccttattcaccaccctacgtaacaaagctaattacatgaaggtcgctggttatgcggtggctcgaacgacccatttggctccaatgggaagtgggtatcttccaaataatccaaaagctgcatcattcagcaacgtgcaacttattgatcaagatggccaaacatccaagattccacaagatctacctgccactcagactttcccatccatctattctgtatctccaatcaattttgagggtaaattcacatatggtgggccgttagaataagaaacaatcggtgcagcttttctatataatagaaataatcattgttaattttgattatgaacttgtcatttgtagagaaggtttaaattttttttatctgatgtgttgttgcatatttgtatttttaaatttctaagccatccatattccaatgcaaaggcaatataacttgggtcgcacgccatgcacaatcccaattgtatatatacgtataaactttatatgcgtgtatataaagtttatatatatgtatatatacatacgtatatactaatgggactagaggggtatgacttttttttaacgaatcgacgagaccaccaattttattaaatagagaaggagaaaactgtacaaaaggaattttacaaaagcacaaacaggactacgagtctacgaccctgacaaaaaggctaattacaacgccaaccagacagcgaggcttctcgcacctgcaaggctccacgtttttgcttcctcttttatcttggatagcaggtttgatgccggcaacttcttgggttggaaagtcctccggctcttttcatcctagatctcccaggccactagcaaagttaacgtgcgtagtgtcctttttggtgcttctctggtactcatgatggcctcccaccactcgtgtaccatagaagttgctagccagcgatgagtgctttgatggccattgccagtccaaagcgctatttgcagcctcgcgcggctggtcgccaatcaggcatccccacgatatggtctagccatccaagtcgtagatggaatggtgtttaacccttccctgaatacgaatatcctggctaccatgagtctctttccaaatacggtttatggtgtacggtatccatggggagagttccattatctgaggggtatcccatatttgctcccttgacacttcatatttgctggagtaataatacaaaagtactgttttaaattttccttttgtctacactgaaaacttgtacgttctctagataaaagctccagttttatgcatgacctgtaatggaatgtggaatgtgtcagggtatatgtactccgttcgtgctgttcagtactagtgagtgttttactcccgaaacatactccaggagattagtggtatggagtagttgatcgagtagaaaatttagccacttcaggagactagcaggatggagtagtatgtgagagaacattgctgaatgcttctcagtattgtactccacacaataatatgtgcttgcaa

SEQ ID NO: 17319 - DNA, 775 bp, Oryza sativa
actcattaaaaaaaggtgtttctgaattgaacgaagggagtatttggtacattcttgagatacctaaatattgaatgccccctctagaacacatgccattgcccatacggcaagcatcacagtcgaaacaatacggacgttacagaattatatgttaaccagcattattcaatgctagggtacttgcaatagatttgtgccacctgatacatgtatgggaatgcaaaagattgcagaactaccaatatgtgaaaattgctctgaatatacaggcaaaaacaagcattaaaccacttatgaagcaatttacatctgtgaagcaatcgccacagccaactgttaacaccctttctaaaccaacacccttcaagtgctttagtcttctactaataaatatggccctaatgtgggttcttccttaacagatggataataactgcagcaaaagggagtattgtgtcagaactagaagagcgcgaaaaagtataaaagcactcggagaatttttcacatgtgcagctcaacatctccagagttcacatgtaaaaagaataaaaaaatacagatgtagtatatgtgaaccttgagacagaacgggcaatttttagtgaaaaaaacatctaactgaaaactgccccaaggatggcaaatgatttctgtacaaaagatcttacctcacagaggacaccagttactgaaaattttcactgtcctcatctttaggtgtccccattatgatactgcacgtgtaatggcataaacagggctgcaggaa

SEQ ID NO: 17320 - DNA, 17064 bp, Oryza sativa
aggaccttgcccacttaagagaaaaaagagagaagaggggggggggaaaaacaccggagctcggagaggagagaaagaggaagagggtctttagagtttgaactctcttgctctccagctctttgtaactccttcatacacagatccaccagaacacaggagtagggtattacgcttctcagcggcccgaacctgtctacatcgcccgtgtcttgcgcatttgctctctcgcgaaacattccacagatcgagggcttagaacctcaccttgcgcccctggccgaaccggcaaaggggggcccgcgcggtctcccggtgaggagccccacgctccgtcatctggcgcgccaggtagggggcgcgtgtgtttttctaagccctcgtcctctttcgtgtgcgccaagcttctcccgctcagcccaatggccgaacgggcagtggcgcacaacctctctccgagcgctagcggtgacgacggggagcagaacccgcgccgtcgagctcgtactccaccgcccccctctcgccgaagtcttaggcgggaggaggtgctcgagggggtcgaaagatccgcgacttcgccgcccacgagcgatggagaaggacggcgagacggggagcgtcgcctcctcgtctacggcgatggcagcacgccccagggcgcgctccaagctgcgggcgcgctcttgcgtcacccgcccgtcgtccccgatccagagactccagcccgacgttggctggatgacgtggccgacttggtcatgacggcgcagcagcgcctaggcgccggtgggcggtcctccgccaccaaggcctctggcgctgctaccgccggctccgtgtcgtcgaggcggagggcgcggcgagcggcggccgttacccgccgttcgtctgccatttcctcgtcaacgcctccgacccaagaagatgtgcgtagggggccggatgcccgcctcagtatcgagcgccggcgcaatggtcgtcgtgctgcccacgcaacggaaggcgcttcctcgtccggagcgccacttcggtttgggcgcgggggccagccccccgtgcccccggttggtggtgtcggctgtcgagcctttgtggcgagccttcggaacgtccgttggcccccaaggttccggcccactatcaccgaaaaatatgacggaagtgtcaaccccgccgagtttctccaggtctacacgaccgggatcgaagccgccgggggtgacgacagggtcatggcgaatttcttccccatggacctgaagggacaggcgcggggttggctatgaacttgccgcccgcgacggtccactcttgggaggatttgtgccagcagttcaccatgaacttccaaggcacatatccacgcccaggtgaagaagcggacttgcatgcggtacagcgaagggacgatgagtctcttcgctcgtacattcagcggttctgtcaagtccgcaacaccataccatgcatccctgcacacgcggtaatctacgcgttcaggcggggcgtgcggcacaaccgcatgctcgaaaagatcgcctccaaggagccccagaccaccgcggagctttttcagctcgcggaccgtgtggctcgcaaggaggaggcctggacctggaactccaccggttccggtgtggcagcttcggccgcccccggatccgctgctcggtcagagcggcgggacaggaggaggaaaaagaggtcggcccattccgacgacgagggtcacgtcctcgccgtcgagggcgcttcgcgggccacccgaaaggggaggcctgcgagcaacaaaaagaaggaggctggcgctcccagcagggagcgcccgaccggcaagtggtgcaccgtgcacaacacctccctccacgacctcgcggactgccgcgcggtcaaaagtttggctgagcggacgaggaagtgggaggaggagaggaggcaggagcgccgtgagggcaaggccccggcggctccctccggcaaccggcgaagtgaggccaagcaaaaggcccccgctgaggacatcgacgatggcgacgatgacctagggttccaggagcctggggccaccatcgccaccgtcgatgggggagcgtgcgctcacgcttctcgtcggagcctcaaggccatgaagcgagagcttctggccgcggcccctacccatgaggcgacgcggtggtcggaggttgccctcaccttcgaccagaccgaccacccgccgtgcgttgcccggggaggacagatcgcgatggtggtttcccccaccgtttgcaacgtaaagttggggcgtgtcctcatagacgggggtgcagccctcaacatcctttcccccgcagcctttgacaccatcaaggccccggggatggtgcttcggccgtcccagccgattatcggtgtgacgccggggcacacttggccgctaggtcatatcgacctcccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctccagatgaagatgccgggccccggtggccccatctctgtccatggcgacctcaaagtcgcgcttgcttgtatggagcagcgcgcggaccacctcgccgccgcgtccaagcccgagggtggcaacgagaggctcagcacctccatcccagccgccccgaggcagcggatgatcacgtgcgacgaggtcccggtcaagaaggttgccctgggcgacggcccgtccaagaccacacgaatcggtggtcttctggacggcaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccggcagaaagtgcggcggcaggccccggaacgtcaagccttcatccgcgaggaggtggcgcgacttctggaggccggattcatccgagaggttatccatccggagtggctggtgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatcgctagggaggatgaggaaaaaactgctttcattacccccataggaacttattgttatacgacaatgcctttcgggttaaagaatgcaggtcctacttttcagcgtactactcgaatttctttgggtagccaaataggacgtaatgttgaggcctatgttgatgacttggttgtgaagacgcgcaaccaagagaccttactctcggatctagcggaaactttcgaaagtctccgctccgcccgcataaaactgaaccccgacaagtgcgtgttcggtgtgcctgcgggcaagcttctcgggttcttggtctctgcccgaggcatcgaggccaaccccgagaagatacgagctatagagcggatgcgccccccagcaagcttagggatgtgcaatgcgtcaccggctgcatggccgccctaagtcggttcatatcgaggctgggagagaaggcgctacccctatttaagctcctcaaacgctccgggccgtttatctggacggaggaggctgagcgggccttcactcagttgaaggcgtacctcagttctcccccagtcctggtcgccccggagccagatgagccgctgctactttacctagcggcaaccccgcaggtggtcagcgcggcgttggtcttggagcgcgacgaggacaaccctcactccgcgcatccccaccctgtgtcgactcgacccgggagagagcagggaggagaggcccccgagtcgaacggcggcccgaggcccccgacggccggagttggccctccgcccgcttgtccgacggtgccaggcacccccgacccccaggatggccccggggccactgcgggaaggccgcgcctgtcgccctccgaccccgaggtcgtcggcacagaagccgagtgcgccccgcgcggcctctcggacgaagagcgccctggagatgtggcccctagcgaagaagatcggccccgccgaaaggtgcagcggcccgtctgcttcgttagcgaggccctccgggacgctaagacccgataccctcaggcccagaagatgctttacgctattctgatggcttcgaggaagttgcgccattattttcaggcgcatcgggtcacggtggttacgtcttaccccttcggccaaatcttgcataaccgagagggtactggatgggtggtgaaatgggcaatcgaactctctgagttcgatttgcactttgaaccacgccacgcgatcaagagtcaggccctcgccgactttgtggcagagtggaccccggcccctgagcccatctccgtccccgaggccagctcgggcccctcgtagctgcctcacaccgcctactgggtgatgcagttcgacggctccctatctcttcagggcgccggtgcgggggtcacgttgacctcgccaaacggagacgtcctcagatatctggttcgcctcgactttcgggcgatcaataatatggcggagtacgagggactccttgcgggactcagggtggcagctggactggggatccgccgcctcctggtgttaggcgactcccagctggtcgttaactaggtctgtaaggagtaccggtgctctgacccgcagatggacgcttacgtgcgccaagtgcggcgtatggagcgccattttgatgggatagagcttcggcacgtgcctagacgggataacgcggtcgccgacgaactctcgaggctcgcttcctcgcaagcccagaccccaccgggcgcctttgaagaaaggcttgcccagccgtcggcgcggcccgaccccctaggggagacggacgcgcctgaacggcccctgaggcccgtcggagtccaggcctcgggacccgaggggagcgctcccagctcccttagattggttgcttggatcgctgagatccaggcatacctcacagataagactctacccgaggaccgcgaagggagtgaacgcgtccagcgcatctccaagcgctacgtgctggtggaagggaccctctatcggtgcacggctaacagagtcctcctgaagtgcattcctcggaaacaaggcgtcgagcttcttgccgatatccatgaaggcgagtgcggagcccactccgcctcacgcaccttggttggcaaggcctttcgccagggtttctattggccgacggctctcaacgatgcggttgacctggtccggcggtgcagggcgtgccagttccacgccaagcaaacccatcagccggcccaggccctgcagaccatacctctttcatggccgtttgctgtctgggggctcgatatcctgggtccgtttaggcgggccccgggcgggttcgagtatctgtatgtcgctgtcgacaagttcattaagtggcccgaggcttacccagtcatcaagatcgataagcactccgcgcttaaattcatcaggggcatcactgctcggtttggggtgcctaatcgtatcattacggataacggcacccagttcactagtgaactcttcggtgactactgcgaagatatgggcatcaagctctgcttcgcctctcccgcccaccccagaagcaatggccaagtggagcgcgccaacgcagaaatcctcaagggcctcaaaaccaaaaccttcaacatcctcaagaagcacggcgactcgtggatcgaggagttgccagcggtgctctgggcaaaccgaaccacgccaagccgagcaaccggggaaacgcctttcttcctcgtctacggcgcggaggcggttctcccatccgagctcaccctgaggtcccctcgggccaccatgtactgcgaggctgatcaagatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgtgtccaaacgcgtgctggactgagcaagctctcaccaatatgggagggtccgtatcgagtgatcggcgtcccccggccgggctccgttcggctggccacgggcgacggcacagagctgcctaatccgtggaacatcgaacaccttcgtcgcttctacccctagtgggggtcgggtgtcaggtctcgggctcgggccaaccccgcgcccccccaggcgtgcagggttggccgggggctaccacatgcataaacttatatttttttctcttccgtatttcaataaaagcattttcgatttcctaaggactgtgtctgtgccattgtttcctttcgaagaatcttggcttgaattagcacgctcgtgctcgatcctgccctcggtggcccgggccggctaaaatcgccaaaaggggcccagaaccgagccgtgccccggggcgtggtgaactccgggggggaatcggcaaaggcccacaatcgggtcatccataaccctcggtcaccacattcccggcctggccagtctcgacacgtggatctccccaggcactagccccgacccgcgccatttgaggctaggacctaggcacgagcccttgtttaagctaagacacagagacacagaaggaccgtggcacagaccatcctcgtctcatacacacaacaaatgaaattgacacaaaaatttcctctttatttgattgcagattaaattagtttatacaagaagggggcccgaaggcctcagaagaagaaagaaaaagctatttaagattggcgggggcctgggggctcacgccgacgcgcccgggtcgccggcctcatcgtcgctgacgtccgcaccaccgtcaccgccctcctcgtcggagtcgagggcgaacgcgagccgaggggccgtaccctcgaagctgtggacgatgtggtcggcggcgtcccggacctgcgcgcgcgcgccatcctcggttccaagagggaactcgtccagcgctgcccacggggagaagtcagggtccctagcctggtagcttgccagtacgagctccaccgccccccctgcgaggtccctcgaggatgacttgatcgtctcctcgagctcctcggggagccgctggagggtcccggccatctctgagaggcgctgggcgaggcccccctggttggcggcgtatttcgcggtccgcccgccccagaggcccgcctgccgcccggcacggtctagacgggagacggcgtcccgaagcatgccgggccctacctcgcccgccaagcggagggcttcgacctccccggcggacgagtccagcgcgccctgcagctcggcgatggtgtgttcggcggctgcgaggcgggcggctaggtcgccgtcgcccgcggccgccccgccgctgcgcgctctcgcgtccagctccttcacccgcgcctcgaattcagcagcccgctgatccagtgcggccctctctgcgcgggcgccttccagattgaggcgcgcctgctcctcccgccgctgcgccgcggcctcggcctcctcgagagctcgctcccactcagtgagctcgtcctcacggaggcggagtgcggactcctcttcggcgcaggcggcctcgtgcgccgccagcgttgcctcccggatggcgacggcggcctcgcgacccgccagttccctctccttcgtgtccagggcgcgggcgcgctcctccagcaccgtggcgcgagcctcaagggcctcttcgcgctgccgggacgcgtcgagcttcttctctagctccgccgcccggctcccgtattggaggcagaggtcgtcctgcgccgcgttgaacacggcggtggcgatgagggcagtctcccgctcctcctccacctccctggcgatctccgccaggtccctacgacgggcctcgagctcggaggcgtgccggcggtgtgccttgcggcccgcctccaccatggcttccaccgagcgccgtccctcttcgacgcgcgcccacgccgcatcgacctccgcccgctctgcctgcaggacttccatctgggcgcttaacccgtccaacaccatggtgttcgcagcggccaaggcctgcaggaggggctctgcgctcagtggggcagcggaaggcagaggggagagccgcctcggtgtgggcgccgcgcggctcggcccgccgatcgacgtgccgaactcgggggcgtcccccgacgcgggctcgtcccgaacgtcgccagaggggtcgggcccgagcggcgcgcccgcggcctcgtcgtgggtggcctcggaagtcgttgtcgcctcgggcggagtcgggtcgggggcttggcaggccgcccggcgtgtgcgcgccgcctccgtctcccggacggactcctcggcccggcggagtctggcctcctcccaagcggcttcctcagcctggcgagcccggacggcctcctgggcagcttcttcggcttcccggaggcggtctgcggcttctcgccggtcagcttcccgcctccgggcctccgcggtcgccgtctcctcgacctcagaccggccggacttggaatggcgggaagggcgcgacgggatctcgctgaggcagaagaaaaaccagaagacgaaaaacgggtgagtgaaaacttgccttgggagatgggagaatgaatacggccgcagtgggcgcggggacgaacctgcgaggaggtcggctaaacgaccaccttggggggggagatgaggtttccccggcatggttcggtcccccccatcttgcggagccgcttcttttttcgctcctcctcgggctgcgacgtcggcacagcaccctccgggcgcctgctgctggcacgcaccgccccgccccctcggggaggagatggggagggggtatcctcctgtttcctcttcccccgggcgtcggcagggcggctgccccccgggcccccgtcacggggcccagaagcacgaccccctctcggggtagattgttcccccctgcggctcccgcccgcgccatcgtggcctcgaggagcccgctcccctgacgccccgaccgcctgcatgatggtcaggatgttggcgcgctctggatcgctgcagagggggaggacaccttgggggatgagggatgcctccacggagctgagattcagcacccgttggatcaccatcttgaagtcttcagggacccagtcccatttgaccccctggtgggtcctcatgtagtcctcggacccggtgtactcccaggcgccccgggcgcgccgctggagtggcgcgatccggcgatgaaggtaatcgccgtacaccatggtccccgtgagcccctgggatcgcagaccagccaggcggtcaagaacggcgtcgtagccgtctcccagatctaccggcgcccgccagctggaggcctgcgccgggggctggttcggaagtcggaggcgcgcttcgtcggcgagaggggtgtagaaccagtcgctcttccagtcgtcccacttcttgcgaaggacgcagggaatgtagcggttcagcaccggcccccgcggctggaagtagcagccaccgactaccgacggtggcgacaccggctgtacggtgaagaaccatcggaacagccggagagatgggcgcaccccgatgaacatctcgcacaggtgcgcgaagatggccaacgtcattaccgcgttgggggtgaggtgcgccatctggagatcataaagctccagaacatccatgaagaaagaagagaatggcgggaccagccctgccattgcaaaggaaaggaagaatacggaccgccccgggtagtgtggcgccgggcgtccctcacccagcgcgaccacctcccggccggtggcagattccggcatgaatcggcgcggcagcccggcctgcctctcgctcacgatgcgagaaggcggcagcatgctaccgtcgagcggtgcggagccccgtgccatgacgccagcggaggaggggcttgagagcgagtgagtgtggcgagggtagggcacaggaaacgagaagttagagcgcaagcggcgaaggcaaggggaataatggcgagaggaaggaaacgagtctcttcctcggcgtctttatacccttgccaacgctatgcccggctcctcgcttcccgggcccactatctcgccccctcgtttctcacgcccactcctccactaatcccgctcgcccgtttgcggtgcacgaggcggatgtgcggccgtggcagtcgagatgggacatatcgtgcgcgccgaccgatgcaccatcatcacatctccaggcgaaacgaaccggctcgtcccgattcgcgcgctgctcaagtaatgtagcggtcttgaagaaagccgctcattattgtcggtcggttttcccttgccgatgcgcgcaccactggattcctgcccgcctgtagagaccggccccgcctgtcaccaggcctaaggagtggcgtcacgcccgagcgctttcctcgaggagggcgatcgccctggcataacgccgggggctactgtcggtgacatgggaccgggggtatcttgactagaggtttggggcagctgcggtcacccacgtggcctgaccccctcgggggggtcgggcccgagggtgatgtggccgcccctccctctgtctccccgaggggttgggccgctcccgtttcggccccgagggctggggcgccccgaccccctgcgggtttggcgccacgtgtgtgggttaggtgagcacagcggcgctcacctaaccgcgtttattgcgggttggacgagcgccccacgccgcatttaatgcagcgcagcacactcgttcggtccgtgacaggtcatagtgtgtgaccggtcacagaccggtcagatcgcgggttgggtggcaacaggcggcctgtcacacgcctcgccccgtcccgtcagaatgatgagagcttcccggctctcgtccctagccggagccggcgtgctaactcctggagttggtacgtcagtcccggtcagatccattccaggcttcagcgcgagcatggcaaggaagtcgctggccattgaatgaaggttaaaatgggcgtccaccgggaaagctggcgagcggggcaggaggcgtgtgctctgcttgtcagaggtcacttccggctgtagactagccctcattgtaaaaagcatgtttcctttcttaggcagctagaggcccctgtggtgacccctgaccagataaaaaggaggcccaggcctaggaggagagggggactctggcggaggggttctggagcctgaactctctctcgctttcgagctctctgtattccttcacgcacagatccaccagaacacaggaatagggtgttacgcttctcagcggcccgaacctgtctacgtcgcccgtgtcttgtgcacttcctctctcgctgacgttcctcagatcgagggcgaagaacctcacttagcgcccccggccgaaccggcaaaggggggcctgcgcggtctcccggtgaggagccccacgctctgtcatccgtggtggtcagagatcatgcgggatacttaggctagagttgacgcacgtggttgatggagattccatatggcatacgatggaggtattgtgtgcgtatgggatgcggagttgaatttggaaggagtccaaatttggtatgattggttatgtaaagtttgtttcttgttctagagggtttcctaaggtgtttaggacttctagtatgagtttggttcgtggctttagactgcctatctcgggtataaatagagggggagtgtgaggcttcccggtatcgcttttgagagcaattgagttgagttttgagttagggtttcgagtttagtcgaaatttttgtaaggagtgatgtttgtgccctttgtaaacacagagagaatcaataaagtcgtcatccactttaagagttcttcaatttgtgtttcaccgggtttcggcggtctaaccggcgatataccggcggtcagaccggcggcatacgggcggtcagaccggcggcggcgatagcaagcggcagctgatctcggcagtcagaccgatcgatctacaccggtcagaccgacggggacaggcgctgtcagaccggcaggacaacttcggtcagaccgatcttcgtcgaattcgagggtaacttttatttccgctaaaagttttcggtttttgggtataccaaccattcacccctccctctggttggcttagttgttgtgattcgatcctacagtgacactcctatgggcaattaccttttgctagtgtctcgttattcttggggaaggacagtggcacattctcgtgaacttgcatatgttttcaatttgtcgatagaacaaagaaaaaggttgtatttgaactgataaattgtacttcaacatttgtaacatgttgataaataatatattccttagtctaccctataattcaacaaataatttcactcatctttcattctttcattcatcacttaatggtcgatatcatcttctgtgaaatccaacgcatcagaatcaactacgtagtacgcggggtcactaggcggaaaatcgcacacgcgggatcaccgctgggtttcctttccactttccttcgccctccgccaaatcgccagcgctcggtttcctttcccttttccttcgccctccggagggatcgccaaccgccgccctcgcacccccatggccccatcccgcgccgcccgccgccctttgctctccgcccttcgccaaacgccgccttgacttcgatccccctaaaccctggccaccgttgcccgcgttcaggtcgccgttcggaccccatcgcgccgcgtcgccacccggaccgcggccaggagatagagcagcggtagacgtgcggcgtcttcctccttaatccgtcacctcggtttcttagttcctcccaccatgcccctcccttccaaccctatctcctttaagcgccaagtcgccgcagcagcaacgaggttctcaacggggcatgttaaggtgatgtctcgtctattcctctgttcctaaatcctcaaacaaattaatatttgtgtgccaaatttgacttggatgttttgttgtttaatgtaaatctaaaaatgtttagcaggctctgcatgagatgagaggtcgactcaacgatggaggctgaaaataaagcttgatgttaagaacatggtagtcaatttgatggagttatatttacaaaggattatgcggaaaaagcatccgtacttcatttccttctgtgcaatgaaataaccaattgttctttatttcagccatttatgtatgggtttagtttgcgttggagccaagctgccagatcgtgtggtccctggtaaatctggagctttattttcatatctatttactctatgaacattgtcaaataactaactgaattatatgttttgcaagcatgctaaggaaccattaacctagcttatacggctggaatgtaattatatacatatagccaactgagtcatatgtggtcaaggaataaaaaagtaggaggaactaggaagagatgtcggtgctgtgttgatagtaaacatatgggtttgcccacttagtcaattcttctattgtgtgatttaagtaaagttaagtgaggaaaccatgcttagacatctctccccgtatggctgtatggctaatttgtttttaaaggcagtctgacggtaattgtacatttgtactgtcataaactcataatctatggcctgcagagacgcgtttgtgtcgcacacaagcatcccagtgcaaattaagacagcttatcatttcgatcgcttttaatttgacacctccttctgaaacttaattaattctcattagccagctataggatagatatagtaggtcgacacaaaacgatggagtatagtataactgcaatcagcaggttggattctatgatattactaaatggtgaaatactcaaaagtattggggctgtatcctgaaggaaaccatcctatttcatccaataaattagtttcgatatcttacaaatcgatctggttttgtcggtgtgtgtaaatggtgcatgtgcacgtatagcaaacatgagttggattactaatcttatatattgtcaattaggtaagtatagggacaaaaatctgtttaccagtggactggaaatctgtttgtcaaattcacttcaatttttcagtgcaaaatttatattttcagaccttttcttattttcttttcattccatatcaatgaaagtaatttatttttctgtccggggaaatttggtctcttaatcattcagcacttatcttcttgcaccgatcttataataaatcttctgcatccgatgtaatcacatttctgtcaagtcacattcgatacttattagatgctaataaactaaatctatatgtcaacagttacaggttgaatcaactaattttctgacagtagatgtgctgacgttcatatactgcagttgaatttaacttccaaatattactgccagcatccggcctcctcaacatcagatcagtgtttcaggtgtgtgtgtgtctcatttaaattagtcatcttttccggttcgaaattttcgctttgcaattggtatatatgtttacatcacaccctgaaatttctctaattcagaagaacatgtaaccatagtaagtataaaatttgcaagatatagatcttgatggcctggtgctgctaggtgtatgcattaattctgttgtgctggatgtagtttgcttgcctttaagattatatgattagttagatgtattttgttggcctactggatgtatgcattcagctcctgactcattcttgatttatttgtgcatgccggatccatggaagaatcggccactaaagtctaaactctgaaataaggtttttggtatatagtggcctatatattctgcacgtcatagatctttcatgtcacagtatttatgtaaaggttgattagtacacaagtacacataccttttttgttatcttgtagcatacaaagtttacacttaatcactacacaaaagcacttaagtataactttgtattatcttgcaagtcaccacactaaaccactaaaccactaaaccatcctatcaagagagagagagatagatagatagaggtggtgaggtgcggcaccgcttggatagatggaagctgtttcttttcctccgctaatcacacttggatactctggtttatggcaataatgagcaacagggcagccacgacatctgtaggagcataagaataaaaagcccagttaatcattgacgtttgtattcaacttatcgatgtctggtagtgctaatctccaaaacaatcaagatattttccatagccatatggatcataaatatgcatctgatccttttgcaatccctgaaatttctcttaaagaatcaattgcaaatcatgtattgtagttttctgaggtccgttggtccattgccaaatattagcaaatacgttatttagtcagagttatggtatccttgaaggttcaatgattggatttcctttattcatgcatcaggaatttgtgttggatgatcaaattgcagaatttttatgccctagatctatatactttttaatgagagagttgtatggtctattaggagtgaagatcaattcagtttctatcctagattgagcagagttaacatggtccatttttttatcataaattcatgttttcctgtctaatattttttttgctaccaactgcatattcaaatcaactgtaatttgattgcaccatgaactgcatagcattagcatgatccaatctaatctatggcctctaacatggtttagtgcaatctgtcatgaccttctgcttggtttcatgtgcttgacatgttctcctcagattgaaggaaaaaacgcatgtcctcccactaggagtggttagtggttcattcttgaggtatatactactcatcctcttgcatatgttagctttatagttcacatgttagggtggaatgggatcctttgcctgttcactggacgaaccactttggaatgttcataatcactgtttcctttttgtttgaatcatatatacatcccattatatgtttaattgtcaaaacatagatcatcttttgactgttttgcattaacaaataatgccataataccgttagcacgggcatgttactatcataattcaccaactagcagcatgatgttttgaacatctttaagaaatgatttatttataaattgattctgtccctcttatttataaatgatttatttccctgagtatgtattttctcgaaaaaaaccaaatgattcattttcctaagtatagtttggccttgatttactgtttgcccatttcaggttatctttctttttagcttagccctgataagtcgcacaaaactttctctaaattattttggcctcattcctaatggctacataaccatcattgaaaaaagtgtatgtgatatgtggatttgggtgatcttaccatcctgttggctttttacatggcatgagcgatagtgtgtaaataaaatcatttagtactctgtaagaatttatgttgcttgttcatctccgaatgggcatgtataacattgtcatcttacataaatactatgatttttaacattcattgtttagaagaagaaattacaaattcgaatcctactgactactgtcatttgattttgtatagcataccagaagaaacacgtgcggtaccacgtgattatcactggcttaactctttatgtaattttttgcttgaaccttaatcccaccccttctatggggaaatgtaatgcctttaaaatatcaaatgtcactatgacgttatatctttttcaatttgagttatcaattgtc

SEQ ID NO: 17321 - DNA, 2212 bp, Oryza sativa
acttagtggttaccattgttggcgtagtttttggtcatgccgcctacatgatcggtatcaacctaaagctttacggtgatatagagtcactaatcacctctagaagaaacctcctggtcaatatgtgtttagaagattaaaaccgactagtggagctaatttagacaaaaaggataaacactcgtctcatgagcggaatggaaggttttcatgacatatctacaaagaggacccgcactcttgcggtgaagacggacggcttacagcgtgacgacgaacatagatgaaattaggcaaaaagtagatacgatattgaaagaatgattcaattagccaattgtgttgtagtaaattgtttgtcttaatggaaccaaccatagctcttataaagacaattggtcttaccttccataggactctccaaatcctactaggtatataaaccaattagtactcgaaaaatctcagctcgagaaagaataccctagaaccgataaattagagtcggggtcggactcaaacggtctgaccggccaaatgccgctggtcagaccagccccacaccatcggtttgaccagccctatggcaacgatcagacgacatcgcacaccaaaccaatcctttccaaattcattcatatttttcctatttttacgtagatgctaaatttgagtattaacaaccatgtctcactttctagattcccattgctgttttcaccatataaatacttttctagaatcatgtttaacataagaagtatacatggtatactatctttgtccttttttttcttcacccatcgtataagctaaaaaaaatcttgtatcatcttaataatttgctattaatattatctatttctataatttatcgatttatcatcattctcaatatatcattagactgtatattttttaaaaacatacccaaaatactcttatagaaaacaagattatcaattattttatcccattatttttttaaaaaagtgacttttagccttcttacacaaccatgaagcatgcatataagttttaattttttttattgtcattttttttaaaaaaaagttaatttttgcgtataagagaatttactcacacaaaagataatgacacaatttgtgtatgatataaaagatgttttaaattaaaaaaaataacgcaaaaatgtattctatatagtatataacggataaatgcaaaaaaatcttgaaaagtatgcacaaaatttcatattttttaaagaggctatataaagaacatagtttttaaacttctgatgggacaaatcaactgttaacctgatgtgtattttgggaaaaaaaactgacaaaataacatattgcaaaacaattgataactcggcgttatattatacaagggacaatacaaacagcaaattgttgaattggactaaatcaatggcaaaagtagattctctcatccaggaagccccaagacaatcaagcgatgacagtggcgaattcccgtgagcttatagtattatcaattagttgagataacgaaattatatattgattgataaatattgttcatcaatatttgtaacatcttgggaaaccatatatgctttagcttttcttatttgaattgacaaacattgtagttcaataattgtcacccttcgttacaacctaatcacgtaatgattaaaaaaaacgactgcaacttccattttcaagtggtaagggatactgggacagtcacttggacaaagtataagagctaaaagtagacatagcaaatctacatttctatctttgttgttagcatctataatctgcttctccactggaggaactgtacgagaaacctgccctctacagtattgccgtgaacttacaaaatctcctcccaccacgctggcaatctcaaccaggactgcacacatgcgttcggaagaagcccggcggtctgacaaaatgctgtgtattggggaaacccatcttggtcgaaagaattccactcacgtgctccaaaaatggcaagaaacaagcttaatctctttatctgctgaattttgtatgcatcagtcttcgtcatcagctagcagagcgaatgaaaagggtctgaatttatagccatccccatggtagaacttgttcataaactcaacccagtgtagacgaagtgcatgaaggaaggcgctcaatgattccatccccagcaatataaaggcagtagc

SEQ ID NO: 17322 - DNA, 807 bp, Oryza sativa
cttaatgcccaaagccgaagatacgatgcagtattgagacagcgccaagtacaaattcaatggaatgtatcatttgatgcacaaaaacttcattaaagttgaagtcatcatgacgtgaccgggctgagtctggttcagaatctggatccatttctgaggtcccaagaaagcgataggtgtgaccttgaaacctctgcagccaggtatattagaaaagcaattcactagatagcataaccatgaccaaaagtttattgcttaatcaagatcacccaaaagatttttaacctcagctccattttcattaaagaacaattacagatctcaaggaaccttttccaactttttgtgtatggtgtataatctgaacattgttttctagatcatttgtcagtacatacaactatgcaacaagaactatttcttaagctgctatgtaaagcacctcaaccagaatcagccactcaaattcaacatccattcagatgactagcatcgcaaagctcaaatcctggcgctgcctcatggacagaaccaaggaggaagcattcattccatcaaccagcaaccaatctaattttgtcctggaccggttgctctctggaaagacgggatccagttttgactgttgttgcagtttctaaaaccctgatcatggtagatccacccaccaattttttttatggggttcaaatactctactacaagattttgcatggagccaaggaaataaaacactctaagccatggatcacatgcttaattgttgaacgcggtatatcccagagcatgtgcacaatatagcct

SEQ ID NO: 17323 - DNA, 13406 bp, Oryza sativa
tcctctcagagccattggcaacccatcacggactaggcattccaattcttccttccaaggataatgcccttcttgattcgcatcaacattcatgcctgaatcagcatcagcactatcagctacaggcccttcttggttgggatcaactttctctacatcatagaactcatcatcggagtcctctgagggtttgatttcttcattatttgcagattggagttcattcgctgcattctccttatctgcagaagattgcttcttcttgacacgcaagctcatcatctccccaatgtggcctaaggagggccttatttccgaccatatctgaatcttatgtggtctctgctgtttcactttctgttcgtctgacaatttggacctgccatcctcagctttcttgccagcttcttcatcctcagcggatggtgaaaccttggcatcctgatcctctccggatgattcatcgtactcagcttggctatccagaaaattcttccatctctcagatctctcctcttcctcctcctggagattatgcaatgcaactcagcgagatggaacaagaaggtaccaaatggaggcatcaccaggtgcagcttttctaccttgtagatgtttgcatactctctgtaccgttgcaagtgttgtggccgcacagcgaatccatatgcatccctgcaccatccacaatagcatcagaaacagaaaggagaatgccgctaatactgaaccgttggtactcgagttatgtaccacaagaccggaaccaatccaaattcatactctagtgagtttattaaaaagaaccaaaaattccaactaaaatttggtcctatcatgtttacaatgtctgcctcgtaaaaaatcgagttaatttgcttcgattgtagcggacatccacacaaactccgatccttccatggatcagagaagctaacacgattcaaacactcctttctgaggggagcaaaaaaaaaaaaactaatcacatcgtacacacggagatctaggactgcattgcccaaatttggccccaacatctcgcatcagatcgagatccccgcgcaaaatatcaccacgagaagaaaaaaaaagcaagtaaactacacgcaagcggaagtttcgtgcagcagaaacttcaaaaaacctccggcgaaaaacttccgaagaaacacatcagaaacagcaaacaccggcacgaacgccgagatgcgcgcgcgcgcccgcggcggcgggagacgaaacgaaccgcttgtgctccgaggcgatgaacgggaggctcttcgccttcatctccacccgcgccgccgccgccactgactccgcgccaccaccaccaccaccaactcctcctcctcctcttccttcccttcgctcgccggtggcgaggcgtgcagtgcagcggcgccgccgacgcaacgcgacgcgacgcggacggcgaagcgtgagcgagtgaagtggagtgtgaatgaatttagcttatcggcggtttggagggggggggtcacggctcggggaggcagcagcgccgatgattcgattcgatccgatcgccgtttactactactccgactcctccatcctacgagtcgtaggatttcgagatttgatctgtgtgcgtggaagcgtgaagctgcgaggtgacagattggggagttgggaaattggaggacaagtcttcacaactcgttgaatttttctttcgaccggttggttatttttttgtcatggagattggagagatggccagatggggactcgggaatgaccacccctcgtgggtttctcctcgtcgacatggacttggcgctgggcggggttcggccacaccgagatctcgattatccgtgccaagtggagctgtgttcgtttgtgtgctgtggactgtggagtgtagaggggcctgtggtgggtttttgtagagatcatttttaagttgggtattgatttttcttatatggatttgttgttggcgcatcgacatctggggaacacataaaatccatcattaagcttgtcttatttctatctttggcatactcactaataaagtatagctagtctttattgtggcatagtattaggagacaacctttaatagattctccatttgacatgtgatattgtaatgattttgtatcacctaacttttattgtttgatgaaaaatcttggatgacaaaaatgttgctgtgttaggatatatttgttgataaatgactaatttggaatataaatagtcaaatagaaaaatatcaaatgacaaattgacataaatgctacggatgtgcaccaacaaaagcaaataatacttcctccatctcatatagtgcgttattgttttatggaaagtttgacatttgtaaaacctaagatttatttaaatggggctgtctattgcaaaatttgacagagaactttagattttcctcgagttgcatcaagattcatacataaaaagtaacattatcctttctcattgtcttcttctctcctacatcgctcgacaatacaagaggagtaagctctccaacgttgcttgcatcggcccatcgtccccgcctgcaatgctcgcccaccatcctcctctattcccactgtttcggtaacactgtcttgttgttcgcccatgtacatcgctcaccgctacttcgctagcccttcactatccatggctatcattctaagccctagaaaaaaaaaccccttccccactctcactgtctcacaccctaaaccctaactagtcgagggtccgccgcctcgctgaagttacactactcattggagctggatgaagagatcaatgtgaatcatggcacggatctgatggtttaaaaatcgatagaactctccactaaatttctgtcacatggatgttagcaattccgttttaaaattttactcttaaaatttgatctccgccgatgcaagccagctgagcgctcaccaaatggtgcaggtgctgcacgccacaaaggatccatggtgtacagattatatttcggacgaaatgatgggtacgtgcctcctgcatgaagcggtgcgatgcatcaggcgagatagtagtaggaccaggcgcttcagcacagccagtgcagcagccttctgcaacgcttcagcgaaatgggatcgattaccctgcccgcctgccggctctctccggccggctttgcgtttttcccctctttggtactagaagtagtgagtactcatcacctcaaacttttacccgggcggctccagttattactgtaacagcaaccggatccataaatgtgtgtacgcttcgtccatttatactccgggccgtgctgcttgtcctctctgaattgaaccctctgtctcctctccctttgcatcatttcccaaagtacagcctggatgtgagtatgtgatgtgcatcgctcgttccggttggcatcaaccgtatccgtcctgatgttactccgatttggcaaccggaacaaactctagctgtcgacccgtcctctcgcgctcagctactttcatcggatcggaccaagctatctcgcgattcaccgatgaagacaggtaggagcagagcaatagaaggaagtgaaaagaattgatgagatggtgatcgactggcctcccaacaaacaggagacagggtacctgcagacctgcagccgtcctgacaagaaagtgagcacctaggcacgccggtctcctccttccttggtttcatcataaactgcaacttgagtggcaccccggccgaagtactcctatagcatccggttcaggacttcaggtggagctaacgggttccttttacttcgtggtgaaaacggagcacctgaattaggccctgtttagttccaaaggatttttttttaaactttcaactttttatcacatcaaatcttttatacacatacaacttttctatcacatcgtatcaattttaaccaaacttccaaacttcagtgtgaactaaacacagccttactgaactaccagtagtactaaggctctgttcggtatccccttttcccaacccctctctctcgtttttagtgtgtacgtttttcaaacagctaaacggtgtttttttaaaaaaaaagtttctataggaatgttgcttaaaaaatcaaattaatccattttttttttaaaaaaaagctaatactccctccatatttataaaggaagtcgtttagggtaatgtttaagtcagatcttgggaatataaatcattaataactctcaagttgttgagtttaaaaatataaaaattatatgaatagatttgtcttgaaaaatactttcataaatatatactgtcagggttacggataaggtataccctctattcttggacatacgttgtatactgatgcggtatactcgcgcgtatacggatgattcctgtgtacattaaggaaatctatcacgtgatagaaacaaaatttacagatggaatgagtcctactcggacaagactgggtctttaccatatcgtgaggggtccgatatctccgagtcctacttggagatcaactgacccgcgatataaaatggaccccctgggcaggacctaaggcatcgaatctcattgtcaacacatccaccacagcctacgaagctggagcctacaggagccaagtcgccgggtgatatagtcgaaccaactcgacaacggtcttgtcggtatcatcgagttctgttattccctttgtaatatgtggtttccatcatataatctcatatcaattggattagagctattaccttccaagtggcctgaaccagtataattcttgtcttttgtttgcttgatgtcatactacgtagatcctcataccagcgtaccccaataccctctatatccggtctacgggtatcccccgtcgacatatacatatatcatttttcaataaatatttttatagaaaaaagaagtcaaagttatgttttggagaccgtgtcgctgtcataaacgacttcctttacgagtacagagggaatacttagttaatcacgcgctaatatactgctccgttttccattattactgttgggaatgggaacagcatgtgcgaacacagcctaaagtccatactaggcattgtttagttaccaacttttttttttcaaacttccaacttttccatcacatcaaaacttttttacacatcaaaattttcctacacacacaaacttctaacttttccgtcacatcgttccaatttcaatcaaacttccaattttagcgtgaactaaacacaccccagcttatgctatgcttataaaagaagggtggtaaactggtaatgtaaggttgagtttagttcctaactttttctttaaactttaaacttttttatcaaatcaaaactttcctacacacatgaattttcaatttttttcttcaaacttctaattttagtgtgaaactaaacacagcctaaatatgcaactctgctgtgctgtagcacattaagcctgtccagtacgtatacgtagtactactaactactgctactatactagctactcaaatgacgaaacctacccgcttgattgtataggctgtgtttagatccaaagtttggatctaaacttcagtcctttttcattatattaacctgtcatacacacacaacttttcagtcacatcatctccaatttcaaccaaaatccaaactttggattcaactaaacacagccatagtccggtagtcccactggcattttcaccggtaatgcgtacagcagtgcgctgctgatcaggggaggctatggggttttcctgcctgtctacgtacgtactcacgacgtacggacgagctaatgctagcacacagagtaattcaggcgacgtaccgtccagatctcgatcgtgaggtggctggctggctgagcccgtcgatcgatggatcgcccagtgtcggtgggatagagtacgccgtggcccctcgtggcatgttcgcgcaaccggcgcggctcacgcgcgagtggttgaacgatgggcacactggtttagcacctagcaagctcgcacccaccacaagggacaacaccgccgccgtacatggcgtacagctagcggtacaggcacaccgcgcgcacacgaaccaccgcgaatacgatattgaggggtgcggcgtgcgccggagcatgcatgtgcttgtcttcgtatcacctgacaaggtcggcgcacgctagctagaaggccaccgtgccggccggccaccactccaccagcctaccgcggaggacggcagattgccgtaaatcgtaataggaacaggaatataaaaaaattccgttgccgggactcgaacccgggtctctcgggtgagagccgagtatcctaaccagctagtctacaacggaggttgctgcttgagctcggagattgctagtagtagtcagtagccccgacaaccagaccaaaataccaaccgatactgactgtcacactttgatagcgatcggaggtcaacttctacgaaccgctactgcacggcgcagggccttgcgacttgccgacagcgttcaagtcaaaggaaacattcagcattcagaatgctgaattcccacccgctcctttggctagaggcctgtgtgtacgtatgggtggatagcgagcccagattgactcgtgtcagctcatcaagataataagctagctcggctcaataagggcagtcccaacccatagtgttcataagtagtgtctatagtgccatgtcaataagacatcacaatagaaactacactctataacccatggtttcttaaagtgggccattaataaatatatcatctctcttctctaccaatcataattattcttcatctattatgaagacactattctctcccaatacataacttgatagtgtctagtgcataggttctcgtgttgaagctgtgtcttacatgagacccaattttttcctctcttcactctctctcttaattaatatagtgccacataagctaaaagtcctacataataatgtagttaataccataaacaccattctagatggagggttgggactgccctaagcaatcgagcccaaacaataacttggctcggttcgtaaaaggagctcgagctagctcattttggctcgcgagctactctactactagctgaggagctccacgcaagacaagtgcacaagtgtctgcctacctgcgtgcaaatgcgcaacgatgtgcatggcgatggcggcgctcgtcatgaggatgggagaaataaattacggttcagtaatttcatagcttgagtatttaggctggcctggaatggtcgtatggatggactgtattgtgatggggcctcaccagttgtccatattccctaataaaccaaaacggtttactatagagtaaaaattaatttataggtgaaacttttatatatttgttcgtagcgacttaaacaacaacactaaaaagaaactacgttgaaaatatcttaaaatcaactccaaaattaagtttaaaaaaattaaaaatttacttttgctttagcttattagcccaaccgataagggttattggttatttttcaactgtccttatgcatctagcgctcgcttagcatatttttctttttgggctattggacttgtgcatagctcgttgggctcgttaacttaacgagctaaactgctagcttggctcatcgaaaaattcaaacgagtcgagccgactcagtcccgagcggccgagccaaacgaagagtatggaggcggggacggtgggaagtgggtcgccaccttcctgaggtccatctcactgggccggcgaatccgcaggccggaaataggacggatgcatacgatatctgggccggatacatgcccgttagtgggcaagtcctagatcacgtcgccactggactgtactacatcacaaggaataagttcactttacatccctcaatttgttgccgagtccgaaatttgttccagtgcaaaaccgggtacaacacatccttcaacttacaaaaccatgcgaggtccctcggcagtattgtgcccagttttggctgatgtggcgtctacggggctcctttgactaagtcttcgtcccaagtggagcttacgtggaaatttgataaaaaaaaacccataggacccacatgtcagtttcatatagaaaataataataaaaaaatggtgggcctcacatgtcatccttactactctatcttctctctatcccctactctgtagtctgcaaggagcggtggcgagcagtggcgcgcgaagtcgatagggtggcgagcggacggagtggcgacggagagcctgcgggagtcgagatcgtccggggaagcaacgacggcaacgacggcagccttgtatcccgtcggcgaggtcacgctcggccattgcgcacctctcccttcgcccatcgccatcgagcccccacccacggcgcccggccatccccggcgaggagctctgtttttggtgggtgtcggcggagttggaacgaaggagggtcgttctcggcatcgatgtcgccatctccgatcctccaccgccaccgccgccctccccccctccattgccgacccctccccggcgtcgagaaaatcctcgcccgacctcagcaacaagaacgacgagcgaggagcaacgacgggaggagatagcccgcgcagctgtcgtgcttgccggcgacctccttctctgcctcttcctccaccggccacctccactgcccgtggcctgccgccgctccgccggcatgctttgaccgccatcttcgttggaggcgacgaggactaggacgacgacgacggtgcggtgacggctgtgaggtgacgctgtagcgcgatgaagaagaagagggaaagccaagaggggagaagatatgacatgtggggcccacgtgggccccaccatttttttagctgatatgtgggcccatgatttttattatttttccgagaaataattgtcacgtaaacgccacgtgggacggagacctagtcaaactagacacgtaggagccacctcagccaaaaccgccgagtcgtttacaccggttttgacagtttagggactggttgtatctggttttggggttcaggatgaaaattgaattcggtgtaaaattaagggacctctggtgtacttattccacatcacagcgcttggtgaattagctgatggattgacgtcccagggccggtgctggacgaccacggcccatgcgtggggctgtggccttggcgtcgcggtcgaccacgtatgtgcacggttcagtgatggatgaggtattaggctcggcggcgatccgtgtcgcgtgtcagcggtgcaacgaaagataaaaatgctccaaaatttaaaaatttccgttgccgggactcgaacccgggtctctcgggtgagagccgagtatcctaaccagctagactacaacggatcttgtttgataacgaactgccaagcttatatttccctttgtttctccaaacgaaaccctaaatatcctggaaaagagatactgataagtgctctgctccctatatccacaataattcagcatggtttcactgccaccttatataaaaccgtaaagcagctcgatttgacgtgcctaccatctctactataataaagataaaaaaataaactagagtagttatggacataatgcttgtctttcaaaccagtatcattgatcctcattgcgaggactatatcgaaatccgattgctttcctttcaaaaagagaggattgaatcgaagtcctaatcgactctttctttccgtgctagcaaaatgatcaaaatcttcagatatcatgttggtaggggaatggtctcatcgaaccggtgcactctcgctatttcaatgccaagaggaactatcaaaagcaagcttttagcgggcaaaataatcccatggtccaaaccattattgaagtttaataaactgacacatcagaagacactgccatgatctgcaggatccgctagctaccagaagttgttgctaagtgcgaaaagaaaggcaatgcgtttctgaataaattgcccgcgacaatcgcaagatgttctttttctgatgaaaagaacagtatctccaaacatacaaaaacgtcgtctttctctgcgttggaatcgtgagcaaatcgaaaggaaggaaaggaacggctcgtgctgagtggagctaggacaagttgaggaacagatggcgatcaggcgatggcgagccctacatgtcaagtgtgatccggatgctcccacgtgtcacccctgcccactgtgattaacgcactacctgcagtaggcaggggccaaacggttatggacagggagtcttgtcaggttactgtcagcgttttacctgaaaatggtaagggatattcttgcgcttctgcaggtttactgctgggtgaaagtgtttcccagtcgctttcccgaaggacatgatgtttcaacctgcaaatgcaattgtgctgagtgctgatcgttaattaattaatcaatctatagaatttatccaacttaatagtactatatttaattagctagattcgctacgttgaatgaccagctaacatcctccaccgaattccctatttcatttctctctgcatattgattgttctggttctacgggggcatatgtactagacgaatctttattagatatgaaaataatgaaacgacgcacgtcttcgagtgattatgatgtgcacagagtacaggtatgctgaaatatggatgcaacattgtgtttgctttcaagatggagcccaatatagctgagaaagataggcattgtcgcattgagttggtattatccatccaaagaacaattatataatcaatggccatcaagaataccttcttaatttgatttgagtttcaaacaagaaaaaggattcaaacaatctgatttgacaataatagctagagcccctttacttcatccagctttcactagaaatattctttgatatggtcactgtttagcagacagaaatgaactgtcgccttgaccaaatgaccagagagaactcagtgcgtgcatgcatgccagaagagtatgaacttaatctatcctggtggtagacatacgcccaagttacactagaaaaaaaatgctaaatttgattggattgcagtgccccattttattttattttttctaaaggttgctgttatcccaacttgctgatgttcaagcaaggaagtgcccatttcatgaatcctaccaaagccccaccaaagcatcaactgcaccctgtacacatgggcacatctccaatatgactaagatacgctaaccatctcttaattctttgtcacatttgcagaaccacatcttttctcttttgaaaacgtcggtaagacatatatagacaagatactcgtagctgtttgatattgatattgcacagtagtagtacaatctcagtggtttgtcaaaccgctcgttggaacaaaacttgtctttgccccctgggcctggaccgtctgcagtactagatctcattgagttctgaaaacaataggctacctcagggacaagactgatattttgagaagcaggacaggagcctggtatgccactacattgaaccggagaatcaagaccttcgttggtcatctctcttaaaaaggttcatagatcctaaagcaaaatatttttttagaggactaaagcaaattaaatttgatactgtaatatatttgaatattagataggggcaaatctttggccatttttctaactaaaacaattttggcctctatattaatcactttactttaatattcataaaaattttaacgatgtgtcggccaagaatggattttaatctattgaagggatgtcccctcatatatcttttttttctctcaaatataatgtaaatggtgttttttcgtttaaaaaaataatgtaaatgcggttatgattcttttttttttaaaaaaatacaatgcagagtatagtggcatcaatcactccataaaaattaagtttgaaatcgatctatacattgagaaaaaaaagagaaattcaggcaagaatagtgccaattctattcacacattggatttctgcatttcatttcatgaatgtacaagttaagtttagacacttgagaatctgtgaagtggtatatgtagattggatgagtgttgtaaacattttttttttgaatttctcacaaccatttaggtggtatttgagtgaacaagccgacattccctctagggattattgatttctctatttttttcatacgcttcgtgtatctctgtattaagattaagaaaatttacagcggttctctcgagcgacagagaaaaaaaaagagaagtagacaaaatgatttatctgtggtaccttaaatatgattttgcagaataaatgcctgttttagggtttaggtacaaaaacaaacaaacagagccggtccgaaagagaccggaccatgtgcctggtacatttaaagtatcagcctgtctactctaattccaaagtatcattttcattttttttttcactgaacctccacagagatgtcaaagcgtagagaatacaacaacaggaatgcatctgcatctcgtagactattagtttaataaagctccgtttccgtacttaaacaaatgaaaaaaaaaagttgattagaacgagagggctcactggagcagttgatcagagctagagtcgatgaactctggtctcctcccaacgtgcggcccattttcccggcaccaaattctgcgacgactcggctaaaatctgcgagacatgcgttgcaaacctccgatccatctcgtgatagatgcttagtactacatcatgccaaccgttcttctcccaccggccggcttgtggcatttgcagtaatcttggcgtataaacaattgcagcttggaacattctattccatgccatccaactcgttttctttagtggcaagcacaacgctgcatggctacgaattcgtcaagcctttccgcgtaatacacgtacaggagaatctctgataaccccttgtcaaagaataggagttagtgtgtgctagctagctgacctggaggaggacgatgctgtgtgatcatgtcaataaaaatcaatgcagttaggtgaggtaaagagaagaaactccatgaaaaagcatgaaagcttcctccccaaccgattgcaaaagggaaaaccaaacgaacatttgatcgatcgatcactgctcactgtcatgtcaaccaagctggcagccattgcaattgcaagccaagagaaggttgagaatatcagtagcagtggcacgtgcggctaacaaccatttctctttgcagggctcttgcttcacaccccatccggcttggcctccgacagagacccaccgacagcgagctccacttgttaaacgatgatgatc

SEQ ID NO: 17324 - DNA, 12636 bp, Oryza sativa
gggaagaaatgtatatgtctagaactctatacggcaccgtgcaagcaaataggcgagctaatcatcctgtcctactgtccgagcaatctttaattttttaattggaatcgtccgagcagtattaatgtcctatttacgtgcaagtacgatgactttgttattaattactgtccttgttttgtcatgtgctaatcagggttagtttttttaatcgattaagagcgagcatgcttggtaaagctctcctaattctgcactgtttaaagacgtcgcaatgatagatcataaagatgcaatgctccattagaaaatttgagacaagatttcagatcattggtggctttctcaaaagttcaggcgatggctttcacatttgtgtggcttttcagactaatttgataatttcaggtggccaccctttgccatatattaatgcgttctacaaagctacacacatgtcccaagcaaggtactggttactaccttgcgttagttgatctactgcactgcaaaactgtctggactagggccggatgcttttctggccccggaggcatttttgctgctgttgttgttgatcagaaatcacgtgttcagttcacacatcagtgatctccaccttgcaaagtccaggcatcatctgggtacatttttttttaatagagatcttttacagtgcttgggaggtatgctaggtaccttccaatgtattgcacatccaccgtttattttttgagtgataatttagaagaaaatcaatataagcaggggtagtttagtactttttatagccacaccatctctaacttatctcgtggaccgttttttataactaccctcgaagtaatcctcgtaattctaatctcctgcgctcgtcgatctaatcattacggcctcacagcatcagtgcattttatttgctgtaccgtctattcatatatagattttagtctaattaaaactactttttccatctagttaaaatttgattcttcataatgattctctgttacaatctacacgcacgagaagcaaatattttctatttaatccaagatgcaactttcattaaccatcatcggtaactatgtggaaataaattactttgttttagattcgtattgatatatacttcagttgattaactcataaagtaccgtacgtaaattactttgttttagattgaggcgccaaacgtcagctgccatcgatctgttgcttaggcgcaggaacaatacgcaccaaatccgacttgtttggaagaacgataaatctgctagtaattaatttgtgtttttctatctattgtaatattcgacacaaaattacctatttaactttgcacctaatcttttaagttagagagaattcactcagtaccactgagttcgttatgattcaacaatatgccactgactttgtcaacttccattatataccatcgtctttgctttaacctttacaatttaccatcacgggcacaaactgttaatttgcattgaagaaaagacaaatacgtccttatgatgcgtgaagaccagtagcactatgaccatggcatgtagggtcctgagagtgataataattgagagagaatgtacaacatgactacacatgtgaaaaatatctcaacatgattataaataataatgaggacatattataagtatgaataatgtacagcatgtgtgcaaggaaattcatccataaaaggtgcatagcacaatttgacagtaaggtacataatatccaatgtccaagttatgcaaggaaaaatcatccataaaaggtgaacattacaaaagctaaataaataagttacgtggaaaagatgttacaagtacatatcccaggatgacaattacccatcttggatttcaatggagagagcaacaacggcaatcggcaccgggacgacctccttcgacgacgatggcgcgcggcagcataggggcatcttctcccatcggcagcacaggggcattttctcccattggcagcacctccttcgacgatgacggcggtgctgacgacgacggcactaccagcaacagaggcgcaaggaatggaggagccggggacggcggttgtcgcggcgccaggcccgacgatcggggcggagagggggacggctgttggggcggcgccggggacggctgtcgctttggggacgacgggcggagatgtagcgcggcggccggcagagatgcggcgcggcggcggagatgcggtggccggcggaggagatacggtgcggcgatcggcagagatgcggcgctgcggcgggcagagatgcagcgcggcggcgggtggagatgcagcgcggcggccggcggagatgcagcggcgggcggagatgcggcgcggtggtggcgtggcggcattggcgctagccctaggaagggctcgaagagccgattgactgggcgctcgaagagaggattgactggttagggttagatgaatcaaagggtatttcggtcattacggaaaaaaaataacagtacaaacggcatatagatgactgtctgtggacggcgatggtaaatcgtagaggttaagggaaaggcgatggtatataatagaaatcgacaaagtcagtggcatattattgaaccgtgacgaactcagtggtactgagtggattctctctttaagttaactagctgggtggcccgcgcgattgcgcggctagcacccatttaaaattatctattttctaaaatgattttacttaaaatttattaaatagctatctcgttgttttaaaactttaaaagaccaaaccttattatccccgtgattctaattttatagttcaaagtcataccagttgttactccttacttcttcgtcacctccttccttatttgtttgctcgatctaccactgcttctattctctctctttggaatctttaaaaattactccctccgtcccaaaatataagcatttttagctttgaatctagacaaccatgtgtctagattcatagctaaaagttgttatattttgggacggatgtcgtagatattatttagatatagtttattatcatcattgagtttcatttttatatttttttagaagtcccatcaaacgttgtcactgtactcctgtatgacccatccgttgcctgggattttaaaaatcaaacatgattatcgtttagattcattttttactttctagaagtcccaccaaaccatcactggctttgccactgtacttctctatggttcacccgctacctgccctctttattgtccttgagattttaaaatcaaacatgattatcattggggtttattttttatttttttcatgaccgtgttgcttaatagcctatccatcgtccttgcttttaatcgtcattggattatatttggggttttgttaatagtttttagatgtctcatcaatcgttacaactgcttctattcattctctttggaacctttaaaaattggaccttatagtttttagagtttattatcttcattgggtttcaattctattatttttggaagtcccatcaaacactgccactatactcctttacgacccgtccgctgcctcatctctttattgtcattgagatttaaatcgaacataattatcgtttgtgttcatttttttactttctagaagtcccgccaatcatcattggctttgccactgtgctcctctacggctcgccgctgccttccctctttattttatattttttggatgtcctgccaaatgtcgtgaccgtgttgcttaatgacctttccgttgttcctactttcaatcatcattgggattctatttggggctttatcaatagttttgagatgtcccatcaaccgttaccactctactcctttacaggcatgttgcttctcccatctttattatcagttgtcatatgttttctagatgaattttttgtttgaaaattccataactttcattccgatatttttttatttagaaaaatatattcctactttaactcttataattgggtagcccgcgcaattgcgcggctagtacccgtataaaattattatttttacatatgattttatttaaaatttatcatttccatgtttctaatttaaagtttttaaaagtcacgttagttgctacccttgctcctctgccacacctttatttgattgcttgatctatcattacttctatttatcctctttagaacttcaaaaattagaacttgtagttttcagatttgattgtctcgttgggtttcatttttataatttttagaagtcccgtcaaacgtcgtcaatgtactccactacggcccatccactgcatcctctcttttttatcattgggatttaaaaaaattgaacataattattgtttgtgttcttttttactttctagaagtcccaccaaaacattaacggcttcgccactgtactcctctatggcccgcccatagagatatttaaaatcgaacatgattatcattggggttttactttttataagtctctccaactgtcataaccgtgttgcttaatggtatgcccgtcgtccctcctcttaattgtcatttgattctatttcgggttttgtttatagtttttagatgtcccatcaaccaccaccactctattcctttacgggctcattttttctcccctctttattgtatttgtcatcgtagtgttctaaatggaccttttttttttgaaaattccatatttttcattccgatatttttttatttataaattatattcctacttcaactcttataattatttttctattttcataatttattttatttgttataccgaattttcattaatctctctatatggtctcttctttcaataattcttttttagtacaaattttagttatttatataatgtattccactctcatttttatttttgtattttcgtgtttttttattttgaatgtcaattactctcatgtcgtgttcttatttggagataaattatattcctatatgaactcttataaatatttttctattttcagaatttattttatttgttattccgaattttaattaatctctctctctatatagtctcttctttcaatagttcttttttattgcaaattttagttatttatataatgtattccactctcatttttatttttgtattctcatttttttattttgaatttcaattactctcgtgttgggtttttatttgtactcttctttcaacattgcttatttttaatttcgaattttagttattttactacttgaaatcttctttttgttaaaaaaaattcggattttattttatttatattttaaattttaattaatctcatattggattgttatatagactctcctttcaatattgcttatttttaattccgaattttagttacttttaaattgtatttttacttgaaaaattattttttgggttaatgtaggaatttatatccctcataacaagagtagagtacaaagagttagccgaggtaattgaataaatggaccagccatcaaatatatctatttctctcgtgtactggtcgtaccttctctttctttggctcctatttcttcgttattttgttggagacggcagatggaaactgtacgtgctgtgattgctttgtagtatctttttttttggtagctagccaccatagcaatcggacataaaatcatacacggacatagcttttttccctagattcctattacaatttttgtttcctagtcctagtttggtaagaaaagtgtatctgctgctggccaatttctataataaacgtatctgtatctgattaccatattaaaacttctatgctattaaatctcagcccttaaaatttagacaactaagatctaatggtgtaaagttttctctttttcttctattaatgtgagaatttctagccgccacaacgaacgtggtgtcttctttcaaagctgttttaataatataatagatagatagatagatacctggcccacattttcaagtacccacccacacataccttctgctatagatcgttggattgcatccaatcaacggatgccatcattcccaagcaccatagcaggtctctttttaataaaaaaataaagaaagatacacacagatcatcattccctctgtaaatctgtaactccatcattccatcaggaccgaaataaagctggaattcgcttgccttagaatcaaatcaagcctgaacctccggtcatcccggctgctgacagtaactagtggatgtgagtaaaaaaaatcaggacactggccgtcgagtgaacggaatttacccttgagattctccggccgaagatagtgtgggccttgcacgcgatagccactgtaaaacatcgggacaaacctgtcacctgctcgaacaagctaagatcgcgccatcgtgtggctccagcttctgcaaacaacaagggaccgtatattcctggagctagatttttggctgtgtatgtatgtagccaagcaacccttgttcaagtacaaaacgtggtacatatataaatgcaatcttggtcgaaaagaccggcgatttggcgtgtatatagccatcgcggtaatgacatttagccaagctattagtaaaagtgaacatccttttcagagggaacagcaagtgatgagcaagatggtcagtattgtaccaagtgattaaaaaaatgaagaaatgtttgttaactaaaaacgagatttacagggaaagtcatccctccaaatatattttttaaagaagacattatgaagttgttttactaaattggtatatattatgagcttgttttttttttgcggggatattatgagcttgttgatgattgaacatgaaactttagacttaaaatcacacattatttaccactgtgttaagtgtatctaatcgttaattaggctagcgatccggtcgcttttggtttatttttccaccctccgatttcttccggtgcctgccagctacctgcggcaaaggccaccacacgacacgcaccaacagacccctttccggcgcgggcccactcggtcaggctcagaaagaggccagccaagttgccccacctaacgcccgcctccctgagccgtccgttccccatccgatgtcccaccacccgcccacgtgtccccccttaccttgcctgctcgagaaggcaaaggctcgcgatgctacgtgagccgtggatcttgtatccgacggcggaaatctccccccgcgcgcagcagcaggcggtgcacacgacgtcgtcgcaacggctataactggagacgacatccgcgcatgttacccgccatatctgtctccctctccccttctcatctcccgagaagtagtagtagtagtcgtctagtagtagtagcctaccaccacctccctcggcgagcgggtcccaccggccaccgtccgtactccggtgagccggcattgcgtgttccgggatggcgtcgccgtacgaccaccagtcgccgcatgcgcagcacccgtcggggttgccgaggccgccgggggcgggggcgggtgcggcggcgggcgggttcgcgcgggggctgatgaagcagccgtcgcggctggcgtccggggtgaggcagttcgcgtcgagggtgtcgatgaaggtgccggagggggtgggggggatgcggcccggtggcgggaggatgacgcggatgcagtccagcgcgcaggtggggctccgggggctccgcttcctcgacaagacgtccggcgggaaggaggggtggaagtccgtcgagcgccgcttcgacgagatgaaccgcaacggccgcctccccaaggagagcttcggcaagtgcatcggtgagtccccggcccgcagcttccatcgatggtgcgatccagaaacagatagccgtaaattcagttccaaaagggcgattagttgttgctaacaagaacacagcagaaatatctctgattgaaggaatattgtgttggcgccatctttcttgttttctgtcaatcatttttatgctccgcaacagttgtgtgatgatgccgtgaactgttcatctttgcccaaagagttggcagggacagctctgcctaactgagatcggctctttgcttctcaactaatcccctcgaattaatgcttttgctttgcgaaatggtccattattaagcagtaaatcggtacagcaaaagaaacgagtactctgtacttctcttttgttattgcacatgcttacggagaaaatggagttatagcgaccggttcatgctggaggcagttaggcgatcgatggaataataatcgtgtagcgctaagcgaatcatttctctttttagatagtttggatgtctaacaatgcccatgattcatgatcttttaattgaactaagaaaaattaatccatggtggatctgcttggcatcaaaaggcatgggggactccaaggagttcgccggcgagctgttcgtggcgctggcgcggcggaggaacctggagccggaggacggcatcaccaaggagcagctcaaggagttctgggaggagatgaccgaccagaacttcgactcgcggcttcgcattttctttgacatgtaatggttcaccgtcccagttataatttccaagatgaacacgataaatcgatcgccaactgacgaaatggattttttttttccttccccctctctctgatgcatccaggtgcgacaagaatggcgatgggatgctcacggaagatgaggtcaaggaggtgaggacgaaagaattcttctggattggatctcatctgccattctggaacatggagagagaggattaaatatcgttttcttgtttggctggaatggatttgcaggttattatactgagtgcgtcggcgaacaagctggcgaagctgaagggacacgcggcgacgtacgcgtcgctgatcatggaggagctggacccggacgaccgcgggtacatcgagatctggcagctggagacgctgctgcgcggcatggtgagcgcgcaggcggcgccggagaagatgaagcggacgacgtcgagcctcgcgaggacgatgatcccgtcgcggtaccggagcccgctgaagcggcacgtgtccaggacggtggacttcgtgcacgagaactggaagcggatctggctcgtcgcgctgtggctcgccgtcaacgtcggcctcttcgcctacaagttcgagcagtacgagcggcgcgccgcgttccaggtgatgggccactgcgtgtgcgtggccaagggcgccgccgaggtgctcaagctcaacatggcgctcatcctcctccccgtgtgccggaacacgctcaccacgctcaggtccacggcgctcagccacgtcatccccttcgacgacaacatcaacttccacaaggtgatcgcggcgaccatcgccgccgccaccgccgtccacacgctggcgcacgtcacctgcgacttcccgaggctgatcaactgccccagcgacaagttcatggcgacgctggggccgaacttcgggtacaggcagccgacgtacgccgacctgctggagagcgcccccggcgtcaccggcatcctcatgatcatcatcatgtccttctccttcacgctggccacgcactccttccgccggagcgtcgtcaagctgccgtcgccgctgcaccacctcgccggcttcaacgccttctggtacgcgcaccacctcctggtgctcgcctacgtcctcctcgtcgtgcactcctacttcatattcctcaccagggagtggtacaagaaaacggtaaaattctcatcaggcgctcgatcttcctgtgactgcaatgaaattaagtgacatcatctcaaaatgtcaatcttgttcctgcagacatggatgtacctgatagtcccagtgctcttctatgcatgcgagagaacgatcagaaaagttcgagagaacaactaccgcgtgagcatcgtcaaggtaagcagctgactcatgtaactgggatccattctttcttagctgtttgcctgttactcataaaattggtgatgtgggtgtggcacatgcaggcagcgatttacccaggaaatgtgctctctcttcacatgaagaagccgccgggtttcaagtacaagagcgggatgtacctgtttgtgaagtgccctgatgtctctcctttcgaatggtaaccaattcacccttgtcgcatgaatgcatgtccaaaatgtggtttatctgagactatttctaactgtttttcctgcctttgcaggcatcccttctccatcacttctgcacctggagatgactacctgagtgtgcatatccgtacactaggtgactggacgactgaactcagaaacctgtttgggaaggtcagttgaggcagcacagctgcaaagagttgcaagaacaattagtttccctcgttaaacaattctaggagaataatgcagattgccaaaagatggagaactaaatcttagtattcatgtaggcttgcgaggcacaggttacttctaagaaggctaccctttcaagacttgaaactacagttgtggcggacgctcagacagaggatactaggtgactagagaagctcttctatttcacctaccaaatgcatttggtctacaatcattttctaaccctggttatcttcacaatgttgcttcaggtttcctaaggtccttattgatgggccctatggtgcaccggcgcaaaactacaagaagtatgacattcttttgcttattggtcttggaattggtgctactcctttcatcagcattctgaaggatctgttgaacaacattaaatccaacgaagtaaaattcttccctgataaatagtgtttccttatttcctacaatgttgtataactggaggaaatagataactaaaatgagttgatggcaacaggaggtggaaagcatacatggttctgagataggcagcttcaagaacaatgggccaggaagagcttacttctactgggtgaccagagagcaagggtccttcgagtggtttaaaggagtcatgaacgatgtcgctgaaagtgatcacaatgtactgtctcactctcaattcttcgctgtattttcaaatttccatagttccttcagtcatagatagaacataaactaatatatgtgggaattgcagaatattatagagatgcacaattacctgaccagcgtgtatgaagaaggcgacgcaaggtcagctttgattgccatggttcagtcacttcaacatgccaaaaatggtgtggatatcgtctccggcagcagggtattcgacatcttccccctcttctatctgaaatacttatttatttccagtgtattcctcttatttctgattgatctgttgcagattcgcacacattttgcgaggcctaactggagaaaggtgttctctgacttggcgaatgcccacaaaaactcacgcataggtgagcctcttttttcagcgaacatcgtcgatgcaacaattttgagctttgcagtaacggttgttaacaaatccataaatatgcaggtgttttctattgtggatcccctacactcacgaaacaactcaaggatctttcaaaagaattcagccagacaaccacaactagattccacttccacaaggaaaacttttaagaccgtaccaaaggacgtctaaacagactgcatatacttgtataggaaagaaatacgatagcattgggatagcaaatatagtcttacaagttttgctctacgatggattgtacaaaatatatgttgaaagctagtgtcaccatcgtgcatagattctggaatgtttacagatatatgtattggaacagtgggaatgcatgttagaaaaattgagttccaggtggtgcgccttgagcatgcatattttctctcttcagtctttctgccttcgccagtttttctgccctgactgtctgtgcattgcgtataagaacactattttgtggtgtgcattcagcactttgagcatttccagacaagttcctgttttttggaggcctgcctcttcttttaggctgagtattggcaggaatagttgcatcctttcgaggatacatagttgcatcctttcgaggcctgcccctttttctaggttgactactagcgttaacatatgcatcgttggatgtagatgctggaaccaacgctagtaagttattggattgatgttcatttgccgctccagtcatcatctgatcttccatagcattgtttgtgttgccatccgttatagcatagacttttcttggtctacccaccttaggtttgaagacaggagctgtattttgaagtgcgaatttatccgaaataagtgttttcagcgggatagttatgtccaatggcagcatgatctcctccacttccttccactcgagatcctcctggtctccatcttgatagacaacactgtaccagttactttcactatcatacttgtccactttccctacaaaatgcttgtccccaaaaggtttccttactttccgcccttctagaaattcaccaaaacgatgatcaacaggaggttctgcagcattacgtggctcaggttgtgattcggatgctacatcaggaggcaagtctggaactccattgataatgacggcaggctctctggcaacttt

SEQ ID NO: 17325 - DNA, 1358 bp, Oryza sativa
ttatatctagggttttgtgcaacttcgaccataaaatatggggttttctgaaatttactctattttaaatgttatcattctgagaaagatttttgtcaactgcaagactatatgttacaatctctttttttttgtacttgatctaataatatatctagctattatattatctcgaaatatgcttaatacttaattgctatttgaacatttcagtccttcgagtttgggatgtgcttctgtttgatggaaatcgcgtgatgctctttcgaacagctcttgccctaatggagttgtatggtactgggtcgatcttttgcatttttgtcgctcaaacaattgtaacaaaaaaaagtttgtataatctcaggatatatattggtcactgcatgaatacttaccactggtgttggttacaggtcctgcgcttgtgacaacaaaggatgctggggatgctgtgacccttttacagtctttggctggttctacttttgacagcagccaacttgttttaactgcatgcatgggttatcaagctgtagacgaagcaaggctgcaagaactgcgaaataaacaccggccatctgttatatcttcaatggaacagagagcaaaaggtcttcgtgtttggagggacaccaatggccttgcgtcaaagctctataatttcaagcgtgaccctgaaccattggtgtctttatcaacagaacaattaagtgacttgacagaaactagttctggaagtacagatgacatgtatagtggcctgactgtcaacactgagattgattctttgcctgatccaaaagaccaggtatccttctcaaaataacacttctttcacccctaaaattatcaattatggtttcaaaaaaattcagcagacaaactaaataagtcaaaaagtcgtgtataaatatttaatcaatactgttctccatgttataagtgcatacagtgtcacgcatgcttaggatttcaggaaactgtttgcatccattcttttcatatttttggcaaattttatttggggtagaggacgactggtgagataaacaagatgcattattatccttatgctcttgatagggcaaatcagttttttctgaagtagacagcttgactacttctgaaagcaaactgctttggtctaatattttgcatattcaccagaaaatagcttctgtagggattctttatggtttatttctccatattcacaatatgaggattgagagctcatggcacaatagagctatagagaatagatgttatgatttgttttggttatcatttaaagaaaatagaatgatgtactattgatgggttccttttgttgttttagaatattggttttggtt

SEQ ID NO: 17326 - DNA, 3147 bp, Oryza sativa
cagtatataacatatattaatctatagctggttgaccatggtctatttcatggcaattcctagcagattctggttcatgtgtaagtagttcattatatctaaaagaaaaagtgaaaacagttatgatttgtcctataggtggcccaaaaactcactcaatcttttatggtttcttgagaaggaaatagttgatcctatatatcaactatgagtgtactcaaggtggtcgaaattacacaaattatccgctgaaaaccctaattttgaccgggccatgaacctgtgacctttggtttataaaagttgtgctgaactcctcagccaatgaacgatgtgactggttgaccaattgtattttcaggtgtacttaggtggtattctcatgttcccatttttatgttgccaagcaaatacttagtattagctgctggaaattcacaaacaaatgctaccattgagggtttgctaaattgttcttgcatcttctcatccaaatccagggctgatgaattagagacagcgctgatggagatggttaagcaggataataggcgggaattaagcgcaaaggttagcattgaactactgttttctatggcagttgcattttttattccatcacctgttattatttagctctattttgttgcctctactgttgaattcatattgctgcgatcttgtgttttaacccaaaaattgtgaaataatatctcctttccttttgataaccaatttatcaactaggaaactcatatatatcattggtccacctcactgaatggacatttattgttttcctggaggcttggggcatggttgttctcatacttgcatttccatttttataggtcgagcaattggaacagaagttatctgatctaaggcaagctctattagacaagcaggaacaggagcaagcaatgcttcaggtgtagtagctaccaatatgttgctctgaataaaccttgtcactactacatcatgccttttactactggtttatctagttataaactaactaggtaatgcatgtaggtcctgatgcgtgtagagcaagaacagaaagtcactgaggatgcgcgcatattcgctgagcaagatgctgctgctcagaaatatgctgcacatgtgctccaggttagtttaatttcatcgattatctatgtactgtatttttttctgttctaatgcttatgtcatgttgaaacatgaaatggtcattcttttcttgattgcacctggaggacagcactgtttctaataatttcctctgcaatggattagccaactagatatgtttgtgtaactatatgcttcattagtctatacattatttgaactctgtaatgcttttattcatggaatggactccattttgctgtcattttttttgacatataatctagcaaatacatgcctgttcaatataatgattctcttgttataacatttgactttgtatgcaggaaaagtatgaggaagctatggcttcactagcacaaatggagaacagagcagtcatggcagaaactatgctggaagcaacactgcagtatcaatcaagccagcaaaaggcacaattgccatccccttcaccttctccaaggtattatggtattatagcattctacacacactggcatggaaagttggaaactgataaattaatttattgaatgcaataatatatcctttctttttatggtatggaagtgttggtatgctattacataaatgcaataatattcaatactggcaaaatgttctgtgaaaaattccagtcatttgctttataccaattgtccctgtgtgtaacctttttatttttaggacaccaacaagggatgcatcacctggccaagtgaaccaagattcatcacaggagtttcaacctagaagaataagtttgcttgctccgttttcccttggctggcgtgacaagaacaaggtaatttttattggaaagtggattactggattcctttcctgtgtagtgacaataaatctctttctagtctaaaaaaactcatagtccagcatgaggaccattgcaattatttatatagcagactgcaaagatggtgaaatattttgatgtcttttacctttatgattgtgatcaagcagtgtgatccatgaaatgtccttctatgctaattgttactaatggtcgttatattccgaacaataatccacatcatagttaaatttagtttaccatatcacttaaacttcttatctattgatttgcatcaacttgaccattatccagatatcatagttaaatttagttgctgatttaaactatagtaccaaggtaggctagagttttcccctttttttttgggaactgacttcacttgctattgtttcttaacaaacatgttgaatgtaacctggtttgtgacttatatctggaaataacattacttgtttacaaaccctctcaggcataatattgatcgacgcatttctctcgtcttagaagtatatggctttaaacaatgagatatgaattgctatgccctttattatttcgtgatatcaatcttttttttgacacgttgtgatatcaatctggcgccgttgattctttacagggcaaacagaatatctccgacgagtcaacaaacggcaatcttaatagcaatactgagcaaatggttgacacacccaagaaggatgatgaaaagcaaggagactctccacaggagggtgaacaaagagtggatacacccagaagagatagtgagcacagattagacacgccggagaccacaataaagttggaagaacagttggaagaaataaagttggattgataatcacaagcccacccatcggcgaatttttaccaatatggttaactactgccgtggtattaaagggtagttcaagccacaatctacggccaatataaaagtatgtgttgtatttattctttttatttattttctcctactcccttttccttcttaattttgtctttgttttgcaaccattttttcctaggtttatagatttaatctttttagccacgggttgatgggagagaataaattgtgtttattcattcaatcaggatgagttgtaagttatcgataggcacatgaaaaatgtatgaaatgaatgaatctaccagca

SEQ ID NO: 17327 - DNA, 16508 bp, Oryza sativa
agttttagtgctactgtgctgtatatggctgtggaagctggaagcatggaatgaccttggcaattttcagcagatggtccagatattactatggagccaggatcaaaatgatcttttgataacaggaaaatatagagacttgctattggtcagttcattgaaaataaggaaaacattttaatggccaggatcgcttcaagattctctcctcactcctgcgttcggaagacagtcttcccaacccatggtgcgcacacagaaaacggagctgtccattagcacgtgattaattaagtatttgctattttttttcaaaaataaattaatatgattttttaagcaactttcgtataatttttttttaaaaaaaacacactgtttagcagtttgaaaagcatgtgcacagaaaacgagggggagaggataggaactggcaatgccgaacacagtctcgtggtgccacttgtgtactgcggaccggaatgaaataacgagaagcccaccggtcactcctttcctctcgttaacaacatcctcaagaagtttaagcaggagaatggaggaggaagacgacgacatttttacccaaaaaatttgtagaatgccttgaaggggtacatagtggcatatatcaaataagaaaaattataataacatgtttacaaattgatgaatagtaatgatatattttaaaaccgtgaaaattataatggcatggacccaattaacctaatattgtttgccatagaaagatgattttgtttactgatccgattgaatgatagcaacgcggccgcggctttaggtgcggggctcacgcactgcacgtgcacggtggtggtttgagtggcatagtgcagccatcagcacatcagtgtcccttccccacagcagaggccaccgcaaaaggagccccaccaatcaccaccatctatcgatgcaccaaccgctcctcctaaaacacgcccaattttgccatgtgatccatgctttcccccacccccatctgctcccgcatgtgggccaacaaaatgtaaagtagccctacgaatctataagtatcacgtgacacggtctggagtgcaataatttggagtcctctctctaacagcttctgtcacagacagatgggtcagtgagtgactttacgtttctcctaccgttcatgtaatcatgtttagcacttagtactctgatgctaaacaaattttcttagattcttcgatcctcagctgtagtgcctaacagcgcaattcaattaattaactcaaaatctaatgagcacttagtgtaattaattaattcaaaatctagtgagcacttagatcttgtttgttttttcaactccagactttagttttcttatttttcattagtacgttttttaaattgttaatgatgcattttaaaaaattctatataaatgttgtttttaaaaaaatcaaataaattatctttttaagtttataatagttaatatttaattaatcatgtgctaataaactttcttctttcgcatgcaccgaatatctttcttcaaactcatctaacgaacgaaacccaagcatctagcatctctgcctacatatcaataaactaattgtcaatttgccatgaggtttaaacttcttaagtggtctaatcaccacggggttaaccaaacctaatcatggaggctttaaagatgacccctttcccccccaaaagaaagcggcaaaatggtgaggagtgagacttgtgacaaagttgtgagttgtgactcagctcacactctcaacagaagcgcaaacaaacacatgactaaaaacaaaagtgaaattattgcgggaccccaactgacagaacatgtgagtaatcaaggataaatgaaaaacgcgcaaaccaacgccacatggctaaaaacttccgctataaatcagtggtgccttgcacttgcacactccatctccaactctccaagccagcccagcagcactctccttctccaggctccagcaaacacacaaaccacggaaccaccaccaccaccagcagcagcaacagcagcagctcagaggagaggagaagagcaagttaaaacaacttacaagcaatggagtacagctatccctgcaacagctgcagctgcaacaaggagaagaggcctccgctgaagagggggcagctcaagctgcagatcgccaaggccctgggcagcctcgtggtgcccggaaagaacagggatcacagcttcaggagatgagcgtcgtggtgccccggaggcaagaactgggagccacagctcaacacttgagcagcagcgcctgcaaactgatggaagttctggtgtactacggtggtgggcataggaattgtgcatagttgttggtgtgtagttttcccccctttccgccccgtagcgtatggcttgagacttcgagagtatctcgcttcctcggcaattgctttgttcttgagtgaagaaatagttagggagagactcggaggtgtgttcctggcagtctcatgtctggtttggtaatgtactgatgtgcagcataattttgatggtaatgagagtgttattagtacttccttacactgttactagtacgtcgagatgcagctgcattcgtatacgtacccaaagtctccgtctccagcctccaggggctccatgttccgtagccatcggtctaaagcccctccgctccgccaccgcttccgctatcagcccatctgccgagcgctaactgccatgatagatcgccagatccttcgagttacccggtccccgctggccgctgcgccttccctgacgaaggcaccgcgccggcgggttgccttcattctccgattcgctggttcgctgcacggatttgctggtgtgctggttcgtgcgtgcgcgccgctgccatgaccacggtccatgaatccacggggaccacggggtacgcggacgcaagtagcacgtgacagcctcacaaccgattgccatcaggcggtgatgtgcacggcaccgtgcgacgagtcgggattgggaagacccacatgtcagttagcgcagtactgcagggcattttataattggaaccaatgaatgaaccgcggagtgaagtgatacgaccgggtgtcgctacgctagcgggtgatcccataagtcgtcccaacgtcgccctccacgccatcgctagtttggccgtttgccctcgtccgtggtatctctaccggacactggatactcctctgcattttttaggcatccataatctgagacactcttagagtaaagtactcgcccttacaatacagggtagctcaataagtgtcccaacccaaaaaaacatatttctctcttcttcctctctttcctattctacccctctcttccccctcctctctctatttctccatcgcacgcacgcgagagcgcaccgagtcaccgtcgccgctctctctcccaccgctctctccctctctctctctctctcgtggaaggtagcggcggtgaccccggaggcagcagatccggtgccgccgaagccggatctagccccccggcagatggagcagcaccggccacgccacatcgaggtggcggacggcaaactcgaggcggcagacgacgagcgcgcggcgagctcgaggcggacgaggcggcggccggacgaagcttcgtcggcgagggcgacgagagtagcctactccgccgcggatctgtcgcctccgccacccccgccgcggatctgacatcccggcgccgtcctaggtcgtcgccgcctcttgactctccctctctttctccagccgcgcctccctctccttctcgccactgccgccggcgccacgcctctctccttctctctcccatcgccggcggccgtgactgagtgcgatgaggagctccatcggtgtcgccgaggagctcgaggagaggggagaggggtggaagaggaaatcctcgctcttggggcgtcgcctcaagcacccgtacccacgcaacgggttccttccaccggcgcctgggcgaaaaggagctgggggagcgggggggggggagggggcacatctcccagctaagggacgcgctctcaccaggggacggcgccgatggaaaaggggacggccgtcgctaggggcacgggctgaagcaccgcattggtgatagccttatctacagtcaaaagttactttgccacagcagaataataacaacaataagaagaaagcgtgtttcaataatggcgctaatctatggattagttacagtattaatcccgcggacgaatcactatgctggatcggtacgagatttatcatagatctccactgcgcgagaaaattccctcaaatccggtccagatttgcttaatgcaacactcagccagtcaattgtgctgggtgactggatcattccagaactaaacaaaaccatagcacactgacctcccggctgttcttatcagggaggataaccagcttctctgaacagtgaacgcacaagcacaaggagctaatgatatgatgagatggatgattatattagacagaaaaaaagtgtcacttaatcattggacatcatacacgttagctagctaactcatagtatgtccgtatcacatcgccacataggaataccactcagactatgtagcacgatgctagggaacttgcagttaataaaacgataactaatcttgggaatgatgtgcgcaattattaggatccgcaagttaggcgtaagtaaccaagtgtgatatactctactccctccgttacagaatatagcaacctaatatcggatgggacgtattctagtactacgaatctgacggagggagtaccagttaggctcagaaacagtgtgccgtacctgacgccttctgctgttgctgttgctttcaatagttttcagcccctcagtgctcaggtaaatatgtgatttcgatcggattaagaacagctagtcctaactacgactgcaattttagggttacaagtatctgcaaccattcattttgatgatcaaccatccgcatttatagctatactgatcaaaccaagaaccataaacaatattttattctacaacacttttgttatagtgctctgactaattggtgtcgtttgattcagatcaaatgtactctaaggatagtcccaacccatagtgtccataaacagtatctatgtgccatgtcaataagacatcataatagaaactacactttacaacccatggtttcttaaagtgggccattaataaatacatcatctctcttctctaccaatcatatttgttcttcatttattatgaagacattattctctcccaatgcaaaacttgacagtgtctagtgcataggttctcgtgttgaagccagttttttgcatgagacccagtttcttcctctcttcactctctcttaattaatatagtgccacataagcttaaatttatacatggcaatatagttaatacaatagacatcattctaggtggagggttggaactgccctaagcagctatgcctacataagttgcagttagtactacaactgctgttgctgatccaaatcctttgagtttatcagttaggtctagcggcggacacatgaatttaagactggtcattcacttaataattgcagacgcccttcttacaagtacttggtagtcaggactatggaatttatagaaattggttaatggtctagaagtagtgtgagccaagagcatggaggaatggatttattgaggaaaaccgagtaaagtatgaagcgtatactccctccgttctaaaatatagggcataactactttttaaaggtgtttcataatataaggcgtgcatgcatgcatggcaattaattagcatctattctctcctaaattattattttttaaaccatacactcataagatgtttaattctattgggtgcatgtattgtattagttggattgattcaaacaaagagatgatggtaattgtttcttggtttttgagttaaaagtggttatgtcttatattttggaatggaggaagtatatatatgtatgtatatatgacacgggtcacatggccagtgatggtggtggtgggctggtggcatgaaaatcaccaccactactatcttttagaagtattctctccacctaaaaaaattcaacctaaaaagtgacgtgacctctcctagtataataaatctggacatactagaaggggccacaccctatcctaggttcagtttttattttacggagggaatagtatagattataaacttaaaaagtatatatatttgatatttttataacaacttctatctagaaagtttttgcacaaaacacaccgtttagcagtgtaaaatatgtggtaataaaaccgataaaaaaatctgcatcttaaaagtatttttgcgaacatattttgactgacatcaaaatattcagactgacccagtctgaaataaatcaggaggtcagatccaaaacagtttcccaaactcaccgatgagaatggagaaccaactttttttttcggcgtctccgcttggcagtatcgatgacgcggcatcgatcgatcgtgacgtcctctcggtgatgtcatgcatgcccttcggttcttctctcatgatcggctgatcggctcagctcagctgctgctgctcctcgctccagctttcggttcttctctcatgatcggctgatcgcctttcggttattccctaatgatcgcgcttctatcccatactagaacagaatcgatgattatatcctaagcagaatggattatgagcagaatgtgcagcttagattcgtacacatccagttgggagctacgaacatgttctgttcagtgttcacttgtgatgcagcctattccctaactctttaagaaaaccaaactagaattgagggcctatttgaatcgcaggattgagaaaacgtaagattttgatagtaacgtaagtgtaaaacagagcattgcaaaacgcaggaaaaacacaggaattaccgtttgattgaacctcagaaaaaacgcaggaattggatgagagagactcaaaggaaagttaccaagagattaagctcttgctaaatttcctccaaaatctctataggattgtccattccatacgaatttcaaaggattcgatagaattcaatcatttgtttcaaagggtttcatagaaaatttttctataggattgaaattctacaaaattcctatatttttcctctaaattaaaaggccctgaataggatgtaacctaatacaacgaatttagaggagcttatgttgctctcgatagatgtgcgtgcatgcacgagtcagcagtgcgtcaaccgcgggtggccgggcccggtccgtcgctgaatgctgatgccgtcaagctagcggcagccggcggccagtcgtagctgcgcgacgacgacgacgaacccggacgcgcgcggtcgccgctacgatccgcccaaatctacgggaatctcgggcaaattaaagcggatcggggccaccgagaacaaccgcctcgcgcgcgcaccccaccggcctttccaccgtcctgcactccacagtattccacttccactggcctcttccggactcggcttgactgcagcaggttggttagcttcgcctctccaccctctccgacaagatacggtccaagtcagcccggtactcctagtgcagtcttttgcatcaccatcctcggctgtttggcacggtgggggcatcaccgaatcgatggaatgcacccattctgcttgcacgtcgtactatgccaccttggttcgctgttcaccatctccctatttatacgcggttgttgccggatcagtctcaccaacaccaacactacaaaagtacaaagcacgaagaactacattgtctgctctgctcacttgctcagtggtcgatcgaagcgggagagagtgtgtgcatcatcgatggcaacgagcagccacgctccggtgaagcgctgcctgagcaaggcgccgtcggggaacccgctgccacggaggggccaggtcaaggagagcatgggaaagcaaatcgtggcggccgcggcagccgtggccaccgcggcggcgcttgcctgcgagaagacgggcggcggtggcgctggctctggcgacaagaaaggcagtggcaggccggcccccgtggtcggcgccaagaagaaatgaccagcgagctcactaattaaagcatagtgcacggcagagtgaaagcagagtgcatgtttggttaaaaaaaaaaagcagcatagtgcatgttgcacgtacttgctccgtccaaaaaaaaaaaaaaaaaactcaacctcatacgtgttagtgtccgatagtacttaccatgatgcgaattacgtgcatggccctttttcggtgcaccagagggacctgcagctatcatgctcggtttctctgtgtagcgtgtgtcgtctacgaggcttttaaatcttccttgttttgtttggtgtcagtatgtagtagtagtaattgatatgggttttacaggggtttgtatgtagaatcttggatcttgtcacatgcatgcagactgcatacgtttggtgtttctacttcttatcttacataaaaaaaatctcgcggtactacctcaaacttgtttgagtactgattataagccgtaacagtttattaatagttaaaaattaatttataagtaaaatttttatggtaaattttggtacatgatactcaaattttgtataatttgctgataaacatcgagaaaacgtgtcacagcttaaaaacattagtaaaaaactgataatttgatagaagacactttcggcttaattggattgataatttctttaaaaagacgagaatgaccctaataccacgcccttcaaacatgacattaaagtaaaagattagaaattatgcaaatctaaatttaccgtcaccctaaatacaccactagcatacattatactccatctttgctacagtcttagctcaaaagcttttgaccttagggtattcttctctttttgaagaatttctctccccaattgagtccaaaatgttctctagcaaattaccagttttttaaagtgtcttttggccgtgacacatttttacgatgtctaccaacaaattacacaaattttgactttcccgtagcaaattttgccaatttttatatatgtttgtagaaatttaaaaataaacactgaaaaataaactacaatgaaaaaacatcaaaatcaactctaaaatttaatttttggttatgtttataagctgaatgattaacgatgggactgtgattgagctattatgaacgaacaaagattctttattaagatatctatattttgtcatcgataaacgattgattataaaaattgttgaagccatcgataaattatgtgagtatgacaaatcgtggttagccttccattaaccccatgcaacaagtacattttgcctctacacgctaagctagggtagagtgcatttgacagaaagctgacaacgatggcataatgaaagaaaaagcattttgaaatgaaattttgtagaactcgcatttatcaaagaaatttgaacaataaaaaaatctcctttttcaaggacataaattttctctttaaataattacttcaaaaatataaaacggtatgcttagatttgtcttgaaaattaattttgcaatctcataaactaattatattttttatagcattgaaaggtcattttttttttgtaatatcgaaagttacccattcattttgatagcacagttaccttccgtttcctttttaactcttcggtcaatttcctgtcgctttgttgtcaaaagtttcctctctctcgagatcgaatagtaggttgcaccgtagcaacatcgtcctgccgtcctgctgctatcggaagaagggacggcacggcgcgtgctctgccgctgccccatcgtctggagaatttttccttcttcttttttaacctttttaatttttaattttaaaaataaacccttccacaatcttttttttaaaatctaaattatttgatcacaccaattcatctggtatggtaaaacaacattaacacacaacctataacagacacaattgtattgttttgccatgctaataagagcggtatggtcaactaatgttgccacgccaatgagatcggcatggtcaaataatgttgtcataccagcgagatcggtatggtagtattgttcgtcgcgtgttgacgtaccaaatttggttgttaacatcgcgccagttcggctagcatgagtaaaagattcagatattgaaaataagtttgagaagtgtttatttaaaagtaaaaaatttaaaaaggttaaaaaaaataaaaaacattctcgcctggatcgccactcacccttgcagccttgctcgaccgattgcttgctgcgacggccagtttcatcagctctttggtggtgtggttccgtctccagcaacctcacatccatagccggtaccattaatcccatcaatccccaatcctgctaacaggagtcatcccataagggcactcacaatacgtcactaaattttgaggagccaaaactgccacgtagactaaaaacttcataagcaacaaccttcgctcagtgcatgtggtctatttagtgggtcccacgaataccaactttatcactttactagcttttcctttatcctcctctctcactccttttccccaccccatagcgccgagtcgggccgagctcctccgctgccgacggcaggggtgccgcgcttggcgctcgccggcgcaccaccctcccccccccctcgccgaaacaacggcgaggtcagcacgcggaagcgggcggcggaggattcggcggcgggggagctcggcgttggctagcgagggcgccgtcgcttcaccacctccgcgggcgagctcctctcgtcgccgccggatgggatggcgaactcggtgtggatctggctcggatttggcgcccctactcctctccctctccggcgagcttcttcactctctctctcctgctctgtggcatgtgtttttctctaacaatttgctgaggttctcggagccaaaactagccacgcgaagctggtaaaaacgcgcgcctcacctccttctctcctccacgtatgcattgggccgacgtggatagagattgccacacgctacctcaccgcactgtgaatggtctaaaaaactaacctggtactagatgtgacacatactagtactataaatctagacatataaatgttcagattcatcgtaatagaatatgtcatatccgattctacattcgttttttatagacaaaagggagtacagcacaagaacctcaccggcagaacgcaaccaaggcgggcagggctccacgcctccacaactctatctcgcggcgttgtgattccttacgaatgcaaatatttccggtgaatcaagaagccatcatttccttctttcttgtcgtgcacatgtacagccagattagattatactccaattagtttcctatagagagagtatcaaattatcttttggttgttgcctcggcggctcggcgtatttttttcgaaaggctgagccaataccagccaaccttgacttcaaacagagaacgttgacataagggaggtaacatcatgatgctactaaagtgaaaacgtaactttcagtgctataaaatcaggatcaattttgcctcgactagatatgcacatttaagattgctctatgtgatttatccaaggatgattcaacagatcggcagcaaaggggcaaactaacagaaggacgattcaacagataggcagcaacaaacctcgcaaaggggcaaactaaaagaatttcatcaaaggataaagactaacctgatgaacttatggcaatgtttcacatcaaaaatcggttatagtgtgcacgaggccaaaaagtagtcatgttattcacaagtagcaacgtaactcccgcaaagataatataaagggcagatgcgtcaaaaaatcaattgtcatgtcataacagcactgagcatcattcactaatcatggatagatgatcagtctggttgaaacaaattgcacttgcatctatgctccaccttccaccttttttgtttctaaagcaagtaggcaatttaaggcgcaaaaatggtgttctacttctcaatggccttccagtccagagtgttactgctcaagatgatgttccctcgccaggttctcgaatctgaatggaagttcttgacaggcttgcttcaagctcgtttaactcatcaatgtccaggtcatcatcaatatttatatcttcatcatcggactcttccacctccttgccattagaagttgatgaacttggcccctcatcctggtttttattgctctgcaacatggaaataaaaatatatgtaacacattcattgaattgccacagagcagcctgcacttatctactatctgccaaaatccctttcaagcggaaaatataaaggaacaaaattattttggggggttgaaggaaccaaagttgttaggattaggatcataggtagggtcgcttttctccaagcaaaatcggaccataggattgggatcctatgagatgtcttttgtttcaatttgaatttaatattggtattcagttatatgtagttatattggtattcaatttgcatgatactacaatccgcatcgcgataccaagtttactgaaaacaatgagttgaactgaacataacaacgtgacatggatacatgatatgtgtatttcatgttgaccattctatccaggcatacctattcaacttcaacgcatacaggtgtttcaggcacaataaatacattcaaataagctaagaaaataatctcactacgaagtgtcacgccaacaaataaacctaagtacattcatggaagaagaaaaaatcagtttggcataagattcagattacttctttattggaagtttgtcctattcatttaatttctcaggaggcgatcgagcatagatacagttaccgccttctgtaaaagtgcctaaaaagatgtttcatttttccatagacttgatttcagatatgtgaaggacaacagcccaacatatgttctgattgggtatctacaacccacttgtgattcaggcatgtcaatagtcttgaaaataacaaagggaatacaaaaggagtgctccccaaataattttaagttcaaggtgtatctgccaaaactgatagttccattatataactttagaatctttgggggagggtatctgggccttttctgctccctcaaacaattagtactttcaatctttagttgtaacattaatcaaacaatttgttaggagcaaatattatagcacatgaatgaaaatttaccggttcttcattagcctctgattcttcctgtctttcatatacatcatatgcttcagcatcatcaacgaacacacttgaatcagccatgaacagctcacggccactggacacaatagcaaatactatcacagtaagtacctcaagcctcgagagctcaaaacgataaactaataggagcaaatactacctcatgcgatcattcttagccctctctgccctcaaggcagccagaccagcttctctttcttctgccttcttccttttccattccatgaataaatctgtggtcataggagttgttgtttttacctttttacgctgttagatggacatggcaacagatcgtcataatagtgaacaagtggaaagaagacaacaaaattcaatattccagacagaacaattttgactgttgatcgtaattctacctgatcttcaatctcatcttcgatagcaatcttttcactctcttcctccaataaggccttcatttgggacttcagtacatagccaggtggaagtgcatgcctgtagtggcaatctttgcccccatttgggcaaacccaaaaccaaccgtactgtttcttctccacggcatcaagaaagtacttgcaaacctacaagacaaaagaattaccaaatcaacatcatgtttgaagacaacatctttcagcttgcaaaacaaaaggagttcttatggtttcactgctacataaattcatcttccaggagagagagagagagagagagagagtaaagaaggcaatacaagttacaaatgcaacagatacagcataaagaaacagaaaactgattttgtaaatcgtagcagcaatgcaatgaagacaataaatatgacttgttagaacagatgcaaatgcatcagagcataatcatagcttgttaatttactatattttcaaactgtgcatcatcaaacttccctcactgccaatatattggcattcaataggttaggctagcattttgtaaggaatgaaataatcaacaaacatttattagactagaatcttaatggcttctataacttataggtgaaagctattacttaaaaatgatgttgcatcatgcacattgcgaaactatgtacatagccaaattgccacacagaatcctagtaagtaaagagcaatggtggaatgacagtaagactacttaggctgtgttcggcagcttactttcccaactcatctccctcattttccgtgcgcacacttttcaaactgttaaacgatgtgtttttttacaaaaatatttctatacgaaagttgctttaaaaaatcatattattccattttttaaaaaaaactaataattaattatgcactaatgagtcactccgttttccgtgcgtgggagattagttcccaaatgcaaggaacaaacgcagcaattcatcataccatatcatgagctgcaactaagaaagagtcccaccatgccaattcatcacaccatatcatgttaaccactgttgcaacatgacatatgtcagattttcctctagttgttccaggtgcattcagaactaaaatcaacacaggtggcttgctaacgatatgaccaagaggacaccctaataactgctgtatgcaacatatattcagaggataaaatgatgctaaccataagatggtctgtgtaaattgtaaaacataactgtttcatggtcagatttgagtatccaattatcatgcattagaagacacaacacaagaagcaaaagcaaatatagaagcagtgaagcactgcctagcacaaatatttacaaaaaagaagcaaaatactagaacctttaattcattcataacaagttggaaaatgacatgccacacattcacacaatggggatgacttaaaatgattggatcacaggcaatatgttgagtagggcatacaatatcagtaggtttattctgctggtactctgctccttttgacgcaacaaccttctcaagagtctcctggtcccagtcttccatggtttctgccatgaaaaagcatatgagaatcttcacagatgaactgacgaattatggacaaatagtacaaaaatagcaattaaaacccatatcagtgtattttacctgcatcacgcttgtcagtgtaaatatcaatcttttcaccctttctttggacattaaggtcatgtgagaacttgcacttaaaacccttctggcactggccaaccttaaagaattcacacactatggacttgggatcgacacctgcataataaaatgtatgtcatcatcatcgtaaccagcatatgagttgcaacatcttacaaaaataccaagctgtgctcatcctagtgaagctatgcttcctctacgtacagcttgttttagccccaatgtgctcacaatgtacagctttgaacaaatcaatcaaaccttagcagcattagcatcaatcagcaccaatacaattagaaacactaccataccacaactgttatcctatcgaatagagattatatggacatatactccttttttccatattgacctgatgagattcacccaatacagcacatcaatcacatacaaactcactgattcacattaagtacatgagcataacaaatacaactcagtgcgcctaaatctatttgctcaaccctaaatcgagggagacatacacacataaagactgggtgatgacaaggtggagaggaggccataccaactgggaccttgggctggctgacggcgaccttgaatagatcattgagttccttctcgcgcgccttctcctcctccttcttcttctgcgcatccacatccacagcaaacagaaaaaaaaaacaacgaacatcagagaagcaaagcaatcgaaaaatagggtaagaagagcttcgatctgagcatcctgcgtgccttggcggcggtcttggtcgggtcgggcttgggctggacggcctgatgcagggactggacgtacttctggacgttcttgctcttgttcttgttcttgagcccgaacgtcttgtcctccacgaccttctgcttcttggccaggtccgccttcgatggcgctgccttcttcggcggcatcctcccttcttcttcttcttcttcttcttcttcttcttcttctt

SEQ ID NO: 17328 - DNA, 2040 bp, Oryza sativa
tacagtggttggtttctcccactaaagttcaaaaccataagttcatttgctcactgttggagggtaaactcctcaagcaaggactgtgggggtcccctttatggttcagaccaggaatacgggtgaaggtttgagaaatgaagggaaggcgattcagagaggattcgggcccctcgggggcaatggggacggaatcggtttatacaggttccgggcgttgtggaaatgtaataccctactcctatgtgtggttgattatgctaggagaatacaagtgctttcttttcttcggcctctccttcccctcaggcatggatctccttttatatcttaaggggttaccacaaaaggcccaagacttagcttcaagggaaaggaaaacattctctataggtaattaatgtgtctctcgtcctcccgacgtgtgaagccatgcgcaccttaccacgacatgggccccatcccatcatgctgagcagtacgggtggatgcccatgtcattccttcttaactatcgacgacttttgggcgtccagccccaccaaggggtagagatctcttgaacggacctgtgcagagaaaagctggaccgagtccaagtgagaggaaaaaaaacctcatcaatggcgacgggacagggtagacgtaggccatgtcccctgctagcagtaggcatgtgcagacagcgccctgtcctatgcctgtccgccgtcacatccgtcattcctgctgctagtggcctgtcagtgtgcatgctcgccacattaaatacagcgtgccacggccgacaggacctcattaaacacagtagttgggcgctgggaacgcctgcccagggcgcacacacgaatcacgaatcagagcgaggagggggtcccaactcggaaacagccaccacttcaacaccccccctcccggagggggggggggggcggcacgtgggtttgaggcggcttcctccctttgtatggggggtaccctgggcccatatcactgacactcactttcttgttcgaactaaattgaccactaacaaatatttctattatagggagcataggtgcgcatccctgtacaataaggaaccacacctctgatagaactataaggatcatgcgccttaatgcttgatctaaagttaggcgccagttccacattgcattgattttcgtcaaaacttttcacaactatagtttaatgaaaggcatgcaaacagttttaacaagcaaaaaataacgataactacgttcaaaattagatgcacttagatacaaaccaagaatcctagttcatccccactaagtgtagataatgctacttctctcttctctcattaagccacatcaccccaataatttatagcctttggatgatagatctatggtttaaattgtctcttctttcttctctcttaaaaatatgcaatatcaattatttttagtctcaaaattatatcaaattattttagttttgataatcaaattacgtcttatttgtacatattatgcaacttaattttccgcagcacacggcgggtagtcatctagtaatattatatacgagagatagtcgtagttgaaacaaagcgactagtaattaggcatttaaatatttaacgtgcacaactaatgctacaaaaaaaggactcataattcttaaatgaaaaataatttgtgtataaaatatttatatacgtgttcttagcaatttaaaaacaaatactaaaaaataaacttcgaaatttaaattttaactgataagtataagcaaaagcgaaaaatgtgaggcccagaaactcccgcgatccacttctcaacatctgggccgtcgtccatccagcacggatcttgaagcaggaaggcccattagcaaaccctagacagcaacgccaccgcaaataaatagcttcgctgcccttccccctatccctctcctctattgccgccgccgccgctcccagctcgtgctcccctcgccgccgccgccgccgccgcctcgcctcctcggagatcttcgctgcccttccgccaacatggggta

SEQ ID NO: 17329 - DNA, 3425 bp, Oryza sativa
gacgttaacaagacgacaaacaattgttatacattgtgaaaactattaacttgacattttttactccagtattaagttaaaaattctatggtctcgttttcaaaattgtacacaacaaattgaaattttcaattcaacttttaaaacctccaaccttttaatttctcacgcgaccatgcacgactttggagagtgaatgcgcgcacgtcgctgcatctcccacgataatatatactacctacatgtctcaatatacattatgcttatacacataacaaaattaaattagactacccatttcaataggaattaaaaaaatatcctaaaatagactaattattgaacgcacccatacaaaagtgtgacatgatcccaaaataaactattttatcacaccacgcaaaaaaagggccatgtgacataaatcacactgtagtgctttagaatgggcggcttcaatatgaatacaaactaattctaaaataaaatatttatcaaatgtgtggcaaacaataatagagatatgtgacattatcctaaaataaaatattttatcacaagctcaaaaaaaaaatccgtgcatgacatgagttataattgagagatctgcacataaaaaatccactgagctctggatatagcctttcttttatatattcattcattcataccagaccatctccggtttgaaaaatatatttgttaacaaataatattgcaccttaacatttagcatgaacatattactatcaaataaaggaaaaaatcgtgctatacgtccattctccacgtggcatgccaggtccaccgtcggattctatcacttcccgcgatccacttctcaacatctgggccgtcgtccatccagcacggatcttgaagcaggaaggcccattagcaaaccctagacagctacgccgccgcaaataaatagcttctctgccctttccgttatctctctcctctattgcagccgccgccgctcccagctcgcgctcccctcgccgccgcagccgccgccgcctcgcctcctcggagatcttcgctgcccttccgtcaacatggggtaagctcgctgtcactctcctgcggtggattttgtctgtataggtttagcgatctggaatggtttagtcgagttccctcgtagctggatgcttgaatataccacttgatttttgtatgcgtcatacttgtattttggtaaatttgcgtgtgatgatggaactcagcttattgacggtccagtgctgatcagattataaaccgtcaacactaaacatattcataagcgatatcaatccgttgctgctgtgtaatcagaatttcttatatcaatttacttggatctgggaggttatgcatgttagcatacacactgttatcatttttgttgtttaaaggaatcgcccttagcttagctgtcaaatctttttgtggtttatgctaagcccatcactttgcaaacaactatcgacttctgatggcaaatttacatattatggtcatcaaagaacactttcttatgcttttgctattagtctgtatttggatgtcatgtctctttcaattgttcatttcatcccttttcattctgcacacgttcttttctagcaccgcactatatgtcaaaccgtcgaattgtacaccataatcttgttttaatatagttgcatgaaccatgaattcttcaaaatgcaggaagacacgtggtatgggagctgggcgcaagctcaagacccaccgcaggaaccagagatgggcagacaaggcctacaagaagagccacttgggtaatgagtggaagaaaccctttgctgggtcatctcatgccaagggcatcgttctggagaagatgtatgtagaaactataatatggttttgtcaccctttgccttgtgagtttatgctaatgtgagaaatttgatggctctattgcagtggtattgaggccaagcagcccaactctgccatccgtaagtgtgctcgtgtgcagcttgtgaagaatgggaagaagattgctgcctttgtgcccaatgacggttgcctgaacttcattgaggaaaatgtacattcttcatcctgcactttctcgaatgtttgctctgtcacctgtacttacttctcatgtcattatccaggatgaggtgttgattgctggatttggtcgtaagggccatgctgtgggagatattcctggtgtccgattcaaggtcgtcaaggtctctggtgtgtctctccttgctctcttcaaggagaagaaggagaagcccaggtcttagattactggtacatcttggttggcaagcatggaatagacagaatgaaggctttagatgctcaagaagatggttccttgctatgtttaaagtgcactctctatattgttaacttaagattgtgttggtaaaaaccatgccttgtcatcagattttgcttctgtcgagggaaagtactatgctgagtttttatcttagttgccaatgtttatctgtgtttgtgtttgaggatccttgacccttgaggtattgttcggcttagctctgttcactgcgaattgctactctttggagttccctgtggctaatacatatttaggccaactatgtggtactctagagtacagatagaagtggtgctgcaggaatcatcagaatgaacgcatgtcatttacttgggttcgtttgcatatcatcgaatttggtcgacgaaaattggaattttgttgcctaaatttagaggctctctcaaaccaccgggttattatgtgacattagtcatcttccgggtgcttacctcaccaaaacaagattacaaacgcggctttcagatcaattgaaaatatccgaaacaaagatcgcaaacgctgctttcagatcaattggtaaagatataaacagtgatctttcatgtcccctttatgacattagttaatgtaaattgatagttttcggtaagtctaaacccccccttgaattttgattaaaagtttaccaaacacctgcactttgaaattggacatccgacctcccaaactatatgataccgttaatataacaccataagatggttttataaagtggatttatctaatttgcatataagttgaataagtttgaccatatgatgtatatgctgcacatatatgttaaaatttcctccttttttttttttgcttttgccccattttttgctctcacctacaattggtgtatatataataccattatggtatctatagtataaattgatcaccaatgattaacaatatgtaaacatgctatattaattattcaaaaccactcatttaagtttcctaatgtgcaataccacatagccatcttagaaggtaatatgaacaacattgtaaattgttgatcggaatgttactctataacgtactcttgttttgtccagcatatcat

SEQ ID NO: 17330 - DNA, 1579 bp, Oryza sativa
aaattttaagaagtttgacttaaaaaatttaaaacaacttacaatatgatgaaacggagaagtattctacaagtaaatttgaacatgatgtgaaatttcccaatccagatcaatgcgtaagaaattccccagtccagttcaaattatttgttctgcgattactagatataagctaatatatattttcatctatagtagatacaatataataataagagtgaattacgctttgggccacattataaatttgctattgttgcaatttggaccaccacgaacgatttttttcagtacaattaacaatcttaaacacatcaactttaatatacggccaaactcctatatgtatggttcatatgtttgttgaaagggaagttaggcatgacgagaaaaattgtttacggtagtccaaactgcaacaatgataaatttacccggtccaaattgaaaagataggtttaagggtagttcaaattgaaacttgggtaataaaaggtagaccaaagtgtaatatactctaataataattaaaagagagcaaaccaaataaagcccaaacagcaagtgctcccgggtccaccggtcagcacccagggtctcgaacggcccggataccccggctgcccccatcgcaccggcccaagccgcttctcccttctccagcgtccgatctcctattccccacccttcctcaccgcaccattcaccaaccgccgtctcctcctccccccactctcgccttcccccctctctctcctctcctctccgcgactccctccacccccgcgcgcgcgcgttttttttttttcgtaaggtacggatccaacgacgctgctcggctgctcctctccccaccaccatctctgatggtttgttgctgtgatgatgatgatggatctagggtttttggagggcggcgcggggatggcggacgcggggcacgacgagagcgggagcccgccgaggagcggcggggtgagggagcaggacaggttcctgcccatcgccaacatcagccgcatcatgaagaaggccgtcccggcgaacggcaagatcgccaaggacgccaaggagaccctgcaggagtgcgtctcggagttcatctccttcgtcaccagcgagtgagtctgcgcgggctcggtaccgtgatcctgccctccccacaccttcttttgtgatggttggtttagggtgtgattttgctttgctttgtggtttgggcggtggtgcgggatgggacagggcgagcgacaaatgtcagaaggagaagcgcaagaccatcaacggggaagatctcctctttgcgatgggtacgcttggctttgaggagtacgttgatccgttgaagatctatttacacaagtacagagaggtaattgtgcgcttcgtactctctgccagtataaatgttaaacctttcgttgttgtatgaatatctgatgtctcttctgtcctcctggcaaatttgcaatacgtggggatgtgcactgttaactgcagatggaggtacaccatctaccattctaccctcctcaaaatccccttttttccccaacaatatgctatggtttcatgtgaa

SEQ ID NO: 17331 - DNA, 532 bp, Oryza sativa
aaggagaagccgaggtcttagattactggtacatcttggttggcaagcatggaatagacagaatgaaaggctttagatgctcaagaatgaaggctttagatgctcaagaagatggttccttgctatgtttaaagtgcgctctttatattgttaacttaagattgtgttggtaaaaaccatgccttgtcagatttttgcttctgttaaggggaaagtactgtgctgagctattttctccgattttgaggcgccaatgttttgtttgtttctttgatgactccagctcgtttcgttcatctgttctttgtttgagcctgaagcatcgtttagctattgatttttatatgctcgtatggtttccggttatcttcgtcggcgtccctttgatttactggcttactgctagtcacatgcacatatttactgtgactctaatatgatacctgcgcttatgttttgcatttgcttggattcatccctttgattcatctcccaaacggccaaaccatccgatttgtgctgaattttttga

SEQ ID NO: 17332 - DNA, 3140 bp, Oryza sativa
aagctagcaattttgatgagaacatatcgctcttctttgcacacacataatactcaaattactatgcaagatccaatcactagagttcgcgtccggcaattaaatttacaagtgagtttgtttctaagtatttctttatatgattttgaggatatattgctacctaataatttaattatgattagaaactatggaaagaaccatagagcacttgaaaagaggcaaggagatgaacaagattgtcatgagccttcaagccaaaatgtaggcccaattcatatatcaatttcgagttcaccttggactctatgagtagcccacactaaaatcatcggtcagattgcatttggacttcgatttcaacgttctacatacgtatgtaaagctaacggaaccacatttccaatggatctggtccacgtcaaaattccttccaagttgacaggaatagttgaaacaagaaggcgttcaaattctgtctagatgttgcgtcactggctttgggcccgttgagccgtgtattgtgtcagagttcaatagggacgcgtccaggggtctaatgtcgaccctaaaacctatatattcagtagtcatcgttaatttagtgttgggtttagcttagattacttctgccattgcagtttctcctatagttcagtttaattgtaaaataccaactttgatatcttaatcattcatcagtaaattgagttgcaatatactttgtttttacttttgttatttgattcgcataaagagattagccttctcgcacgacagtggaccaaaactcaataaagcaaaattgaatgaaaattgcaaggctcaaaactaatgtttggtaaaggaaaaagtggtgcggctgtatagtgaatgatgggaaaaaattacaaaactaaaatcctcaccaggcaactgaagctctgataccaactgatgacgctctctctcgtggcccgatcttctggtgaggagataactctcgctttgatcgagtgcgacgtttgcgacgtggctaccaaccagaacaagtccaggacgccatgcaatcgctacaccacaaacgatgtcgtaccaaccgtgacgagtggttgatgatccctgcaatgcaaatgagagaacactgcaagaacaagataagatgcaatctaaatattgcgaataggtaattaagcacaaaggaatagttgcgattgaagtggtagatctaatcgacccggcaaatcaacacaccaactattgggggctctgaatcaatagttgccgactaatcgagcgaggactagagacaaggtgaatggcacttggcaaaattcaactaaacaaaacccaattattttttaggatgtacaaagctatttgtagaggaaaacaaagctagggttaagtgctaattcgtggaggtggagggaggcacttccgagatgggcctagtctattacaaggcccaaggcccaagttcggtttcagcaacaacactgtcttattttggcgattcccgttgacttgagatgaattggacatgagactggatgcgtttgaaaggtagcgagataagctttccacgaagtccaagatcacccaaatcggagttggcatgaagacgctaggtccatttgaagtcagtactgtctccgaaggccgaactggacttggacttggaattatcattggaacatgtgaagttatgagcgtatccgacaaagtgatgtcctcatcaattggaaaccggatcatgtatatcaagtttccaccaaattgagagttatcagtgcctattgaaagatcggacctatagttcatcatcaaatttaaatatttaatactacgaacactgatagatgctctgatcgataaaagattaattagctagtatgcgagtattattgattcttgtaaggcggatatcaacgaaagttgttaagtttagcactacagggttctcccctattttagttaactgttgtatgttatattgattattggtttatatttgggatacctaattaaatcaagtttctcgaacatttacacacgtacagtcgggtatgattgagttgcatgatatgtccaatgcgtcgaaagaaaacaaatttcagagatatttagctttttatatataaacatttttgctttgacagaaaaaaatgtttaaaacgaaaatttggtattgggctagcagtgctacaaagatttcttacacttgcggacctgccttaattgagggccgaaatgtaggcccaacatgtacaccgggccgaacacagcgagttgccgtctcacccgcatgcttcctgggccaaaaggtgatctggtaatcttcactttgcaggtgtcttcaaatgctgtcccaaaaaagcggaaatcctaatcggcgatcgatcgcctgggacgggggtagcgatcaattcccctcccccctccctccctctactggtttccttttttggcaccgcattactttcctattttagtaaatttatgtacctaaagtttatacacctcaagtttacacatctaaagtttagagacccaaagtttgcacatataaagttagagaccaaaagtttatatatccgattcaaatttgaatttgaattcaatattttttatatatagtatttctgtacatctaaagtttatagacctaaagtttatagatccaaagtttataagttaaaagtttacatacccgattcaaatttgaatttgaattatatctgattcaaatttgaatttgaattcaaatattttctatatatagtatttttatgcatctaaagtttatacacctaaagtttatagacctaaagtttataagtcaaaagtttacatacccgattcaaatttaaatttgaattatatccgattcaaatttgaatttaaattcaaatattttctatatatagtatttatatacatctaaagtttatacatctaaaatttatagacccaaagtttataagtcaaaagtttacatacccgattcaaattttttgtatatagtatttctatacataaatttttgtaactctttgtttttttaaaaaaaaattgtgtggtatactgtagtaggaagagaagaaggggagaagaaaggggggagaggagggaggaatgtatcgagtatagggggaggg

SEQ ID NO: 17333 - DNA, 6456 bp, Oryza sativa
gggcggatatgatggctggatcgatggcgtggcgatcgcccgcccattagcccccccccctcccaaaaaaaaagtcctctcaaatgctttatctacttaaattatgagctactactaatattaacatgggactgtaatgtaaaataataaaactaatttattttttaccaaaagagaaagggtgtaccgaccagggcagcattggcccacgtttgtctctacaagcccaatgatatagcgaggaggatgacatttgaaccttttttggctttagttgtctattttaaatcataaaaataaagaataaaaacgacatcatcataaagtaaaagtagaagacatcaacatcaggaggcgaatgtaaaaaagatactagtttcggtgtaacttacatacatttattttgcatacttttctgctctttcagttctctctctatctctgtcttttgtcctctccaaataaacaggacctaaagcgacatgagccgtgcaataagcaaaaggagtagattacacatcacgccaccccggatttcccttcgaaaccaaccaaaacctcaccaaattaacttgataaaccggcagaaaaaaatgagaggaataggcatcggctggtcaagtaatgtttaatttgagccaccaaaaggtgcacttcctctctcagcaagagtcccgtgctgtctgatggctcgagaacctaagatcgtgaacctacgtactgcaaagagatgatatgattcgggaccaagttaatatcggttcacattttcatgcactcgggaatagattatcttttgccaccaaaaggtacttagatgacataaaggtaggcacactgattaagcaaaagttccggatcacattacattattgattgcctacgaactttttaagatgaagttattcatgcacagactgtgcatgaataactgtgcagcacagtcctctctcttcactgctcactgccccttaggcaggtaacactcctagtgacagcgagcgcgaaatgtgaatcgcttaaatagcctggaataatcaatggtgcgcccattgttattgctcaattagtcattaggcatatcaccaaccttttcttggatcaaattaagttagagttggttatctttgtctgggttttcttcagtcgttcagtgccgttctagtacaattatcaatcttgtgacgcacggtctgctgcttgattgagatccacatcagggagggctaacttttcctgaatcgctgatcagaagaaaatgaccttttccgcaactaccgccgaccacgggctctgatgatctttcgggtgtcctgtctgaagaaggtgcgcctaacaccctcgagacgacgatcatcgtgttgattatacttcttgaattaaactttgttcggtgacctgtttttgtagccccggtgtttattaataggccttggttactgcggttgttattcagtatattcacgcgcttctaattttactcctctaagcgaactgaaagttggttgattgataacccaagatgaactacaggcctatagaattcagccgtcatgattatgcttgctcatccgcttcttgctttaccacccagcaatggctaatgtcatcattagacgagagctctattagaattatgatcactcgtctgcacggtagagctcacccacgcttgcttgcttgcactgtatatgtggtcacgccccatgtaataatcctagtcacagagtgatatcgtaccatcacgcagacaagaacgtaacagttggcatatgctgctacaaaccaaaaattgcatcggcatctcttgggaagaaaacaagtaccagcactatataatcatcatcatgccagtaccgcatatttaggagcaacttgtatataaaaccagcaggaagcatacatgcagcgcagtagtgcacggtacggagtgctcgtttactcctaccaaccaggcaaccggagccggcagtcacggccttgaagacaaaggggacggggacatccccacggcctgggctaggtgcgcgcggtggcagcagaaaccaatgctgcacccggctcacctacctaccgagtaccgacctggcgattccccgtcccactcgccatcggccgcgtcacagtccaaagtccaaacccgtcgcgcggggcgctcacgccatgcatgcatcagcccaccccgcggctccgcgcgcgcgcggggtggcacgcgatttctcgatggccaccgcgagcaaatcgcggaaaaggtggcgaggcgacgcgccccgggttgggttgggtggggtgggttggtggtgcggtgcagcgggcggcagaggtggggacggacgggcgcccgggtccagccttcactggcgagcggtgaatggggtggggtggacaccgagccggttaataattttcgcgccatccgcccgaccacggtggacgcgagcaggaggggtgatgccgttgtggtggtggatgagatcggagcaccggcacggcgcgggaagcgacggcagcgaggcgaggagagcggtgcaagcaacacgggcagcggctccgaggatggggggcggccccgccatgtggcgtccgggaggggtctccacatcagttggctctgctctctgccctgcctcggtctgcaggttacagcgagaggcccaccgggagaggacccacggctcctcgcgctttttccctccttctggagccaaaaaaccccaaaagggaggcacatccctagctccccaagggccacagaccttaacacggcgtacatgttatattagggggcaaaacatgcataccagccctcggttatcctattctgcccgtggaaaaaaaaaacaaaaatggttatgtatattagctcctcggtttgccctattccgcttgtagagaaaaaagagagagagaaggtaaggcgacttaaattggtgtggcagataatattatcacgtcatgaactattggtaaagacacatattagctccttggttatctatttcgctcgcagagacaaggaaaggttcatccaaaacttgccgaaacaagaagttattgtcaagttagattggtgtgaccgggcaatattgtcatgccatgaatcccactctttatatattctgatcatagaaaaaaggagggttcatccaaaacttattgaaatgacaagttataatggtgtggcagaacaatattatcacgccatcagtagtcagagatgcatatcagcccattgatttgcctattctatgagtagaaaaaaaaggaagatacatccaaaacttactaaatgacaagttagaatggcatggcaagacaatattaccacaccatgagccgttggtgtgataacattatctgccacgttaaaatttttgtcatgccatcactttttactggtgtgacaatattgtcattgcacactagtttaagttgcgtggaaaaatgttcaaatttcataagcttttagggctttatttttaaattttaaaagattaaaaaacaatcttaaaaaatcaaggattcacattaatttgccacagccagttcagtttttgcaggagaaagttatttttccccgttctaaacagacctaaattgcaccctagtaagaagtaagaatttctaagtaccatgttgaacataaagaagtactagtactatagtactactacaatggttaagttcattatagcatgtgtttcaaaactccgaaatccaaatacattagtcgtcaacaattcgatttgagcaacttgtgtccttttaaacacaagcaacggttgtcataggttctgatctcttccacggttggacctaagatctaccgcttgatatagacgcagtttataattcaagattccattatgacctatacgtgtcaacgagacatcgactctcctctggtttttttttttttttttttttttttgagaacacgagacatcgactggactgtttgtatttggaaagaagaaaatctcgaagccgtaaaatgtaatatcagagttactggagggtctgagcgcaatcaacggaaagtttttgtgcgcatatgcttttctcttctctctctctctctttcttctgacttcttttgtgcttcttccaagcttccttccagtcctcgctctcgtcctccctccgtcactcgcagcgcagaccaaggaaggcttctcgcctctcgccttcgcctcgcttcgcttccaagtcccaatgccgacgcaacagcttacctcacgcggcgcgccacgcgcttgagaggggccgccaaccgcatggcggcgccgggcctggacgaggtcatggcgttcctcaccgaccacgggttcgcgggcgccgcctccgcgctccgcgacgacgtcctcgcccgcgccgcgtccgccgccggggacgccggctccgattccgatgccgcattagatccccagctcccgcccctccggttgccggcgtccacgtccggaggcggtggggcgccggcggcgccgcctgcaagccctggctccagctctgactcggcgtcgtcctctgccttcgtcagcatgcgctcctcgccctcaggtagttaggggatcagggcacaaggctgaatttttttttttcatcatctctcagcgttaaacccatatcttctcgttttccgaggtcgtcagttatgtcgcgcgaaatctcgatctgtgcgccgatgtttttggcggctatggttggctttgggtccaattcgaacctgctggatcaaagccagcatatctctgtgcatatgttcatggaggaaaattgtgatcttttgatctagtagggtgctggttaaaccccttcccctgggttttgtacaccaatgatactgcttgtcgttaaattctgatttctcagtatattctttttccaagaaggttggctttacgacgaccatctcttccatagcaagtcggagctggacgacgacaatggagaagacaaagaggaggacaagtttgttcttggtgtccacgatggctcagggaggatagagatgggagtgcttagtgccggtgatgaccaccgtcatgaacatgttggcaatgacggctgtgagggatgtgctgaggtgtacacatgttcatcaccgctctgcggatgctgtggtgagggactgaagaacggggggctagaggtggtgaaggattctagctccactgtctatgggaggtaccagatcattgatgacagacagagatacttgatgagtgtggcatggatgggtttcagttgaagcaccctgcggatgttgtgcttgagtgtcatttgccaagagattctggggaaggagatgagcgatcggagctgagtgtagtggagaaggagcttcaaatgctcagttcatttggtactagggttgatgcagatgcttttacaagtaagtacttctgaaatcttaaactttctgcttgatttcacccttcaatattagtactccactaaatacagtatttgtactaattttcaacattaaccctctttgctccgatgaagatattatgaatttatttattgaagtgggagaacagggttgaattacagcattaaagagtttggatactgttaggcaccgtttggatgccagaattgaattgtgtagttatcccaaaaaaaaaaagaattgaattgtgtttgtggaaatggtggtccaattcaaatttcaactataattggtgttgggatccaattcaacttgaattgtgtatgagtggtgcagacaatgctgaatgagagatgttttgttactgttgtaaactgaaatttgctgttaaatatgcacagagctaaaaaaaaatggtgcattttagtggtaacctcttccagaaacattactgctgttatacgattatgcttcacatgggttttctctgtatattagaagaattgaaaattttcttctgctcttcaatataatatgtaacttggttttggtaacactacagaaatgaaatgaatctggatttaaaaatgcacatttgaggagacattttttaacaaagaaaggccaaacctattttattatcagtcttgctgaactgttgtttgtttaccaacgtttgtgtgaatttgcaatttaattccagtcatcttcttatcctgtataaagatcatttgctgcttgcttcattaggtttactgtaaatgtttgttgtctttaggtcctggacttgtacacgatatcacagacaatgccaaactggatgatagcattgaaaagaatatgaaaaacagtagcgacaaatatctgaaggaaggttatagcatagagcctttccctgagagttctgttgatgatacctttgagtttggagatattggaccattgaatactgatgcgcaaaactcaactgctgctaaagctgaggaagaaaatccagagacaaatgttgatctcgctctcgctaatttccatcgagaatatgaggtatttgaact

SEQ ID NO: 17334 - DNA, 7091 bp, Oryza sativa
ggtatatcacttaagaaataaagttgactaagatactccctttgcattgatgttatgctgcatactttttggctattcggaagctaaggaagtttgaaagggatatattgttggtctttggcaactttgaaaaggatctatgatggctaaaagcaatatagcttcttattttcagttgatttcttaaattgcttgcatgcttgtttaattgtagaaaaatcatagaatttattagtactttattttttgcggttgcaaaatcatagaatttctgtaacggcatattgacattgcaacaggaacacctttttattgtcactgaattactgcgagcaaatctatatgagttccagaaatataatcaggaatctggtggtgaagcatacttcacattgcctagaatacaggtatgtttgaccgttctatactaagatgctatctataattgttgcatatgcatagacacttacagttcaatttgtagtatgcacgatatgcaatgttccaaaccaatttaatatgcttcatttaaacataaagtttttgaaccgtaattgatcattttcttggaatgatactgctgtaaataaaatgattaactgttttaagtgcaattaaatttaacttaagaaaaaaggttttgatgaacaaaagttcccccttttctttcaggcaatagctcggcaatgtttagaagccttggtatatttgcatcatttaaggatcattcattgtgacctgaagcctgaaaacatccttatcaagagctacagcagatgtgaaattaaggttatcgatcttggaagtagttgcttcttgacagacaacttatgtctctatgtacaatcacggtcatatcgagctcctgaggtcattctggggcttccttatgatcagaggattgatatttggtctcttggttgcatccttgcggaactctacactggtgaggtaagaagcttctgtaccttgctaatccttctttttggacacgtgctgaccttttagctgtgttaaacccatagtggcctgttgtcatacagcacatagaattttatggagatttcaacacactgcattaatagtgaagtgctgtgttggcatgtttgataccttctttcttgtctaaatgctatgcaacatatagctccaaacagaaaatagagatcaaacttctgtgccagaattatttttttttgaacgaatgcctgagtaaattttggggcacaaggactggctttaataaataaagacaaataagaacgttttacatggaaacgaataatgtgcttcaagttgttttgttgttatccatatggaaacaaagttgttttaaaatttaaaaatgctaatcgtctaattataattcctaactggtacacataacaggtactatttcctaatgaaccagtgcccataatgcttgctcaaatgattgggataattggcccaattgacatggaaatgcttgccctgggagaggagacgcaaaagtatttcactgatgattacgaccttttcaccaagaatgaggtacactattcttagtgctagtggaagtagcctttcctgtgaccactcgaatttcatcatgtccatctctctctgtggactgtgcgagttataacacattgaacactgaactcattttgttgtttacctcatttctattcaggaaacagatcaattcgagtatttgatcccagaaaagtcttctctgcagcatcacttacaatgccctgattcagagtttgttgattttctatcctatttgctgcaaataaaccccaggagaagaccaacggcaagtgaagcgctacaacatcaatggctttcatttgcatactaatgactaatgagaaaccaacaggtcatttcgtttgttttaagtgctttgttcaactgctcctaagctggatccctgcaatcttctaaagatggattgattttctgatgtttccccatgagtccatgacatgaaacattttacactttccttgagttttagaaggatttacctttgtgcttgctgaactagcatgcggcacaattttcttgtttcgtttcttcagggcaattcttggagtggaagccctgctctcagtgttaagattcgtgagtgtatgtaaatatgaggaaattttcctgtgtacatgtacagttgaaacaggctcttgtaagccatctgattcatctttcataacatagtgaaaatatgaaataatcatcctgcatttcttcagttgtcgccatacttctgtgaaaatttcccttctaatctcaatcccgtggagatatgttttgttaaatgcacaggaaagtacagaaggaattttattgtccatgagaaatttttagtctcatgagagagtttttagtatctttgagtaacccggaagagccgaaggtaccaccattgcagatttgcaggcccatgaagttgcacaacgcggcccagcaagggcagtgtaccgtgtacgtccagcccaacaactcctatccatccgatcttgaaccaacgtctcggatcagatctggtcgcgacacttcgctctgtcaccggcacgcaaaaatctccctcccttctatccattatccccgtgccccaccactggcgccgctcaccggtcacgaccaatgccgccgaccgccgccgtcgccgtcgccgtggccgcggccaccgcgctcccttctccctcctcctcctcctcccaccgccgcctccccgccaccgcaaaatccgtctgggtaaaccccagcctcccgagctcccagcccttccatcgccggaaacccgccgagccccagcaccagcgccaggaccacgtgcccgacctccccgcgctcctcgcggccctctccgccgcgcgcacggcctccgacctggccgccgcggtctccccgcaccgccccgtctccccgcgcctcctcggcacgctcctctcccgcctccccgacgcgcgccgcggcgtcgcgctcctcgacctcctcgcgccagacctccccgcctccgcgctcctcatcccgtacaacctcctgctccgctccgcgtgccgcgccgggatgctccgcctcgcctccggcctcctactggagatgcgggacagaggggtcgcccccgacgcgttctcgtactccacgctcctcgcggcgctcacccgcgcgggccaccttgaccacgcgctcaccttcctgccgctcatggaggacgacgccgtagcgcccgacctcgtgctcttctccaacctcatccacctcgccctccgcgggggcgacgcgcccaaggcgctcgcgctcttctcccgccttcggggcgccgccgggatcaagcccgacctcaaggcctacaacgccgccatcgccgcgtactgcaagtccgacctgctccgggacgccaaccggctcctcctccacgacatgccctccgacggcgtcgcgcccgacgcggagtcgtactcccccatcctcgccgcgctggcgcgccgcgggcggcacctcgcggccgtgtcgctcttcacgcacatgcgcgccgtggctcgcgtcaagcccgacctgtccgtgttcaacatcgtgctcaacgcgtacgggcagctcgacctcgcgcgggaggcggaccggctgttctggtccatgcgccgtgctggtgtcgccccgagcgtggtcacctacaacaccatgctccgcgtgtacggcgacgccgggctgttcggggaggcggtccacctgttcggcctcatgcgtagcgccgcctccgatggcagcgaccgcggtggcagcgtcatcaagccgaacgtggtgacgtacaacaccatgatcgccatctacggcaagtcgctggaggacgagaaagccgggagcctggtgcaggacatgcaggccaatggcatccagcccaatgccatcacctactcaaccatcctgtccatatgggtgaaggccgggaagctcgaccgtgccgggaagctgttcgagaagctccgggaagccggcacggagatcgacccggtgctttaccagacgatggtcgtggcctacgagcgtgccgggcttgtttcacaatccaagcgcctgttgcatgacctcaaagactcagaggacgtccccaaggagacagccatcaaaatcttggcgaatgccggccgagtggaggaggccgcatggctgttccgccgtgcagccgacgccggcgacgtcagggacacatcggtgtaccgaatgatgattgacttgttcgcaaagagccggaggcaccggagtgtgatcgaggtgttcgacgaaatgaggaaggcggggtctttgccggactcggagacgatcgccatcacgatgaatgctcatggtaagctgaaggagttcgacaaggcggcggcgctgtaccgggcgatgagggaggaaggatgcgtcttctcagacagggtgcacttccagatggtcagcctgctcggcgcccagaaggacttcgacgcgctggaggcactgctcggtgagcttagcgatgacccgagcatcgacaagagggagctttaccttgtggctgccggcgtgtacgagagagcatgcaagtttgatgagtcgtcacagattatcagccagataagaagccccaacgccattggtgtccagaagttcagatgagaacctccagtttctctgacgacaaattcaggtgtattgccagacagcaatacacaccatagtgtcattgacaattcaaggttgtaacttgtaagtgcgcgtggccactgtggaagttctttttcaattaaattttagacaccaaagtgttatcactgatcggtgctgtttgttgggcttaggcctttgtaaatataaacatcagataactacatttatataaatacatgttttttggttggagtgaagtgatggtacagtgccaagaacatttctgatgctgaaccctttgctgaacggaacaagcaggatgctggcagcataccaattagactaactgaactatcaacaatgaaattttacaacagaaggtgatatacaactggtgtttaaatgccccactacacaaataccaatctaacattctgctagattacaattccttttgtcttcagacatggcaattctgtacgaaccttgacttgatttttatcaggatccaggaaacctaaacgaatatataaataataatgtacaggtgctatcccctgagaacggacttatggcgtggcaggcgtttcagccttcatcaaaacaatttcatgtagcggctgcaaaatttacactgcctgatcagtttgggggatgccatgtttttggaaccattcaggcatatgaaatctttcgtatagtgctggtctaacatctctctggatagagagatgcttcagaagtggaaatataacttccatgagctgaaaacgtttaaacaagtcagaattagtaagtagtggaaactcaaacatggctaaagactggtggcagttatcagctacctgattatcattatgttgtccagctgaaaatggaacacagggtattccattcaaaggttgcaatatgaaactgaatgggttgttgtcaacaatgacaactctgcagaaatcttttgacacgcaagaaagatctttgacatgttctctgtattccctgaaattgtgcatcccatggatatcagaaagcgcattggccaaacaccaaataggtcctatgcgacatttccagcaagaaaaaaagccacttaacacatagccctcaactaatttggcacacatctcagcaagcatagtaatgaatgcagcagcactatgataatatggtaaaacaccatgtgtatccataggaaagttaacagtaacttacgtagtaacagttgatggacgatatagacggagtttgaatctattatggacatctattctgtcaactaaaggtcttgcataacctgagaacaaacatgggcatgtgaggtggcgctaattgggttcaaatgaatgaagaaaaatagtagccagcacataccttccaaacctgctgtaaagagaataagatctgcaaattcactagttttctgcaagaactcgtgcaaaccaggacgttcaaaaacggtgacatgattcactttgtttctcccttcaacatcctttacagttcacacaagcaaaagatcctttagcagtagtgattaaaatcattacatacaataagagccaaaagcacaagttctgtaccttctcagtggatatgcactccatgtcaaagcaatgtaatccagcttcaacagcttgggtgcgtacaatagctggaagactggatgattcatatgcagaaactaaagtttcatccaaatcaagcacaacctgaatagataacccaaatattttcagaaatggtgaatgaataacttataattatcatttcatttttcgttttatgtaaaactgttatcatttcatcttttgttttatgtaaaactgaaagctcaacataaaaccatccaagttcttcacccactaaaacaaaatatgctaacaggaaaccctgctatgagcaaattagccaatgttaatcccacatgataattcatatataatcaccatatgtataatctcataattctgattcaattacagtcataatgtatcatcaccaaatgcattatcccacaacactgctcaaatatctactcatctacacatcgatttcaacggacgttctaaattaccatccacagctctgctaaagactgcagcaatgtattgtcccggttaagtaccaacaccagcaccgttgcaattttggaatattaaatcatcatttcatgaattatccaagcagtataattcagagagacggattaacgccattgttggctgctaaacgaggacttgattggggattgcaggacaacggattgcccatgctcgtaagccaagaaaacaaaatcatcgcaattcaaatccccacaaaaaaggtcagctttacaacccacacaataattagcccccaaaacaaatcgaattgcctgaattaagccggaataacacccagctaacctcaaatcaatcactctacgcatctaccaaatcctaaatctcccacgaagaccgggacat

SEQ ID NO: 17335 - DNA, 13328 bp, Oryza sativa
tcttattaaaaaaatttgtgcaaaaaaaaaaaatgaaaagttgtgcttaaagtactttgaataataaagtaagtcacaaataaaataaataataatttcaatttttttttgataagatgaatggtcaaacagtgtaagaaaaaaaatcaaaatcccttatattatgggatgggagagtactaacaagctggagcactgcacaaattactgttttcatggggtcctggcagtagaattttgcttgtttttgtcattttcgttgttattagctcgtactgcctctaattatagacatgctaaaagcatgaaaagatgctctacttgtttaagtttaacttggttgtcttttcagattccttggatctgaaagtaggcaacagagaggtgaagaaaaggggtgacaaactgaggtggcttgctatggcagatcaggaccaactagtcctaatccccaagagaggcagtggttttgagcaccttttcaacgcagatgtagattaaagattttgccaccagctctttggtagcattattttcttcaagtagggaattaatcaaactaatgtgagcggagagagtagggcagtcttcggctgagttcatttcagcaacataaaacaacaattttatcgttcttcgttggcacattttatgaatttataaatagtatgttttgtaaacaaaaattatatataaaagttttttatgttcaaaatcaaataaactctcttttgaatttataattgacggagcgtggggctcctcaccgggagaccgcgcgggcccccctttgccggttcggccaggggcgctaggtgaggttctaagccctcgatctgtggaatgtttcgcgagagagcaaatgcgcaagacacgggcgatgtagacaggttcgggccgctgagaagcgtaataccctactcctgtgttctggtggatctgtgtatgaaggagttacaaatagctggagagcaagagagttcaaactctaaagaccctcttcctctttctctcctctccgagctccggtgtttttccccccctcttctctcttttttctcttaagtgggcaaggtcctccttttatatctcaaggggataccacatgcaccacttctacctactcttcttttgggtggggactcaccttatcttccaaaaaaaagtggcttgcgccttcgcctagaagctaaatcacagcttgtctttgagtgaggcccagcgtcatcactcgcctgacaccggggatctccctgttactccctcattaatgggcggagatttgccatggctgctgtccgaatgaccctccgatgggatgggccatacctacctccactccgccggaagcaggcgcaacgtgggagcacggttgtctgccgatgacgtgaccggcgtcagaccagtcacaaaccggtcattcttgtctaccacgcgtcagtttagcatgccacacgtcagcccttcttcataaaatgacttccttgtaatggttgcgatgaagcctggtatgaatctagccgggactgacgtgctaactccaggagttagcatgctggctccggctagggacgagtgcctagaggctctcattattccgacgggacggggcgaggcgtgcgaaaggccgcctgttgccacctaacccgcgatctgaccggtctgtgaccggtcacactgtgacctctcacggaccgaacgagtgtgctgcgctgcattaaatgcggcgtggggcgctcgtccaacccgcaataaacgcggttaggtgagcgccgctgtgctcacctaacccacacacgtggcgccaaacccgcagggggtcggggcgccctagccctcagggccgaaacgggagcggcccaacccctcggggagacagagggaggggcggccacatcaccctcgggcccgacccccccgagggggtcaggccacgtgggtgaccgcggctgccccaaacctctagtcaagatacccccggtcccatgtcaccgacaataatagttaatatgtaattaatcacgcggtagtgattcattctatgtttcgaacaacgaacaacttcaactgaaatgctccgacaaacacaaccttcgtatgaattgatacacgtatattaatatataattttattgcgaataaccagagttccctaaatacatgtggcttcatatttaaaacaaattttcgagaaactattggagtttcagcctaaaagggaaacctgtccaaatacttgtgcatcagattgtgcatcagatgattctatattgcttaacaaactgtacaacagaaaataaactaatcctaacttttcaaaaaaaaagagaaataaattaatcctaaccgagcctttttttctgcagtcagtatagtcacggactcaattttccgtcagtagccttctttgcaatccaatgaatacattccgttagcatcgcgccggcgccccactatgcagtaccaaaacagctccctgatgggtatacacctgtagcgatgttctgtacgttgaatcgtgcgttattcgccatccccattcaccaatcgcacctgaacgtacgtgaatcgcaccgtccgaaatcaaagcccgtttcttctgacacagatctgtgggagcgcggatatataaaagtgtcagcgataggtggggtgcagctgtgatgtgagggctgggttagttactaactttttcttcaaattttcaaattttatatcacatcaaaatttttctacacacataaatttttaatattttcaaccacatcatttcaatttcaattaaactttcaaatttaacgtgaactatacacacactgagctttcagatctgcgttttagagcaggtacaatagcaggctataagccagctgcaaacatattttaagtagataaatgaggagaaagaagggcggtgggctacagatttatagccagctgcagtacggactctaagacgcagtgtctgtatgacaggtggaaccatatattaatagtgtagtatgtaaatattgtatgaataagctattagattagctatagataaattgaagctagtagttggccatactgttgaacttgctcttacgggggccttccgcacacgaagattggatgcggacaacagcacgagcatgctgtttcaggaatccatccgttccacagttcccagccgcgtcgctggcgtctccctcgcgtgcccacgttcgctcgcggatagggggcgcgtacgtgcgcctcgaacgacgtgtggacgcgatggaagatgcgttctgtaccggacacatgcacgcacgcggcccgtgccacacaaaaaccgtctcgggctttgggcgccgcgcgagctggtgggagtgggacaccgcgacgatcgatgcaggcgattcgcccgggccgttcgtgccgcctgggccgttcctgcggccgcgacggcgtctcctcccgctgccttgctcggctccaccgtagcagcggcagtagcaacgggggcggaggagcagtgaggtgcgcgaaggcagccgcgcagtcgatggaggccgtgaagaaggacgaggaggcgagggtggtggcgctgcgggcggtggaggcaacgcccgagtcgttcgcgccgttcggccaggtcatcgccgccacacccgacggcgacgagttcggcccccacgacgcccagctcgacctcacccgcggcatcccaaggtcaggatgcaccacccccaatcttcttgcagttccacgaactaggaatacacgcgtcgcgcgggcacacgttacacgtagggcggtgatgcggtggccggtaggtgggacgggatgatgcaggcgcactgggcctgggtcaaccgtgaagccttctccactccactgatccactccatcgccaattcgccgtatcaactcaccaactggggaaaacgccgaagtcgaggaggggaggccgcccggtccgcgcgcgatggccatggagggggtgagggtggtgacgctgcgggcggtggaggccacgcccgagtccttcgcgccgttcggccaggtcgtcgccgcctacggcggcaagcgcttcggtcccaacgatgcccagctcgacctcagccgcggcgtcccaaggtctctcaacccacacgctgcctagctagcatcgatccatcgatcccgtctgcatctctggttcctgcacctgatttaggcgaaaggttcccacttcctctgatctttttttttctctcctctacttggcaggttctacatcatgaggttggagaagcggccgctcaagttctggacgatcacccaccacgcgagcgtgacccagtgcctcggctccatcggcggcgaagattggtacctcggcgtggccaagccctcgatcgtggaggatggggcacacgagcagggcggcgatgggaggaagcccgtgcagtcgcgtgctggccactactaccttcctcccgatccagctgaagtctgcgtcttcagggtttccggcgctaagtttctgaagctgcacatcgggacctggcatgcggggccgcagttcaaggcggatgcggtggatttctacaacctggagctcagcaacaccaatgtgagttctaagctgttgaattgaacttcgacttattagctattggttcttgcgttcagtaatactggaaaaaaatggcttctcaactttaaaaggtaggaatgtttttgtttgttccattttgctatgcacgggcgcggtgcgtttacgcatggccatacagttgtgtttgtttatatatgtcttagagcctgatacaattttaggaataaaacttattcaacttttaatttcaccaatccttatcactgacagaagtgtgtgatcttgcttgcaatactcagtactacaatgtttggatagtccagcactatgaaaacattcttttgagtaaatttcacaaaactacaatttagcaactttagtaaggtatttcgcagaacagcaacaacagaattttatcagaaagctataactttatccccataagttgtatgattgtatgtaggaattgagaagcatgagtacttcatatgtgtatgacacgccacccaaacttggcacacaaataagagaaattttacactacttgagaaagtaccttgaggtacctaaatttttgataccttgagatatacctagagttaccaaattttactatagaaaatatggtatctctaagtaccttctcaaggatggtaaaattaccccacaaataaagttgcagttttatgataaaatcatatactgttgtcacagttctctgtaatggctagctaaagttgtagaaaattgatagttttgataacaacagttgtagttttctgaaatttactctattcttttagaatagttttctatggtgctgtgggaaatactatagttgtgcctccttaatagatatttcatgaaacagtgcatgaaaatttcatctttgtgcactgtttacatcaaattcttaagcccttactcatcttttaggcattttggagagtttatcaggttcaatctggttgcatctgtgtatacagttcattgaagcagtgtgctctgtggttgcatttgtcttttagactaaagcagtttattcaatgaccgatttggcaatttctattgtcttcctagttaataaacttggttctgcttattgctgacttatatgcatgttttcgtaattgtattcttgccaataaatctagggtgccagtgtggtaataatcttctctaaatgaattattgtcagttagagttggaaacttatctggtagtctctgattgctggtgtgtccagaaccgaaatccacagagtcttgtttctgtgtcacaagaatggaccaactgaacctgccggttctaaattttgcgatggactccagatatctgatgcttgtctaatctaaaatgagttagtaattatctgctagttggaggccaatgacaggacccatattcctacttttgttagggtgcagaaataacaaggacattctttcgaaaacaactcaatatgttgtagcactaaagaaagtccaacaatctagttggtctgccaagtttggtggtcgtccctctttccataacttctgataagtgtctttcttttttagaggaacttttgtatacatgtcaattagtagcatatatttatcatcatctttttgggatgtgcagttatgttactacaacatgtcattgctaccatcagacttatgttcaatttttatttgacaaactgccatttctatctcgaagttaaacttttccttttcccccttgtgaacctttgaaaagggcagggagttcctgcaattcacctcgaagttaaactgagcatatggtgtttgtttcagtcataatacttttgcttatttcttttcagattgtcgaccacactacgcacgatttcaagaaagacgacggggtaacttttgtgattgaggactgagacacatttcacaacctaaggctgggtaatgaatatgctagactgtttgcatgtcttgtctgtttcctgagtttttaatgaacaatcgatatgcaaatgtgatgtacaatatgcacatatgagctgcttgttcaagtcattgtaaaaaacaaattaagaaaaaagaggcaaggggagtctctagtgggtacacccaaaagggcaaaaagccgtccagtatgaaatgatgttgctcttttctgaaaacaatatgaatgatttgagtcaataagtgatgtatttccagagagagaactatcagacaatggactttctggtatcgtggctgtcatactatgtttgtgcttgtggtgccgcgaaaaatcttactactcgagtattattgacataccaaaatctcgttatcaaggaagtgacattggacgcgcaattctgaacgcggagagatcggcagggggcgccagggggatcgacggtgacgagacggaacctcgacaacgacgcgccctgccgatccgggcagcgtttggactttttttttaaaagccccgatttggatcgatcgcggctaacgattcggccacctgtccgctgggtcgatccgtagtaggcgcttggccggccatgacgcacggcggcgccggcggcccggcctctcgccccatacccacggcggccgcacgccgcacagtcgcggtcatacgggcgaacgcggtggaagatccaggccgaggacgatggcgcgacgtcggcccccaggctcaaaaaaatataggaaaattattcgcggctttggcctccaaattcctctcgcaagcgccacgtttccccgacgtccacgtccattatccggcctggtcagagagaaaaccgggcacccatgctgattagccgctgcttagcaattgattatggattaattaacaggataatactggagtactagctctagctgctgctagtagtaatcagctgctcataaaaagcaatcgttggagaagcaaaagcgcacggcacgagggacgcccaatcctccgtgtccgttggctcaactcgaccaaacaaccgcctttttttttagtctccactctctccacttccccccctccattgccgccccgtttctctctctgatcggcaaaaaagtggatgctccggctgctcgaccgccatggtgaggtctctcgacagctacccctccatcaaagatgtcacctacaggttcgattctgcttcccctggtcgaaaaattggttcttggatcaaaaataactgccaaattcggttcttttcgtcagttatgctgattttatctttagtatgattcaccgagtatgtggtgtagtttccctaatttggatttagagggaatccaatttctgaagtgctgttgtctacttggcggcagctgcggatactgcgggtacgcgctgaacctgagctcgtcgacgcggaacacggcgaacatcgggtccaagtacgggaagcagatcaagaagggggtcgtctccttcttcgcggtggacgagagccggttcacgcaggccgacgaggtcacctgcgtgccctacttccactcgcggcgctcctgggggctcttccggcggaggtcgcggctgctgtgccggaagtgcggcggccgcatcggcagcgcctacgaggaggacgaacccgccgccgcggcgctgcccgcgtgcgacggcccggacgacctgcgcaccacgagctccgggagcagcggcagcgcgtcgagccagaagaactacgtgatcaagatcaacgcgctgcagccctcgtcggacgattctgatgctgttgcctttaccctatgacgattctgctgtagcctgtcatctcttccggcccggttgaatttgctgctgcagtcttggaattcgcattgggagtgcaaaaagggtgatattgcagtcaaggaagggatcgccatggcagtgagcttttggaagggtttgataccatcatgatcttgagtcacctttgctgtctgtagtagactagtagtgcttttcttttcttctgtgaattggtgggagtatacactggttgttaatttttggatctgttaatattggaaaatgacaaagtttgctgtatgtggcttggccctattgagtttgtaccatctcatgaggttcataggggttgcaattttgagtcatcttgctttactggtatgtcttaagtttctctacacggattcttcattagtcttctaagaaagcatgggttgttgcattgtgtcagttactgaatataaattctctgttaaactttaaattatagtcttttggttttccagaaataggcatgtatcttcagttttgttaagctgataaggtgaaaccataattctgatttctgtttatcagtgtaattttcctctggtgccagctcgtcaagaaatgggacttgggagcacagaatgaactcatgtaagcagggctccaggtgagctcatgttcatacaaagtttttagatataagtaacaacttcatacaaagcagtaactcagttgtatagcatggtaaagagcgttgtaataaccaagaaatatctgttctaatccacaaaatttgatatgcaaatagcaagatgaaggatcattttctgagaaagatgtaaaattgtaaattttactgctcaaagaatcactatcagtatcatatacaaaggagctctttagctggagcagtacaattgtcaggtttccctactagctagtaagaaacatacatacatttagtagagatagttgatatcatgttgtaataatcaaatcaaattaaaaaataatgtaaaaacactttagcactttatatgattgtcgtagtttactctatcattctgcttcaagtggctattgagttggcatgggtgtattctgcaagaagtgtctgaataatataagtgcttctcgaggccggtgtagtggtacctcatggcctgcgcctgctatagtgacgagagttaatcctttatacacttgactccaacctccaacctgcaagaggaatatatcatgtattcaaatgattcattctgacccagaatttgcttagaactgcaaatagtttttagtatactgacctttccgtggtcataccaagggtaccaattgaccatagttggaagcttaagagcatctattgagtaccttgttgcagtaacaggaactacagcatctgtatccccactgtgaaaaggagtaaagaaaatcacatagcaagttaagtcatctcactaaatgttagccagcacaatataatggattaactttgtagcagtagtaactcattagatcgtagtattgaatcaaacaatgagttgaagtactggactgacctgaaaacccatatcctgataccagctgcaatcaattcttggtagataggaagcatagatttcggggaatctgcccagtatgatccgacaatatcgctgtagaacagaccaaatgagtatatgtgtgtgtaagaagagcagaaattttaaggcacaattaacatctatatttattaaaacctgcaagttttccatgaatattgaatcccagtggtgttagcatgcatcgctatctgcacttctggccggttgtagtaaatacttgagtatctttctgtgcagggatcatatgctctggataaccaaggctgtggatggcaacatgatgttaggtacaaatagtatggccaacaattatctaccgatatacatatataggcatcaaatcaagctgaaaaaagacatgctaggcagaggaatgagaacaggaaaataaaacagcaaattctaaggttctgcaaagtacagtataatattgcagaaacatcaacccatgcactctatctgatctagatagggtgatataaccttttctgtattcaagaagtaccaaatgccacaataggaaataaacgcaatccattatctaaatatataacaaaataatctaactgaaatcagtaataacttcttaaaaaagaaattagttctagccaaaaggtatatttactaaacaataagtttattattgcatcttttaccacattatataatggatttccaaaaggtaattttcctcttttatgtgttgcaatgcagctactttcttattcttaatcagcacagttcaatgtgtttcgagtagtaaattcactgtttcatgaccatctaaatagatctgttataatgggtttaaatgatctaagtagtggaactagatctgtgcaacaaagtcaagagggtgatctaagttatcaaaagtcaatgagaaaaaaagaacacttacgtagcgtcctcccaagccaagtttgagagaggctgtattattgcagggctttgtatacaggctgtaaggatcgatattgccttcttctgaactggctaggttcaggttctttagacattcaggagaagggtgctcagaggactcaagcaagcatgtcttcttcaggttgtgataagtgttgtcagagatgaggccatgagtccaccaatactcaaaggtaccaagatagtcgtggtagtcatcagtaaccgcattacccacctaatttttcagaaaccaaaaaaattcagaacatacacatactcaaactagaacaggcagaacatggatttcagagatctaccatgaatcctttgagattaattattggattctgaatgcccttgttctgttcatagatgagctgggctaactggggaacgtaatgccctgaaagcaccaaggaaatacatccctgtaagtctttcatccaccaaatagcaagaacagaaaataaaataaaaacttatctcatgcaaacttacctgcatagctctccccagcaatgtagaactccctgtacttgtattgtgggaatctctccaaccagttcaccagaaatgcataagcatccgatgctacaagattaaaaaacaagtgacaagtaatcagtaactgaatcatggtaaatcagggcttagtggatagctcacagaaacaaatggcctcgaatttgtttacctgtcttagcatctcctgcgacgtacagatccaacgtcttgttcgagtacgagaaccccacgccggccggcgactccaagaacagcaaattcgccgctgcaatcaccaacagaaattaaaaacgaaattaatcaacagccagagccactcccagcactgccattgttagcagcatcacttgctgtaacaatggagctcaagaacaacaattgcaaaagctacgcacccttgttccaagaattggggttcaggtacagcgtcttcccgtcgggcctgatccggaacgggccgacctcctccgacgcgccgtacccgaccgacgagcaccccggcccgccgttgagccacaggacgagcggcgcgatgggcccggccgccggcaccgcctccaccagccagtagaagagcgcgcggccgtgcgcctggttgaccgtcacgtagccggagtactgcgagaacctcaccttcgccggctgcccggggagctcccggatccggtcgctctcctggtcgcccgacgccgcggccgccactgacactgacactagcagcagcaccagagccgcggccttgtgagccattacgagctccaaaatctccaatggccggaccacgggacacctgagcgtgccaagcaagaagccttgcacttgctcaagtacgcaacactgctgctgctactgaacaagatgagctataagaaatccagagctactagccaccaaaggaggccaggttgcttgcatggatttcagtgaggcggggtcgtgagctttgatccttacgccaccaccttcctgcactctcattgaccaaggacagctcaagaacccttggcaaccgctaaagaaatggaggcggcgggaggacggcggttgagctcattcgctctgaccagcggcgcgcgggacagagaggtagtgtgcggagattttctcttgctttccccgcgccggggatgattgattggcgcgagtacagctcagggacggaggaaaagggcggatcagatcgcgtactattggcacgccgaaccggatggattgcgagattaggtaagcggctgcgtgcgctacagatcgggcactcactggctcactgctagtgtgctagctcgctctagcgctgtagcgcagcgacgcggcggggcaagtgggggtgtcggcaactcggcattagtatagtggcagtggcggtggtggtggtggcggcggcgctggcggcgagcgagggcgcgcgtgtgaaacggaggtagaagaagctgaaacgagcacatgggatgggactgggagggaaacccccgcgcgcgcggcagcggcagcggcagcgaataacaaaattcgcggaggatgacgcgcgcgccttccttgccgcggcagcggcgtccgctcgtgcgcgcgtgcgcgatggaaagcggaaggcagaaacggagcacgcggcgcaacgtgattgagatcgtgagggtgatttgagatggtgaggcgtttgctaactttgaggcgctcaagacgggatttgcttacgagagacacggtgataatgacgagtcgtacgaaagaacgagcagtctcccagaagaacagtcaccaaactgacagcccgcatcattgcgtcacacgaagaaagcgagatttgtttccgtgagccccacatcagataggagtactagtagtactactctgttatcgatgctccattttaaaaattctccattttgaggaactcgtattacatgagcgcatgcaggcggtatctaggtttggcgtttggccccatgttgaggtgtcgagtgccgacgagctgacagcgtcgaggcaaagggctgcaggaa

SEQ ID NO: 17336 - DNA, 6372 bp, Oryza sativa
ttcctgcagcccctctcaaaattcagcaatgacaaagccagccgaccgcatatcgaaaggccagcaattttaacttgccaaatcggattcaggctcgatggcggagcggagtccctgccgaaccatcatctgcgcgtagaattcggcgtgttcctgttcaggcaagcaccaaagtagcaaaagaaaagttaactaaagctatagcaacatactactagtactagattactagtagcatgtgatgggagcgtgtgtgttgccgccattttcggttggtttcgaactaaaggaggcgggcgtgaagaggctgtggaatttatataccttcacggcgacaatgacgagcgcggcgcctttctgccgggacgcgtggaagagctgccgcgccgcctccgcggtcacggacggcaccacctgcggcaaggccttctccactgcacacaccgcacgcgtatcaacacaagtcacacagcgacgcagccacgcaggcacgcagcatgtttatgtggcattcacagcgttagcgatgcaggcgagattgttcagcttgcagacttgtaggttgcagcaatacaggttggccaggttgtttcgtgagaagagaaggatttgcgtaccaagcttctcggtgtggcgggcgtcgtctatgagcaaaactttgtagctgtcaccgcttccagagcccctcctgtccctcatccttccggtgtcccctcctgtgtatacagtcgtaaatgcgagttaagcaacactgcaaacgaatgacaaatctctctacaaaggacgcagaattgcaaaaagtacatcgttgcacataatcgataaatcaccttcttgtgtcacgggaagcgtgtcgagctgggactggtcgaaggccggccgctccagcagcgcgccgccgctgctggcgtgcggcacggccgccaccgccaccgccttcctccgccggtggctgactctttggtccacggagacgctccgggagaccggagcggcggatgcggtggtcgggaagatgagcgcgccgcacgcagctgctctgctactgatggccatggcagtggcaggcgttgtcatgtcggaatcggaagcagaggagatcgatgtatcgcgtttgatgcgcgcggcaagagttcgctccttgcgtgagggcaatggagggggagaggcgcacacgcacaattcgcaaccggtggaagatgtgagctttgttcttgtggcgatggtacatggcaggatttattcagggtttcagccaagaaagcgccaaaaagccattctgtcgtgtgcttgagagcatggtccatctgtgcgtactcggtagggcgaacgatctgtggctaagcatagctgacccggggaaattgggggctattttggattgaagccaaaacatgtccctaccaaaattttggtaacttaaatagtaaacgtgctagtttggattgaaggccaaacaattggtagtgtcgttgctcaatttggctatattctagaatcttcttcaccatgtatctatctatctatctatctattatattattaagacagctcgaaaaaaggcaccacgttcactgtggagactagaaattctcagattaatcgaagaaaaagaaaaaaaagagtccaaacagaaatacaatctgaaaaataactggaattcagaatttaaaaaaaggctatattgaaagaggagtccatctaaaaacccaatacgtgattaattaaaattcggaataataaataaataaattgttgaaattagaaaaaagaaaaaagaaagttcaagtaggaatacaaatttgaaattactaaaagaataatggtctagatttgttgtacacaagataatcatatcaatctaattatagatcatacaatccgtactaggagtccttgtccgtttagaaaaatcaattgcaaaactgtacagtatagagctatgattctaaaccaacatacattgccgcacatatatagggtggagataccagaccagcacgcttaggctgcagcagcagaaaaataatatagtgccctcatttcatacgagtaagaacccaatacgagattaattaaaattcaaaataaaaaataaaataaaatccgaaataagaaataaaaaaagaaaagaagagtttaacttggaatgcaatttaaaaataactgaaattcgtaataaaaaataaatattatttaaagaatacaccatctagaaaaatacgagattaattaaaattcgaaatgaaaaataaaataaaatccgaaataagaaataagaaaagagaagaagagttcaacttggaatgcaatttaaaaataacttaaattcataataaaaattaagactatttaaagaatacaccatcagaacactgtcagggttatggataccacatacctaatagtagttgactaaatctcggcaggatccaccacataccatgtactatacggaaacaacctgcggatataggaggagttccggataaggaaagacaaccagagttctacatggaaacgacaaggactactcggattgtatccatattggtttctttatttttacttggacaaggggacacctataggtataaatacaagcccccctaggaggagaggggagagaacatagacacggacaatcaacacacgaccacctcaatcaacacccaacacaatcgacatagaagcctacatacgccaagacacgccgccggatatcgacttcagggataagcacggctagtaccctgcggtgtctccggatactgtcaggagagacgaaagcgttatctctgatctcgccgggcacggattcgaggaggaaggctaccctgttgtcgactacgagtcagaacttcagaccgccatatcgacaacagttagataggctaccccaaacattgtactggtgtgattatggtgaataaaagcaacgaccggctccggccaacaggatgtagggttattacctgacaattcaggggcccgaacctgtataaaaatcctcgtctccgtctcttttacctcagtctcgcgtataccctagcaccgacgatcctcatatcatgcaaataccagaaccgcgacatcagacgtcgacaaacacataacgagattaattaaaattccgaataattaataaaataaattctgaaaatagaataaaacaactaggaatataatttataataaaatctatcggaacgaaaaatatggaaatttcaaaaaaaaaatcatctagaacacaacgatgataaatgataataaatatctgagaagcaacagggttgtaaaggagtagagtggtgacagttagggacatctaaaaactattaacaaaaccccaaatagaatcccaatgacaattaaaaggagtgacgacggacaggccgttaagcagcacggtcacgacggttgtgggatttctaaaaaattaaaaaaataaacctcaatgataatcacgttcgattttaaaatctcaaatataataaagagtgggaggaagtgggcgagccgtagaggagtaaagtgacaaagccactgacggtttggtgggactttagaaagtaaaaaattgaactcatacgataattatgtttgattttaaaatcccaatgacaataaagagaggaagcagcggatgggccgtagagaagtataatggcagcttttaatgggacttctaaaaataaaaaaaaatgaaaccaatgagacaataaactcaaaaaaactataagatccaaaatttaaaggttagaaggagaatgaatagaagccgtggtagatcgagcaagcaaacaaagaaagggtgaaaaaaaagtaagggatagcaactgatgtgacttttataaaagttataaaattagaaacatggggatgatatggtttggtctttcaaaatcttaagacaatgagatatgtattgaataaattataagtaaaattatattaaaaatagataattttgtatggtgttagccgcacaattacgcgggccacccagctagttatattattaaaggaatagaaaaaggagcctccacgttcgctctcatgacctagaaattctcacattaatcggagaaaaagaaaaagtagagtccatatagaaatacaatttagaaatagctgaaattcggaattaaaaaataaggaatattagaataggggactagagtccatatagaaataaaatttagaaatagttgaaattcagaattaaaaaataaggaatattagaataggagattagagtccatataaaaatacaattaggaaataactgaaattcggaattaaaaataaggaatattagaagtagagtatagagtccatatagaaatataattaggaaataactaaaattcggaattaaaaataaggaatattagaagtagagtatatagtccatatagaaatacaattaggaaataactgaaattcggaattaaaaataaggaatattagaagtagagtatagagtccatatagaaatacaattaagaaaagaatagaaattcggaattaaaaaataaggaatattagaagtagagtatagagtccatataggatttttaaaactaactaaaatttggagtaaacataataaaattaaaagtagagtttagaatccgtataaaaatacaatttacaaataactaaaattcaaaattaaaaaaatatgggaagaagattttaaagtcaatataggaatacaatttagaagtaactgaaattcgaaattaaaaattaaagaatattgaaagatgagtttagagtccacatagaaacacaattagaaataataaaaattcagaaataaaaataaataatattggaagaagagcatagagtctatatagaaatacaatttacagaaattttggaattaaaaaaatattaaaagacgagtctagagtccatataggaatatatataatttacaaataactaaaatttgatattaaaaataattaataactaacacgtatataaaatacaatatggatatttcacattagtagttttgtaaagttattgcaaaatttaaaattatgttgtcattttaatatattagtataatataatgagaaaacatatatgctattatatatgtgataatataatgatgctagccgcgtaatctgtgcgggccaccatggtagttatattattaaaatagctttgaaaggaggcaccacgtgcgctgtggaagctagaaattctcacattaatcggagaaaaagagaaaaagaaaaaggagagtccaagtagaagtacaatttaaaaatggttgaaattcgaaattaaaaataagcaatattggaagaagtttccatataagaacccaatacgagattaatcaaaattcgaaataaaaataaaataaaatccaaaattagaaaaggaaaggagagtaaaagtagaagtacaatttaaaaatagctcaaattcggaattaaaaataaggaatattgaaataagtttccatataagaacccaatatgagattaatcaaaattcaaaattaaaataaaataaaatccaaaattagaaaagaaaatgagagtccaagtaggaatacaatttaaaaatagctgaaattcggaattaaaaataaggaatattaaaagaagaatccatataagaacccaatacgagattaattaaaattcgaaataaaaataaataaatccgaaattagcaaaagaaaataaaagaagagttcacgtaggagtacaatttaaaattagctaaaattcaaaattaaaaataagcaatattgaaagaagaatccatgtaagaacccaatacgagattaattaaatttagaataaaaataaaataatatctaaaattagaaaaattaaaagagagttcaagtaggaatacaattttgaaacaactgaaatgaaaataaaaacattaaaataatacaatacgatattaactatttttttaaaaaaaatctgaaattataaaaagaaaaataagatttaaattaggaatacaatttataaataactaaaatttgtgataaaaataaagattattgaaagaaaagatcatttaaaacacatgacgagataaattaagtaacatgcctataaaggagtagagtggtggcggttgatacgagatataaaaattgctaataaaacaccaaatagaatcctaataacgactaaaaggagtgacgtcaggcaggccgtgaagcaaatgagtaaggcggttgtcgggacttctagaaagtaaaaaaaacaaaccccatattcaatttttaaaatctcaatgacaataaaaaggagaacagcgggcgaggtgtataagagtataattgcagagccgccgacggttgacgggact

SEQ ID NO: 17337 - DNA, 17532 bp, Oryza sativa
gtggtagtgagtgttccagaaactgtagtcgttagcaccaaaacaacggtaaagatccagaaccaagaataatgaaggcaagccaatcctactttttctcaaaaccagataaatccgtttccctccagcaaatggaggcaactgaaaagaggtcaaaacaggcggttgcccctggttaagtccgtctccattacgagaagacacaacaacagcaaacggcaaaggataggatgaactcttcgtatttttatattccattcttaaaaaacaattctgtaacactccagtaaaaagcataactttggggtaacattttacagtgtaaaggaaaaacagcatgcattacgtataccacatatttatccacgtcgggacaactcactgagcaagctatctaagcttggcagaaaatcagaagctcctatgtactgcaaatgtgcgcaattacttgactggaacaaactaactttaatttgcgcgtcaaaccacttggtagttataagtaaccaatcgattcctctgagaaaactttggtgggctaccttccctcagcggacggatggcggtcacctgaaacaagaatttgcaacgcaagaacataaattcaactagaaaaacaccaaatatagaaagttggactgactaagccaaagaggaacggcatgctatgttcctgactgttttctccgggctaacagtgtcataatgcaatcagttcaaaaaaacattcgaaagcccataaataaatttcagcattagaactgctataaattttcaatgattattctatagggaaaaaaactgctaatttttcaggattagaactgctgttccttaaaagtcagttttagaataacattctactatagaatggtggagaactggagatatccagagttagatatcgctgaacttttgtatctttaaatgcatgtataccattttcctaaaaaaccaggaaaggacacccccactacttggtgtaaaatgctaagtgggtggccatgcaaccttcccagagcaaattaggcgtcaagtggctaaaagacttgatgcatggaaaggagtttaatctacagaccatgggtcgagattctcagatctgatcgcacaaggggtagtgttctaaagaaagttggatgaggttgggaaggtcaaacaacaaacatacaaagttttcagcagaaagttcattgactaagaatcattattaattcaaaacagaatacacacaaccatcaccatgaaagatgccatgaaagcttcatgaacaatggtagctgtaaagtcaactaatttcaactcagcgaaaggctagtaaaaatgatgtgatacagcaaaatgcccatgaaaaattcaatcctccaagatattttgaagtgcctgattgtgtcaaattgctctgtatgcatgtaagtatggtccgctcaataatcaggcaactatggtaaagaaggaaaatcagaaagtatgcatgtatgacacagtgggatataataaccaaccttcaaatcactaaatgtatttgatgcagaaaacccaacagatatcgggaagaatgttgatggatcagctgcagggacagtgaactccaaagaaccacttcaaatgaaaaaataaagttagcatggacaccgtggagggaaaactgtgcgatactagaaaagaggataatgttgagaaaacatatacttcttgtacctgcggtttgattgatcaacaagaataatggaccactccaacactgaatttcttgagtcatacctggatgtaaagacaagaaatgaataaatgaatgaaagtaatgaagctatgcagctaaagatcagcttggcaggtgatcagaagaaacttccataaaaaaatcattttcaaacaaaaacatgagccacatcacaaattattctaaagctctaattatactataatgcaatgtataacacgagaaagcaaagccaggctagatatttatttgcatttactatttgttaacataaacaccaagacttttgtcaacgtgcagttaatgtccaatactccaaatagttctttggcagcaaaaagtatttgttaacgagctccacctttcactagtaacctaaactttaaatgctcaatgaaaacttttgcacgatcttttctttccatttaggtgcaatgttaaacttcaaaattaacagttaatagcattagagcagtcccaacccatagtgtccataaacagtgtctatgatgtcatatcaataagacatcacaatagaaactacactccacaacccatgatttcttaaagtgggccattaataaatgtatcatctctcttctctaccaatcatatttattcttcatctattatgaaaacactattctgtcccaatgcaaaacttgatagtgtctagtgcataggttctcatgttgaagctgtgtcttgcatgagacctagtttcttcctctctttactctctcttaattaatatagtgccacataagctaaaagtcctatatggcaatgtagttaatgccatagacaccatcctaggtggagggttgggactgcccttatgcatggtaccagacaattaagacaagacatgggccaagaaacattacctccattctccgtctatctgcctaacacctggagcctccctaagtgcggggagagggatagagatgacaacattgtgcaaatcaaacatctctgaagcttcatattcaatgttcacataggtttcatttccggacaccgaaggccaacagttcactgcaattggcaaaaccaggttatacatgtgcaacttagcaaacaactttaagcaaacagttctttttacctgccaatggaagagatgactcattcaactcctggattctccatttcaccaacggtgtttcattttgaccactggggaaaggcctgtttggatcttttgcccccacaatttgttgactgttgaataactctttgttgatattggggtgtgtcttgaagttaaggccaggtacatcttggttctcaatctgtcgagcacaccaaatatttgaagatttagtaactcctgattaaaactaaatttagataataccattagtcaaaagagttttgcaggtaagtgattcaggtaaatattaacttgccgatgtcaggaaatccctgagttctatagcaacttgtataatctaattaggaacaaacaagaatttaacaattaatttgtgatgaatgcaattgttcagaccaaaagagcttggttctcaaaggtctgatttatggaaagcggtgcagaacaacaattctcaaagaagcttggttctcatggcctacgaattatctgaagatattcaaaacagtagtaatttcaacaaatattcagaaatggggtttgagttgtataaagctgtgcaattagttaatagatgcaagcagaagcttcatgcaaattctcattaaaaacaaactaatagattgtgttgattccaaacaagggcataatcagactaaaagatccagacaccatatatagaaaataacctgtaactgaataaaaccatcagtgtcattcagaatttggagagccagggttccttgaatatcaaaattgctaactcccccatcccttttaacagtgacattgagcttctcttcaattgtcactgtgataggatcgcttggtgggatatatgatgaccttgattgagttgcacttggttgagtgtcctccaaaatgacttctccttcagctttcaaagactcaaggaactggtttgtcttctgtgctttgcttaatttcataccaccaggaactttagtagaagcagatgcaggagcaggagcagatgggcggcctgtacatatgccagccgtcaagataaaacagcatctagatagtcataacaccaccaaccaaaattaaccatcctatatccactagccacaccattaccctagagaatcgactttactcaagtcaaaagaggtctcaataaattgagttaaaatacatgtggaattgtggatgcaggtatttctttcttgaaccactagccatttcgttggtacttttgttgtggcagaacccatcactactttcgaacaaatcaacaaactattgcacaattaagtgattttatttatgagctacggtgttagatgaacaatgtgtaagatgcacatttgccctgcaatttggcaaatagttatgtgtattactttctggcatgtcacaactgacaaacttaaaaagcacattagtacaagtacaatattgtttgtctcacataagaaagaaaggttgtctaactcagtatcaagatcctgggtagaacctaatccaaatcataggagcacggaaatataatttaaaataactggttgaaatcctatcttatgctgcatggatgattctctccctaaatcattaggtgtatgtatgaacaggctaaaagaactgccataaaatatttactactagttttggttaccaatgctcaggaaaatttattgttacaggaatattacaagtctagtcagcttccttgataggactccaaaaggaaatgctaaataatatttccatttccacatgtaaggcatttgtttgagtacaaacctttggccttgtgggtgaacgagtccatatcaccaaatataggatcgccccctggaccaccacctctaatgcccatgtcactgaagctgtttggagttctcaaggatccaaatcctcccttgtcaggcttccctctatcagtctgcatatttcaacagattttaccaacttatataaagatgaaaaataaagctatgcagttactggttcactacgccttcaacattaatttttagcatatatttcctatgtgttcgtagatacagtttgcaacatttaagatctaaggttccatgtgatactgagatgtaactacactgaaccagataactacatgctctatatttgagtataggtagcacaaaccttgcttttctcaatctcagtgactttcctcctcatgacatccttagtttcatttattttgctttgcataaccagcttgtgcagcttttcttcatggctctccatttcacagtattgtttaacttgtgcaacagttacgttctctttgtttccaagagaaatggcttcaataaaggcaaacagaagctcgaatgctgccttacagacaccctcttcatccaaagagggagcatattcaggtatctttgtagacgttcaaggaaatcactgcattgaattggtatgcacaaaaggcaaatactaactatgtcgtcagcaacaagaaatagggtttatcaggttagtggtgactactctgttgatctttgttccaaagtgaagttgttctgcagttacacttaatactgcccttttctccttgccaaaaagaatataagttcgaatttttcattgtgataaaactattgaatgcggagctacagccttttttttaatctttctgaaatagctacatttttttaaagaaataatttagcgtttgagaatagaaatatagcacaactgatggtaggatacaagcttggagagtagccttaaagtatccagatcttcaagaatgttactttgcttatttgtgatgagaagcaaatacagtgcttcaattggttgatagacataacgaacattttcagtctcaacataagtatgttgctttccacttccgaccagcttcggaaatgctgcaagcagcccatcgatccttatccgggacatgtcaacaaattgtctcgaaacaagagctgaaatcaaaaaatgacaaatttcttgttcataacattataagtgtagacataaacagactacaaaatgcaaaaattctaaagaccaaaacttgtgcatataaaagccattttagtgttgttacttggatagaattggtgtacttgcgtataagaaaaggatgttaattgctattgttagcaaaattgtattgccccttttttgggctgcaagagctaatataagaggacatcccattagagaattgtgaatccaacaagtcaattgttcgagaaagttgtgaatccaataaataaatcaataacaaaagatactgtgaattggaaattttcaacaaactcaccttttccagacttcgatataatagaagctgcaagaaccacctgtatgtgtataaaagaaacaatcactcttcttaatagagcaaaaaaatgcaacagtttaaaatgaaacaaggataatgctcattcctttgctgtgatgcccttactaaatgtcctttcctgaatcaatttacaacacagtaacattgcaaatgagcaattcgaataaaccagccataccattttgaatggcctttttagttccagggattaccaaatccaagttgacaagatatagaactgcaagacggaaagtaatgagttccaaagcaatcgatccatgcgagacaactgaacaaaataaatttgtcaacactgcagatgcataaccacagaaaacataaataatgagtttgtcaataagtacaatgtttcttatgcttttgcgtcacatgtccaacaggatttaacaaactttattaatgaccagagaatactgccgctgttgtgatgcataaactaaataaaaaccagcacacttgaattgcatcaaaagttcaagatccaattgaggccaatcaaagttactaaaacacaataacaaggaaaaactgcatgaagttaagtgaccatcgtgaacacagatgaaatcagacatatttgggaatattggttattaggaatttatatagcataaattgctgatgatggataggcatcaatcagcataccactagacgttactacatccgatgtatgaaaaaaatacaaactttcatagatttataacaaccatgttaaaaaaaatcacataatacaaacccacgtaacagaaaaaatatgatatcaatgcctaattgaaacaacgtaaggctcaagctagttttcctaattaagcaacgtccaactagtgcagaaattctaagcataacgtgcgtatatccagagatccagactcacaaagtactgaatcacaggaagaaaatctcacaaccaaactgcttggcatgcaacactcctcgcaaaaacgcacactatcggacgatcctcatactgcacacgtaaaccgaccatccagacaaacggaacgccccggtggcgcacaaactaaattttctaagcaattaagagacgctacgaagaactcgtgcaaaccccaccggcactcccaacacgagcctggactccaacccgagagattccgacaggcaaacgcacccagcgaaatgaatcaacaaggccagcgccctgcggatccggcctccgggtggcgcgaccgaccaggcggctccgtcactgcggcgcgtcgatggcggaaggcacgagtcccgatcagatcctcgcgccccgcaccgcaggcagcacccgcgcgcgggcggagaaaaccaacccgaatcaaaccctagggctcccagggagaatccggaatggagagaaggcgaacgcgacggggagaagggaggaggtcgggtgcgcgcgtacctcagatccgcgagggaagggaggagccgagccgaggacgacgacgcaggcaacagtgagctcgctcgctcgcctcgctcgctcgcgcggtcgcgggtcgggccatttatcggtgggtggtgaactggttgggccgtacaagcacgggctaattgggcccaaaggcctagcaaataggctgattgagcccagggcctagttctgtggaagttaggcccaatattgggcattgagctatatctatgggcagagtttatgctatgtttttgttttgttagagagcatcagcatccaatgctcttgctagttattttgtgtcaaaaagaaaagtatcattggtttatgctggtttcagaaggggaagggaattccaatcctgcaaccaaaatgaagaaaaactgagagcaagtacaatagcaagctacaagcttgcttacttttttttttcttctcaaatatggagaagagagacgagaaaaagagagagcatgcttttatgcaagagtcaatcttgcaggcgatccaaaagaggtgaatgaaatagaggaactgaagaaagagaggggaggataaaaattggagacagctttgtagacaaactattgtactcctagatgttagctgcagtatactacgtgtaagagcttatagacaatagttaactctgctattaaacttacttggagaagaatggtgctttcagcgaagcaaaagacttttctttcgacaaatgattagtaagtgccttgtgcatgtttctagtttaagtcggccaccgatactactaccaaccaaataatcggcgtacctgaatacattgatatgggtatggagatgttcaggtaccaaaaccagcagaatctaccaagaacgatagacaagtactagtgtcctatataggacaagcatctagctgaactgttacgacgtgtgtaagcaatgcgtctgtcggctgagttatttggagtactagccaagcaagcatgattgcaagagcatgcgcatgcggcgtgctgatcgttgggaatacagcattctgaaatcctgatcgtttgcccttgtcgtttgttaacagtgttaccaaagcattgtgccttttgtcgtttcacagagacagccaatacagtagataagataactggcattactctgcattacctggatttctcttcttctttgaatgcaagttagaaatactgtcctgttctttctttttctgcacaatgagtccctcttaattaatttgcctgctgcaactcacagattcccagtccaccatggagtataatcttgtaataatgctaggtactagtacatgtacaaaccccaaacaaaattgtcagttggcgcaaactcacagtccacaagtacagtgcaattaagatcttatgttctctggatacaaataaaaggtggtagcaagcattcatcatccatacgacatatatatttggcactatcacattcagcaatcgcatttttggtatatgagtatgcatcaagtgaagatgtcaatgttacataatctcgctgcactgctagcagcactatcacattcaacaatcgcatttttggtatatgggcatgcatcaagtgaagatgtcaatgttacataatctcgctgcactgctagcatgtaaacctttttagcataaactcttaagtcactgaaaaaagaactggaatcacagttccatagtttccatagccaactgggtcagcacatcgggcacacatatttcataaccagaaaaacccatgtcttacaattaataggtcaacccatagttcatggagtattgtacattggaagagaagcacacacaatattagaacacaccaccatttttttccaccgcttcattttctttttcttactcttcacacacaacaatcatcaggaaaaaaactgcctgtaaacagttagaattgtctcaaatcaaccctgacaaatcatacattttcacggagggttcaacctcgactctcgagaatgcaatctaaattagaaaatacacaaaggaagaaaagcaacctaacaataataagctctgataatatgactgaattatgaaaccggaacatccttcagtgaggcaggatccaccttaggagggtctgaatgacgcctccctctttccatcagcttatctgcatgctcaccatttggtttgtctgcgactgggaaggataagcgcttctttattgaagaatggaccaggggtactctctcaggaacctcaaacctgtcagtcaatagactgcggtaccgagacttcgcccttgcagactctgtggactgcatgtagctggggagagctggtgtgcttgttaggctcgcatcatcccgaacagaggcaccacctgtgctctgcctccttgggcgttcagagcgtatgcttgtgatgctcctcaagtcatcctccttatatagccagctatcccgtggacttgctggtctgatctttccggtaactgaggggacccttgacgggggagttgatggcgattgccgacttggtggacggcttgacttgtttggtgttgcaggtctctggattgagattgcgcggggtacataagtacgagaagcgctagtgctgggattctttgttgaataatggtccttaggatccttatctgatatcactcggctctcccaaggccttgatgtcatccagcgttccatccagctccatccccagttaggattcccttgatccgtgaaggtaggtgttatagttcggccagaattcttccactgcaggagtcaaaacagagaaggggctttttttagtaacgagatatacaattacatctatcgagatatcacttaaagctacaataggtaagaataaggaggaaaataacaagaaaagtgagtaattcaaagaggaaacttgcctggtgagaaaatgcataggcaagagctctttcccgccttagcgcagcttcttgtttcatcattaggctggtctcaacctgctccttggactgatggctatgatcccaatcttcatcaatctgtcaatgaaataaaatagcatagtattgttagaaacctgctatatatcagaatcagctcattctattatagcagaacttttaaggttacataaaactctactatcatgcaacagtaatttttgctatggtttatgtttcttctattccataaataaaagtatagaatatggaatggctcaagtaggctccataagtgatttatgcttgtagactgtaaagaagaaaaaataccgataaaagaatctataggatcttggaaggattacggagtgcttaccttcattttctcaagttccctctgatgctttaattgtagctgcctttgaagagcctgtttttcctcctccatcttcacccttctagagtatatttgagtttgaactctggtcatggtttgtgtgcaatgcaaggtgtgcgcagtttgtcgtttgacggcgtttccatcaaccagcgacttcaatctaactagccctctaagtgctcgcagcgctcttcttgcctgaaataatattagttctgtaaaataagtagccacttaatgtcacataaataaaacagaacttaacaaagatttaaagctcatcaagtcccaatggaagtatcttgtcttgcttcactttgatttttatagctattatatcaacaccaacatattgtgatgtgtaacaacactggagtctggaaacatcaaacgtcagactaatgtatgtttcattttgaccagcagaacacaatattgacggtgttaccaaaatggacaaagcagaaaatgatgcatctgacagcaattttctaccaaccaaattagatatcttacaaacacttaatattagcaggctgttagctaaagtgcatgctcaggaatgaaaaataaatgcccaagacagtgacccgcacaaataacaagatataatcattttttgggtgtattcttagtgaaaagacgtaaacatgggtgacaaggacgaacacaattatactacaagtgcagttggttaccagataacccctgaaggcagtctgaatcttgatagcggcaagctcatcctttgaactaacaggcgatttcggcacagccgtggtggctgttgtgaggcggaccacctcagcagcggcctgggcagcgacggcagcagcttctgcagcaacagcagaggcaagtgcaacagagtacgcatgcttgttctgttcactgtcagtttcaacagccttgacatctttgatctcctcaggctgtggctggatagggtgtgttggcggtggcggtggcggctgtggaggcggtgctgtagaggtaggcactgccactgttgaggtccaaggatcagacttcttagactttccaaatggccatttcctcctggatctcgacttgtccgccttctcgatcttcatggtaatcaaaagatatatattgaagcaaggagaatttttatgacaagtatagcgatttattgaggaagcagataagttttggcataccttagcttccctcccatctggatcggatgagctgaagactttcttgacagcactgaaccaatttcctttcttacccatttttttggtgttcctttattgtgtcttcagctaaagcctgaaagcatcagagcagacaccaaaggttcaggacacgaatggctgtaaaagatcagctgaaatcatataaccaccagtaaaatctatggttttctgcagaattaaaaagttcgacatggtcgcgcacagaaaagagggtttttagtaagatgtgttaaagatcagaagttctgccagtattatgatactgcctcaaacccaaccggtcaagtatccccactcgtaaaatcaaagatttaattttaccagaaaatcagcatggccaccaaaaattgacaaaaaaggagcacgcaaaagccttaaaccgatcagagtaaaaaaagaagcaaggaaccgaactccatggtttggagctagacgattaacgtcagtcgccaaactccaccacaacttactacctttctcacaaaaaagggcaaaactttgaccactaaattatcctagttccgcgtgttctccttcctcgctcgatcaatctggcagcggcaaaacctctcaaaccaaaaggatcaaacaccaacccagactgacaaaatcccccacccccgaaacaaaccctcgccacctgcggccaaatcccatcacaaatgcgcagcgaaattaaccctggattcacctggagcggagccacggaaagcgcgcagccaggaagaacgccaaaaccgggggacgcaacgcaaaaccccaaaagaaagatgccgttttttacagtgagaaaaggcgagagagctttcacctcaaagcaaccaaccaccgaaagccgctcaccttcctcgcccaactgaagccgccaagaaacctaactcgagccgccccgcccctgcctccctcccaagccaccgcccaccgtccctccccctgcttctactacgggtcagatcaaatcaacgaccccagccatcttaagcggaagagacggaaaagaaaaaagaaatctcaacactcacagaggcggaaatggtggataacccaacctgtttttttttcttctctcctttttttttttttactttcctcgccccgtcgaaaggcgccgccgctttggcttttatcggcagcacgcagaattgattcgctctcgcggtcgcggccaccaccaccccggacgacgacgaccccgccctcctcctcctcctcctcaccaccaccagccgttacgtgggcccccccgcgcccccctctgaccgcgtggggaccaccgcgagcagcagcagcagcagcagcaccgggccccacgacgacgacgagccgttcgttccctcctcttcctctagtacgattctacgaactcctcctctctctctctctctccgtcgccgcggtcaccggctcaccgcaccgtgacagcggagaggcgtgtcgctgtcgcctcttatggaggcggaaggcgagcgaatccccccagctgctgctggtccatgacaggtgggccccacctcgccgtgggcgggacgggacgggacggcgcggtggtggcccacacgtcagcggcgggttttttttttccgttgcttgtacgacccgggacggcgccgtgcgggccgtgcatgcctaaccggtggcaggtacgagtacgactacaccggctcgtacacaagccgtgacacgacacctgtagacctgacctcccccaagtatacgtggtccacatgtaaaatatagataggagtctagtcctttgggtctgttacgtgggggggcggggctggtagtataccctacttgccgttaatgccgtgttaaatgaggcgtttaagcctttgattaagtgcgagtgtacccgtagatgcaaaaacgtttgtggtcttgcagagctggaaaaaaggcgatgctcggcggtttttacagagcagggacaaagctgatgagcaaccgcaaactgctctcgtcgtttgtaggagtaactttttgcaggtttttgccacccatgttccggtcgaagggggagcggtataaaacaagctgcaaatgggtggcgatggcacatcaatattcaatcatgcgattaaaatagcgttggtgtcagtgacagtgcaaagccgccaacgagatgagatccgttacttggatcgagttctttcggggttttttttttcttttttactcctctactcctactattcctgtgtctgtgtgcatgccagcctttgtgcggtgtcttggatcttgggtggggagcggccatggcctatttggcctcggttcttggtgcccttgcacgtgccgagtgccagtttgggcagccgtctccggccgccttttcaccccggcgcgccgctgccttttcacccgtacgcgagcgaaaggctctgcctttgcctgcaacctgcagctttgttgattgccacagtgagattgagggcgcgatggattgatagtgccatctgtaaactctcaccgcgccgccgcggtgaaaggttcatgagaacgtgctgatcaccgagcgccgaggcgagagctttttctgtccagtcaaataccgtatgttcagctgtgctcacatgtcatcttgaacactgctactattatgtttttgtgtttgtgtagtcacatgcactaacccaggtggctaatcattgggggtagaatggtagattatggcctctccgcgtagaatcttggccatacatactttccaccttgcactttgcagcggagtgagtagtacattaatctgctactactagttgtatatttgtatgtattcattgatatatgtacaatgtacttatcacgacactgaggtactgcgtggtggtttgatcctttcattattgtgagactacacatctctaatcaccaagacaccaatgctctcatgattgcttgttgatgcatggtcagtgacttggtacgggtgccgggcgtcgcttttccgatcagaaattattgtaccgtggtaagacctttagatgggactaaaacttttaactccctatcacatcggatgtttggatataaattataaatattaaacgtggactattaataaaacccatctataatcttggactaattcgcgagacgaatctattgagtctaattaatctatgattagcctatgtgatgctacagtaaatattctctaattatggattaattaggcttaaaaaatttatctcgcaaattagctttcatttatataattagtttggtaaatagtatatatttaatactttaaattagtgtctaaatatagagactaaaattaagtcataacatccaaacaccacctaagaatgaactgcgcagacttgaagtgggtgagcaaccgaacgtcgcacgatcgtaagtgcaatcgattttgtaacaacaaaagaataaaagagatggtagtagtagtattgattattgaagagacgagggttggttgtccatgactccacgggcaaggccacagggatcctctgtacgatcaactatacacagagagctacagtgtttgtgccatagaactctttggaccgttggatcagactttgcatgattgggactgggtctactgggagcctgggatgctacagtatgctttatgcagtagcatggctggaaaaatgtactctagactatacggctagacacacaatgccaagagacttctgaacaatagtttatacgcaaaggcaactcaatagtattaggcccctttagggcccctttgatttgtaggaaaaatgtaggaattttggaggatttcaatcctatggaaaaaaaatcttatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgtttttcctgtggtccaatcaaacggccattcctgtgtttttcctgtgttttgcaatcctctgttttacaattgtattcctgtcagaatcctgtgtttttcctattcctctgttttttcattcctacgattcaaaggggcccttaatatgtagaaaaagtataagaattttggaggattttaatcctataaaaacttcttgtgaagacctttaaaacattggattgaatcatatcatatcttttgaaatttctatagaatgaatgatcctatagaaattttggaggaaaattagtaagatattcaacatcttgaaaaatttcctttaaatatatctttctcatctgattttggtgtatttcctgcggtcaacattgtcattcctatgttttacagtgttttgtatttgcattcctgttaaggacccctttaaaacgcatgattgagaaaacacaggaataggaaaaacgtaggaatataatgtcatacttattggattcctatgatactttgaaacacaggaaagtcaccaaccgtcgttttattagcacacagaaaaaacacaggaatttttagacacacgaagaaaaataaacatgatgtgagatctcatgcttattttcctccaaaattactcaaacaatgtctattccatagtaatttcaaaagaattggtaggaaataatcctttatttctaaggactctgtagaattatttttcatagaataaaatcctacgttttttctattttttttcattcatgtgattcaaatgggtcctagcgtgcgatattacacgcaaacttttttttagaacttaccacacactaacgaaataatgccagctcttttcagcacagaaatatagttgattagtcaatgatcttaaggaaaaagatgggtttttatgggtttgatgtgcttaaccgttcacctttgcttagtaagatatcagcttacttaattttccgatgtattttttgttatacaaatttatgctgggatatcagcttacttaatttatgctgggatatacaaatttgttaacacagaaaaaacggatgaatttaagtagactagaaaaaagcagttaaaatgcactatcattttagtgtttcgtgcattaccatttaccagcatccgattatttagtaaagggagatatatttactacttcatgaaatacactttactacgctgggatgagagtgagacactaccatcacccttagcactgattatcagtttggagaagttcccagcttctccccggaaaacggagggattaattaatcatcacatgattaaatggttattaactaaaatagcttaaaatgattaatgtaatttttaaagcaacttttatgtagactttttttcaaaaaatacaccgtttatcagtttgaaaaacctgcgcgtaaaatacgaaagatgaagttgggaactcacacc

SEQ ID NO: 17338 - DNA, 4259 bp, Oryza sativa
cccatcacccacgcacggaaaatgaagtgtccattagcgtgtgattaattaagtatcagctaaatttttttcaaaaatatatcaatatgatttttttaaaaaaagcaactttcatatataaacgtttttttaaaaaaaaacataccgtttagtaatttgaaaagcgtgtgcgcggaaaatgagaggagggagttgggaactcctggtattgaaacacagccttagtgctctaaggttgtgtaatactacatatgcttagaaataaactctactcctttttttcgcttgacaaccattattgctcgttatggatgcctgaaaatcaaagatgttgcttgttgtctcagaacaaggaaagtgttacttatatgttgccatgagaaaagcaccatacattttccccacaatatagttgaacacactttaaaaaaatcttcattttaaagtttcaaatcactgcattaagaatacaacaagacgttagaaggatcaagaggatagacatctgcaccggggcaattccattagttgcaaaaccggaatatttctaatggtcttacatcagctctcattctctaatagaaggcttttattgtcttagaagattcagataggctgatagctgggctattaggtattgcatgattgatataaccctggcatttatcattaggatgcgcaacgtacgtatcagctgaaatgctcaaacggcatacttttcgcttgcttcacctaaagaaagtcagaaaaaatcagctgtccattgctccattttgctgaacatgggttcacgtcacaacgtggccgcgctcgttaatcagaaacacctttcctcctaccaggaataatacaataaaacaaggtgctgtctatacaactattaaaaaaaattctctcgtatatatagtcttcccatcgctctgtatcaaagattcaatgggctatccccgctaaaaaaaaaagattcaatgggctaaactaactcttacacacacttattagccttttgtttaggtttatgttttaagtcgattttttcttatatggtttataagtcattggcttttaaaccttaaatttaatggtgtaatcctatctcatcttgcattagcccaataggttactctgacataactttttaacataacggtgtaatcgtggtttatggttttaaaagagccaaacaaaaaaacttgccttgttgcttagacttagatttttttataaatcgtctaataagcctaaataaagaggacctaaagatataagcctaatcttcacctgcgactcgttcttaccagtgaggcaagtcattcccaacctccactcctggcgatctccaacaaggttacctacgccattgatcttctccatctccacctaactaattagcatattcttcctgatattcggtgaggtacctctactttgccaatctccctcatctctaaccgatcctactgttgattcatcatcaccatgtaaccattcggccaatattccccgtcactgcccacctacggcttcagaagtatcgccactgccttgtcgaccccttatccaccacccgtcgccaaacaccatctcgacctccctttaaaccaagggtccccctcccccttcgtacccctaccacctctactgttattaactgttagggggtcaccatcgttctcactgtgggagaatcgacatatcgcgagctagagaacaaagatctcgcacacaaatcttgaagccaattagatagtctaaaacatgtaagatttattcccctgtttttctatcaaatgactgcaagtagcccctccattttatattataagacatttagacttttttatagtaatttttttttcacttttaaccaaaattatagaaaatttggaaacatctacaacaataaattagtttaatttaatgaaacggtgaatatattttgataatatgtttgttgtgtgttgtaaatattactatgttttttattaacttggacaaattttaaaaagttttactaaaaaaaatcaaagtgcctcataaggatctactccctccgttttacaatgtaagtcattctagcatttcccacattcatattgatgttagtgaatccagacatatatatctatctagattcattaacaacaacatgaacgtgggaaatattagaatgacttacattgtgaaacggaggaagtatctacaaatatctcgccataaaacagaggcgaaaaccatcaaatttcgggactataggatacaaagttacaaacttaatcaccacaaatcgccaggcccatacaacatcgacaaagatcattggtgtgggttggtttctcattaggagtcttagataaatgaatcagtacttataaaaagtataccaaagttacgctacaattacatcataattttattcaaagttacatgaaaggtgttaaatgatcacactgaattctaaacactacggcgactgcattgttgcccagcgccgtagtgggcatggtgcacatcaaaacaacttcagccagcacaaatctagatgaatatcaaaagtttaaatatcgaatgtaatcgggcgaaaattatatcgctggaagtatagtatgtccgtcttatatataatatagtgagggagtagcaaatccgataaaacaatcacaacactgagcaacgagacatgagtcaaaagccaggaaatctccaagcattgccatgaacccatgatagcgcggagggcaaaggtgaccaaccgccaccccccacaaaaacaggggccgttcgtttcgttgatgggcgcaggcatggtggtggaagcagcaaggggccctcgtgggccacgggtctcatgtgacaacaggtgacgctgggaatgcgccactacaaactgtttctctgctatgtgatgtgatgcgatcatggggatgggccgcgcgccgggatccgcatggataatgctgccgcctgacaggatggatgctgatgtggtacgtgggggggccagtgcagagcgcatcgcatcgccatcgccacgccaatgcatggccagcatatgggttcttcttcttcccttctgctgctgttgcaacttgcaggttgcaaggcggttgggtgacagtatcaggcccgtagtatggtttgtgctttaccacggtctaaactcttcgtttgtttcatctgggatcctgacgaaaaaggctggtgatgtttgctacgaaatgggctggcccaagacagaaaagggcccaggactgagaaatgggccgaaatgtttgaatcacgccgattgaagaacaaaaggttacatacaaacagctctcatcggtgaatctgagagaatcagaactgacgaaaactaacaaaaagcctaatccaatctgtcacgcccggatgaattaacccttcatataccacgtatgatacagctatgagcacgtttacccccaaccagtacaagcacactcctatgtttttctcctttttccttttgtaccaaagcaaccggcaaaaagaatttactacaacacgggaaaagatgagcaaattccctagcgcatagcgcgcgcagtttgattctgatcagcctcatttcttccacatgccgctgatccgcctgagcacgttgccgttcttcctggccgccgcgtcgtcgtcgagctcgtcccacaggccggcgtacttgccgccgccgccgccgcctccttcaagcgactcgctccggtccaccaccttcccgttgccgcccttgcccaccgtgagcagcgccatggcggtctcggcggccttcctccactgctcggcctgcacccgcagacgcctcagctcggcctccatctcccccttcttcgccgcctccgccgccgcgtcggcggcgtccgtcgccttcgccgaggccttcttctcggaggtgtgctgctgcagctcgcgcttcagctgcccgttctccaggagcgcgccctgcagctgctccttcagctcgttgtccgttctcgtctcggattggagcttctcgttcgcgtccagggcgcgccgcagctcggagtccttgtcgaagaggctcgccttgaggaagatgacctcggacttggtgctctcgagcgccgcggcgagcttgccgtgccgcgagtcggactccatttttatctggtccatgagctcgtaggcgcactgcgtctccactgtgctcaggatgcgctcttcttggaacctggcctccgtggactccaattccgacctcagctcagcgacctccgatgccg

SEQ ID NO: 17339 - DNA, 13302 bp, Oryza sativa
  unsure (1)..(13302): unsure at all n locations
cgtgctgcttctgcatggcctcgagctccgactgccacgagcggtcgcgctcctgggacagccggcgaagctcgaggaggcggctctcctcggcggaggagagctcggcgagctgcgcctcggagtccctgacctgcgcggacgccgccgccgcctgcgccctggcgtcctcggcctcctgcagggcgcgccgcttggagtgctcggtggagagcagctgctccttggctttcttgagctcgtcttgcagctgcgagagctgggactctagctccgatagcttcgtcggtggcctccttttctggtcatatattcatcgcaaacacgaaatgccgacaatattagtgctcataaaaacccatcactttccacaacggcatgattaacgatattagtagctcgaattttaagtacacgacaagatggttttggcgaacattctgatgcatcactggaaattttgaagcttaaaattccaccttccaaacattcctatttactaccatttgctaaaatgctagtagtaaaatatttgcagtgatcgagctatccagtccagtggatatttctttctgcaaggattatgtgactactggaagaaaagaacagtgcaacaaacagaattgatatctgcgctcataaaaacgtgctaaatcagcttgtcaatcttttggtatcagtcaataacataatcaatacaaaaaacaattggtggtgccaattacagtttccctgtccaaatcaacaatttcctcagcgtttgctaattctacctaacctgcactcactcactggttgctcccacatacagtacacggtttctgcgaaaattgttagctatctcaaatccacctgattcctaattctgacaggggcttcaatatatagcctaaattccctaatcattcaatatcccggaccacttaattaagctatggaacaccttctgtctgcttcggtgtaattgacagtgtgctccatcaagagagagactgaccaagagccagccaacaactactaattgagaatgtgtccaaagtgtccacatagaacacttacctatcagggacaaaaacgaaaataaaaaatctctggcatttatgaacagccagcggatcgttgaagcacttgtactccaacgaactacggattggaatctgacaaatttcccatccacatgccatttgcagttgtacttgttccaaaccacagtactagtactactgaagagaactctacttcgaaatggaactgctcaacaagagtgtactgaacagtagaggctttgcgttcagatcagatacctctctctccgcgctcatcgtcatgcggcgctccaccttggggctcctcccggcgggcggcgacttcgtcgacggcctgtcggcggcggagtccggcccggccggcctcgccgtccggctcgtcttggtagctccctgggaagacgtccgggtagggtgttccaaggagccattccttcatgccagaaaagaacacatcaagtaagattcagaaaaaaaaaaccgcaagaatcacaaggcatgcagggttcacaactgaagcgcgttacctcccgctcgtactgctggaatataacttgagaaaatgcattttgttcagagatagcattgtcacaataagcaggagatttcagttcccctcctcatgctaaaacgaccgcaaaagaaagaaacttcaaccaaatcgagtagtgaaccaatccaaactgtggattccttctgaatgaatcccaaaatggctcaagatttcagcttaaaccggatgcaatgggggtagaaaaacacagagagaatccgaggccgaaaggagcagagaggccgacaagaagtggaggaggggagcaaaccgagcggagagagggagaggcaggaaccaagaaaaaggagcagcggcagcattaagttaatctcccggtgtgcaagcacgggatcaaaagggcggagctttacagatgtggttagcgacaagtggaccaccgcccccccttggcgccgagctcaagaacaagacacgcattgtgcaacgcgaatggagctatctgcgcgcagtcacggtcacatgcgcccctgatttgaaaacttgttctcttctttggctccagtagtaaaaatttctcaaattttaaacgggtgacaggcaggacgtgataaggaggaaattgtagtttacagcagcccaatcacaaattacccatatcatcacggatcggtgccatatctgcaactgtagtgaccagtgagtctctgtttgaactcccctgagcaagagagagtgagcagtaatgaactacttccatgtgaggagcttcttgcctctgaacttttctgcggtgctcgtattgctcgtagaagataggacttgtaacatgggctggtagcccaactgaagaccggatcagagaacatttgcattaacaaaaccgatgcatgcacattgactaattaaacctgattcaacggctgaagatggagaagggaatctaacatcacatagcgtgatcatagggagatttaaaaaaatcatgtttgcagcaatcaccaaatggcacatggaatgtagcatggaaggggatgaaatgaatggaaacaaaccttatcttggctgcctgcatggctatatctttacttcagaattcagagccacggcaaacaccaaggtctcctacaagaaagctgcaacgagacaaaaaatggaaagaaaatatgagtggtcagctccctctctttcatcaacaaatttagagatgaatgagaggcacagagacctagctacaagatgaacaacacactgtatatcttcacatgaacaacgcagctagataatggcaatgcgaggcagcatcatttcctgcttgcttgcccgactaatctggcactgactagtactccaaccacttagccaaccacaaggacaagcagtctggcttttaatacttatggccaaccttaaactgggagatgacacatggtcatggtgagacagagaagaaggggggtgagcaatccgattctttaagctttgccacgggcggtgatggctctcatgatcactactagaggcctacatggtcccttggaagataacacattatacacacaccactacaaccaccaaacttaaggctgcagaaaggtaggcctgaagcaagcaagaatccaccaccccaaggcttccccttttgtttgctctctctttcgccttactcaactccccacaaaaaaagcagcaatggcgtccacaccctaatactcagctgaatcatgcatggcgatggtgcaaaagtagttgcaggacctagccaaaatgacagctgcaaacccaaataaacacacctttcattagcaaaaacaaaaagacacttgctttatcactggtttaaactccggaataactaatttagatagccacgtatgcatgtgagctggtcttcataagactgatggcgatgagacaaaactcaaacagagctttacagcttgtatctggataaagaagcaagcttgttagctaaacaaggcaggtaggtgctaggcttgggcatcagaacatatgcgagagaaaagggcaaaattggagattacttcaatgaggaaatcagaaatgcatgagaagtggcagcaaccaatcccagtaaagaggcggcaaaacatttttggctgattggagccatgcataatgcattgatgtaaccacccctacgatgtaggatgttcagaaaaaggagcaaacgaaactgaatgaagaagcctcacctcaactagaacccacaatgggctgggagatgcctttcttctctcctcttctctgcctggattggccttcctatcaatataccatgccttgagaagccattgccccaaggtgaagcagagctttgttctaggcaagtaggatgtcctgctctttataaataaggcgggaaggtgtgacagatcttgaggatttcagaattgaggaaaaaaggcctgcagcgagcagaaacgcaagaggaagaacaatcatttcggtgttttggcctcccgtggacgaaatcaatgcgaacaaaatctgcacaatcagtgctcggttttgtttactacgatattttggtgaggttttgaacagttctctgatactgatgctgccgtcgcgctcgacgccacgcgctcaaggttgttgatctcggataatgatcgatcctcgttggcaatttgagtacgctgctctgtttttagtacgactgaaaaaaaaaagaaagtagtagtagaaagtagaaacgtacgtattgcagcagcacttgcacgcagagtaccatcatgtttagctcgatcaaaggtaaaaagcttctgcagaacaaagcgtgctgtgctcctagcgcttccttgcttttggatggcttctgcaaatactactgcactagcacagctttgctagtactacgtgccaagctgaaaactaaaatcacgaggcaatctagcaaagcggtgaatcctgtttgtaacattttaccgcgagactggcaggtctgtgcctttgtaaaggtagccccgtgcatacggaggagcccccagtgttgggggtacgaaaccggtcacacgcgcgggcgacatgtagcaggaggttttttttacctttgagctccatggccgcgatgcccccccccccccccgggcgcccccgcgtagccgccgttgctttggtcctaatctcgcgcccgcgacatgccacgccgcgtgcgctgcgcgcgaggtgtgtgcgtgtgtgccgtgtgcgtgtgtgtgggtgggttggggtggggggggggggcggtgaagccgcgtgccgggcgcccggcgtgcgcgccgcatgtgaaaccccgtcgtctcgtctgatcgtctgaagcgaaatctaccactgtggcacacggcgcggggtcacgttttgacagatgcggatgcgagagattacagcggccacgcagaacaattcacggttttctcaagcagatttgcaggagaagatccaggcggccagtcgcgcggggggcaggtaccgtgaatccgtgattattcgtacttgcgttggttctcggctctcgcttgcttgccgttgtatccactgctccgttgacaactacggccagctcgtagtactagctccgtcgccgtccaccggccgctctcgcgcatgcattcaatgtacgtacacgcacgcacgcacacccgctcgtgccgcgatcgctcgtaactaccagagggagatatggcgtatttattcggctttatcacgtaccgcgtcgacgtcagggagcttcggcttcgctgttgcatcattatcactcggtcgagctaagctgcgtgctctgctgtgcctgtatggctgtagcagcagcgtcgcatcgcactcaacctcattgtctcttttgcttatcgaaagttcatcttttccgttgctaatggctctcgacagaactgtgcctctaactgcagtcggtcgaagcaaattaaatggcgcgtccttttcgtgggccgatgatcacggtcgctgaactggataggccaactcctgacggttccatcgcatccaataatcctgagctttcccacttgaccacgatacgtttccagtttatggacgcgaaattaaagaacatgcataatgtattttgtggttaaaagtcaaaactcgaaatcggcctcgcggaaacaaatgaaatgctgggcctgtaaagcctgaactcaccatggtttttttttttttgaaacgtgaccattaccatgaacttaatcaacccatacgagtagtaatcaaagagcaaataggtctttaaaaatgcgcagacttggactgatcggagctttgctactgagccccttgtgaaactcgtagtcaagctgtaagagggacttcgacaagagagagagagagaacaagtatattttgctttcctcatcttttctctttgatctacctcaacttttaaaacaggtgcaagtataaaacttcgattattgtttgggaatcggtttttaccaaagtgacgggttaaccatggttaaatttgctgagccaacatggactatgtatgcagcatgacgacgttcactagaagacgaggttcttattcccctttgctatcgacttcgctaggtggagcgcgaaagtcgtcatgatgtagaaccatacatagcccattctgactcaggaagtctgaccgtgtttaacgtgtcatattagccaaacctaatcctgaaccatcgaactagtctatttgctccggttttaaaagttggtgtagacgttatacccggttttgtacttagagatgtgattcaataatgagcctacgagggacataaaatagacttattaaaaaaaggaataccttgttcattgcagttcggcccttccacgatgcacaagttgggctgacacccagttgcaaatggatctgaaatagaataagttcacttcatgaccctcaaagtgacacgaatctaatccatgaccttaaagtgtaaaaccggatatcttcactccccccaaactattgaaaccgatgcaatttgactcccttggtggttttggagggcggtttcgctgacgtggcgctgttgtggtggtgttgacctagtttgtgtgctggtgtggcgctgaggtggcatttcaattaaaaacatatatgtgggacccatttgtcattcggaaaaagtacgaattacccccctgaactatcgcggtcgtccgaattaccccctaaactacaaaaccagatattcttcacccccaactatgcaaaccggacaaattacccccctcaacccaatccgcggtggttttggtctacgtggcgtacacgtggcaatccagtcagcattttattgtggggcccacctgtcatatatatactttatctatctcatgtttctctccccctatctctcgcgctgtagggctcagggcggtcggcgcgcacggcgccgcgcgggggcgggtggtgggaggcggcggcgggtcgacgagctcggtcggctccggtggtagtcggcgcggacggcggctcccgtggccggagctgggttggcgtgcctcgccgcctgcctctctgccacggccccgcctcgccgccgcctccggccaccgtccacatctccgccacggtcgccaaactagcttccagccaaccaagctagagagatcgaagcatggagaacgcagcttagaacctcgtaagcaacgttggtcagttgctgaccgaggaataccggcagctcaatggcgtcggtagcgaggtcgctgagctggccaccatgaacaccctccaccgcatgcaatccgaggccgacgacggcaccgtggaccacttcgtcctggagtggatgaagcagctccgcgagctcgcctacgactcggaggactgcatcgaccaataccgctcatccagctacagcatatgaagaagaaggcccactccagccccctcctccttctccgcatggcggcaacgccgcgtacagctcgtagagaccacctacgtttgctgctccccggtcttcttctccaggtgcaagagcgtcgtcatcttcacggggaactaacaaaaggaaaggaatttgttagtgttagtatcagaccacgatcgagaaaataaccaaatctcacaaaaaagaaatgcatgccaaacttaacaccacctgctcgccacgctcttcctgcgccgctgcctcgccgtcgccatcagcgagcgccacgccgttcccagtcgccgcctccccggtgatggcggcgttcgcgtcgcccacgcagctgctccaccatgccaacaatggcggcaccgccgctaggcaccagcaggtggttagcatcggggacgtggtggacgtcctggttgagcgtctcaaggcgcgggaccgcccgcccccgcgcatcgccgtccgacgcccaccgcccgctcccacgcggcgtcgtccaccgtttgccgcccgcccctctgtgcagcaggcaaccggtaggctgtgacgggcgtgacgctgaggcgggaggccgccgggacagaaggtgggcgcggaggaaatggcgagcggcggtcgcgggaacggcctcctcctccgccgccgctgtctccctcttccgcctctcttgctcctccccgtcctcatcccgacgccgctccagctcccgacgcgcgcctttgtccgccatcccccgtcctccccccgacgcttccggccatggctcgcctctccgccatggccgccggcgcccgtctctcccccatcccctccacctccccgcgcaccgcgtgcgcatcgaccgccagcctgcccccgcgttgctgcccatcgcccttccccgcgccgcgccatgcatgccggccgccggcgtgcgcggcgctgccgctgaccgatgaagagagagagagagagaaagagagagatagaggaagagagaaagtggagtctgacatgtgggtcccaccattaaaaaaactaaaatgctgactggactgccatgtgtatgccacgtagaccaaaaccaccgcggattgggtcgaggggggtaattcttccggtttacgtagttgggggtgaagaatgtccagttttgtggttcagggggtaattcggacggccgcgatagttcaggggggtatttcgtactttttccttgtcattcacacacacaagattgtggggcccactgacatgtgggccccacctgtcatctcttccctttcttcttcctcccggacctcccctcctcccttcactctttctgttctccctctccacttcggccgtctgcggggagcgagcggcggtgggcggggtctgaagcgacgcggccagcgggagctagctggagcggcgacggtgataggctggagctggcagcgggggagggaggcgtgggccggattggtggcggtcggcgagagctgaagcggcggcggactagagctgacgcgagagaggacggcagcgccgacgccaacgagatcgagcggggggacggtggtctacgagccggctacggtttcggatccatccgcatccctgggattagagctcctcgtcgccgtcctccaccacctccccgcatcaatcctcgcatcgcgcgggacgtcgacggcggcagcgggcgcgagacgtcgacggcggaggcatcgagcgggtcgagcaacggctccggcgacgtgcgggcgagcgcgagtgcgggaggaggcaccggcggcgacaacacgagctcagcggctccgcttctcccctctcccttccggccctcaagcgccaccgccgcctctcgtgtaacccaccaccttcgttcctccctcacctgctctcctctcatctcctctctccacttggcgaggccgatggagaggctaccgccgccgctgctctggccccgcccgccgccgctccagctccagccgctcgtgctccccgtggccagccgaaggggagagaagagaaagagagaaagagagaagggaggaagaagaaagggagagagaggggatgacatgtggggcccacatgtcagtgggccccacaattttttattttgtgtgtgaatgactaatggatcccatacatattttttatttctaatgctacctaagcgtcacgtcaacaccgcgtggaaagaagaccgagttaatactgtcacgtatgtgccacgtcagcgaaaccgttctctaaaaccacctaggaagtcaaattgcaccggttttaagagtttggggtaaatatatccggttttgtggtttaggaccatggattagattttgatcacttacttttaagagtcacgaattgaacttattccatctgaaatctgatacggcccgtatattctggccatgaggtgacgggaagcccacgtcgatcaagccaccagcccaccactgccactgccactgccaccggtcacactcgtcaggcactcaggctggactctggagggaccccaaattaaggacccaacccaaccaacacggccacgcggaaccgacagggtcggtggcctcggtacaccactacacccgcgtgaaaacctcgaaacgcgaggcgcccagagggactggagttgcaggcgaccgaaactgcgaccgatccgcgcccaccacccagggccagggaggcatgggcccacatgccagccactgccaccggccgccttccgagccgnttnccttcccccccccgcgcgcctnctnntctntttnttccgtgcggtatggcagttgcgcactagcgctatagaatttcagagaagggagaaaaatagaattgttcggagaccgaacccgcggcctcagatctgagacaagccaccgggctccctctccctcctcgcgcgcgcggggccttcgcgaacctcctggaagcttccggaggcggaggcggcggctgctccggggagatgggggtgttcgaccggctgccgccgatggaccgcctgcggtccgagaagatgtgcttcgtgcagctcatcatccccgccgagagcgcgcgcctcgccgtcacctacctcggcgagctcgggctcctccagttcaaggacgtgagtctctctctctctatctctcgctctcggcgccagtcgctgcccgcatcagaggcccctctctccctcccggatctgtgtgatctagcctcgtgaatcgtgatctctaccgcgctcgcttatgcgcgtcgtgctatccgctcatgttggatctggtttttggcggtgctcagatcggaggactagttttttttgcctggtgtcactggatcgcgacggctcgcgtgtttctgtcgtctgagctggtttgggctgctacgttgattggatagtgggtggcggggttgttttagatcagagggaatgaatgcggtgttcatataaatgcattaggttagggagcgaatcaaacaatgtgctattgcgcgagattatcctatgataagagcaaggacaatagtgcgctataagctaactataagcttatgtggaagagagagagagagagagagagagagagaaatgagaagtgttggctctcatgcaagagctagcaacacaaaaaatagagtctatacatgttagtttagtatgagctaatagccaatagttagctatactattaaacttgctctaagcatgagttggagcggtgatggtttaaatacatttatgtgcttagctgatcctagcaggtctcattgttttgcggtctatgcatgaatctttgccttgtaatttgtaccattttatgccaaacatattatttgctatggggtatcattcgtggacagttacatgccttgctattcagcaagatttatttgatgaatcagttaatggaatagacaccgtatttttgtgagttgggtcttaaagtacaccagtacctgtatgtttagaaaaagcttatgaactcttagtttgattgcaaaaacggggttgcgtactctgttcactttatcccatagatgccgctgaaatcttgggacaatatgaaagaaaatcatgagagggagactaaatgttgaccgtcatcgttatagttgtgtactacagaactttgtgagcatggcatcatcctagcagagaacttagagaatgcttacatagttatgtttgaacttgttcttttttattggttgtgcttcctgctataatggtttaattgagatttgcaaaaaaaaggcccaattgcttatctctctttttaactttattcctctttatatgcagttgaatgaggataagagtccttttcagcgtatatttgtcaatcaggtattccaaccttttatcttcgatctatctttttttgtgaatcacatcattttgcatgaaccttgttttattccactatgctgatttctacctggatactattgttctgtggcgcccattattttttacttcacttggcctgctcgtacccaagatatttgtttgaatatcatgtccatgtggtactcatatactctcctgaaaatttaaggtggattttgtgtgtgcagaaatattacgatgattataaaatcaagagaacataactgaaaatgagcatgccatttttgtttacctaaaatgcctagggaattaatgaattatagagaaaatgattagtgagcattcaaagtatacatcggggaaaataaggtaaagcatcaataaatttgcatgcaagctctatattttaatagaactcagagaaaacagtatgccttatattttgatgagggagtaccaccattgtttacttgggactagtgaatggacaagtcaggcggttaccttgtttagctttaggaagcatgcagcggggattatcatgttgagaaatattttggaggaacttacttcttatgtcagactatattcatcgataccttgaatcgtgatccaatcaagttactacctctgtttttttaatatatgacactgttaactttttgacacacgtttgaccattcgtcttattcaaaatttttatgcaaatgtaattttttttaagtcatgcttatagaacatttgacgataaatcaagagacaataaaatcaataataaatatatatatatattttaaataaaatgaatggtcaaatgtatcttaaaaagtaaacggtgtcatatattaaaaaaaaggagagattatttcataatatatataactggttccttgcttttatttatttatgttccaccagaatataatagattgatgctgtaattgtgatattttttctgtcaactgtcacttctgtgcatgcacagatgcacattgacacctgtgtttcccgcctgacgcagagaattttctgctgaataacttttacgtagtttgatgttgttaagtatggttcaattctcctacaggtaaagcgatgctctgaaatgtcacgcaaactaagatttttcaatgatcagatcaacaaggcaggtgtaaagtcctctgttcgacctgcaatgcaaccagatatagatttggaggagctagaggtgcattactcatgtctttattaccgttcaattctgttatttctgaagctaatagctattttgaaggaaaaaatgaataatttgttaaggacttgccttttttcctttcaggcaaaattgcgcgagcatgagaatgatctgcttgagatgaatacaaatagtgagaaactactacaaacatacaatgagcttcttgaattcaagatggtcttgtcaaaggttgtatctcaattctttgaaaacatagaattaattcttccagttattctttgactgttaagatggaactaaaaaaatcagcaccagtacatggg

SEQ ID NO: 17340 - DNA, 1884 bp, Oryza sativa
tcctgcagcccttgaacaggtcttatatttaattttcgtacttaaacacttgaccttatttgattgaaaactgtaacacaaaaaaaaaatgctcacagggtgtgcatctaggggcttcggagaattctggagtgaagtttgttagtgggattattttaaagtccaaggcaatggcttttgagaggatgctattccgagctacaagggggaatatgtttttcaatcaggcgcctgcaggggaacctgttactgatcccatttctggtgaagaggtctgattgtcatggtttgctcttggtgattctcgtgttaaatgaaatctattgtttgtctccaattatatgcttattgtttttttgtccttgaaagctggatttatgaacaaaattaatgcttattgcagtactgaaatccaaccttgcatgtgacaatttcatccaataccttgaagccttaaagtttctcaatagtttcaacattcaattttactttgccaggtagagaaaactgttttcgtagttttcttttctggggatcaggctaaagcaaaaatattaaagatttgcggttcatttggagcaagttgctaccctgttcccgaggagatggttaagcagagacagatttttcgcgaggtactttaatttgcatatttggcacacaaattcactgcttgatttgaccgtgcttgttagaattttattggaagaagcttgagtgttatacttatctgacttattgttctcgttattttgtgtcataatgttaatatgttatctgctgagatattatgtagtagtaacggtttatgaaaatgtgttaggtatctggacgccttgctgatctggaagccactttggatgctggaatccagcacagaaacaaagcactagagtcagtaggttcacaattatggaggtggacaatcatggtaatgaagtaatataaaattttcattttctatttgtgcgttgtaatccctaaaatctcttatttatgtctgttctgatacatggatttctgaaccataacccccttttgtgttaggtgaaaaaagagaaagctgtatatgatacattgaacatgctgaattttgatgtcacgaagaaatgccttgttggggaaggatggtgtcctatatttgctaaatcacaggtcagaaatattacattcatttgaaggtctattcattgtgctcattctgtttaggatacttttaaggatatatatcttatctctactttgtacttcagatcaaggatgttttgcagcgtgcaacgcttcacagtaattcacaagttggaataatatttcatgagatggacactattgattcaccgcctacatatttccaaaccgataagttcactaacgctttccaggagatagttgacgcatatgggtatgcactttgttgcaagtgtcaacttgaataaatgaaattcatatgctttctgtttttatgattcatgaactgagtattcgtgggtatatgtttttcaaatgttaaatttcttgagcaaagcagttgttaaatcatgtgtactactagctacttgatccaggtttcagctatccgacacaaatattttgctgctatattttgaagttcttcacttttgggtttgattttgaggttggtgagcaagagctaaaatattagttttagggacagaggtagtaattaataatgttgacttctttagtgtgcacattttgctagctctgtttgcctttgtaactagacaacctgaccataaaaaacagattgattcattaaacattggaaggttgtctgatactttgacatacttgctttatgatgtgatctatttttaatccttaggccctactttttaatgatattttagtcatgcaactttg

SEQ ID NO: 17341 - DNA, 699 bp, Oryza sativa
gagtgattttgatgcaaagtttcatggaaatgctcttgacataaggtgctgtattttgtttgcatagttttcttcttttgctgcaagtaattgaaggggaggataagggcgatctttttaactgtgtgagttcctcaggtatcaattcataccacagatgatctttctgaacagcctctttggctacttagcactcctaattctcatcaagtggtgcacgggctctcaagctgacctatatcatgtgatgatatatatgttccttgatccttctggcaatcttggagaaaatcaactattttggggccagaaggaacttcaggtttgtataaccttttattaacaagaaaaaggcttcactacctcattttcctgccagctaacaattattactctccgttcagatacttttgttgcttatggctattgtagctgttccgtggatgctcttcccaaagccttttatcttgaagaaacttcacaaggaggtagatttttcatgaaaattcttatagttgatcaacaaagcatttcccttttgagatgggcattgatttgttttcatgttctagtactgcatgcataacttgacaaccacagaaaccactgccattacatactctgcaagtacttgtgcacattgttagtctttttatgcaatgggctaatggttagagttatggcttagggttgtagggt

SEQ ID NO: 17342 - DNA, 2220 bp, Oryza sativa
  unsure (1)..(2220): unsure at all n locations
nnnnnnnnnnnnnnnnnnnnnnnnnnnnnnnnnnnnnnnnnnnncggccaccaaagaaaaagctcggagatttcctcccgctggtcatactttaagtacacagaatcgcgcgctttcagttcatcatcagtgcttaaagatgagagtacttttaattagacctccaaaccacacccgagaaattctaattttactcaaaattgaccagttaggcagctgaaaatctcgtcttcctattcctggcagcgcctcgatcaaactgcaagatccgaaactcaaaaataaaccccccaatctacccgcacaattccgcctcgagcgcacccaaaacgcccccaatttgagcgacaccatggacaacggcaacaagataaaacaaaaaaaatctcaggagagtggacagaacgtacgtggcggaagacgggccgaggagcgggttctcgcggagcggctggaaggagaagcggcggaggaagccggcgacgcagccgccgagcgcgctgccgtgcttggggcagttgttgacgtacatctcgacgatgaacaccgcgatgcaggcgacaatcacggtgggcacgagccacggccaccacttcctgtcgtcccgcccctcgtacccgccgtacccgtaccctcccccgccgtaccccgccgccacccggctcttctcctcgccgccgttgctcgccatctcctccgatccctcttccccttcccctcagtggcgaagaagaagctcaagtggctactagtggtttccccggagctcgggtttggcttcgaagcgaggggaagaagaaatgatgcggcggaggaggaagggagaggagacagcgaccggcgtgggccccgcggtgggtggagggcctgtctcgctggcgcgtggggtcccccgcgacaccgggcggtgagccgttgctgtctccgcctcctggccccgacgaggcgtcgagagagaaagagagagagagcagagtggttggtccggctcgctcgcagtaactgctccacacaggggaggcgaggaggcgaggggaaggcgagcacgcgacgcgggcgaaggcgaggactcggcgtacgtgtggcgtgtcgtggcgagacgaggcgcgaagcgtgtggatccgagaggggggatcgttccacgccacggcaccgcgacggacgcgggtgcgtgttgcgggcgggggtgagctgttgcactgtcgctcggcccaggtggcgtctcctcttgcatacttcctcccaaaaaaatatttagattgatcttattttaaatcataccaatttttataaaactgttaaatatgtacatacatttagtctttgtactaaatattgataaatagataaaaagttctgccaaaattttaataatattatcaattaccaaaattttggtattgttttgattacagtctaaacatcctcaaaatcaatctagataagaatgtgatataacctaagataacgaatctagatatattcgtatatagattcattgtcttggattatgtctcgttcttaatttttttgagttatgtctcattcttaatttcttatttagggtcatatttttgagacggacgagcatagtatagccacctgctctgcacgggcgcccgcgccgactgggtaaacggcgctccgccaccactgtgtcaccctcaccgtgccagcgtagccaatgtacagtacaaacagtctacagtagatgctacgtactactgtactactactgggatccgtggaaaaggtgactgacacgtcgtcgacgcagccgcatgcagcagcagtggaggctgtcctcgtgtcgcgcattccgcgttagatctgggaagaactgtggtgggatcatatgcaagctgaccgcgtcgtaaatggaacttttttgtgtgtgggtgcgtactgtgcgcgtgtacggccggtgttgcatttaaccgcgccgtgcgccgcccgcgtactgtgcgtgcgtacgtacgtacgtggtggcgcacgcaacgggagaccccaagtccccagcctcggccacaccacaaccccaactctccaaggctgtgccttgcacgcaccgacgccgtgcgacggtgcgagggcgtactactcagttgcattgcatgcgctcgcgtaggcgtagggctcacaccgagctggtccgtcacgtatgagtacgtgctccagcttacccaggtccccccaccgacgagggatactacgactgca

SEQ ID NO: 17343 - DNA, 28027 bp, Oryza sativa
  unsure (1)..(28027): unsure at all n locations
cactgtaactgctaaagttgcagtcgtagtactgcaccagatcttgatccgcttgcattgcagctggctgcaagccctgcaagctgtgtacgtgccttcaatccccgtccgtctcggcgtctcgatcgatcgccggtgaatcggcgatcgatcatggctctgcgatttctgcatgcattcaagtgtcgcaggcgaattgctagctggaaaatggagttagcaagcatgcatgatggatggatatgctgccaatggtatacggccgtggccaacaaatccaactgtacgaacagggacggctcgctcactttctttcacctcagccttcgtcgtcctggcctcctggcccgcatccaaagggcatgaattgaccgagcaactcatcagccaagccagacccccaatccattcctgaactcgtggtgactggtgagggctccacatgtcggatcccaagcttttgggtatgttcgttagtgattggttactagccacactataccacgcctcacttttcactgccacaatttattatgtatgtagggatgaaaacggtcggaaacgatcgaaaaacagcctcaatcatttccgtaaccatattctcggaaacgaaaacgatatcggaaatatcagaaaaccggaaacggaataatacggacggaaacatgtcggtgcagatcggaaaccagtaacaaatatggaaacattaaactataaaaacatatatttaactttacataagtatgttatatgtatacataaattcaagcttatactatataaattataaattaactttattttagccatgcataaaagttagagatttgattgaagagtcagtcaatctgtaagctgtgggccaagtatagacatgctctataaatatcgacatatttagaatacggtaattaccatattataagaaatggtaatttccacaagaatacggtagatacggaaacgatcgatataacagcaaaaccatttccgtttttatttccatatgttttgccatttccatttttgttttggtcgactaccatttccatatcgctcggccggtagaaagtcgaaaacgaacgctagtcggccggtaatttccgttactgttttcacccctatatgtatgtgtttggttagcttaacttccttaccaatttcaccatacttaatgactagcaatttattcatcacattttatggttgtcacaacttatctaacattagttgtggcaaagtataaccggtaaccaaacatatccttactactgtagttaagacttctttcaaaatcaccagtttttaaaaggtcaaagaataaatagttaccccccttcataaaaaaaaactaatatatttgtagtagtattatatttgtttttaggcagaaggagtatatagtcttgacaataaattaaaagccagaaatcgaagaatcaaggttattcagattttcacaatttgcttaaaattccaatctctgtacttagccctttgccttattttacaaaacacatgacgccattgtaaaagattccacataagttaagtggctattagaagctgtggtgtcacgttgtctcgatggcaaaatcattttccgcagggcagctgtactgaccccatatgtcgcctctcgctaccggtggtaccgactaccgacgatgccacagcatttgctgctgaaagggaatcattggcttgccaagttaattagcagcagcagcagcagtatattttggtcctaatcaaaagggattatgctacttggtggttatctccatattgtcattgagtttactcctaaacaatctgatcttacttcctacacgccaaaggaacctcctagtttattgttgagcttgcattacgcaaagctaaacaatgttggattacgcaaagctgaactatgctatagttctctttgacaggactgaactactgtaatattttcttctttttttttttgaccggactgaacttgcgttgttcatcactccaacgtccattttctaagaatcgatgtgaatgatgtgatcatttcagccaatgggccaggctccgatggcatatccatttcattgccaaaataaaccctatcactatttatttcaatgggccaggctctaaggacatatccatttcgttgcaaaaaaaaaaaaagtgaatgtgacgggacggcatcccgttcagacgggatgatatatctgagatatcgcctaataccttagtatcagccgatacttaccagtatcagtatcaggctgatactaaggtattaggcgacacctcggaggtatcataccgttcaaatgaggtatcaaacaatacttactagatatcaggtgatacatcaatgttatcattatgtccgaacggtataccttcttgtatcatttccaaaaaaagaaacttattattattatttattggtaaaaccaaagattgataatgccaaatgttgccaatataaaagatgcaaatgtgttgttgtctggtttgattccctatcaaaatttaaatttggtgtagttttgtaaatagatggagttcggtaaagttgtaatggtgaaatcatgttcagtttattgtcgtacaaaaatttggttgacaacaaagtgaacaaatcttaaatataattatgtaccgtataattggctgtatttagattggtccaaagtttagaatttggttaaaattggagacgatgtaactgaaaaattatgtgtatgaaaggtttgatgtgatggaaagttggaagtttggaaaaaaactttggaactaaacacacgcacaaacgtgacgaaatatcttataggccttgttgcaatgagccttttcggtcaaagagcccaattgtgtgctacaaggcccgcatcacgaaccacttgaacccaaagatttctcatgccaattcggcccacaccaaccaaccccgcaaaacctcccctaacaccccgatgctccgccgcatcgccgcactccggccgccgccgccgccgcagtcgcggcgggatatgcatccaagtccaccactgctgcttctgcgggaccacgccttcgacggcatcatggagtgcgccgctttctcgtcctctactccgtcctcctctatgcggccacccccaccgcgctcgccggcggcggcggaggggccatgtccgtgcccttctcccgtcttggcgccagctccgcctcgcgcccctcgacgccggccgtttcctcctgcgccacccgcacgcgttccaccgcgtcctccacgccccgcctcaccccgcgcgccgccacggcgctccgcctcgaggccgacaccatcgcctcctcgctgccggcctccatcatccgcatccgcaagctcctcctcctcgcccccccccccgcgcacaaccgcctccgcctccgcctcgagcacatcctcctcctaggggaaaccagggtaagctgcacgctgtgttccttcgggaggcgtattacaaaggtcaactcgttgagcccaatgagatttatgcggcgaggcggacaatgtaagagctgctcatgtggaattgaacccgcagaaggcgaatttggaccggatgttcactagcacgggtcgtggatgggatgagcttggtggcggtcgtcgtgggggagcagaattgagggaggagttccttggtgaggcgagtgaccggagagcgaatattaaggctgatggtgattatggtggagattgtggccatgactcgggagttgagtcactctacattgagtgaggactgaggagcagaatcatactgtggtactaacatcaactaaggaagcttgccttctagaacaagtattgacaccatctataagctctctttcttctgatggtgaattaacagtcggatgcagcaatgctgattgaggagaagatattgccacccgaggctaaaactagtgagatatcttgtgctaaaactgttgatattgtcaaatgaagactctgggtgtcggcatttaacttcactgcaatggtcggatggcatcttcgttttgcactccgttgtatgaagaaggaacaaagagagaggcatgggaactgaaaacccctcattattttgagcactcgttcttctgataatttttactgagtcttgtgagtactctcagtctctcacactaggagtgaatctctctctctctctctctctacctattggggattggcattgccatctcaaaattctgtgactatactacctatcatttcttatacatcgtatagaaacaattgaacttttatgtgtaataagtgttgcagggaaactccagctaaactgaattgtttgatgtcagtgttaatgtcaatatttaatcttattaattgttttatgttttccttgctatgtcttgagtcttggctaagaaatctggaaatacagtccaaaagaattaatttccagagttgatttcaaggaaaagtaagactggccttttggatcctgttgtcgtatctactcatagactggcactaatctttaccttctacttagttaacgaaggatcattgcatccgactacgatttgatgcataatcagtcttgaactatacattgcagacatgttatgtcttctgtccattgtgaatttgtgattgctgaaccttactatttagtatcatattttaccctgccagttttgtagttctcagaatgtttaacctgactgcaaggtctaacctattagatatgtgtttttcactttaggtatggtcgacaaccatacaggtagtgttctttaccatccaaagataataagatatttggacttttattcagagcgtcatggttgtaaacagcactgactgattaaacaaaaagagtttctatttcatttcacttagtgactaatcagcttgactgttcttcaaaacattgttcaagtttggaacttctgcaatcccttgattaataatgattcttctatgcaaaacaacaaattttcacatgtgaatgtaacctcagcggctttcatatctgcaatgaaggaacgcggtacagattgaaagggcaaccaatgcacagtgcaaaagacattgatgaaaaatcagaaaacaaatattacaggaaaagtccattcagtttggaacagaatgatgaaggctcatgtagcactgcagttggcatgccttattgaggtctgcagcttgctcactgtttcaaatgcacagtgctggaatgtcttgtgttgtggttgtgagttgtgactgtctctgccatatgcacttttataaaagactttaactcttcaatatgcactggaatgctgaatgtaatgaattggcagtctgtaggatcaaagttcccgggtcgatgggatcgaggaacagggtcgagaaacatggtacgctacttacaagatgggaacgaaaatgacctcgtgttcctgggacggtgttcccggattgaggatcgctgccaccgaccccgttttctgtgactatgggatttgttcttctgaatatcatttgaaacctctgaatttcaacttgcatgatattgtgaacccactaattggtacgtgatgtcatcatggttataatgtctgatattatctgccaaatatgctgctatcattgggctccattttactgctttgcagatgtttttactttctaaataacctgttttaggattttttttatgtcattgactgcctactttttttagtttgagtttttaagtgttaacacccaattatactttaattattctgaattctgaactaacttattgtcctcttgccacctgaaattgtcagctctcccttcaaataataatactatgatcctcaagtaatatcaactagtagtagcattctctgtacatatcagataatcgtgcttgtcatttttcttttggccttcttgtgtgatgggacttagttctgatttgtgtctcctatctagctttatgtccttttctgaaaatttatttgtttgatagtgtcattagatgcttatagtaaatggtctattcttgtaacatgtattgatgacagcatgggttaaaggatataggtctagtttagcaatcgagcataacctcatttatgatgttaagtgctgatgaagattgaaatgtataaaaacaatctatgttgtccacaatccaacagacatattaagcaggtctctctcgctctatttaattcaattgatagtaagcttttctatcagcttttgtacctctgctatcattttcgggtatatcttttgtcctctactttctgtctgccttgttgttgctacttcttatgggaaaaacatacaggattacttttgtgcgccaaacccatattccttttttttttctcaaaccattatgcagtgttttgctatttgtgctcttacatgggtgttttgaactgagctaactatttttcttgaatgatacagagcaaagagaggtgatatatggtctctacattgcacttattattctggaaatatcatctctatcatttatgttgcctatattagctggattcttttggcccacaggtatgttgacatcacataaacatcttattcctaattaattgtgctgaatggaattaagagcgtatggacgaattacgtaagttacgtttggtatggtgtgattaattgccgttgctgttaagcctttccagttaggtgtgctgggttgatccaatgcaaggccgtatttgtatcatcaataattgccattgcagccgccgcacgcacgacccacatgacccatccactcttggtcactcatatcagtgtttcagctttcagccttcagcctacagaaaaaaaggggggtgttattacaaacagctttttaactaattagtaccaaggaataatcatgtgggtaatagtaacaatttttgggaacaggtccacgtgaagattactattgtccagctctgtaggcacagctaacacatgctgacatgcaatactactgctgctctgcttctccctctcttggggttaaacaggatgtcatcagcattaggccaggaggtcgacgccaaacctaatatcccagtccagtgaacagtggccgacagaattagagttagagatcggattagattgaaccctatttagtggtaaattcatacaatcgatgacagtaaaaaggttagtatatccttaaaatatagctgagctcaaactgagcgtgcttaaaagctcgaagacacagcttgagctcgagcccaaacataccagcaatgtagagggatgtattactccctccgtttcaaaatatttgacaccgttgactttttagcacatgtttgaccgttcgacttattaaaaaaatttatgaaatatgtaaaactatatgtgtacatgaaagtatatttaacaatgaatcaaatgatatgaaaagaataaataattacttaaattttttgaataagacgaatggtcaaacacgtactaaaaagtcaacggtgttaaatattttgaaacggagggagtatatcgctattcaggtaagttttgtgagggagatttgttcaatccctctcttgatgttcttctcctcccaacgtaagtctcctcaactctagcagcactatcctccggctgtgcttatgtcatagcgttggaccatgacacaggacttagtaaagccttatatgtaagtacgtgccatgggggtccggtgtaaaatcatggggctgtttcaaccaacattcactgcacgactaccaaaattcagcagcatatagtaactccttttaccctcatgacagccatgcatgatctctgcaccacacaactgtgaaacgctgcagtataaccaccaccgccgagcctcctgattcacacttgccgctatgactgtcagtagcctttttaccggccaacctttcttgttctggctgcagatcgatggacggatgcccggacgactttcgatcaggggcgtcaaactgtcataaacctgaaaaagcattggtcattggctcctgttaggactgagatgttccgacatgtttgttacccgcggttatcaccatttatcaatagaagttattactacatccgtctcaaaataagtacatctagtatatagcacatcttatataaattcgtagtattaagatatatcacatccaacattagatgtgtttattttgtgacgaaggaaatatcaaacttgcataaagttaatccctaaaatctgtcacatcttagcaaaacaagactgtttggaaagctattgattatgagaagctggtgaatagctggttggtaaaaatctgaaaaaacttgatttcttagtttctaatttctagtttattttttgaattttatagctacattttttttgaaaaatgtggattgtttagagagctcgagcctgaagattatagaagaagttgcagtaactagaagcttctctaactatggcccaaaagaattttgccatatatacatgtaggatcaaatttattaaaagaaatttttgttataactctgactataactagatagttgtctaagttaatcaaacttgactactattaaagctctaagaatgtagcctttggtaaatcttattaacaaatattgtatgtttctatacctgtctgagttgatcaatggtcaaagtgatcgagaaggttagtagtcaagtgatcgagaaagttagttgccgctttactatatcggctactccctctgtttcgtattataaaatacttttgactttgtcttaaagtattgctatgcttgttgaaaatattgttatatttgtttataaacttaattaaatacggagtataaagtagtttgattttaaaaaacttaaatcatactaacaaagggagtaatcaaacatggtggtaagttgtggtagccaaccaatcagacagctatttgccgtactccatctgttcaaaaaaaaattaaactaggaggggatatgaccatcccttctagaacaataaatccgaactatcttagtccagattcgttgtcctaagagggtttttttttaacggagtgagtaaacctttggatgctactactagctatagcatcggtcgatctgtcgttgcaaaggattgagtggctggatgctactactagctacagctatatgtcaagttctctacagaaaactggaccggatggcgcagctactccctccatccccaaaaaatctaacctaactaaaaatataattcattctagtacaacgaactacctggctgcacggacgacgtcgccggccggccgtcccgtcgcttccggtgtccgggtgacttcgccttcgctacagaccagaagcagcatcttccgcgggagcccaacagtcaacagtggccgccgtaccgtacgtgcacagttacagctgcggccatacccgcccgatcggggcaggttcgatcagtcgccgtgttcgctaggaaagtcgctggatccaccgcgaattccgtgtaaaagcttagcgccgccgcgcgctccgtctccacgggccttttccaccgtctacagcccgtacagttgctttcttggcaccggtgttgaaagaggagcgctagttcggctgtttatagttcagcctaaagtttggattttggttgaaattagagataatgtgactgaaaagttatatgtgtatgacaggttgatgtgatggaaaaggactaaagtttggatccaaactttggatctaaacacaactttcgtgtgagtttcaatttaaatcctaagtataacattcattcctggctgcaagtattcctgcattttatactccctacgttgaaaaaataaaaaactgttcaaatctgttgtactaggaggttagtttttttttacggaggagtatgttcctgatttatttttcatttttttaaaaaaaagtaatatgtaagtattagtaaaggacgtcctcgcaaagagacaggaggcagcagatgttggggtgggggtgcattgcaactttgcaaggcaaggatatgagagatcttgtgaatttgtgatcagctagccgtctctgagcttgcgcaggatgggcagcaaacgcaatttattgcccgcccggcggcagagggacccgcacaccaatgcagttaacggacgcggatgcttatccttacccggctccaaacggtatatatattgcaaataaaatacgtgctcttagtgatttaaaagtaaagacggtaaaataaattttaatgaaaagtttccaaaaatcagctttaatttaaagttataaatttaaaatttagttaataagtataagtataagtataaacgaaaagatgagaccgggtggtagctgatgtaccccctttcatcaccgaggagagtcatctgtttacatcaggctaccagccaaactcgaggccaatctcagggccctttgattaaaaggtaatttataggaattttagaggatcttatttctataggattttttcctatatatggccctttgaatcaaatgaatggatcctatagaatcctataaaattcctatggattgtcttttttcatgcaagttttggaggaaatttaacatgatgtagaacctcatggaaagaatccttttgagtctctatctctcttcaaattcctgtgtttttcctgtgttttgtaatctcctgttttacacttgcattcctgtcagaatcctatgtttttcttatttctccgttttttcattcctgtgattcaaagcgcccctcaatgtgtgcaatgtgcagtgcacactgctgcctctcgaaaacttataccgagagtatttcaaaattggagagagcaaagatagtacgatacgcaggttgtacgtagtaatactttggtgcatggtccagatttgttaaaaatctcgagtgaactatattgccgcagattatcttctcaattatagtgataaacaaaatgttttaagaactgaactaaacaaatactccttatattttgtagtgtcagacaaataatctggtggatggataaatcgaaaataatagggccataaaacagaagcaaatactagtagcactttctgagcagcctaaaggaggtgccatgttttttagcataattttttaagtaaatttcactttgacccacattttattaccgatattttactttgtatcaccctttaactaatatttttacctaggtaatctggcctttgtttcgctttggatgatcacttaactcttttctcaaacgtatgaacgatcttaactcaaacatatgaacgatcctaagaacgtcggtttatacttgtcaatgaactctaatatatagctatatgttttcttcaacatatgaaaaattggatatagatggataaaagagttgaggatgttccaaagtgacacaaaagtaaaaataccttgtccaaactgaaaaacattggttaaatggtgattcgaaacgaaatattggtaataaaaagtgatccaaaataaaatttactttttttatatctaattacctgaggtatcaggaagttattagtgttattgacaatataatatgacgtgcttagaggccaaaagcccaaaagtggttgcttaccgttatctaaatataaaaggatagggatgagcgatcgaccaagaaagtagcatcacactaaatgtgggtatctcagtatgttgctgtcatgaacaatggccacactgttgacactaactgcggatacacacgtagctcgacattattaatgtcgatgtacataattaaagagccatatcggacaactgatgcacattaatcagcttgatactacaaagttagacaagcaacaaaggacttactgacagatgtgttacagagaattaacaaggcattacggcatgtctcttaacttatgtttcacgtacatatatgtatgctttggataggaagggcccctttgaatcgcaggaatgagaaaacataggaataggaaaaacgcaggtttttgataggaatgtaagtgtaaaatagatgattgcaaaacacaggaaaaacacaggaatagtcgtttgattgaaccgcaggaaaaacgcaggaattagaggagagataaagacttaaaaggaaagtttccaagaggttttacctcatgttagaattcctccaaaatttgcatagcattaggcaatccataggaatttcataggattccataagatccattcctttgattcaaagggctatataggaaaaattcctataggaaagaaatcctctaaaattcctatgaatttcctttgaatcaaagggggccgaaaagtgatgctgcaattaattacctgctctaacacagaactagctaaccagacgtacatacaaagttgtactaccctcttctatttaccattttttacttcatttaaaattttcaagttaacactgtaattagtaagttgtaactgacgggaacatatttctaaaattttgaggttagaaattcaatccaacctaaataagtaaggattctcactgtttctctaattatcgtcactccctttagtttgcaaatacgtacttgtttgctggaaatattcattaagcatacatgaaagtttactaatacgatatgtgtttgatattccctataatcaagtaagttttgttgagcatctataccattttatggtgtgataaaccaggactctgatatatagtaaaggtcgtgtacgtccatcttattatatagaggctgggatttaatttcattattaaaaaatcaagtgagtatcaaaattaatttaataactgggagtaaaattgtaaaatctcttttgtatttgttttcgagcctttttagatgtagaggtatttagtgttggactgttggtcaagaggtacatacccttgtggctctatcaagacgaataaaccttctgaccaataatatgagatatgcatatctcgctttatatatacctcttaagatgagaaatgtattttgtcaatgaaacagctctatttttttacttctcaattaatagttgggagacctcccaaggaggaaacctctaaaatagaaaaacatagactttttccttcacaatttaaaacgataccatgatagaaaaatgattccaaaaaaaatgcataaacaaacatagaataaaattgaaaatttaaatatgattttgatgatgttctcaattaatctatcaacggcattctgattaaacatagtatgccaaaataaacatgtttatatatcaactcattccaacattatgcaaactaaacaaacaccaacgatcttggggatctgatcagtattgtttctctatatttcccccattttggagaattaaaaaaaacttcacaaaatggttaaattaagcaaactgctagatatatataggagatcaaagccctaggggtttattttcaccagagactaagtcaatacccgaaccaccacatcagcttgagccaagcctagcgcaaggttcgttcttgacttgatccctctgcaactcaccccatttaatttgctcatctatgcaaatatactccacacactatatataacttaattttatttttatcctcgctcgcatatcgcctctcgaaaactctacctgatcaacgattgagttgcatccatcagccagtttcggtcggccatcgcccgccgcggaagtcctctcagtcttctaaccttcaaaagttagacatttgagatggcatccgattcgactcaaaaatggtcgagtcggaatccacgtcaaatgtccacttatctatggtgagatgatgctggcctgcagtgccgacttgatcttctggatggtgcaggagaggaggttgctgacggtgtcgacggactccacggtgagcttcgccgtcggcaggttgttgacgagtatctggaacgccaccgtcaccagcgacccggtgttgttgctaccgccaccgccaccggcggcggagttcggcgaggcgccgctgccgacctctgccggagacggcgaggcgccattgttgtggccgtcggggaggatggcgaagccggaggggaggagggagacgtaggcggagtcgccgccgttcatgacgacgtgcatcgactgcacgtccaccggagcgtagacgacgagggagcccgatgagtcggtgcacgtctcctggaggatcagcatgttgttctggttcccgcttgtggcctgcaggagagacattagtatttgttttttcaagatatgagaagtgaacaaaacttaattcaaggcaagaatttcttggtgggtttgaacatatattggtgaattcgaacattgttcaggaataaattaaccagatagaatgagctggtgcagatgaaagttgtaaagtggtctccaatctagagggaaaattttaacttgccataccatgaaaattcgttgaaaatgcaaagctgaaaaattggtatatgaatcatatctaattcatctgttagcttttgtacacaaatctagacatagcctatatctagatttatatataaaaattgacttattttgaaacggagagagtggtactttctagtttctttttttagataatatcataatagtacattctagtttcaacaactgcatgtatataaaatatcctaaacttttggagacaattttgtaacagcagtcttggtggaaccatggagcactagtatgtgcttgcagcaactgccagaatcaatgcagtcagaaatcaggagttgcaagttaaaaacaagaaaaagatgtcatcctctccaaagtaataaaaaagaaaagataaaaaagagacacggggtaaagcctgacaggctttctgagccaggacaagggcagcaactcagcaaggctaggctgcaagcaagcttccaaaacatggagaaagttaacagctagccttctctcacaaatgtcaacccggtatttttatccttttccgaattgtcctcttgcttctgtcactcactaagctagctcatcagtctcagcccatgcattacccatacaggcatacaaccagccaccctcatggtagtacagtactaggtactactaattgaaatgttgtaaagctttagcaacaactgccaagtgcagctaatgcataggctgtgctcactcagtgccatgttaattaggtaaaagttttcagcttaattatagtgcctctccctcttttgcatttagggtttatcacttttgcagggccctgtacaatattttttcttgctatccttgaagaactaaagaattgcaaccaaaagaacctaatgataaatttactacaaccttctagtttatgtacactagtatagttcttttgtgagaaacgcccagggttttctggctaggtccacaaggtggtacggtagacgatctgaattcgaaacctcaccccttctaattatttgatattagatcatttcctaatattcgtgtctttttttcatagtccttttgttgtaacttgcaataacaaaatacgtacattgcaacttattttaatatatatatatatataccccatttatctagccttaaaagatcctatcaactctagaaggcagattcaccacaatcaccatcaccaccgccaggttttttttttatgtaggagtagtagagattttcatgtgtaggaagatgaaaaaaacttacatttggacggaggagggagacggcattgccgtggtgctggcccttggcgatgtggtccatctcctgcatggcctcgccgttggcaaggatgtcccagtcgccgcgccgctgctcgtcgcggaggtagtcgaacacgcgctgcggcagcgtgccggggagccgcaccgacgtggtggcgctcagcacgacgcccggcggctcccccggcgcgcccacgctgtgccgcgccatcatccgcaccttgtcctccccgtccccgccgccgccaccgccgccgcccccaccctcgccgcgccactcgtccaggcgccgccacttctgcgccgccgacgcgcacacccccgcgcagaagttgtccgtcatccgctgcgccagcttcagcatgctcctcctccccaccggcgttatcgctgcaaaaccacaagaaccattagtaagatcgaactccggccaccggagctagcactagcacgaacggcgagctcaccagcgtggtcgcgggcggggagggagttggagcagaggatggcgagatactggcactgtcgctggagcgaggcgagccagcggcgggcgccgagggcctggccggagcggagcagcggccggtagagctggtgcgccgccgtctcgtcgtactccgcgtgaaccacccacgtgacctgcccacacgtacacacacacacattagcctagctaccggcaggtgaatcagttactgccatcacggcgagctcagctcagctcagcttcgtcacagcctcgacaaggcagtaatggcggaggcaggtgaaaaagacgggtgcattcatcctcatcacgtagcagtaacaataactagacattgcagatttgcagctagcagcaaaaggcacgcaaaaaaaaccccaaaaacaaaatgaccatggtaaaaccccagcaccggaagcagccatcgcacaagaggacagactactgtgttagtatcagtcgaaatgaataacaaacaccaagtgttagcatagtggaaatccagaggtcggcatgcgtcgccagaaattcaggattgaccgctgcgaaaaaaccctagctaagctctactccaccacagtagcatcgcagagaagatgagccaaagaaacagtaatatagtactactactaccacagtgcaaccaagagctcgaggtcgtataaaaatactgtgatgaactccataaagaaacactaaaaaactggatcttggtggcacgcacgcacgcacggacggacgacgcagcgagaatattgggctgcggaagcatcgaaacatttcaaaatcgagagctcatctaacgaggcgtacgcctagctctctcgcagtacaaggtcaagcaagcagcagttgctggctgctgctgcgagtgacgacgagtcgctgagtcgtcgccggcgaaaccggccgttgttgttacgcgcgcctcggcgcgcgcgcgcgcgcgtccacggcggtcatcaccaccatgcgcgcgtacgggggcgcattgacttgggggcacttggcgacgctgcatcggttggcgcgccgcgtccgtcgtcgcggcgcgcgcggctttggattcacccagcataaaatactgagctgtacaaggtcttaatggcggtgtctctctcgggccaggccaccactgtagccgccacatgcttgctgcgccgtgcgtgcaagtgcaaacacaatcgacgggagaaaggtgtagaagtttttgcttgcttttggtttggttaattaccttggagtagccattgttcatgtcctgcacgatgcagccggtggggaggaggcggcagcccatgtacgacgacgacgacgacccgccgccgccgttctggtcggggcggaggacggcgtcgaccgagacgtcgaccaccgcccagaggccctcggcgtgctgcttgcagaaacgcaggaacaccacctcccgtatcggcaccagcggcgacagcacctgcagctccgcgtgcatctgcgcatggcatggcatggcgtgtctgagccggcgagacgccatggacgaacagctagctcgcggcgaggggagaggggggagatcgatggctcaccagttgaattgacccgctgcgcgtgccgcccatgccgctggagatgatgtccgtggtgctcgctctcgccaccacgcacgggaacatctccgaccaccgtggctggccgcggattgcattgcgtcagtacacagcttaaacaaatgcgttgtttttggagttaaccgtgcgtgcgtgcgtgcgtgtgtaccgcgtccatgaggctgtcgacgaggtcgacgctgctgatgatggcgatgccggactcgcgcgtcgcctcggagacgtagccggcggggcactggccgaccaccctggcgaacgcgcggtggtactcgtcgtagttgagcgtctcgaacccgccgtcgaggctggggagccagagcggctcgtccatctgcgccaccttgacgagctcgtccatggccgcgagggcgagctccaggagcacggcgcggtcgatggcgccgccgtcggccgccgcggcgtgcatggcgccgtcgaggccgccaatgcccgcgggtaggcgcatggcggcggagcccacgggcccccccgtcaggccggaggagccgcccatcaggtcggggatggactgcatcgccgccgaggccccgagcgcgccgagcccgaacccgccgttgctgccgacgccgagctcgaggccggagcacgcctgcagcgacggcgggcccggggaggagatgctcgagattggccggccgaggaacttgccggcgagcgcgcagacgcggtcgagctcgtccttgagccgcgcgttctcgatgcgcaggtgctgctcctccagcgacacctcgccgagcaccgccgcgccgccgcagctcgcgcacatcgggttcctcatcgcctcccggatcgtcatgttctccgccctcagcttgtcgttctcctgccgcagcagcgcgttctcatgccgctcgatctgcgtctgctcgccaccaccacaaatcgaaccaaaaaaaaattcaaaatcatgatcaaacgaacacgagaagaatcaaacatcatcatggattgatctgtgcaacagcaagcgaaaccttcatctgggtgcggcgattctggaaccagaacttgacctggcggctctcgaggttgagccgccggctgagctccatccgttgcttctcgtcaggatgtggacactccttgaacacgctgcacgatcgcacgtagagaaaaaaaaaaccatcaaaaatcagaatttgcttcgttattttttttcctgatgtcatcgagagtttgacgcttacgcttcgagttcttggatttgctgcggggtgtggcggtgataacgcttcttcttcttgcgcgggttgctgttgtccgggtcgagttcgtcgccggaggcgccgtccaggttgtcgctgccggagcggctgtcgttctcttcctcccggccgcgtcccagcgagtcgccgtcgccgccgctgccgctcccgccgttgcccatcatggcaagcgaccggttcacgtcgccgagctggctaccgtccatagtttgctaaaccaacacaagattaaaattttaaaaaagtaaatcaatatctaagcacggcaaagaatcacaaacaaaagaagtggaaaagctcgtgagaatctaccaggccgagagagaggccgggagcggcgaacccgccgccgggcttggggacgggcggcgtagggaggaggcgggagttgtgtactccgccgccgccgccgccgccgccggcgtcgtaggagaagacgccggagccggcgccatcgaacatgccaccgaagctcatcacgcgagctcactacaaatgacaaaacaaacaccagtttttcttcttcttcttcttcctccggccaaaatcactccaccgtgatcctaccaactccggcggatcccctcagatcccaacaattcaataatttttatgagcctcggggagaggatttggcacgcattaaaacggctggagggccgcatcagcagcgcggctatacatggcatggcggcagcaaatatggaagcgaattattgcagcgtcgcggacatggaaggcaacaagccggacacgccggaggcgcgagccaagaaacaacagctcatccgccggagaagacaactttacacacacacaccccaagctcggtcgccgccggcgtccgtcctcgccgatccttgcttaaaccaagaaagctactactactaccacttccgccgcaccgtgcgacaggagaaggagaagctagtagtagtagctagcatgagagaagaagcgaagagaggagaggagttgaggaggaggaaggatgggagatgatgagaggaggaggaggcgagagggtggctggagagaatggctataataacaagcgtgttagataaagctggacatgtggagagtccacgagcagcgcagataaaacagaggccgctactgctgttaccgcccaagaaaactgcagctagcggtaaagatcgatcagaggatgaaacggggtaaaaaaaatcaatcgcaagtggggctgactcgcacgcggcgtcgacggcgagagtcaaatgggcggccccccactctcaccctcactcaccgatgatgaacgaacgtaagcagacgcaggtccatgcatatactcctgcccatttttatatgcctcagatcccggcgaataacgacgattattttattcgatcagcttcggatatcgtgtgcagagtacttctccatacccgcagccggttgtgtatagacttgtagtgtaagggtctgtttggtttcagggacttatttcaagtccctgtcacatacaagtccctgtcacatcggatgtttagacactaatttaaagtattaaacatacattaattacaaaactcattccataaccttggactaattcgcgagacgaatcttttgagtctaattacgccatgattttgacaatgtgatgctacagtaaacttttgataattatggattaattaggcttaaaaaaattcgtctcgcggattagctctcatttataaaattagtttttttactagtctatgtttaatactccaaattagcgtccaaacatccgatgtgacatgggctaaaaagttttagccccatataaacaccccctaaaaagggaaataggtgaaaagttgtgttactgcgactactacctttgattggtgggaaatttaactatttgccactcttacgagtgtcaactctccatatgccactattagatttggcctaacatatttaccactagagagagattacgccctaattttttgccactttcgttgggttggagcaccacatcagcatgccagcatggaccggcctagtgaaatgacaattttacccctccattctcaagtggttaatagccaacataatacaattaaatcaactacgcacacatgaataaatgataaaacataataacttgagaacaactcaacacataacatactgcatcattaacacacatgcgcaacaaaaatcaatttttatcccataataacttcttcatcgttagaaatagtactaccaagttcataaccactatcaagttcagagttactgtgaaggccatacataacaagttacatgccattacgcaaggccatacatcattacaaaagcacaataatagaaatagcaacatcaggccaggccatacacttaagttcgttaggccatacacttaagatattcacaccacatagcaaaatatgccataccaaagtgcacatatcatcgcacattacttgcaattagtttttccaaaatatcatgccatagtagaccacaaataaccaatttcactagcaggttgacaaatttcaatccaaaagtttaggtggtgttgcacttttcttcttgcttgcgagcttttttctgggtgtaagctttttgggtggctccactatagctggagctacttgagagctttggtcaagctccaatgccaaccttcttgtgtttgtgatggtgtaaataataaaaaaaatttagttcagtgtataataagtaatgaaagctagagaaaaatgaaaagagcataatggtgcttacctcctagtgactggtccagggctgcttgtttgtgatggctgcacttgtgtttctgcagctcttctctagctgtaactgctcttgttcttggtgtagttacttgttcatcactaacaccctttgatttcttccttcccacctttgttgttgttttcttgttcctcttcctgccaaaagaaaaacagttagcatataacagcaagaaaatgaataataattgagatgaaaatacagcacacctctttttggtgccagttagttcacatctagcacttcccttcctgtgtccaaagacaccacattatggacacttaatggccttgagccttcccctggccttctcaagagcagatgggatcgtattcttcatatgcccacccacttttctttttttggacacaggagaaagaagcttgaatcccttctcaacttgaggccatagcttcttgtctgtaatgttagggatggttgatgcatatgctgcctgaaatctgagcacagagaaagccttatcaacatatttctccatatttggttgcctcacggttgtgatgactgccaatgcatgttggaaagggtttttccccaagtaacttgccattccctngcaggtgcaagtgcacttgtcaaggtacaccacatgccttgttagctcctcatcattatgtatctctgtaacctcagcttggtaaggatcacccttagtgacctttagatggcctaacccctttgaggctgcattcaactggtgaatcacaacaggaagaatcactccattgagggctgtagagatcctcctcctcttctcaaaaagaatcaaggttttctccctaattgcatcagcaagagcatcaataggcaagtccttcaaacctttgatccaagcattccatgactctgccaagttattgttgatatattcacacttactctgacatgaaaacttgcttctagcccacagtaggttgtgatgttcgtcaagccatggcctntgacaaatcttgagctaatattcaaacacttcatccatccacatttgatgcttctgaggcatgtatgtcctagctgcaggccacatctttttcccatatatgttcccatgaaacaatttcttcatattctccatcaagtgcctaaagcactctctttgttcagcccatgggaaaactttttttacaattaaatagttagtataataccctgacacttttatcagcctgtgtctttgctctgattttccatgggcaaccatttgcagaacactttcctcgaaatctatctggatcagatttttcagtctcaagctcaaactcactaacaattgcatgctgtttcactgccattctgaactcattcattgatggatactttgtccctacttccattggtggatcatccctatcccaaacaagttctgggtcagcaggtacctcatcactaactacaatggctgcatctatcatatcttgttgaatctcaattggaataacagggagtgcagcttcttcttgtattgctgttgctgctgctctctcatctgtttttttgaaacccatagcatcaaatagttcatcctcatccaacaatgcatgagcatcaccatctaagccatccaaaatgattgccaacttactccagtccacaagagcagctgagtcttctacatttggtgcatggttacaagtgtcaccagtatcttcttcattggtcatttgaactggagagcaaatatcaattgaatctgaatttatcacaccacatctagcaattgactgaccagttggttttgcacttatcacactaccttcagcaattgatggaaccccaagatctacacttaaaacactagtgacaacttgagttgttgactcaactcgatctacatagctttcagcaggcttgtatccctttttagtaaccacttctaccccaagatataccactttctctttccacccagactgaaaccacttctcaaactgttcattgttggttaccttccattcagtcccactatcaaagtctaatccccacactacaatttcttggctaggcccccatattaccttgctagtcatatcatcacagaatttatctaaactataacctttgcatttatcaacccaccaatcatgctcttgctctgacattgatagcaatccatactctaagtttgctacatatgaagcacatttaacaacaactctaacagcattgccaggatcaatcctgacaaaaaaaatggagccaggatcaattctaacagcatgctgcacacctcacacaaagtcaagagaaggggaatacagagaaggggaatgaatttaccaaggaggacactccgagggcttcatcacgatcagatccacttcacctccgccagctatacgtcccggatgaccggccgatgcgttggcgtcgcgtgcaggcgcggtggaggggaggagctagcggggggactcgccctgccgctgccggctgggtcgtgagagccggccgcgacgcagtggcgtcagggccggcagcggggcggccgcgtgaggctcccgccggccgcgacgggactcgctctgcgtcacgcagtagcggcctcgccggccggccggcgcgtgtgggttccaggcggcggcggcagtagggttcaggcggcggcgccaatagggatccaggcggcggcggaggcggcgggggtttcaggcgcagcggcggcggcggtagagtttcagggcggcgacggtagggtttgagcagctgtggtcgagagaaagagatggatgccgatgcgtttctgtttccccctgttttctcgtttctgcacaagggcacaaaggtaatttcgccaggccagtccacattggcatgatgatgtggcgctccaactcagcgaaagtggcaaaaaattaggatgtaatctctctctagtggcaaatatgttaggccaaatctaatagtggcatatggagagttggcactcataagagtggcaaatagttaaatttcccttgattggtggtgacacctcgccactcgttgtcagccgtgctgtggtgagagagaggaagaggagaactgtggcgggcgataccgtggaaaaaagcgtgggattggaggtgcccgacggggacttctcacgggcgcggctttgaatccgacgccccccgaaacgcccgtacacggtccccccaccgccaccgcgccgagacgcaacagattttggcccaaacgcgccccccgcccgcccgacccgtcctccgtgcgatcgagggagagcggagtaaatggacgcggtgtgcggtgcggcgcgggaacggagtaaacggggtgggacgttttctttttttcctttttctggtgcaacgtccgcgggagggaggcggctcgcgtttgcttgccgatcgattgcggtggggccgcgctggcaaaacgggggtgggtttttaatgccggcagccgcacggtcacacggccccgcgcgttacgttgcgttgcgccacccaccgtgacgatggatgcggatgccggccccggtgtgcgcgcgggcgatcgatcgatcgatcgactgatcgcgggggtggggggtggtggcacggcacggcacgggcagctacctagctggtggtggcaaccgtgcgccgtgcgcgggtacgtgatcgcgaggccccgcgcgcgggtggatgatcgctcgttcgttcgcttgttcgttcgggtggcccgcgcgtggttcgatcggaggaagtcgtcgcggggttaacgtggtggtgttgggatgcgttgcttggacgttcattgacgtggtggtgtaactgttcggtgcgtgctggtcgacatgctggctgcatgcctggcgcgtacagtagtatggagtatggacgctggattaatgcgacgatatgccgcttttttccccattgggctggctggctggctggcatgtacagcacctatatatggactgatcttgccatgtacggcgtcgacgtaataatatacgagtactaggacgactctgcaagggatggacagtatgatgggcgcaatgcacacacggacacacggtgtgtgtcatatgtagtcatagctgatgagcaacgcacaagcatgcgtgcgtgaagcagctgatcgacgactatgtccccgctgcacgctatatagatctagtagtggcgatcatatcaggcgttgatcgtctcgctacatttaaacaggtattcgtccaatattcgtatcactgaactttctagtactccttgcttggtcttgtgactgcatacatcaatatgctttcaattatcggatttgctatttaacatccgacataaattttggtcgcaaatctgtcaaattttgatttcgagagaaactaaagctgccgcaaggtcctctgaaaaaacccttacattcactccatgtttatgatttgtctttcatgatagagttagatttgttcagtgtgcttttttctatctattcaatttgttcgagtctattttgtactccgtccatctacttttcatatgcatatttctaaatctgaaaaatttatttttgatagatatatttcaatccaacaacctatcatcttaatgattttttctggatttaatgtatgactctccactcttctacataagattggctacatgtgcattgagaaatataaatattaatgaatcgcttgtttacgaggaataaccaataatatcatgtttaaatggatgataagtataattacttatctttggtctgtatgccaagataaaatatgactatcaaaactagatggagtacaaaactagatggagtacataggatcctcaaaggatatttagtactgtttgttttgtcagttcatcgatgatcgaatctgcgaggttgactttaaggtctgggttgctaacttgttcgatggacctattttgttattttgttcagtgaatgaatatggtagttgatagtttttggctttcaggatgtacaacctcatctcttacggcattacaggatgtacaacccttttttcattttgggggatatttttgttttcagctattgtaaccacaatacgacatggttgtaatatattatttttttctattactagaaaaaacacatgtgcgttgcaatgggtaaaaacattttttgtcctatacattatactctcttggttttggactgaatgcttacttatttttagaccgaacattcattctttccttccttttcagctcagtcctagagcagtcctctacctctatctggcctatctctcctcggccttccttccttttcagcttaggttgtgtttagttcgtgtgccaatttgttttagatatacggacacacatttgaagtataaaacgtatactaataacaaaacaaattacaaattacagactccgcctctaaactgcgagacgaatctattaagcctaattaatctgtcattagcaaatgtttactgtagcatcacattgtcaaatcatggcgtaaattaggctcaaaagattcgtctcgcaattcacacgtaatctatgtaattagttatttttttcgtttatatttaatacactatgcatgtgtccaaatgttcgatgtgacagggtgaaaaattttgccgggaatctaaacagggtctgagatcaaagccattttgtatgatatttataagcgaataattcctaacagttatgaatgcccactaggacgacaagtttgtaggacagatgagtaaaaacaacataaggtgatttttttataatggaattcaatcaagagatatatgagctgattaccaattatgacgaacgaaaacttaatataatcagtgaacacttgcgattttatatgttaatttattgggattatgaacacgatgcatggaatgcataaatgcaagctagtaatgaaatcatgtggaaattgtgcgtctcaattaatttgtacatcatgcccatcgtttttatatttgaatagatgaacttggcatcatttgaaaggcgtgcggcctacaagagaatgcactttctttttgcttgattgtatgctttgtaaagttatcgcgtttatttcatgtcttatttttatgttttcgttcatgatgtaatgactaaagcagctagcaaagacatacgctgtacagtaggactgaggtcactatttgcttcgagcaactgaacaaacagtgtgcacagatgagtatccctctgtgctagtaataaccgtactataagtttgataaaaatctactgcaagcat

SEQ ID NO: 17344 - DNA, 10906 bp, Oryza sativa
agagaatcaatgtgtgtttgatggctttgatctcaggacctgtttacattccggcaaattttttcaccttgtcactcaaacatttggacacgtgcatggcgtattaaatataaacgaaaaaaataactaattatatagattgcgtataaattgtgataataatcttttaagtctaattgctccatatttaacaatatgatgttacagtaaacatttgctaatgacggattaattaggcttaataaattcatctcgcagtttacacgtggaatatgtaatttattttattattaatctacgtttaataatttaaatatgtgtttgtatatccgacctgcaggtcttggcatgcatagggattatcgccgaacgacgacgtctgtctgatactctgatcctatcagaattcggcagccgatcgatcacgtactccactactttctcggcgcgaccggccgcaacggcggcgggacacgggcgcgttaactgcgatgaggctacgggatgtgtgtgtgtgtgtgtgtgtgttgaattggtcaggagaggaggccgcccggcgccgcggcgcatcagcccatcagctcggcgcgcgcgcgcgcgatcgatcgatcgcccacacgcgtgatgcgcgcgcgcggtgcgtggcgcggaggacgtacgtacgctacgcaccgcgtaccgaacgaacgacgcgacgcgacgtcggcggcggtggcgcgggcggttgcgccataattgggatgcatgggcggacgcgcgcggcgcggcgcagtatctctcggctgtttttgctttcgatctctcgactctcgtgcgtcgcgttgccccggtgcggcggtgccctcccataccgtccggcttgcgtcggcgcgatcgggacacgccaaagccgatcgctagatcgacgccgtgtctcatggccatgcaccatccatcatccatgcaaggtcgcataataaccttgcacgatcgattcaaaaaggaattgggttacctttagtttctttttcctcctttttttgcttgtttggagcctgcctagcaatagcacagccattatttgctcgtctttttaattttctcctcgtgtaaatccccatgaccactatgtcaggttacagtcatacaaaattctctccccccgctaatatattgacatgcaaagctcttatgcgttaaaaaaaaaattctcctcatgacctgtgtgggacatgatccacagccagttacaattcattcagagcatctaccaactgacatggaaacttgggggcaatcttctcaggctgccatacaaaaatcatagcagaaaatcttcaacgcacaagtgatcttgattacttagggagtgttcgttctggtgacatagggtgagaaaggatatcgtattccacgcgcacgcttcctaaactactaaacggtgcgttttttgtaaaaaatttctataggaaagttgctttcaaaattcatattaatccatttttaaaatttaaaatagttaatacgtaattaattatacgctaatggctcacctcgttttacatatcttaccaatcttctcaatcccctcctcaaactcacccttagatgatttggaagaagagaaacaacaagatctttgaaggagtgaggaaaaccgccaccgaggtctcctaatgcataccagaagaatggtgagcacggcaagctgctagttttgcaggcatcatgatcaaagagatataagacccatttgttatcctagttgtgccatgtagttaggtatttaccggcaaaatacattccttatcttaggattgggttgtttccacaacattcatgtttgttgttttatgtgacaatctcctcattttcttcatgtaattgttcggggctttcctccatctccgacccggcgaaaaagaaaaggaattgggttactacttactactcgaactaggctttcaggaagtcgtaaactggtgggtgtttcagagttgcaaactttcactagaactgaaaacaagcgaggccattcaactcaactcctagtactcgtttcagagttgcaacattcaggaaatggaagttatttaaagtgtaacggatttggttggccaccatgaatgtgagtttcccattgtgccagtagggagcaacatgacagctactgcctgacccgattcatgcgtattggagtgcggacattcatttacgccggcgctgccaaagccaatgccaagcgaagcaaagcctgccggttcgttccagacttggcaatttggcatagccagcattggcacatttctttcctcacaaccatcacagccaagcataagctttcgagatagctgaaattgatggataatctgatatttgtagtatccatttgaggatatcaataaatgaattagctattttttaatttattcatacaaagttgaaaaaatgttttagagaagtatgccaagaaaatcttacatataaatattttgtatgaaacacatagtctagcagcttaggaagcgtgcaaacgaaaatctaaaaattcaggatcagaaagaacagggcgcagtgtatgtggcgcatattgctagtcaagctcgtctgaattcggtgagcgaaatgtggacatggaacagaacaagtccttgcaaataatgcatcatctcccatgtcatatagtcagagcgtgtagactggcattgattattggtagctcgtggtggcacgcagccaagactgaaggaaacaaggaactcttctgaaagcgaaatgaccctatcggaactttggacagctgatcatgatcacattgctccccgtccttgggtgatacaagtagtaagcaaagaggcacatggctttgtcccacaagaagaacaggaacaagatcaagagtactgccagactaggtgaagattaagaacagaagaattgcagaataggaagcagaatatgattatgtccccggcgtgtacttgtacacattttcaacgcaatttcgctcattggtcagagagcactcatcagtgacaagtgtatcttcagtactttcttctgattaagtgattatgacactggcatgtgacaaactaccattaacagtttatctgatgatgttgttaaaagttgggagttcaccacgcgagtgatcccaagaaacgcggctgttctctgcatcgtactacgcactgcagctgatcggctccggtaggtagtagtacgatgctgccggtgtcggtggcgccgcggcgtaaggcggccggcttgctgattgccaacggcgctcgacgtgctctgctggaagctagattgcagcaaagaccaattctctgaactctgaatgaggcagttaccgtattcatcagcttaagtaaacaaatcatctggagtctgaaacatttctatggtggatccgtggagtctacagggtcatcgttgaagctcaagttctaacaaaagatgagacacagttctcctggtattatgtctagtgcatttcacatcacttttaactcaggcaacagtaagttcagactgaatacaaaacgaccaagctctcatcactcaactcgttgcaattgcaggctttgcattgtcttgctggcttttgagttcttcgctgtggtgttttgcgtcgttctggtctgaatatggtgtgctgctgtctgttgttgcctcctatgcatcatggcaattctgtgtgaattgctggatcaagtaaaagaaaacatcttcctcttctgaatttctgcaatttttacccctgctactctgctaaaactgtggcaactgaacgaggttgctctaatttacctctgatttgttctccatcagcacgtggcatctgacgaagacattctcctgctcccaaggtacaacaatttctggcgcatttgcaatcaaggtgctctctgctggatgcctgcaggtttgccggagtaactacagagagtgaaaccgaccagttcatcggcaattcatggccctctgaacagtgaacacccggaaccttcagaattcatacttcagtgtatccaagcttgttcagagtgaatatcaattgcgtctttacccagcagacaccattttcatcaagtctgcaatctactgatagcaattgtcaatgtgtgtgatcaggcaaacaaaactataggagtgagagcttcatgcagaagttccttgctgcaacgcatctgaccgcgttgtgacttgtaaacgcgtatagactctgctatactgaaaatgttttgtacttacaagagaaacttcaggttccttttcctgctctaattatagaggccaaatgacacggtagtactcagactaacgtgtgcatttaacattgacttgagaatgtgcatgttgacatagactccaacgaaaatttggtcagagtcgtaacaaagtaacaggtcggaacaacgaaatcacttaacatttctatactgaatgcataaacattcagtcaagtcaaacgggcttaaagccttaaacaatgatgaatcacatgtcaatttcccaagcacacgttgttttagtcttaaacaatcaaacaaatcaaataccacgtagaaaaaaaatcaacgtaatcctttttacaacctgagcaggattctgcttttcttttttcttcagcacatgaagaataagaaaaacatgaacaaaatctgatctgctctcctcgcagaaaagaaaaaactgatgtgctaatttgtttcaatttcctgatgaattcatcagaatctttatcaacaattaaaaaattgcaatgtcgagacccaatcccaatttcggtttaatcctttcctaactgaatgatatttaccattctacgcgcaggccttgccattggccgtgaatccgacggggaagcccatggctgcgcccgccggcggcacgccgtagcaagagccgccgctcccgctcgcgccggcgtacgccggagctttcaccggcggcggcggcgcggtgtacttgacgtccgtcctcctgacggtgatgttgacgatgccgttgcggcgcgtcctgcacccggaggcgtcgaacagcctgtagctgaggcaatgcaggtggcccggcgggccgacggtgaagtcgccgacggggacgctcgccgccgccaccgcctccacctggccgttcggcctcctccggcagatctcgacgtccagccagcgcgccccctccggcaacgccacccgcagcgtctccttccagtaggggtacccgttgcagtcgccgcccgattcctcgtcgacgcgcgtgcacaccgccgccgccggcgacgacgccgacgccgccgtgcgcaccaccgcgtacgcgccgcggccgagcgggcgcctcgtcggcggcagcacgacctcctcggcggacaccaccgtcacctccagtgtcatcgtcctcgacgccatttgcacgcggcgttgcgtttgcgagcttgcggatcggaaggaaaacctagggcacgatcggtgcggatcacggcgaccgctgcttatatcgagttgagacttgagaggttagaaaccgaatcggaaatttgaaagacgaactaaaatcggtagtatttgttgcgaatttacgcgccctttgatctgatatattcatggaagattagcgcgtggctggtttggaaatatacgagtaaatgggtaagacgtgttgatgagtattcggggttcgggtcacatgtaaaaatagtataaacgtataagtggtggaattcgagtgaaatttgggcggaatttgcagggaagacgcgtgtggaactgtggacgatattttctgcgagtcgccggtttttggtagttattgagtaccaagtagtttaacttttatcgtcggggtgggcgtggggcgtggttaattaacccttttaccccgtgttgaccggcatgcgtcatgcgtgtgtcttccaccattggacggaatgtttcgcagaatacatgacacactttcagagctggcttatccgtcttaaaatataattcttcattccaaaaatctaaatcatatttcattctttattttttttcaaaagtctaagttgtatttgtagtcactatatgctatattaaattttttatcaaaactcaagaagtcattttaatacttattgattacatgttcattgattttgttacatgataaatgagttaactacaccttaatcttggtgaaaaagaaataggacttagacttttggaaggagggagtagcaatttttaaatgtggatagaacatactttagaactatgaatttggaaattttgcctagattcgtaattttagaatatatttagtattcaattcacttaaaggtatatttgagagaagctaattcgcgcgcgttggtgacgtgcgttttaggcccataaggcccacgcttagcctaagtgcatgcatgtttttaatggcgtccacgtacgtgcattcttttttttttttttggaaaagctaacttccacgcgtcatttttgtttctttttgccattttttcacaattttttaattttcgaagttgaatatttcatcttaaatttcagttgaaagttttgaatttgaattgaaagcttttaagacttgagttgagtttttgaattttgagatgaaagtttttaaatctgagttaaaagttttgaattttaagatgaatatttttaaatctgaattaatagtttttaaatctgagtcgaaagttttcaaatcatgacttaaaagttttcaaatctgatttaaaagtttcaaaaaatattgacttgaaagtttgttttatcccgaaagaaaaagaaaagatgaaaaaaatagaaaaacatgtggaggattttctttgtcgtgacgcggacccgttgattcctgccctcgcacgcaacttagcctatcgccgcgcgtgcacggtaggagccccagttatattttgaaacataactggaaaagccaaactggaagttttattttcttttgagagaaacaaaagcactgaagggtggacttatgtttggacgtgattttctttgcttgagatgacctctgatattgtttccatcattccatggttcctatttgaacctccgaatttgaacggtgtttgtaactctgtatgttcgtacttcgtactgagtggagtagagtgcaggctcggatatgaaaccatgcttgactgatcagattgctctaaattattactccctctgtccaaaagagtttaatactgaaagtgtaggttcaaattcatctttagaatgtgttttttagggattggtggagtattgatttcacagctcaaattggtgtctcagtatctagagttgagtattcagctgtttggaaaatttagcgatggaacacaaaaaaccaaatacaaaccaataaaaccattacaacatcacacatgattaaaacttttttcgctacaaaagaaaagcaaatgcgtgcacagctcaccatcatacactctgctcaagtccatatgcacacacacctaagtacgcgagcatttgatgaagcagtcaaggataaatcaacaaccatagaatagctagttcatgctaacctgttcatagtgtaccctgggatgagaatccttttgtgagcggactttacaccaacactccaccacacaccaaaattaatcccctcataattaatctaaccacacaatatttgatgaaatctgcacaggaaagtttgaatatgtttggtttcttatagtatagttctcccactttctccaacacataaataatcaccttccatcatttcaaaaaagtactgttattctctatttcgtcatgctcttttctctgtgcagataccaaagtaggccacatattagcaaaggaagtgattagcttgcagtaaacccctttttttaaaaaaattactcatcaataatgacttcattgtgaaaacgttgatatttttaactaggtatttaagaaaactgcaaaaagaaaagcaaagaaaaaaaattaaaagaacagtaattttatccttcacatgggtatgacatgtggatcacacttgtctgtgatataaagttgtacctttctggtaaaatcatatgatattatggtgatttatttttgaaatacttagctaaagctgtagcatattattattttgataaaatagttgcagctttttgaaattttatgtacattaatgcacatagttagaaattaccaagatcggttctaaatagtgaagttagcatctcaacttattttttttagataatgaattttttttattaatctagcctctatatcacacaaccataacatacaagttcttagactccaatcctcatgcagaggaaaacacacaaacacaccaacacacacacaaagcttgaagagttagctttaaaccttcaacgatgacttgaactttccgccgcaacccgagaggatggaaagggagaattggaactagtcccagctacccatcaccgcaccatctccgcctccgtggatcacaacaccatttgctgttgtctgccatcaccatccaaaaccccttacgccactaccgcattccgagcgtccccagtgcatcacgaagttgctctgttgcaccaccatcatcttttgcagatcgtcgaattcaccaggtcccatcgtttggcttattcaggcatatttgcaaacgaaaaataatttgtgaataaaacttttatatgtgtgttcttaacgatctaaaagcaaaggctgaaaaataaactttgatgaaaatatctcaaaatcaactccaaatttaaggttgaaaatttaaattttgactactaagaataagtataagcgaaaaaatgaggttgaccatctctcctagaatgacatggaaccgaccagaatgacatacacctgcctttaccgccgtttcccatccttgcctggctatggtcaaatatgggtgggtatgtcgtggaaacatacattttgataccaatactaccttcatctttatattgtagaatggagagtacgaaattacgtgaatcaatctttagtttcttttattttagatgtgagaaagtgtaacaagtttcgtgttgggatgttcaacaattttaagacacatgtaggacgaggcaaacgtgaatactccgtgatatgggcaacacatgtaagaacccactagtttacgcaacatctctgacgcctcgacgtggcaatgtcgtggacaaaattattagtacggagtactactcgttgaagaaacgcagcaagaaagatcgatcgaaaacagagggggaaaaaataggccgggccgtgcttacctgacctacagccattcgacgatgcgtcgctgtctgatgccatgtagtacaaaatacgagtagcttggaagaagaaaaatggggaacaaaagggcatccagtgccttctagtggcgatgacgtccgctgcctaacgttggctaagccagaaaatatacgaaattgtgagtaatcaatccctctctgcatggacccccccccccccctaggattgacatgattaatttgcctgacagccaaatctagcgctatgtggttcactacgtgtgttcgacacgaccctctgtggtcgacgacccagtcggtcaaaattaagaattgactcaacttctacacgcggcgtttggagatgataacttgattagtggattctgtgaacacacgattccatttccaggagccaaccatgcaaatcacggctaattgtttggaaggcctttgtttggttatggactttttccaaaagttgtactaatatgatcccttctctaaaacaaaatcacggttaattgaggctttctactctacggggctattcggcaggcgagggcagcttgctgcattgttcgtgttgactgcggctacccactagcatccgaataacccctaaatttcacaactatttctagcagcaaaacttatacatgcaagtagtataaaacatgcatgctagtgctattggatgatttcagtgttagcccttggatgatttctaatgtgtttactcatatggattgtaatcaaactgtgttgggtaaataaagaactaaaaaaattgctaaaaaggaacttgaatagtgacaggagaaagaagggggagtatatatcgccactatttctagcatcaaacctaatacatacatctagtacaaaacatatgctagtgcttccgccctatgtcaccaccatttttggcactaacacctaaaacacttgtaaaactgaccaaactgtgcacctaaaaaaacaacagtttgaggtgagcaacttaataaacaccacaccatcaaggaaatgcacttctcatttccgcagcaggcagccaatacactggtaaacccaggttgcaattaccgccttaccggcatcctgatggatcttacgctgatgatttacaacaacacaatcaagagaaagaggcagacggattacaaggcgatcgatcgagagacaaggtgagctctcatctgttcttcctcgccaagaagcaaaagagcatctagtactactagtggtagtaattattatttcgccgctaattacgtactaatcataattagttgcttataatagtgtaggggaggggcaattaagtaatataggggtctagaagcttctacagggttgggggggccaactcacctggagctggacccgtcttggtcggacccggccctgtccggcccgttgcaagtgggcctgaccgcgtggtacatgggggttggccggtatatgggccacgggtgcgactccggcgacgcctccgtgctgcttccgccgccgccgccggcgggatgcggatccgccgcctccggcttcacgtccgcgccgccgtgctcggcctgatcctcgccgccgccgtcttcgtcggcggcggcggcggcgtggtctcgcgtccgcttcaggccgatggagacgccg

SEQ ID NO: 17345 - DNA, 12575 bp, Oryza sativa
  unsure (1)..(12575): unsure at all n locations
gaagccaccgcggcagctgccgtcgccatccccggcaacagctgcggcggcgccgcggtagccgccgacactcaccttccggcggtgtatatcacacaacaaacgcttctcccctcgccggaagcagtcgttggcgaactcccaccggtccggcacgatcttcctaaatccctacgtcatacagcaagcaagcaaaatccagacacatcaccgacatggccaaaccaaaccaagctaaatcccaagcaaacgacgacgacgaggaggaggaataatcccgggggcgcgtacataggtgttgagctggcgcacgaagctggagaagttgttgtgcttgaagtacttggggaggaggtcccgcgcgaactccgccggccgccacaccacgaacgtcgacccgtcctcgttccacgagatcacgtcgtccaccgccgggtcctccaccagctggtacgtcttcgtcaggaacggcgtcggcagcgacctctgccccgccaacgcctccgccgccgccgtcatcaccgccgccggcggcggctccccgccgcccgcatccgcctcgcccgccccctgctccgccatccgccggggaggcggccggatctgatccggcgaggaccgaccgtagtagtagtagcttccagatgccggaagaaaggcagttttcgcgtgtgaaaacgaaggtacggaccggaagtcttctggaaacttcgtttgcggattaggaaaatttatactccaacgggaggaggagaagcaaagcaagagagaaacaaataaaaaagagggaaaaaaagcaccaaaaagaaaaaacgattttaaagagaaaacgcacgtatgtgggtgttaagattcagttgtgtaaagttttgttttttcgtgtatatcgggtattatatcgttgactgtacgtttgggtactaataaaaaattaattacagaatctataagtaaatagagagacaaatttattaagcctaattaatttgttattagcaaatatttactgtagtgtcacgttatcaaattatggagcaattagatttaaaagatttatctcataaattagtcacaacctatgtaattagtttttttttaagcttatatttaatactattttatataggtgttttagcgttcgatgtgataggttgtgtggaactaaaacatggcctatgaattcgatgcgacccaccactcgtaccgagaaagccaagctggcgccggcggtgcaggtgggcccggccgcagtgatagatatctctcgcccccgcggcgggcgcatccacgccgttgtatcggaacccaccgaggtggcacggatggccaggatgaggcgaggccgcgggattgggttctcggcggggggatgatgggatggggatggggcaattgggggtcggaaggggcgagaaggttcggtcgatttttcgcgcttcggccttctggaaggttcaggtaggcgcgcgggcggggctggatggggcccacggtagacgggacacgtgtcgattgctcggccacggatggcgagtgggataagattttatctcgtctacgatacgacgtggcctttttttttatttcgtgtatgtatacactgtactggagtactttggtatttgtgcgtttttgtttgtcgtccttttggaaggttctttttctttcaatcggcttctagagagtaaggctcacattggatagcctaatcagctaaagaaaaagccaaattttaaattttcaagcttaattttgagattgattttgatatattttcaatgtagtttctttttcaacattagcttttaagtcaccaagaacatatttataaaagttttagctacaaatttatttttatttcctattggcttattaggaagtaagccaaacgatgggggcctaaatgcttatctgccagaggagaaaaaaagtccggttttcttctcttttttttcaagagatgcacaaggtttaattggaatggacttaaacaagaggaggggaccaatgcttgataggagtagtacttatcaaaggagttactagttcatttataaatgaagttaattgaaacttaaactaaattgttgaggggggaggttaccttttaattcaatgaaactatgaaattagaaggaggctgaagcatagtaaaaaaagccggaccggtgggtgacccagccgacctctcggttcagcggtccgtcggtccgaccggtgacccaggcggttgaactgcggttcacaaactacatgtatattacatatttgctcatgtacacatgtcgttggatggcctgatggctagcacttggctctttcaacccccggaccagagggttcgaatcccacccagtgcaccatttcttgctatttttgctaaaaaaaaaaccactagctgcaccattgggcctttagacagcccatcgtggcccattagtatggctagccggtccaaccagtgccggtttagtgtccggttcgccgaaaaaccgccggttcagccggttcagagcagttcgattacatgtccggtctttaaaggaaaccgaaccgtggtcacctctggttctagttttttctactatgggttgaaggactgaatcttagtatagtggtactacatatggcttattacttagaaaaggaggtagtgtccaaaaagccttctttgtaaaagatgacaatcaagacgatactaataatgacaactgtgtctttttctcacatttgtatcaccggttgatcattggataaattactccctacttgcaaagctaggtcattcgccaaatataagtagggatgcaagtgggtagtcccgctatccgcataaaaattcgcttgcgagttcattttccacatggtaatacaaaatttagaagaaaaaatgaagtataaatgagataagcaggctaaaaaaaagcttgcctgccccgcttgcatccctaaacataagtttgcatataagtttgcatggtgacaaaccaagaaagatgtttgagcatgcacaacttaactgctaactttgtcccataataattgtatttaaaggacttaaatttgttccaaaataattgtcacagtagagtactaatggtcccattgatcacttctctctactttaccctcaactacccttccactcctatctatctcatctatatataccatttaataaggggcattacagtctttcttctcaaaccttggctctgttcggcaacgctgctatgcagctgtaactggctgcgctgtacagccagtgcatatattttctctatcatgcactgtagcgcagctacacaacaactacaatttagctgcagcgaacagaccccttaatatttactaaacaatttggattacaattattttgggacggatgttgtacataaattcttccttcaattattctttttttcgggggggatcttcagttattctttcaacaaattcaacaaagcatttctctttgaattttttttaaaaaaacatgaatattagggaatgatctaatattaaataattagaaggggacttcgaacccaggccgtctagcccaccaccttatggagctaaccggaagacccctggacgtttctccctctttgaaatttcatttgaagcatccatctgagcatttatttccccttcaaaccatgtcggatgcaaatcaacttggagcaaacaattagcaccactggtgttagataacaagccctgggcaattatggtttgagcttagcatatctgtgcatggccaaatgggttggtaacctatgaacaatataaaaaagaggaatgtggccatcagttgcctttcggcttataagtgttagccaataaataaataaattttcaaacatagttttagagttaattttccattcaaaacaattagagttatttttttagaggagggagggggttattgtagtttatttttcaatgtgatcttttaaatcgtcaaggacacgcgtgtacaatttttaatccacatattttttgctttaggccaaacattgctttctgaagttaggtttacaactagatgatacgagagtactattgtctttaatcaaagtgatgctaaacttaaccactttagtactccctccatgtccaaagctagcatcggggagtcaggagtaaaaagatactccctccatctcaaaaagtttgacgctgttgactttttaaaaaatgtttgaccgttcgtcttattcaaaaaatttaagtaattattaattcttttcctattattttatttattgttaaatatacttttatgtatacatatagttttacacatttcacaaaagtttttgaataagacaaacggtcacacatgttaaaaaaagtcaacggcgtcaaacatttagaaaagaagggagtagtaaagttgtcaaaatggaaagtaagccaccaagtcttttctccaaaaatggaaagtagaatgcagcttgttcaactattgtgagagttatgtccccacgttcctacattttcgtaacgtaccttggccttgtttagttccagagggataataattagctctctaaaatcttgctatttagagtatttaatagagtatatgtgcaaaactacttacagaacccctaggctaattcataagataaatataacgaggtatattaatctatgattagtgaatgattactgtagcgaatcatggattaattaggctcatcagattcgtcttgcaaattagcctaggggttatggaatgagttttgtcggtaatctatgtttaatactcctaaatagtaagattccagagggctaattattagccctccggatccaaacgtagattaccgacaaaactcattctagccaagcctgatttgttcatgctattgatatattcgaggtgttaagcaatattaggggaaatttgtagctgtggtgatatttaccaggtgtagcggcgacgaatggtgatattggtatacacaggaatgaaaattcgagaaatatgtgttaatgagccgtatggagaaattaacttattaatatagactactaaatagcaagatttcagaggactaattattagccctccggatccaaacaagacccttatccttttgcatctcacttgtgcatgaatgatactccttctagccaagcctgatttgttcgtgctattgacagattcggggcgttaagcaatattaggggaaatttgtagttgcggtgatatttaccaagtgtagcggcgacgaatggtgatattggtatacacacgaacgaaaattcgagaaatatgtgttaatgagcagtatggagaaattacttattaatatagtagatttgctcaatttggatagaaacaaggtaatatagttgcatggattgtgctagctaatgtttaaagacaaaaaggttgttggacaatcggactggggtgaagacaaatgtttcacctagaacttgaaaatgccaatgagatgacaaaagttgtttggttatttatatcccttcagatctttctttacacttctatttccaaaagctgcaagtgtactgtgcatacaaaattgacaatggaggaccaatgtttcccgtttgttagtacgtttctgatacaaaactaacaatggagaacaaatcccgtttgttagtacgtttctcattgtttgccaggatgatgtctatatttagtaaccattgacacttttatagtacacactagccaaattttgcattcctttgcgatgattttaatgatttgggcaacacttttcgtatttgagtaccaaatcatgtagcattagacacaattgcgtggctagaaattactaaaggctagggtagggctcgattgatggactgttgatttttttttttgtaaaatttacatgatgatttaaaaaaaataaactttgattgtgaaggtcagcttatggctcaagccttatctgcgttaggcctgcctccacccctgattgtgtttcatctttcatggatttgtggctttgtcaaatggattaggaaactgagcacttgagcagtcaatactattaagcagacaacataccgtggcccatgggccaaactaattagtatgctcctggcagtatagaataaatctagcccagcttagggcggcacagtccaatccaatccaaaaacgagccagtgaactattgttcaatttgatcttgctactagtatagtatttaaataaacctgattaacatttgccagtatctaaaatcacaacggattcgactaaataagaattggtatactccacttaagaggcacgcatgtcttattaacattttctagtcacacagttcataagaccatggacaattttgatactagtactatataagtggtaatatgatcgccctaattctgctcagcattggcgctgtatccgtacggattcttcttggcccaattccactggtccctgcacatgtcctctattccaaaccgagcactgcaatcagcacaagcataaaacaatcagcatctctatcataagcacaaactataactgtcagttgaacagtgagctggaaaaatggacagacagatttgtgtgatcgttctgtagcgaatcagagaataaattacctccatccgagctccttcttggccttgtcagtggaagcgtaaacctcagtgcaatctccaggtcttctggggcaaatcttgataggaattttctgtggtttcacagccagaaacgtcagtttcgaccacattttcagattgggatttcagatgaggcgaatatcaaccatgcacacatggatgcataaataatactacatcagtcacctttccggacgcctcctcgaacgccttcaccacctcgagcaccgttgttccacaccctgttcctagattgtaagccacacaacctgacagaagaaaataaagaaattatacatcatggatgaattaaacttgtcaaacatcaaccagtttatggagtgaagaacatgtgtgtttgtagcatcgattgatgtaccaatgtcaggagtagcgaagagcttctccagtgcggcaatgtggccatcggcaaggtccactacatgtatgtaatccctgatctgaggacgatatatcaaattgtcaaaattttgcttcgctccacgatctcatccatacaaattgatcttgaacagtgtagtgctcaccgcggtgccgtccctggttgggtagtcgacgccgtagacgttgagctcggggcggcggccgacggcgacctgctggatgtacggaagaaggttgttggggatgcccctggggtcctccccgatgtcgccgctccggtgagcgccgatggggttgaagtacctgagcaggatcaccctcatctccgggtcggcggcctgcacctgccggaagtagttctccaggacgagctgccccaacgagagaatcgaattcgatgccgttagaaacaatgcttgcatagcaaaaaagcaatggtgtgatcatcgccatcgcaattcggcatcgtaatcaccgaatcggcgaagcgaatccgaatggcgcgtgacgggtgcatgcttatcacgagcaatggatgcgatcatgtcttataccttggtggtgccgtatgggttgagagcgctcagcttggaatcctcgacgcagggggtcttctccggctggccgtacaccgtcgccgacgacgagaacactatctgcgcgtaggtttgttgatttcagtgatcgaagcatgcatcggaatggaatcaatcaggtgatcgtgtagatgtatagtactgaccttcttgcagccgtacttggtcatggcggagtagaggttcatggtgccggcgacgttgttctcgtagtacatctgcgggtgcgcgacgctctccnnnnnnnnnnnnnnnnnnnnnnnnnnnnnnnnnnnnnnatacctgatcgatcaatggacgacgacgacgacgacgacgcgtttgattacgtgtggaaacgaacgagttgagatcaaaatcaaaaaggatttgagttagatggcttgtttgatcgaagcaaaacgatccaatccggacctcttggcggcgaacaccttctccatgtcgtccttgctcttgagatccccctgaaaacgaacacaaacatgaatctcaatctcaacctcgccggctcggttcaattcaactgtgcaagacgaagaacacgcgtgctgtttgggtgagtcacgtacggcgatgaagtcgaggcgggcggagagggcggcgccggcgatgaggcggacgcggtcgagcgcctccgggacggagttgtggaagttgtcgacgacggtgaccgcgaaccccttctccagcagccgcagcaccgtgtgcgtcccgatgtaccccgctccccccgtcaccagcacgctcgcccccgcacccttcctcccctccccgttccccaccatctcgccgttctccgccgctactcctccgccgctcaccatcgccgcctcgtcttcgtgtgtgcgcctctctctctcggtttagtagttcgcagcggacgcggggggggatttatatgggaaagggaaaccgcaccgtgacggatcacgcgcggtgcgggcggtggcggcgtccgttttttctcgtgtgtggggagccgggtggatggatggatcgcgtgctggtttggaaaataaaacggcggggatcgcggcgagttcccgtgtcagctgccgtgcgcccgtgccctttttgacccgtatcaacgctggaatatcccgcggcgcgcgcgcgagccgtgtcagctgcaatggtaatggccggttgcatcggcgcgtccgcccgatcggcagtgcacgcatcgccgtcggatcccaacggagattaatacggaaggggatgagtgagaatccgggggctaactgacggtgagatatactgtatcttgtgcgtgcgtgcgtgatcacggtattctgcgagtaggcggtagtatgatcgaaggataattgcgtgtccatgtcatttgtatttggataagtttatccaaataagtttatccatggtgtttagagtgcacgtcgcttgatgacgtcattaggatatgtgttccgataaaggggtcaatttaggcctgggccggggagatcgattttttttttcgcgaacaaactaaagaattggacatcattatattataagaaatcagagttttgattacataacgcaaaacggatggtcattgtcggggccagcgagatcgagattccgagacatttatgagaatcctaaaatagctggtttttcttggtttttggtttctagtttattattttttctaagatttataaccacagatttgagtgataatgtaagtttctttggcatcttctgtcggtagtttctcaaacctggtcttaaaaccgtggcttatgatgcaactaaatttgatttagagtttaatttagacagattcttttgtcgctttcaatactgagcttttgccttgaaaccatgtgtacaaaagcctttgccataaaaatattttcattgttttgttctcctgttttcggcttataaataggcaaacctacaggagcgctacagcaaggcaaagagcaaaaggaaggtgggctttactccccactgtgcagatttcagaaagccgtggagtataagaaacaaccacagcgatagtttaatgcctggcatcacattcttgctccttttttttttctctcttcctctatcatggttggctacttgaccattccaagacttagaccctatttagatcggactaaaacttataagtccctatcacatcggatgtttagacactgattataaatattaaacgtagactattaataaaacatatctataatcttagactaattcacgagacgaatctattgagcctaattaatctataattagcctatgtgatgctacagtaaatattctctaattatagattaattaggtttaaaaattgtctcgcaaattagctttcatttatataattagttttgtaagtagtctatatttaatactctaaattagtgtctaaatatagagactaaagttaagtccctggatccgaacaccaccttaatcgcagataagcaaaggtacaaaaactaccaattgcaaggtgacggttttgatgcccaacaataattggatagacacgaaaactgattccctatcaatgcagaagatatgcaaaatcagaacaaacttccttgatgcctttaaatgggatgattctctgtgatgctttttttaatggccgtaaaataccgccagcgagatgacgtgggccgtaataacaacttactatcatgccctttccctgtgtttcttaatgggctggaacgtgcatccagggatgacaaatgggccgtaaagcccttttatctgtctttcttagtgggctggaacgtgcatccagtgagatgttgatgggccgtaaagcccttttatcatctaacttttttttttgccggcgtctccaccgtccgccgtcgccggcgttgccgatcaagcttgccattgctcgccgtcgctgcgcctgctttgcgaccggcacatagtgatgctttcaggaagcatacgttacgtacgtgcgcgcacacagtacatcccggtagaactaaagttttttatccgctgctgaagtgttgattactgaagtcgtagaaatggtttcatttcctgtgctgtgctggcgtgctgctgatgcatcgaaatggtagctccgttcagttgttcgcagatgatgtaccagaaattaggtgttcactttttttcttagtttaacttttataagtttgatcaagtttatatattaaaaaaaatagcagcatctaaaacaccaaaattagttcattgaatctaacattggatatattttgataatatgtttgtgttatgttgaaaatgatagtatgcatttttttataaattttatcaaatctaaagaagtttgacttaaaaaaaagtcaaagcgcttatgatatgaaacggagagagtacaactagaatgcaacaatggtcccagcaatggccactggttacttcttttctgtctcagtccatacccagatctgaatatacaatgtggccatccttttgatccaaccatccaggacaatgtcaaatggaaaacaggagaaaggtaactgatcatggggtctaccagatcaatccaatgattaaaggctgagcgcaaagagaatggtaaaaaggctatgcgagtgtgataattcccagagaaaagcatatgcatctttgcagatctctcccacatgcagaaaggtacgaagtttccttggatggatacatatggtggagtcctgacaagctgtcattttacaatgatcaggtttggagggaggatctaccggtacattatacctgatgaaaatgaaagcaaacaatgccatgccgacagtctgccttgtctctctgcactattcagtctatggatttcatcatagagaaaacagcccatacaaaagaagtcttcaccactactgaaacttattacattatattgtgaccagtaagaaaaaatattgataaaagaaaataaacagaaaataaaagcactagaatgtgaggtatcatattcaaagaacagtaagtatctacttttgactccaacgattcaattatcacatttccatcacatattcagtttggaatgtagctcaattgatcatgtgaagtgtggtcttaactgaatcagaacacgcttcagaggtacatatctatatcaaacttattatggcgaagagtaaagtttaaattatgcacagttctgaaccaattatcgacgaagagcggtatatagtcgccatcacctctcacgctttctcttcataggcagcaaggttttcggtttctctgaccgtacgttcactgatccttcatcttcaatcaggcgtctaccaaggtgtgatgataaattctccacttcaattttcgccacatcctttcttactcctatgtcagtgatgtatctaccagcacagtacatcccagctgtgacagtggccattccaagtggaccagcagcaaaaagcttaagtggagtggacagaagagctgccaatggcactccaatggcggaagatgcttgcccacttgttccaatgccaggttcctcaacaggaagaagcccagttttgcagtagagtgcaaagtcctcgcaattgttctcaaatatgtcataatttccaaagccattttgaagtaagtacatggctctgtgtaccacaacttctgatggatgtgattgggcaatggtgcaggttcccccacgcagctttgcaaggaaaccggctgatggcactccgtactcgaagcagtatagagagccattcggaaggaagcaatccaagcaggttagtacgacaccactatcaggcagctgaaaccccaatctgggaacgttgggcactctgatgaaggctctaataataggctggaggtggaattggatgaatctgatccttctgcttctttctttcgagtaaaatgaaccactttacttcctccaacataaatgcctgtttgccagtagaacatgaccaacagaagagt

SEQ ID NO: 17346 - DNA, 28551 bp, Oryza sativa
atccccaaaggttaaaaaaacactagatgataactgaatgaatcggcatgctgttaacctgtcaatccctttatcgatgcatgaaaaatgcaccttgatggtgaaaatagtgttttaaggagttgaatgcagacaagacagtttttcttgtatattgcagccctttcatccaggctgtcatgtgcaaaaacagcaaaacccacagcatgtcctccctagatgtggccctgatcaaatgtccacacaggaccactacaataaaaggagctctacatccgccaataaaatgcacttgaggggacatactgtccatttaggagaactacagagtgcatagcaacacagagcagaagtgtcctttacgcttcctgaatggagatgaaagacctctactgtaaaagaaaagagatgcattgcaaaatacccatggtaaatacacctgaactgaatggagatgaaagacctctgctgtaaaagaacaaagatgcatagcaaaattactgtggtaaatacacctgaaggtaaggataaaaaatgaacgtagccacgtagataagtttgacatcaactgttaatcaaagtagttatcaacttatcataggatactatggtgacttgagttttcagctactgaatcactaatagtacaatagtgtactaaacaagtcatttgtcaggttcagtacattatagaaccaaccttacagtacttattttattgcgagcaaccttgaattaacaagagggattcctataaaaaaacaagaggctaatttccacacggagataaaaaaagcacagatacaaacagacaagttggtcagcagtaggtgagcagcaacaagtgccatttgttctacatgggaagcaacaaacacagcatgtggcgtcagatccatctggaaggatttccggatagagtttgggcaattcagttgaaccctcaattctacgcataacccacacagagaagtagaaacattgaatcgatctttttcatgcatgtacccattttgccactattttacagccatcattctaccatactaatgttgtcaactctacacctacagaattaattatgaactgaagatagtacaaatgcacgatgatttgcgtgttactgctgagttctactacgaatctgtaaacagttaaaagtctgaacaatcactcaatcagagagttggatgattgacgcacttgtccaaccaaccacgtgatccgtacttcaagcagaggggtttgctcgagaagagaacatcacgcaggaagtatgaggcgaaagaaatcccaaatccgacagaatggaaaactgagacgaagacacgcccttcagttaccgatgaactaagcaagagacaaccccaactcgaaaattcagatcgcaaatgttccccccattgagccggccgaacaaaatttccagtccaactaggcaatttcgatcgcatttgttcctgacccagcaatcgcagtgaaatttccgatccagtagccgcacagaccaaaaaaaagggggaaaaaaatcccccgttgactcgccgagccagaatttcccggtcaagtcaacaaccattgatcagacgtcaatcgcacgagaaaattcgaagcagcgccggaggaggagagccacagagccgccgccggattagttcccaaacctaaacccgcaaccgccgccgccgccaccattggcgagtggcgacaacaattcaagcaaccgggatggcatccgaggaggaagaggatggagggggtgggcgcgcgcgtaccgtggtgggagtaggcgtacaccgccctccatgtgtagatgtgatcccccggcctgatctccgaccgctccaccctgttcgacagcagccccatcgccgccgccgccgccgcctcctcctccaccgcgtgtcggcgccgccactgtacctttctacccgtccatggcagggtgagtggggcggccaatggcgcggggctctccttataacgggaggaggcgcatgtgatgtgcgcgagcgagagcgagagcgagagcgcgagggcgaggcgtgggcggagaggagagggttggggttggggttgggcaggtaaagaatgtcgctgtcacggcgcacaaggcaccgcacccgccgttgcgtcgagacgagtgcgtcgcctcctcggcttcggtcgctgggcttccacttcacacccggttccaccgggctcggcggctcgaggaaattatgcgggtaacggcgaggaaatgttgcgaaaatcacatgcgtgacggcgcgcgcggagtaggtgaggttaaaaaccggcagccgtggatggggggaagcctcggatcgtgtgcgatgacccaaaggccaaattaccctctctctcttttttttcttttttttttattttgcctactctcggctgcattgcacggacaacttgttgagatgaacagcctatggtgaataatttatttactgatgttactacaggtgaaactgcacggtgatgagaaggtgaagaacaatcaggcgaggttctcgtgcagttcagctgtgcaggttggtaggatgccaactccagtcacgccatccgccgtggacgatctgatgacgagctcacaacatccaccttataagtgacgaagtcaaaaattttttgaaggctatagctaagatataacttaactaatggagcattgattttcctttataaaaattacacggtattttaataaaatttaaacaataatttaaaggtaggcctagagctcaagccctagctatccgccctgaccctaccggagtaccgggcacctggcaatctggcatggactcgctgatggagtgatggagatgtcactgatgtttctttaaggtagtgtttggttggtgggataggatgtgatgggatgggacgaacccacttttaaaggtgtttggtttaggggtgagtgggatgggttggttcctggacaggaatattcctctcagatccggaaccaagccatccggaaaaatctcgtggacgagctcgtcccacctgggacgagcgcacggcgtgaggcgcgccgcttcgccacgctcgttcgctcgcaccgtcgcacgccactcgctcgcccctctcactcgcatcttgctcctccacccatcgtgagtgatgacgatggcggcagatccggtggtggggagggtggcggcagtgaatctgaaggcagggagggcggggagggctcgtcatcggtggcgaatccggaggcggggatggcggcggtggcgaatccggaggcggggagggcggtggtagcgaatctggtagcgaggagggctgcggcggtgtggagggctccgatggcggcgacagtgatggcgggcaagggtgagtgctccggccaccacttccgcatcgtcgttgcctctgactcgctcctccttccgcccgcgccgatggtagccgctcctccttccgcccgcgccgccggtcgcccctcctcattccgcctgcgccactagtcgccgctcatccttctgccactctacttcctccgcgagttgcgagctgcgacacattttctcactaacgtggtgcaacgtgactccatatgtcattcatcccatccctatccatcccttctaccaaacaaaaaattgagatcattccatccaataaatcaaacaagtaaatgggattactccatccctaaaactagggatggtatcatcccatcccacgtagtccccaaactaaacatatgctaaaagatttgatcaaaatgaactgacgtttgtttagacggaatgagagtgatgatttcgacactgcactttagctaaccgaataatgatggtgccaatatgactttggaaaagttgaaatgaccaccgatcgaacactaatctcttattatcatggacgttcattgcaaacagtgtcagcatcccatagtctagctgagaaacaggagataattaaattgagcgatcaaatcatcgaaaactttcttttacctaacaatgtcgatataatacgatgggactaaaaaaatgcggcaaaccaaatttcatgcagccaccaatttgcaacactgaacatcattcggtttcagcgcgcgtcaaggactcgagtcgatcgatgtgatattcagttttagcttatctcttgcactgtcatttttctgagattttgcaaaataaatagcacgcacttacactgtaggagcgataggagtgcacagccatgcagttgatccaacaaaacggtaaatgctgcgcgccgggcgtccgacgttagaaggaaaaatcggacgcctcggacgcctgcgcctttaaaacgatttttctcttaaattaattatccaatctacgatccaatcacaccgttatattcgttgcaattaaatctttacaacaagaccacacatgattatatttcgacaaaaaaatattttagcttctctattgattttttttttgaatattgcatattatctgtttcgatgtttcaaccagtagctttacgatgtttcactatgtacggatcaaatgttgcagtggattttgatattatggaacgtgccgttgtgacaaatcacccacatattttgaaaaccccctattaagggaatttggtttattttttgttccacaaaaaatgtttcatctagtgtactcacaatatttcactatgtatagatctaatgatgtagtgaactgaaatattccattgcaacaaaaaaacgcacatattttggaaaccccctgttaagggaattcgtttcattttttgttccaaaaaaaatatttcacctagtgtacttataatgtttcactatgaatggatcaaatgttgcagtgaactgaaacattatttcgctatttgctgaaacattatttttatataaggtgaaataacacccgatttaaacgagtgaaacattttcgatatatttagtgaaacaattccgatatacatggtgaaacatcgtgcaacatttaaaaataatttaataataagctaaaaaaaatttcatcggaatatatccatgtgtggtcttgttttgaagatttaattgcaacgaatttaatggtgcaatcgaatcatgatttggataagtaatttaagagaaaaatcagtttaaactagtttttcacgtaaatcgggcgctgacgtcatgctgacgtcagtgtccgatttttctccgaacattggacatccgagcccggagttacctcccaacaaaacagatatggattaattggagagagtggataacggaagaagaaatacactaccaccagtgcgagtgtgaaaaccgggttaacaaaaacgacccattttccatgaaattgctaatggtcggtttacaaaagacggatcgatttagcaagttgactgaaagtaatcagtcttcacccgttttcgtcaaagagtggttttcacctctgaaacgggaagataaaccttggtggcaactggcaactcgatttacatattaaaaacaagcaattagaagatactgggttacattcgatgactttggagcttactattcagaggtcgagagatagaatttctcagtgaaaacactccagcattgcgttctttcactcgatctgagctgcactgcacaaccgtgataactcgatccggcaaactttgggagcagatatatgggcgtaaccaaggttgtcagaatcgagatactagacagtatcgttttgctcaaagtaatgtcatatcgtaggatcgtatcgtagtatcgggatactaagagattttttttaagtttaattaatatttatgttaattatatatagccattttgtataaaaaaatatagtaatgatatatatcatgtaaatagagatatttatcaagagaaaccacgttggttttgatatatttaactgatttttatataaatttgagcatatttagttacattattttcaaaccatgttatttaaaataatattttgtagtatcgtagggatcgtagaatcgggatactacctaagatttcgtatgatcgtgtagtaatgaatagtaggataagatactaggtgggatcggtattgtttcggcttgataggatcgtagtatcgtaagatactaatacgaatcagggtactgccaaccttgccaaccttgggcgtaactacttgagccggaacggattcccacgtggagatctcctctagatgggcctcaacaaacaggccaaacacacttgcagtttagtttaggcccatcattctaagtccactaaactctcctggctactccaccgccgcacgtgacacgtcatacgccgcatccttcgttcacgccgccgccgcctcgcgctcttgccgacggccaccgcgccgcctcgccggtcgccgctcccacccttccacggcgaccggagccaaagacggtgaccggcgggcgcgacgacctaggggaatgtgtacctcacctaccccacatcgtccccgcacccgcattccctaaacccccaaaccctagcccgctcctccgttgtcggatacgccaacctgctatatgcgagagaagggcatccacaactgtttgatgatctccaccggagccgccgtttaccggagtaaccgtgcttacgcgtcagctggaggggtgacctcggattcggtggagggctgatggctccgacccagctggtcgatcgctgcggcggcggcgcccccgcgagtcgctgctgtgagcctgtgatcgcctgtgatgggggtgtccgtggtggcgcaggcgccatgggggaagtaactcatgagatgggatgtggccgcaggcgcgattgtcgctgtgatggcgcccttggctatgcttggggcgacgatggtggcactgatgcccctgcaagcggcttcggtgcccacgattggtggttcattcgtgatggtggacttgtgaccttgccaccgcctcctccgcaagacgaatttgtgatgatgatgcagcctatgatagtatgatagcacattcatcgatgactgcgatgtcgctgtgatgccgtacccacatgccagagctgcgatggagctgctgcctttgtgcgcaggccttccaccttattgacatggtattgcagccccaacaagctggacctatgatgccattgttggcacagccgcctttggccatggcactcctctactcaagcttcaacatctggactactttggttcgttctaacactccacctcccctgtactttacattggcaacataagacatgagatatttttaatgttgctagtcgtagctattattattgtcaggttgatataagcttcttttgtctaaaataaataaataaataaataaataagcaagaaatgaagtgagctgcatagcacatcagcgattagcctcttatattccttgtaatgttaagatgtaacccagtgattggatgtagtttcaacatggaggtatgcaatgttttgttcgttgttttgattgtagcttttcttaagcatgactgcaattgcttggtgttatctactgatcatcattgatctgtgatctttggctttgttaatgaactttagaatataagtgatcactgatcattgatctgtgatctctaatctatgtttttctggtaagcttcaagataatcttaggaacagttgttgttttagaattgaggttatgccttttccttttatgctttggcttgtacagtttttaaacatttgttcagtgtagcctacccttttcggttgttaagcaaaatggcacataaggttttcttgtagagtttcaattttgggttagggaaatgttttcaactgctcttgtgaagaaatttggaatgtctgtttggaccaaagagacgatgcaatttataatctgttgatggcgatttcacgtagatctgatcggttagcttaggatttgcatgatactgcattttttgccgctcttacttcatgcagttattgaaagtgcagtaatgcaatctcctgtttccttttaatattggagtatcatttatcgataggatgttttcttgttacacttgctatctcgaaccgagcaagagcattagtaattgccattttggcaattgtttggaaatttgtgtgtacacaattatagcgctgctgacagcatgatggttcaaataacttgccattctcagatggccatctattaatttttcaactcaatagccatatgcttatgtgataaaaatgaaccatacatattcgaaagaaatggttgtggttttcccaatactagtcaatgcctgtgtattgcaatggatttgtgaaagattaattgtgcatgtttctgtttttagcccattgggatggttttttgggttgtttttaaaaccttttttttgtggtgggtgggggagggggggggggaggcaaggatgtgccctgcatgtttatttcttcttgcattgcatgcggtggaggaaggggagggcggacgaacgattgcccttttaagtagtttagagagaaatttcagaatttgccaccgaatacgtaggcctttaaggatttgccacccaatccgcactcctttcaaaatttaccactgaggatgcgaatttcttcattccgtgccgcttcgtccacttgtgcagctgagccttctgtccttccgctggctccatcctcgtccatccgccatacacgcgaacccagctcggcgccaacgtcatccatccgctgcctgtgtcagcgtaatctgtccgcttcgagggtgtcgcgtgggcggacgtcacgggcaaggtggagctgacacgctcgtgttccctccttctctaacggctctcacctcccagcatccaccgcaggagaaaccaagctgcgacgcatggggtcccatcctccctcttccctctcgtcgatcccatcccccaaaacactcgagttacgacgcgggagagcacacatccgtggtgcaccgcgggaataggaagcggcagcggcggtgcacggactcccctcacccccattctctggctcctcacatgtgaagtgcggcgtatatgtccctcccaaaccctagaaattcgacgggctggtgcttcttccacacagttggctagcttgggatcggttgtggtcatagatggtggcgatgcacactgggctcgcaaagtacgttggtggcagatggaagatgatggagccaatgcaaaagatagacggcatgacttcacgggcaaacggagtggtatggaacgaagaaattggtaccctaagtggtaaattttgaaaggagtgtggattgcgtggcaaatccttagaagcctgcatattcggtggcaaattctgaaatttctcgtttagatatgcaccatacacattcttaccatgatttgcagagaacctaggccattggcgaagctaggatttaaacttgaggggccaacttaagctcattaccgagtgacaatgaccataaaaaagttgcatcataatacgcacaaaattgaaacattttgacatggtaataaatcatatgaatatatttgttagttttgaccatacaaaaggatgttttcctgcctattatttagtcattggctacatacatattttttgttttgaagattttagtatttcaaattaaagtgaagaggtaaataaaaataaagtattagggcttacaaaaaaatgcatatttagaacacggtatgcggacattggaacaactgagctgtccaagtgtgttgtgttcttcgtgttagcttgttaggtctgcttagcctaggaagcagtcatcaccatctaaaaacgatatactgctatgtctcccaaataacttgtttgcatgcaatcctagctggtagtggtagcattggaagcctgaatacgccaatgcaccaagtacatgacataatcatgtatttgatgattaattagccggtacttaagaaaaaaaattcgccgttgggggaggcctgacctccctccacccctccctggctctgcccttgacctaggctttttctccacattaatgtatatgcactttcatgatgtattatttgatcacctccatcttgatggacacactctaaccccatgtcatgcaacaccacccggcacatgtaactgacaaacaacacatgaatagtaactgccaacaaatcactacatgtttttgcacaattaagcccattcaatccacaccaacacacctctatcaaagaaacatccaccgtatacgaatatggattaaaaaacatataccaccggtaaattgtgactcacctaatgcctccccagttactgaccacaccactgtccccatctcagtctcatcttatctgtgcctttttatgtgggcatctggtagaggtgctctcttcatctgcatccaccatttcattcaccaactaagtaggcctttttgagctaggtggttggttggccttggccttattaatttttcatgtggtactacaatatgccattatgtccctaagttgtgtccttcacattttatttagtatctatgtagttatgtcttttacatttatttacatagttatgtcttttacattttttttacatagttatgtcttttacttttttttacatagttatgtcttttatgtggttatatgatggagaagaagcttccgatttgtctttcttgccgttttgagtttcttttcttgtggtcagagcagaatgcaagaattaaaaattaggtgagaaatggaacagaaattttggatttaaactttgtttcttctcttgttgttatgccctctgatatttggccatggccacacctcaatgttttccaccactgcttctaccatgcacctgcagtttgatctctcattgttctgcatttgatgcgtgcgtttgtagcagttgttgccttgttggtactaagttgttgttgttgttgttgttgtttcttcaatgctcaaaattgcaacttgggagataaagtttggcggagaaagagaagtgtgagaagaaatatcgatcctaataacaatggatgatgcaataccggcaattttttggggcatccaaaatagttttgactaatcaacccatgttaccctgaaaattatgtggcctatatctgcattaagtcacctgtttatacaacatttctggtttcttatcctttttctttcttagtgtaaatgttgtatgctgattgttattgttagctgggcctctgttgcttcgtgtaattattcttgctttattgaggtgttacgtatgatggaaagttatagtgtagtttgtactttggagtaacatgtaatccagtgaattatcagttcttccttcataagacactatttagcattcattttacctgtcattgtttgtgggcaattcctacctatttgtttgtttttatataatggcaattccccagtacaacactaacatttctcactaatggctttcaatctttgttgttctttaaaatgaatggttacctcaattgcctgatttcataacccagacaaagaaatttctcttgtattttttttctttgctttttttagttgtttcacaaaattatattggtgaacccgtcaatttttataaatagatgccatggtaactgctatgtacaaaatataggatcaacctgtcagagatttccctaattctctagtaatctggtgcgtcttactggctggctggctggtggttgatctgctcgctggtggtgttgcagtcttgcaggattcatcagtggtgtgagctgaagtgggggttctgtggttttttgtttctccgttaaggtttctctttccgtttcccctctcgcttgaggggactgttcacatgtttgtttctgttgcactcccatttattgtaacttcttaaatggaaagggaaaaaaatgttaatgacactttacactagtttctgcctaatgcattttctccaagtgggatgtacactagtttagcattgctcgaggagagaggattgacgtgtcctttcatgtaaacatttctattactgtatttttgcaaatttagtgcatctgatatctaggaatgtgtttttcaattcacatggattgctccttttctgtgctgctaaactaagatcatatttgcctataattagtctaggtaaaaatatatcttttgcgatgtaattcatattgcacctcgttggtgcttttgccctcagaaaaatattgacgagactgttcactaatttctgcctaatgtattttctccaagtggaatgtgcatttaaatattttagcactttacacgtttgtttgtagatatgccttctggaacagggaaatggcctcttccatgaatgaatgagccccctctatagccatcacttgaatgatcaggtagcatattgattataagtttgttgatttgaggctagcaacttttttaccaacatagtaattatcttccagttgcagatgtcttatgttgctggtactaaccaaagtgcgattccacttggtgggatggccagatattcagtgggcatggacagtggaatccatggcgctacaagaactgaatcaagaactctctatgtggaaggactaccttcgaactgcacaaagagagaggttgcacgtatccttttctatgcttgtaaactaaaatcacattttcctagctataattagtctaggtatcttttgcgacgtaattcatattacacctcctaggtgcttttgcccttaactctttcttctgcagatatttttcgccccttttctggttttcgtgaggtgagattggtcaacaaggagtctaggcatgtaagttaaatgctacctgtgatccaaattttccctgttattttttgcaaagccaagcatgcttacatgtcaaatcccctctctgttttgcaggctggaagctgtaacctcttgtgttttgttgatttttcatctcctcctgaagctcgtgctgctctggagactctgcaaggtaattataacatcatattttctgcatccatatgcattgtacttatgttgccaatttcgttagatagtgcttgcgcacagtttcattcttttatgtttgtgtgcctttagtctttttaaaaatctgtttatttttctgaatatttttccctttgtcccacatccagtaggttttagtgtgatgactgaactaaaactaagattgttatttcgaaatatcatattttttccttgttccactttgaaaccagcttactgtcattctatgtgtgctatatcatatgtaataatatttgtgtgcacatcaactttagtgctttccatcataaaactagacgtttcattggtagggagagaataaactttgagcttctaatacttgttcaggttataagcttgaatttggctctgaaattatgacgttttactttgcaggctataagtttgatgaacatgaccatgagtcttccaacctgcgcacacaattctctctcactcctcgcaggaggtcaattggtgggccttgtgttagaaactaagtttcttgggtggagttgaattaataatgcagagcaaaatttgtggagaatctctagggagacttgtatacaatgctagaccaaacttgactctagggaaacagcctcttccacgaagcaatgagcccccattatgtccatcgcttgaacaatcaggtattatatcaattataagcttgttaatttaaggatagcaactttcttactaacatagtgctggttgcagatgtcctatgctgctggtgctaaccaaagtgctattccacttggtgggatggccacatattcagcgggcatggacagtggaaaccatggcgctacaaggaccgaataaaaaactctatgtggaaggactaccttcgaactgcacaaagagagaggttgcacatatcctttttatgcctgtaaactaaaatcacattttcctagctataattagtctaggtatcttttgcgatgtaattcatgttacacctcctaggtgcttttgcccttaaccctgtcttcttcagatattcttcgcccctttctggtttctttgaggtgagattggtcaacaaggagtctagatatgtaagttaaatgctacttatgaaccaaaacttccctgttcatattttgtaaagcctagcattgcttatattttgttctcttttgcaggtggaaggtatataatctcttgtgttttgttgattttgcaactccttctgaagctcgtgctgctctggagactctgcaaggtaattacaacatcatttttacctatgaaatttatgattgtctgcatccatatgcattttcttatgctgccaatttctctagttaatgtctctgcacctgcattagatgcttttctttgctgtgctttaacatgcattgaagtatagcagtttagttttcataggcacccatttcacccgtcatacactttcagccaaaaattgccacagttgtgccagccacacttttcatggcaaaaaagtgtggctgccaactaaagtgctatatacaatgattaatgtatgccatcttcatttgtggttagtacattttttttctgtcattttgtttcaccctatatagaccattgttgcatgtctacgactattaaaggatatgcttgctattctgaacaacttagtagcaagctcttctatcttaaaccacatgccaacaggcttatctactttcacgattttttgtgaaaccaggcactattttgtcatttcagtaattcagttaaaatataattatacaatgtcagtgcgcttttggagttgctatggaaaccattgttggaaacaggcaggggcatatgtacagtagtatcactggtctcagatggatgccatccaaccaatccagtgtattgctagcatttgtacgcatttacgcacttacccccggcagtgcaactgtgcaagcttgttgaccccagccgctaaattgcagcagctcagaggctaaacaatatagctccatctttgaaaacttaaacagtttaactggtgtggtaggtgctggagcccgaatctattttccaacatccttcctctttcatattataagatgttttagattttgaatagattcattcatgcatccatcatccttcctctttcacattataagatgttttagattttgaatagattcattcatgcatccacatgcgctacatatatatgctcaacttcatatgtatgttagtgaatttagacaagagataaaaagaccaaaactttttataatgtgaaacggagggagtatatgttttggtaccatcagccaccactaatgtcgcagtttaaaatatttgatctgttgactataattatttcttttagctaatgtttctatccatgtaattaggccaataattctattatcaactattaaaagttaaccatatttttagctattagtaaaaacaacttcaataacttgcttgtctgaccaaaagaataaaggatttgtatgtcttattaggttctaactctcaaagtattgctcaatacagaattaagtctaaaattaagtgattcaaaccttaaactttaattagtctcaaatgaacatgctcattgaaacaacagcaatattctaccgacaactctagctaaaaagatcagctcaaggacaccttagcttagaaatatttagaaatggagcccttccaaacaccgcataagtataagtgagtggtgacaccggtgccccaaaatcctggatacacccctggtaacagggaaaccaccaagttttggttggatcggtgtctgcatggcaaaacgatatttgaattagctccaaacttgtgctagctgatctctaagtgcacctttaaacaatgcactgtggctcaagcgctgaataacagaagatggttggctgccacatggtgcttttattgttcaagtgcttatttcacttgagaaggcatctacatcaggaagttggcctataatgcttatttcatgtggtctatcaagtttgctccttggaagtgaatttggaaaagttgggctagcttcgctgcaagttattcacttggttagctgtttaacaactggtgttggatggttgacaggcttgctaagcgaggtttatcgcacccgaatgcttgtcccttctgcgaccaggatgatgaatctattcggcactttctcatctcatgtgtatttccccgccatgtctggacatgtattctacagaagctgaatatgttggcctccgtgcctcggtctaccgcgtgtctctctagttggtggtaagttaacagaggtgttcctaaagaccaaagaaaggggctcaactccttgatcattctagtaagctaggaaatatagaagcaccggaatgcatgtgtgtttgagggaacaaagccccaatgttcaggtggttctgcattctattgcggaagagagcagcctgtggtgctgggctggcacctccgcacttcgtgagctacttgtttggtcgctcacaatagtcacctagtccgtccttatggtgttatcctcctttgatcttgttcccattggcaataggcaattgtttttagtccttttgatcttggggggggggggggggagaagggggtttatcctcctttataactttctaaaacaatcgtctaatttgcatctcatatttccccaaaggtacatcaaccatttctacgcatcagtaaaatttgtcaattggccgttgaaatggcaaaattactactacatttttctattttgttactaaattatacattcaataccctttaaattctacaacaacctgtaaccccttccaaccgtttgtaagtcagcagggtctagatttgtttttgttttttttggcccccatggtatatttctgttaaaaaaagataaaagtaataacctttttttaaaaaatcttagttctgtcacttgttcccattggcattgactgtatacagcttctaccaatgcatttgtgttttgaggaactgctaattaaagtactggagttttttatgtggtagcacgcccttagtagtattgcaaacttgcgattcttggtgagtagaagcatgatgttgttacataggctcatatcagttgctggtgtgattagacaaatcatgctctttgacatgaatgaacctatcctaatttatcctttgagcttcattaccaggaacagtagttggttgtgctgtatacttttaatcttgcgtggatattcacctagtctcaatgtttcatgaacgtgagaaccacatatggctgccaaaacatgcaagcgtgattccagtttattgaatcgtgcatgctagataaagggcctaattacctttatagatgtgttggcaagcaggagtagaaatcagtgtggttgtgtgagtttaatgatcttttgtattttactattgcaataaattgaaagtttaagttgggaagaaaggccgttctgaacattgttgttagaggtttaaacaaacgagatggtattagaaagggggtcctggttatcctgcaaccttaaccacctttaccacctgttatcattatccattacttggctgtatcttcgtaggctgatgctaggttattcaacctctggctgtttgtagcaacagggtaatagaacatttattgatttatactcactgactaataaatgaaacgccggtttccttctttgtcaagagagaagaattttgtccttcctattagacaagataaacacggcatattacttttctagcaattaactgtgggtagtgatcgtttcttctttctgattgtcgaaatggccattgccatccagctttccaccataaataaactgacatggatattgcggtaaaagaactgccattgatagcaaaattctaaaatctatcctgcaacattaatttctgactagaagaataaggcaaatttatttttttgctcctgctgcattatttgcttcttcaagttccagcatgacaatataaattcattcgactagacaaacttgaaatgtttaatggacgtagtgtaataatagtactaccatttatagcacagttttgtcactacctgcagcaattttgaaaaaaaatcaacactaatgtggttgtaactatcagacatgttgatacgaaatctattcataggatgtgacctcaacttctgcctgatacgctcaaaggtctgtgtgttttgcagtgatcaccagttactactaaggaaaggtgttcggtgatgccactaagatcatggttccagggacgatgcaaaggcaatggaacatgtttcactgaggttctcattcagggcaaaggggaattgctcttcggagctatgtgaatttggtaagtggtacccttcttagagtggtctattccatggtgcaacagcttatgcatcatacagattttggaatggttcttatgttatgatcgttttgatgtactccattcatcctaaacatatttaagcttgtctatctacttttcttttttcagtttggcagaaacactgcttcgtatggttgcaagtgtattctagcgtgaattgtattttctcaaggtctaaactgtaactgaatttaaattgtaatgcttggagtgaatgtcttaagttaaaaacttttgctttttgtttgagttaagtactccctttgtttcatattataagtcgctttttttatagtcaaacatctttaggtttagttaagtttatagaaaaaattagcaatatctattccaccaaattaatttcattatatataacattgtatatttgataatatgtttgtgttgtattgaaaatgttgttatatttttctgtaaacttagacaaacttaaaaaaagagttgattaggaaaaatgtcaaaacgaatgacttatggtatgaaacgcaacgcggggagtatatggctatggtacaaagacattgtaactacagaagtatattgatttgcccctcttttctacttcgagcggatgagatgaagtttactccgctccacgaagagttgatttttacaaaattccggacaaattagcatcatgatgaaaagatgtcgaagccatccaataagccccttgattggttgcgacctttcgttaattgcttggtggaccccttgaaaattcaactttttatgggacagatttcagttactgtcgaattcgtttcaactcggacctgcttcgttaatcatcttatgcatatgcttaaacttgtaagcaaatttgaatttggctcatatgctcaagttttggaataccgtaaacgaggcaccattttacttcttactagtagatttgctcgaggcaccattgtacttcttaccatatgtatctttcatggccttgttagtattttagtgtgaatgaatgccgcagcaaatagccaaggtcctttttaaagaacatatattaacaggttactgatctacggaatcaacggacatattagggatcgggagtgtttgaattagggagcacaaaattacaccgacgccatatgtcaatgatagagggttaaatatatcagtgataggcagttgttgtggcagatttactatcaccgactaccaacattttgtcatcaccaccaccaacaattagagcaaggtcaatagtgcagcccactactagctctaaatcatcttagctaatgtaatagccaattcatacaatagttgcttactatactatttatatctggtctcacctatcatacacatattacatcttggagttcgtactgcagctggctacagttctgtagcccgctgcccttctctctcttcctttatctctttaaaatatgtttatagctggcttatagcttgctattgtacctgctgttatagctgtgtagattagttttggcaaattttgccacaggatattgtgactttgcagttttagccgtaggacaccgcgcgaagtgacttttggaggaatacactctcaaatgtggttatttgctggtggacaccgcacccattaaattagtaatttccggttgaataggagagataaattgtgtgaaatttctaaaatgtcctttggcccacatgtcaggtctttcttctctctatcccctccttccacactgcaatggctagcgcttctccgtcctctatgtcaacgcgaaggagatggctcgtgctgggctaacccacaagcaggaatccgaatagggaggccagctgattggagtcgtacgccggcgagggagggagcgccacgcgctgggtgacgccgtggggtcagggagcggagcagagaagagctgggcgtgggggcggggcggtggcagtcgtgtacggcggcggcggcagtcgtgtacggcggcggcggcggccttcttctgctgtacctggtgccgcatagccacgccagccgttgctccgccatcgcgccagccgccgctcctgcacgagtgcgccaccgcgtcgcgcgctgccctgcgatgcatcgccggccgcccgcatcgcgccgcacagttgccgcgagccgcgccgtccactactccaccttcgcgctagccgccgctcctgcacaagtgcgcctaatgccctgtgccgcgggctgctcgtatcgcccaatgcccttcaccggccgctcgcatcgcccgctgccctatgccgagcagccacgccggtcgttgctccgccatcgcgccgaccgccgctcctgcacgagtgcgtccctgcgtcgcgcgccggccgcctgcatcacgccgcacggtcgccgcaagccgcgccagccgctgctccaccttcgcgctggccgctgctcctagacgagtgtgccatcgcatcacccaccgccctctgtcgcgtcgccagtcgcctgcatcgcgtgccgcgttgcgccgcacggtcatcgcgagccgcgccatcgagggagagagaggaagaagataggaagagaaagaggaataaggggcaatttggtaagtcatgtaaaaaagtggagccatctcgtctactcagcaccgaaatcattaatttaatgggtgcggtgtccaccatcaaataaccacattttgagagtgttttccccaaaaaattacttcgcgcgatgtcctacagctaaaaccacaaagtcacgatgtcatgtggcaaaatttgccattagtttttcaggcttttgcttggccggctcaacatccaacgctccgatgacaactgtggctgaaggcaaggcccagccctatagacgctggcctccaccatgttccaaagaaaggcccggcccaaaaccaactgtggctgaaggcaaggcccagccctataggcgcaggcctccaccatgttccaaagaaaggcccggcccaatacccagcgaatcccatgcaaaaggaaaaaagttatacctgacttccctcgtcttgtcgctgaattacaaaatcatccctgaaccaaaaaacgagatatatagcatctctcaacttagaaaactaggctctctaggtctttaggtgattttgtctttggtttttaccgacgtgatagctgagtcagtattggaccccatatgagccatacatgttagtgactacttcccttcctctctctctccacctctcttcatctcttctccagtcctctccatctgaggtgtgcaacggtcgacgaggagaagggccagcgcggcgagcgcgaccggcgacgggcggggagaactggaggcgcgcggtgcccgacggtggccctcgctgacagcgacgacgcttgttggtgacgacgagcaaggagaagaacggtggccggtggagaggagctaggagtcagcagcgtcactaagcttgaccggtaatggcgaggaaagcgggagcccatccccccaacgacggtgggctcacgaaggatgtctgggcaggggtgccgtcagcgagagcttgatggagccggagaagagggggcgaagatctaggaggggaagtagagaggcccgctgccgccgccaatgtgtagctcctctccatcggtcactactcgtagcggcaaggaggaggaggagtggcctaaggtgttggatatcgggcggcgacgagcaagagggaggagtagtttggcggcgacatcagtgtggttggctggtcgttgcgtggccaccgcctcctcccgagctgctttgcctagcgaccagccccggtgatctcttcctgtgccgcctctcccccgccacctccgcgaccggctgactacccgtgccggtatctacctcgacgaccctttcccatgccgcctctccgccgctccccgttgctacgaccggctgcctcgtcacgccggcatctgtcgctctgcaccggcctgatgtgagaacggggagaatgagaagagtttatgtcattgacatgtaggtcccacgttaagtcagctaccacgtcggccaaaaccggagtcaatgccgccataggagggacctcaggtatacttttccccacgcaaaaactacccagcccatcatcacggcccatgcaggcccgacacgcttgtcgaaggcagcccacactgcacaacttctctctccctccagccgtcacgcgcgccgcgccgcgccgtagcgcgcgtccacaccagcgcggcgcggcgcaacgcggtgcccgcgcgccgcttgctcccccctcctcgcgctccacgcgcgcccgcgctcgccgccagcgcgcgctgccccggagcgcgacgacagctgtgtggggggcagcgacagcgccactggcgtcagcaccagtaaccgaagccgcgctcgctggctacaaaacacgcgccccctcctcccctcaccgcggctgcgcacgcattccccattccccattcccctatctctcgaaccctagcccctagtcccctcccgaaccctagcccccaccgcgccgccgccgccgccctcccgatcgcgatggccgccgagagctactggcagtaccagtacgccgccgtcgacccgcgccagcaggcgccggcgccggtgcctgtgcccacgcccgcgctcatgtggcagcagcagcagcagcaggcggggtatcagcccgccgtggcgccggtcgcgcccccgatggctgctccgccactgcccgccggccccccgccgtcgttcaagcgccagcgcccggagtacttcggttcgtgctcgcccacacattcctcctcttcttgattgttaattttgtgttgcctgctagattagtcgtaagaaagtataggtagctttgttgtgggtatccatggggtttagggctttaggctatagaacatatagatgatgatagtggaagctagtctttttttataagcagatcttgttgtcctgaacttttggggttcagggcgagaaaaaatcagaggccttttatttgaatgtatcatcatcagtaatcttaataaattgcaaatatccctcatgtttgaattacagatccagatattatcagttataagtctgaaactctgaataatagggagcagaatcacctggatttttgtgatcttgtagaaaccgaaatatcatcaagaactcgtggaagccaatctcctcaagggtataatctgttagaggactcctaaaaagggaaaacacacacacacaccaactatagaaaatcagtgcaaagctatgagataaaccaaccaaccactcaactcaaggagatcttgctgactaactagagaaactaattattatgaacaactcacaggaatgaggaattcataaccaatcaactctaatggcaatctttagaaccaaaagaaatcaaagttccatcttttttttgtcaatcttctttggggtgttattcaaccctgaagcaaaggagtgagatctaaaaaacttaaagagtacgacatatgcagtggctgaatgacgggattacatgcagcaaatgacacacttaattaggctttagtcatgctagctaacccagcgtagtttcgggaatagataagggtcgaggggaatgagatagcttcgatgcttcgtgacctgcgcagactgatatgcttgttggacatctgctaatgaggcttgggcttccaaacaatacgtgtgtggtctggggccctgactgccctgactcagggccggccttgtgttttccctgccacgctgtactattaacctgtccaaggaaatggtaggagaagttgcaggcttgtagttttgaattgttccaatggtagatgtttgtttgaaatgaatacataaaaatgaaaccattcctcatttcctgataaagcctcaatgtcgtaagatgggaactagtaattttcatatgtgaatctacaagatcatattgattctttgttttctttaaagttagatggtgtagcatggtttatatgatatgttagattgaattaatctctggttaggctaatatttcactatcattggtaggctctaggcaaaaggtttcggcttctattatagagtagtcggtctgactattttgatggctaaatggtttgtaaattctgaaatctaaaacaagagaaaaaaaaaggaatttgttgtgtaaaaaggttctaataatctctacaaaggaatttgctgcttgcatgccgttacgttgtttgccgccaattctgaatgcatctatcatcacaacaataaagtttagtccttttttagtatcattttattgggaaaatgattgcttgctatgcacagctacctgaaactatgtatcaggattgcctacctgcacatagatttggcggctttttagttgttagataatgttgtaattaccgcacatcattaattcttcacatgtttgcttctattgcaaccccatttttgtcatagcttgcttcttaaatggacagggaaaaaatattgacgagactgttcagtagtttcttcctaatgtattttctccaagtgagatgttcatttgtttcagtcaaaaaaaaaagatgtgcatttgtatattttaacactttacactttgtttgcagacatgccttctggacagggaaacagcctcttccacgaagcaatgagcccccattatgtccatcgcttgaacaatcaggtattatatcaattataagcttgttaatttgaggatagcaactttcttactaacatagtgctggttgcagatgtcctatgctgctggtgctaaccaaagtgctattccacttggtgggatggccacatattcagcaggcatggacagtggaaaccatggcgctacaataactgaatcaagaactctctatgtggaaggactaccttcgaactgcacaaagagagaggttgcacgtatccttttctatgcttgtaaactaaaatcacattttcctagctataattagtgtaggtatcttttgcgatgtaattcatattacacctcctaggtgcttttgcccttaactctttcttctgcagatatctttcgccccttttctggtttccgtgaggtgagattggtcaacaaggagattaggcatgtaagttaaatgctacctgtgaaccaaattttccctgttattttttgcaaagccaagcatgcttacatgtcaaatcccctctctgttttgcaggctggaagctgtaacctcttgtgttttgttgatttttcatctcctcctgaagctcgtgctgctctggagactctgcaaggtaattataacatcatattttctgcatccatatgcattgtagttatgttgccaatttcgttagatagtgcttgcgcgcagtttcattcttttatgtttgtgtgcctttagtcttattaaaaatctgtttatttttcttaatatttttccctttgtcccacatccagtaggttttagtgtgatgactgaactatgtagagtgtagtccatagataactaaactaagattattattatttttttgctgaaaactaagattgttatttcgaaatatcataatttttccttgttccactttgaaaccagcttactgtcattctatgtgtgctatatcatatgtaataatatttgtgtgcacatcaactttagtgctttccatcataaaactagacgtttcattggtagggagagaataaactttgagcttctaatacttgttcaggttataagcttgaatttggctctgaaactatgacgttttgctttgcaggctataagtttgatgaacatgaccatgagtcttccaacctgcgcatacaattctctctcactcctcgcaggaggccaattggtgggcctcgtgttagaaactaagtttcttgggtggagttgaattaataatgcagagcaaaatttgtggagaatctctagggagacttgtatacaatgctagaccaaacttgactctgatgcaccgttagtgttgtatgttgttgctttgcaaagattctgccgtgtaggttggtatggatgtgttgataactattggttggatggaaacaaagtagatggggctgaaaaattgtttaatcatgtgctgtgtgatctgaattacatctattcttctgtggatgattgcaatgagtacatacatggtgcatcggcacatgtatagtagtgagttatgaatgtgttatctggcttagattgtttgcaggttgatttcatggtgcaagactgctcctgtaccatttcttacaaaaaggatttcggtgagtttcattggtttttcatagtagtttttcttgcctgaaatagtcttacagtgattcgtaaggacaagagtatctcaccacctatatccttggtatttgacaaaatcaaattggaatgggtccttcaaataagctgatatcttgttcagaggctctatgtgttcttttgcagatggcaatgttggctgaaaaatgttgtgttgtgcctggaagatgctatgtcactgaatccccagcaacaacaacagggcacacctatagacttgtagcattactagaaacaacaatatgcatgtgttttctggagatggataagctactgtatgtatgggaatttcagcatgtacttagcagttgttcaatactggtttctgggcctcagtttttttttctctgtaggcacagattgagatgcatttttgttgcatctgcaggacatgtaagccaattgcttgtgctccctgatactgaagttgtaacatgtaacttttgacttaccatgtagtagtactgtaagtatggagtcatggatgattgtccttggattactttgaaataaaacctgttggtgacattttttatgcattcatctggtacaagagaattgatgtgtaccgtcaacggtaagcatagcttctcttcatgtgaagaaagctgcattgcataactgtcctgcaggttgtgattgagtgaagaaatgctctgcaaggacattaggggtctgtttggggaaggttctgacagctgcagcttcttccaaaattagaaattattgcaaacaatccagtttttcattcagattctgagaagttgtaactgtagaatccaaaaaataaactagaagctagaaattggaaaactcagtttttttatattatcaaaagctgactaccaattagttgcttgtttgtttctcggaattttaagttcctctaaacaagccctaatcatgcaactgcttgaacgtacaaagcgtgttggttaaagatagatcatatcttgtctattctagcttaattaacttggtaagtacatgtccttattggtatcagtagttcataatccagaacatgtatttctatcaaaaaataaagttgatgctcaaataatgtcagcatgatagttttgctacagtgtcgagcttagtcggcattaatttgattggacattaaacatacacgtactttgtatatgataaattgatgcaaaccttgctggtcctagcactatctcttgtatagcgacatcatccaactagtcctgacacctgcttgtacatcaaggactttgatcatttgctgagttttcaccttaattaagcgtgacactgaaatttccgatcaatttctcatctctgcacactagccattaccctcaaaatttccagaaaagaataggggaaaaatcaacctggctgctactaatattcagcaaattaaagaaattattcagacttttcacccagtcgcaggcacctgacacattctacttgaccagaaatttagaaacctgccaagaaatcaacagaatttccaccgggatcacgtacccaacatctcggttggtcccgtctcttccttttgcttgcaaattcaggaagagaataccgtatgacacgcatgactactgctgcaattgcgtaacatactggccgacagcgacggcacacttggaaggccttgcatgagaccggatcagacttcagagattcagaggagaagaaaccttggccctgtcgcaattccaaccgtgatttgttgatcggtttatccaggaaactgccgatttgtttggacctggatttttcttggtgttttctgttcttggacggcatacgtacagtgtgaaggtctgcatggaccactgctgattgacaaagcaaagatctgaattggtcactgctaaacactcaagaaggtgtggtattcttcactggttcattctggtcatc

SEQ ID NO: 17347 - DNA, 1961 bp, Oryza sativa
aagggactttgagtcacaaggatgagaaaacatgaggtctagtctcatgttaattttcctctaaaattcttacaaaatgggtaattccataagaattttaaaggattttggggaagctattccgtccaaaggatcatgtagggaaatttttctaatggatttgaatcttccaaaatttctctatttttcttttgttccaaaagagcctgagtatttttttgagacagatgtatgatacttttttgtggattacatgtaaaaaatgtcacttccataaccacagagagattttagcgtggcacagtagcattgtggattacgttattatatgggaaatatatatttttttatctacaaattatattttgatcattacttcctccgtttcacaatgtaagtcattatagcatttattgatgttaatgaatcgagatagataggagggagtaataagtattgcacttataatccgttggaagtgaagcaatgagactgctaataatatctggtttcttgatacgtcatcatgttgggtctttcagttcttgagagctcctgcaacttgcaatcacatttcagactttcgatcgaatcgaatagcataaaatgtgatgtgaagtggcacggctaagggaactacttcctccgtttcctccgttttaggttataagactttctaacattgtccacatttatatagatgtttactccctctgtcctaaaaaaaaaagcaaaccctagttttccgtgtccaactttgactgtccgtcttatatgaaatttttttataattcgtatttttattgttgttagatgataaaacatgattaatattttatgcgttacttgtctttttaattttttttataattttttcaaataagacggacggtcaaacgttgggcacggaaaccagggtttgtcttttttttaggacggagggagtatgtgtctagatccattaacatccatatgaatataggcaatgctagaaagtcttactccctccgttttaaaatatttgacaccattgactttttagtacgtgtttgaccattcattttattcaaaaaatttaagtaattatttattcttttcatatcatttgattcattgttaaatatactttcatgtacacatatagttttacataatttgttttaataagatgaacagtcaaacatgtgctaaatagtcaatggtgttaaatattttgaaacggatggaatatatagtatgaaacggaggtagtagtaataagccaagttggtcaaccactgctatataattcagctatagtctcgaacacttgtttaatcataataacaaaaggtcttcatgttgccctgttccttcactactttttctttccttttctttttctaaaaagcaaacagtctcctggcactgtttcagtttaataacatacgtactccgggtaatctaaacagaaagaaaagatagtctagtactactctactaatggtaaattaatggagattaaccacagtgcatggtaaagaatttctggctttttattattaacacatgtatgagatctaaagaaaaaaagtatgatatctatctattgtacccttcttaaaccggaagcaacatataaacatttttgtaatatgtccagttgtctgcacaaaagttaaaagcaaaaggcaacaaaacaaggactcatcttgatttttttttgtttcttttaaacaaaaaagaaggcctgggtattagccaagctaggtggccttggaatggacagcaaaaggcagcgatgatagctgcagcctccctttgtgcagcacacactgcactgcagcattgcagcaatcctcctctccaaaagcaggacacaccatcactagggtagtagaccaccagcacaccgagcctccctcaaaagcaagcactgcatgctttcaacataagcctagcctctagccatccatctagct

SEQ ID NO: 17348 - DNA, 7358 bp, Oryza sativa
attagagagttcatatatagctgaagtaatcaagaaccaagaagagcagagtaaggtgatcgagcagggaagaaaggatggtagcgcaggaggaggtggtggtggtgtgggagggggagaaggagggggagatcgactacgtgttcaaggtggtggtggtgggggactcggcggtggggaagacgcagctgctggggaggttcaccaaggacgagttcttcctcgactccaagtccaccatcggcgtcgagttccagacccgcaccctctccctccaccgcaagcgcgtcaaggcccagatctgggacaccgccggccaagaacggtaaccatccatgcacacaccgatcatcttctttcctcgcaaacgcatcagttcatacgcagttatctagactcatgacttagaaatactggaaagatcatttttacttgtgataatactgatagtatatataatagagcaacgcaatgatagtcgctgcgaaatcgtgatcgttgctgcgtttttgttagcgtttacgtgttcaagctatcccaactgatctggctgttcttgcatttgattagtaatttggtactccatatacttactccatatacttacatagcgtcaatgactcatgttctgttgcttgctgcgagggagatggtgtcacatgcatgtcagccaagacaccagcttcattttgctttcattgtgattaattaagccgggagctaattggatcggtacaaggactcgtggaagattggatttgtattggttgggaagataaggatgcatgtatagtggctgtcagttttcatgaagccagctgaaattaaagctatgaaatgcgatgctactactagtagcttctgctaaagacaacgcgtcagaacagagcacgccgaccaccgaaagtgatccctgcaagaaccactaatgcctcctttttgcaggagaagatttgatagaaactgtcatgtagcaaatcagtcattacctgcctaatctaacctgcccttggattaggcagttgtcgcctaattaagattttgatctgttttcaatgcaacaaagcgggaattctgtgtgcaattcgtgtgttcccgagggagactgatgtgttcgtggcggaaatatttgaatttttggaggaaatttgagcgaagtttggtctttttggtttcgcaggtacagggcggtgacgagcgcgtactaccgcggcgcgctgggcgccatggtggtgtacgacatcacgcggcggcggacgttcgagaacgtggcgcggtgggtggaggagctccgggcgcacgccgatggctccaccgtggtggcgctgatcgggaacaaggccgacatgccggcgggccggcgcgaggtcgccgccgacgaggccgcgcggttcgcggaggagcaggggctcttcttctccgaggcgtccgcgctgtcgggcgacaacgtggaccgcgccttcctcacgctgctcgaggagatcttcgccgtcgtgtcgcgcagggcgctggagctcgacgaggcacggcggatgcgcgacggcggcgccggcggcggcgaggtgctgtcgctgaaggggaccacgctggacgtcggctccatcatggagaccagcgccatgaagaagagctcgcagtgctcctgctcgtgagcgacacacagagactggatgttcgctcgtgtaatgtttttgtttcgacatatcgattattacacattcacatcatttcacctcgcgttcttgtcaattatagagaaggattaggcatgtaaaacattgtaaatttggtgattgacaagaaatggtttagattcttcatctgtgactgtgattatctacgcgtgcgtgatgctatgattcgtcgcttagctaacagagcaagctagctcggtttttctaatgccacataagcgcaacgtggactttttcctatttcatatacaaaccattcaggcgcacctgtgagtgggccgcgtggcctcgtgatgccatatttgggccgtttcttcactgtatgggctagaaagctaggcccaacaccagaattcggcccagagaaagttggagatgaccaggttgtgcaggtcaaagggttcggagttactaatcaactccaaacgctggcgccggagttttcatttctgaccccgttggcctttttaaagatcgaactggtgattgagtgtctccgacgagcatagcaccgagcacgtcgtgggtgactgatcgagacgtaaaaactccattaatttgtgtggagatgacagtgttgtggaggtcaaggaggttcggagttttaatccccgacccaccggagccggagttttcgttgcccaacccgttcttaccggtcagtccagcaactaggagcagctgtctgccatggcacggcagccagcaatgctttgccggtgttttaccgtgaagccatgaacatgagctagtccatggtcgcatttccaatcatcgacttactgaactgaacacgaattttcaaacactaaacggtgcgctttttacgaaaactttatatacgaaagttgctttaaaaattcatattttaaaaaaatagataatacttaattaattatgtgctaatagatcatttcgttttccgtacgaaaggaattaattcccatcctcatgaaacaaacacattatttcaacagaagttcagcgacgttattcgtattcctattcttgaccgaggcaattctgctgcatcaactgaataagggcatgtttagtacctaaacaaaatttttcacgctatcacatcgaatgtttagacacatgcatggagtattaaatgtagaaagaaaatcaattatatagttcgccaggaaattgcgagacgaattttttaagcctaattacgccatgatttgataatgtgatgctacagtaaacatttgctaatgatggattaattaggcttaataaatttgtctcacggttttctggcagaatttgtaatttattttgttattagactgtgtttaatatttcaaatgtgtgtccgtatatccagtgtgacacgccaggaattatcgttcacgaaataaaccggccctaagtgcggctgtacatagcagcagctgcagcgatcgtgttgtcttttgtgtagtgggtactgttgctgcagctcaagcagccatatgagccgaacaaatggacgcgcagaagcttttggactccttttgatccatccactccagttggcctaatggcaactggtacataactacctacctatgtatgatccacaaatcctgaaaacaacatggccacttgctcatcggtagctgttacatttgcctacttggatggataccactaccgctgctgctgcaattagcaacatcttccatgaagatcaattccacgcagtccttgccgcacgctgctccgacagatgaactgggttctgcactggtgcagcaaaaacagaaacgtgatgagcagttgagcaccatgatcctgtctgcagaaaccacacccatgaacagaattgaacctcatctcagactcaaaagatcttcgtgctagctgtatcaaaatttgggaggtacaacgaacaactcttgatccatgtacatgtgatgcgacatacatacatatacagccgaaacaacttacaactagctagaggcaaaagggagctaaaatgttgggatctcatcagggaagtcaaccgtatcagaggcattcaggctcatgtgagaagcaagcagcaagctggagagattgaccgcatctgcagtgtcaactacttaactaacatttattccaggctagctagtgagatgctgatatgctggtctttctgtagatgttgttgcatcaatcatgtgtgcgcagcatagctttggtcggtcagaaaattgcgtcatccttttcgtcagcgctttcaccacttgcatgagcgatcgatgtccaggttcagttatctacaacgcactggtcaacctggaaccacgcaaaatccaaatcagtttattgcagtataaaagaactgaattaacaacgaaaactctaaatcagtttatcagtggaaaagaactgaacaatgccaaaccctgaatcaattgtatattcatccctagtaaagaaatggactgaaagtctgaaactcttggcagtgagaaagaactcaagaagtcaaagtttcagtctgatcagttagtggttagtgaacttagtgcgattactcggttgttcttaattggttctctatatggattagtttgatcatattgcagatttttttttccagacaaaggaaactatgctactgcatgcactattctgtatttaccaatctgatcgaattggagttaatcctcctcacctgcaattgtttctgtcacgcgtttgagctcaagcctctcgcctcacaagctcgcatcactctcatcctcttacacgaagacacgaacatcctgcaattcaagatgcatcaggttgagatttccacgtttacctttagtttttgcattcgcataattttgaaacgatgatgaacagtgcaatgacgcagtttcagtaatgtataaaaaaagcgatgcggtttcagcggtgcttactcccagggcacgtcgccgacgagcatccagtcgccgtcgccgtcctcgtacacgacggcgtgctcccactcgccgtacccgtccatcagtcctgctcgatcaccgtacacaaaacattattaaccgccattactgatcaatgtttggcagattactcttgcatatacagcgaggtgaaactagcagctcaccaatggtggagcagtagaacatgtcgttgagcgcctcgacgagctcgaggtagtcgccgtacgccgcgacgtccaccttcctcaggtacggcgtcccgtccatgctcaccttcacgaagtacgctgcctgaatcctaaaccgaacaacgaaacccatccatcagaggagacgcgacattgatcgatcatcacaaaaccattagccgtgtaagaacactagaaattacatcgaggacgacggcggcggatggccgttcttcctgccgcgcctggccctgcgagcgctggctccgggaggccccagcgtcagctcggtgagctccacgccgtcgtcgccgtagctcgccatgacccaacaccgtgtcgccgccgctgacctcgacgaagaagacgctgatggtggcgagctgtgggctgcacagagcgagctatatatatataccgttggtgcaagcgcggaggcggcagcggagtgggatcctctgcgggcgagcgggggtgtcagcgtgtcaggcggcgagggcgaggcgggagcagaggatccggaggtggtggggggggggggggtgcagcggctgggacaggcggcgcatcggcggttgggccggttgggttggcaccggaggctgccggcgagggggatggcaccgtgtcgccgtgggacccgaccggcggggcgccaggtggacgccctggtctcctgcgtcgtggctgccttgcgcggggaatcaggtgtgaccgtcttataatctgtggccgccactactgttcaatgtgcattctgcaagtcaatagtactcctagacaagtgaatcttgttctggtggacgtagcaaacttgaattgcaaatctaagcgaatagaacaatatgggatacttgcaagtacgactagtataatacatcatctgttcttaaaaaaaaatactaacttctagtgataaatctggacaaatatatctttagaagttgtttttctacgtgacagagagtactccatagttctattttaaattataaggcattttgattttaattaaggttgcagagagatatactagcctccacttcttgagttcgtttgtggtggttatcaacctacatttactcgttttccgtacgcacacttcctaaactactaaacggtatgttttctcaaaaatgttccatagggaagttgctttaagaaatcatataaatccattttttagtttttttagctaatactccctccgtttcgaaatatttgacaccgttgactttttagcacatgtttgaccgttcgtcttattcaaaaacttttgtgaaatatgtaaaattatatgcctacataaaaatatatttaacaatgaattaaatgataggaaaagaattaataattacttaaattttttgaattaaaacaaccggccaaccttatcctaaaaagtcaccggcctcaaatatttcgaaacggagggagtacttaattaataatacgttaatctatcgctccgttttctatgcttggagattagttcccaacccacaccaaagaatgcagtcaatatctacagcaacaaattagttttattgaatctataattgaatatgtgttaatagtatatttgtcttttgttgaatttgttattacttttttctattgatttaaatcagttttagtttgactaaaatgtaaaatgaattataatttaaaacaacggaggaagtaattggtagggtgcatgatttaggggttgttaagatcatcctagaaggacaccattcgtacaactcattatggaatttgtgacagcgttatggaaatattccaagttcgcacgaaagcttacactaaactgaattttatttttttttaaaaaaaaatagccgccgtgccattgccaccccacccaggcagccaggcaggctgttactccgtaccaatggagagcgaacgggcacagtagatccggattctggcgaggggggtaggggacagggttcccgcaagtggccacgtgcttgttccgctcgctcgccgacttcgccgtgatgctccgctgcgccctcctgcccaccaggtgcaacgcacgcagcagcagcagcagcaaacatatgagacgaccaagcccagtactctgccagtggtgtaccgtgtacgtgccgtggcgtcccctcacccacccctgccagtctcgtcacacatcgcacgctccggtgcggtgcgccccgtcgcccgcccggcccgcggcctcgccatcgccggcaaaaagccgcgcaccggggaggcaagcacgagcatcgtgccccgcgcgcgcccacacgcccattctcggttacaaaaacccagtactccagcatttagagtaagtacaataacagctgtaagctaacaataacctagtatcgagaagagaaggaaagagacagaagaaactatagcctcgcgtatcaagaaaggaggaaaaagtcagaaaaaaacgggttacattcagttgatttttatacattgtatatataaaaggtgaaaccaaatattaatggtgtaatatatttttatagataactattatataaatagattattatattacctat

SEQ ID NO: 17349 - DNA, 4787 bp, Oryza sativa
tgggggggggggggaggaggcagccgccctgcgtttcgccagcgtgtgccgccggctgggcgagcagcggcgtgcgtgtggcggccgtggccaattattttttagtattactggagtattgcgttcaggtcggctttcggtttggttgggttccagaggacagttgcgctgctgtgttggcagaggatgtactaatccatctcggattttgatgagtgtgtgacatgggagtatgggactactcgagctctacaagacatccaagagctttttgatgcaaccacgtttgactagccctttgtttttttctgccccctttgggcaaaaaggtttgttggtgcttgaccggcttcacgccctcaaaggcatgagacgtgtcagttcgtgtcctattgcagagtgcatactgcatgctccctccgtccaaaaaatataaactttagttttcgtgtataacatttgaccgtccgtcttatttgaaaaaattatgaaaaaaattaaaaagacaagtcacgcataaaatattaatcatgttttatcatctaacaacaataaaaatacgaattataaaaaatttcatataagacggataatcaaaattgaacacggaaacccagggtttgtccttttttttttttggaacggagggagtactactcaactacttgtacgagcaaagtttttaagaatagatgaagctgcttacttccttttaagaatagagcaagagtgggatcttattggacaaagaacatatctagattatttatagtcctagcaaatatccagattttagttttacatatttttgaacatccagattttagatttttatattttaaaatagaggtagtagtaattaagaaaatagagcttcgcgtgttgtaatcttgcaagagagcaaaatgggaagtaaatgcttaacacagtccaagcaagcaacatttggatatacaccgaaaaaaaatgatgggtctattaatcttttgaacagtttctaatagcgcacagcagcaatccacaaaagcacaagtgacagcccactgtgcttcccgtatggcccatgtgacaccagtcttacaaccacaacacgagtacacgacgataaatagcgtccacggcatatggcatgccgagttgacatgaactcgttcaacttcagctctactagaatcatactactagcgacacaagaggaccatgtaataacacatattctgcctggctgaagaccaaagctaatccaacctcccggagagctactgctatatagcagcaaccgaagaaatgtacatcctggtgttacggtatttatttgttggcttctcgttcgaaattacatgttggcaccactcctggagaatcatgattgttgacgctaacatccacgccctgagtctggttgtcatcagtaagggaagagcatagaccagagaggaaaatgtgagtgatcggtaaaggtaataatagatgagcccattgcattaacatggagaatgtgatgtacctgtgagtttgaaccttgtccatgagtacggacgggtctcatattaagatcaatcattttggaatcgatgttaccctggtcatcgcagttgccatctgaggctggatcatcagacacattatgatggtttgccatttgctcctttgttactgagtgaggggccttcttttgatccgtccggttttcaggatctttctgttgcatagcaacatcatccatatgacctggtttatctcctggaaactaatcaaaatttcaaacttcaagcactagaaaataaggcgtgagattacaatacgaagttggtttctaaacaataacctacttcaacccgttgccttaggagcaggtatcttccatgggttcgtttcccaccaacatgaacagtcatatcacaactaaggcaaagtgatgtaccatctatctcgcaatagaagaaggctgcatggacagcaggacataatcacaacaagctttaacaggcaaaatatgataagaaactattcataaataagaaagaataccgggggcattttcacatatatcacagcgttgaactttattagggtctgcaagcccaactctcacgtgccgcctagcaagcttgttacacatatgcacctgcatcacaacattggaagaaatatcagaaaatgcagcatgaatatttaatgggttattgagaccaaagctgtaatatttgtttttcttcatgctaatgataccacatgaaggatattgcacagctactaaaataacttgtatagactgattgttggtcaaaatctacaaagtttggcctcttcaaaccaaaatacatcttataacaatcaatggagcgagtaattttgttgatcgaagttctcatagagctgaatatggatatgcatctctaacatacagagtacaacaaccaatctggcaaactttcagtaaacaaatccatgcaaaaatgtcagctttattaacagtatctgatttcttatgttgcctgcacataatcagcatacatcgtgttcttcagcagatccattactgacaaaccttattaactcattaaacaggtgctcaactgacataaagacataagtaaggactaagaaccagaaaagatgacctttcatagttggaagagaacttaactgctcaaaacatagtcgtaaaacagaatagacgtacaatgttttaatgggtaaatcaatataatataagaatgtgagagcacaatgggatatttgaccaaaagatctgcccacgaaggatgtttcataatgtttggcctcattagggatggggccacccacatacaacaattccatttccggttggaactttcatctacaacctggttgcacttttgcacgtactgatgatttttaatcatgtcatcagttccaaatattataaaaaaccaaagaaaccagtgtcatagcattggttacggagcgcaaaactagttgagcagctaaagaatgagtaaaggatgctctcatgtatgtttttattagcaattgaaggtagcgactggaatcatgtacagtaacatagtataagacatactactctgtcccataaaaaagcaaaccctagctacgaatctggacacgaatgtgttcaggattggactttttttgggacggagggggtattcattaactctagaaaatctgcaattcagactctgcattctgcaattaaagtgaggcagaagcataatcttggctacaaataacagtaaacatatggactgaaaaatcgtgtaaacacaagtgcaaaatctatacctaactatttctttactattgaagaatttcaacaagggaaattcaatcattacttctacagaacaatgatcgacttaagtattacacatagccaataaggttaacagaaattccaaccaaaatggcaaaatcacgacaagctcatctcgcactgtcccacatatggccatgaatgatgatgcctggaggtgtctaacgaccaccaagctagatatagaactcagggtagtgtgatcttctaagaaatcccgttccgaagtaacccaattgctggattcaagtacttatttgaacttattatgtatgttttatgctgtaaaagtgcctccttcgataacaacatcatagaattatgctttgttttccagttctaaagttggccagctttaatttcaagtggaattctctaggcaataggcctcattttgaagtcagacaagaaataagtggataccccataaggcaatttctcggttactacccaaacaagcactacagttagtcactatcaatgcacgctggcatcctattataccataacttcgtttggtcataagtccacaatactcaacgaatgaaaaaaaaaaggccttaatgaatgaattgctccaggccagtgagcagtacgcagttgattcgcagtcaaaattaaatggctttctgtacccaaaaaagaaacacgcagatccacacgctaattcgagcgtagtaaaccatctcgtgagatcttaattgcacaatcaaacaacccgatcgcccagcgtgaaacaagcgaccgcaattgaagcatcgcataacccgatttacgattcggcaagcggactccgacgcgtgcgcgttgtagagcagaggacgaaggcagggttagagagagggggcaccttctcgtcgcaggaccggcagagcgcggcctcgtcggccacgcagaagagcaccgccggcgcgctctcgcacacgtcgcagatcgtccgcatcccgcccgcgccgagccgcgcccgctgtcatcgccccccctcccccatctccccgcccccccactccctcctcctcctcctccggcggatcggtcctccccgcctggctcttcgccgtcgtagtcgtacacacagcggcggcggcggcggcggcggcggcggcggcggcgacgaggaggagcagagcgggagtcgcggggcgagaggaggaacgaagccgggagagagattgtggcgagcgaggagggaggaactcgagagaaacaaaaaaaaatactagaaaatagaagtaatagtttttgatttcgatgtggtggtggggcgagcaggagctagcttggtggtggccccaccttctcgagggatcgagccccaccgtcgctagacccggtccacgaggaccacacgtccaactcaccgcgcccgcgggtctaatcccgtgagccgggttcatgccgccgtagacccgaggaaagcgaaacatactgtgtagtggctactttcaccagatccgcacggtac

SEQ ID NO: 17350 - DNA, 8947 bp, Oryza sativa
ccgtgggccaccaccaccgtccaataggagtacctgttggacctagatctctgcaaaggaatactagagttcttgggctggttataggccggcccagctatcctttgcagaactcctccagtgatccggtctctaggctgagctgcatgccctgtgcagtccagtaaaccatcttttttttaatgctattgtctctattgtaaaatcaaagtccactaaacacattattctaaatccagtactttattataaatccatcctcacaatcacattccatcaacacctccaatcatataggtctaggcgtattagcccgttgaatagttgcatacttatactccattcacttcatattataataagtcgtttggattttttttccatagtcaacctttttaaaaaattgactaagtttatagaaaaatataggaacacttctaacacaaaacaaacatattattaaagtatattttgcatctaatgaaactaatttggtgttgtagatattgctatttatttttataaatttagccaaacctagaaaagtataactagaaaagaagatcaaagcaatttataatatgactaaacagatttaggaccaaaataatatagcacagacgtcactatatgctactagcttcgtttcaggttataagacattttgactttgatcaaagtcaaactgcttcaagtttaactaagtttatagaaaaacatagtaacattttcaacccaagtcaaatttattatgaaaatatattcaataattgattgaatgaaactaatttggaattataaatattattatatttgtctataaacttagtcaaacttaaattagtttgattttgaccaaagtcaaaacattttttaccctgaaacggagggagcactatgcaagcacataacaagcctttgaatgtcacccttgccgttatagtccctcatgtactaatcgttttttttaacgtaaagagagactttgagcttgtttgggggagtttctagctgctgcagattcttttagaatcagaagctccccaaacagtccagcttttgatctagattctaaaaagctgtagttgtagaatcaaaaaaatgaactagaagctaaaaactaggaaacccaacttttccatattctcagaagctggctaccaaccaattgcttctcataattttaagcttttcaaacagaccctttattaattactaaaatttggattacattccttatttaatagctcaagattttctgctggggcacacaatcttcactccaagcaaattcttgaactaaatgccagctgagtcaatgcatgcaaatgcacactatctttatgtggatcactttcacttcttgtagacgttgcatcgctcacatattattccttctcacggatgagcgtttcattgtcaagctagccacaacctctacgttgtcagatacggagtacattactaatcgtattttcacctgtgaacttctcactccttcccgtattttcagcgtaaacgattctatcgtcacatcgacaaaaacctttcgattgcactttgcacatggctggtccaatgcaactgcattttcattcatgcacaacgcttgcttggccacgttaatgtgcttgtgcagcgtcactgtgcagagagaacgtgcgtcctacctgctacacgaatgaacgatattaattacttagcgtatgtatatatggcgtaaaccatgtatcagccgtacatagtacgtggattattactgtgcgcagcggcgcttaagtcttaagtgccattttgccgtacgtacctggttgttgactgtgcgtacgtgtctctggtttagtttattatgtctcgtccgtcggccgtcgctaagactcttgctgacaactgactgactgcaatcagcggcggagctagaaaattaattcatcggtatcaccgagatcagaatacactaatcttgtttaacttttagtgtcatatataacacacaattcattgggaggattgactcaacgacgacaaagctaatatggaaagtatggacgctgtcaaaatgaaaaaaaaaaaaactttacatagctcctcattcgaaacaaaatctggatgacagatcggctgcaaatccgtcaatgtctatcagttttgctatagaaacctttaaacggcacaacaccttttcaaggattacactttcgtacatcaaatctgagagaagatctttcaacagccgagacacaatacactaaacacacacgatggcgacgagccactgcttgactggtggatcaagggacatcccaatggaaaaaaacacaaacgaaagcaattaaatcaattcatatggtggtgccttggaaaacctgatgcgaatgacacaaacgagtgttccacaatcaggagactcaattgtctcaactagtgaccaaaatcacagataagaatgcgaggctgtcggttttcttgttgttctccctcttgttcggttctttttcggctttgtctctttcacctttggtgagtctgtaaataatttctatcctacctaatataacaccagcaaaatgctagctacggtttcaaaatataaaaatttatagtgtcatcttgattgcctaaacaatataaccatagatttcgccacaggttaccggggtcagctgacctcgatagttctactgtaactccgcccctgcctacaatctcattatcatttttattatttatcatgtcgtgatttgtaattcacaataatccgatccataatgtttgtaatagttgactgtacattatttaaattaaagactggaaactctataataattaattgtggtctttttaaacaaagtccaaaatgaattaattacatatatcttaaaaaaccctcaaaaagaacacaaggaaaataagcgagatttaaccactgtaccaaatgttcagcaatgaacagtgaccatataatccctggaaatccgtgcttaaaccatcaatcatattctctccgtctaaaaaaactcaacctataagtgtatgtgacctctcctacgacaacgaatgtgggcaaaggatagtccatatttagggcccctttgatttgtaggaaaaatgtaggaattttggaggatttcaatcctatggaaaaaaaatcctatgaaggcctttgagacaaaggattgaatcctatccaatcctttaaaattcctatggaatgggtaatcctatgcacattttggaggaaagttagcaagaggtctaacctcttggaacatttcctctgagtctatctctctcatctgattcctgcgttttttctgtggtccaatcaaacagccattcctgtgtttttcctgtgttttgcaatcctctgttttacaatggtattcctgtcagaatcctgtgtttttcctattcctctgttttttcattcctacgatttaaaggggcccttatagtcttaggagagatcacatcccctattaagttggattttttctgtgatggtgggagtatatcgcaccccagactggacgatgaggcactgattgtagacaggtgaaagttaaaagcgagaggctgaatgtttggtaggtaggttggcaccagtacttggccgggtacccatctgcattcttctgccttcactagttcactgccaatataatgcgacatctgcgacacagtactgtacgtgcgacgggctctgaagcagagcaatggcaaaagcaataatgtcactcatggacatggacggcgagcgatctgccggagcaaagcaaagcctagctcgcccccacagggacagcattcatggcgctctcgtctcgtgtgccccccctcaatcgccattgccaaccagaaagatcgtactcttcccgtggtttctactgctgctctccggtggccgccgccgcctccatattagggccatcgccttcctggcgcggccaccggtcaaaacggttatttttggtccggtctctcctttttcttttccttttcttaccaagtcttttttttaaccattccgtgagcttcacatggcagacaggtgggccccgtgggagttagccccaaccaccgtccactctgctgcctttttcgcggtaaaaaaaagcgagtaaaacgaaaggggaaattcacctgccccattgtgaatagtcccgtcgtccccttcctcctcttcctcctccctctctcctttttcttcttcttcttctttcgaggagaggaaggaggcagccgcgcgcgcgcggaggcgggcaacctctcctcgactcctctcccccaccgtttcgtcgtccccgcgtgagaggtaaacgagctcctcatcgatcgatttctctctctctctcgccgcgaattcgcttggtagccatgcacgcgcgcatggagggaaaccttttctcttttgttgttgtcgtcgtcgttggtgcatgtagcttcgccgtcgttagtacgtgacaacctccggcgacggatggatggatcggtggcggcgaggcggccgcgcgccggccggcattttgctatttttttttcatcatgatgacatgagcgcgactgcgtacgtgcttggtggtgcaggaaggggaggaggcggagatggcgggggaggagcggccggagcggatcgtggtgtcggtgcggctgcggccggtgaacgcgcgcgaggcggagcgcggcgacggctccgactgggagtgcgccggcccgaccacgctcacgttccgcggcgccgtccccgagcgcgccatgttccccgcctcctacagctacggttcgtacgccgccgccgccgccgaatgcaattgcaaaccgctctcccgctcaccttctcgccgtggtttccagacagggtgttcagccatgagtgcggcacgaggcaggtgtacgacgaaggcgccaggcaggtcgccatgtcagtgctcagtggaatcaacggtaaccaaaaaaaaaagaacaaatccattacttgtttgcaacgacgagctcttcgtcgtcttcttcgtcgcgatgaactcactcgcgagaatctgctctgacattgctgcagcgagcatattcgcgtacgggcagacgagcagcggcaagacctacaccatggttggcatcacggagtacagcatgtcggacatctacgactacatcgagaaggtgatcaatcgcgttgactgaattactgttgattttgtttgcataattgcgttcggtttttgatttacgagtctctgctctgcagcatcctgagagagagttcatcctgaagttctcggcaatggagatatacaacgaggctgtcagggacctcctgagctctgacgcaacgcctctcaggcttcttgatgatccagaggttacctttttccttgacatggtttgctgattaccttcaacaaaaatcctgcaaaatttatcacattttgctgttctttctgaatgcaaacagaaaggaacagttgtagaaaaactcaccgaggagactctgcgagacaaaggccatcttctggagctccttgctgtgtgtgaaggtgtggaaatgaattttctttctttcttcccagtgaacctggatatagcaataagagtagcagctcatttgtttcttcagtctggtgatcattttgtttttgcttgtgtgacagctcaaagacagattggggaaactgctatgaatgaagcaagctccagatctcatcaaatactcaggatggtttgtgctcatatcaagctaaattgtttgcaacagactttttttgtaaaaaaaaaaccggttcttaacctgctttgttaactgtagacggttgagagttcagctaagcagttcttggggaaaggaaactcgagcactcttattgcttgtgtggtattgatgaaatacctgcatcttgtaagctttgtattattttgcacatgtttttccatagaatctgagtttcttgtggacagaattttgttgatttagcaggaagtgagcgtgcatctcagacggcatcggctggtatgaggctaaaggagggcagccatattaacagaagcctgcttactctaggaaaggtcattcgccaactcaggttcacagaattctcttctgtgtctttcaaatcattctacaagttcatttttctctctctttcttttgaaacaagacatcttcatttcatttaaaatgatttctgaacaacttcttggtggtgtagcaaggggagaaatggccatatcccatacagagattcaaagctcacccggatactgcagtcatcactgggaggcaatgcaagaacagcaatcatctgcacgatgagcccggcacactgccacatcgagcagtcgaggaacactcttctgtttgctaactgcgcgaaagatgtcgtcaccaatgcacaggtcaacgtggttatgtcagacaaggcactggtgaagcatcttcagagagagatcgctaggttggagaacgagctgaagtttcctgcatcagcctcttgcacttctcatgcagagattctcagagaaaaggatgaactaattaagaatgtgtgtactgctcttggatccttctgttttgatcttcacatcgatgataatttacagttcttcactttcaaatgtccccaagaaaagtactgaagttcttttttttggggggtgaattttcagctggaagaacagttgaaggaactgatggagcaaaaggacaccgttcaatctcagcttgataatttccgcaaagttgcgagcgacggggatatcaacaatcacttagcaaggcgatgggtacttctcttatgcactaatgtgttatctaaaaaaaattaacaacgcaacagtgttttagtatccaactaatttaaccttactctgatgttcttcacagagtcggtcttcagactcgattccgcgcattgtgtcagaaggtgcattttcatcttcagatactcaagacattgactatcaagatcaaacaatggatgaactgtcagtacctcactcgtttccaccaagcagccaaatttctgacatcacagaggaacacgaagcacagagagtagctcatcgagctgaatctgagccccctgaggagcactgcaaggaagtgcagtgcatcgagacaaacaagctcaggagcaggagaagccaagaattcttccaaacacctgaaaagaagacacacactgatgatcaaaagcatagcgaaagcatgtcaaattcagcagaaaatgccatcaagctatatgcgtgtgattttgagccgtcatttgatctcgagaagcctgaaactgaagaatctcttgccctgaagaggtgtgtggttagctccagggacagtgcgcttactaggagtagaagctgcagagctagcttcatggtcattccgaacagctggttcgatgactcggcgagcacgacgccgtcgtccgaaaccttcagatattctaccagaaggccagagaaggtgaggaaaagcctgagtcctgatgagatcgcagacaagagcacgggcaacgctgaagaagacaagagcacctgcaatgctgaagaagagactgctgtgaatgacatcggctgcgtcacagaagtgaagcagaagacagaaatgaaccatgcaccccaatcttcagagcaacaccaggtacagtaaaaatgggaaatctctcttgagaattctctctccataaaaaccattgactgcaacatttacatttctcttgtcaagccgatttcactctggtgtactgtctgtctactattgattcatgcagccgaaaattgctaaagaagttgccacggtctccctttcgaaatggcacatcgatttcgagagaaagcagcaggagatcatcgagctgtggcatgactgcaacgtctcgatcgtacaccggacctacttcttcctcctcttcaagggcgatcagacggacagcatctacatggaggtagagcacaggcgactctccttcatcaagaactccctcatcgcagacggcgagctccacgctaccaccgcatcaaggttcagagacgcatctctgaaagtattctgaacaccgtcttgatgagcagcatgacaaacaacattcttggtggtctttgcagcttgaggaatcttcggcatgagagggacatgctgtacaggcagatggtgaggaagctgcacctggccgagaaggagaggctgtacggcaagtgggggatcgacatgagcaccaagcagaggaggctgcagctgtcgcggcggatctggacgcagaccgggatggatcacgtcagggagagcgccgccctcgtcgcgaagctggtcgagcacctggagaaggggcaggccatcagggagatgttcgggctgagcttcagtttcaagccacgcagatctttcagctgggtcggcgtctactcccgagactgaattcttgcccggccatggcgatgaactgatgatgatgtctcagtggtagatggatgcgtagtggaggagacgatgctgcatgtcaggaaggagaggagagagattttgccgccggaattgaactgatggattgccccgttctatctatgcatgtgaattgtgattcagattttttgcttctggcgtgagttcctgagttgtggaaaagaatcggcgtcgagctcctctccggcgaagttgtggcacgccgccgccggaaccgcgtcgctggcggcggcgcggcttctgctcggcggcgaggcagcaacaacgacttgggccggaacgagcttctcactaacgtgtgggccgaaatgataattgggccgggcagccgcatggacctaactgttaattctaagtaataggagggacctagtgaaaataatgcagccacgacgcttcctatttcccagccccatctgatccgccccataataaatcggaccagtccaaatagtagcgatccaaaactgaagggtataaaaagacaaaatctaatat

SEQ ID NO: 17351 - DNA, 1384 bp, Oryza sativa
ttatgaaaaaaattccaaccgtacgttctttgacccgatctgagccgcacatccgagatccaacgtctcacagaacaagccaattcatattgggccaatggcctatcagattcgactgggccgagaggacacggacaagtgggcctttgcttaactcgacgtgggcccaaaaacccttcgtccctctcacttcgcttctcttgtcccctcccccatctctgcgatccaaaggcggcggcggcggcgagctcggtggcatggcgatgcggctggcggcggcggcggcgttcgtgcgacgcctcgtgccggcgcgaaatccggtgatctcggcggaggcggaggcggtgacctgcgggcgcggggacaagaagaccaagcgcgggaagcggttcaagggctcctacggcaacgcgcggccgaagcgggagaagaagatcgagcgcatcaaggaccgcgtcgaggtgccccgctccaccccgtggccgctccccttcaagctcatctgagccaaagcccagcgcgagctcccccccgtcggttcgtgaggctacctagggttttcctttccctttttcgatttggtactcttgtccaactcttgcgcctgcgcccacgcttgcgtgggcacgcatcgtttttttagttcctcatattgggctgtgtcagatatgtattgtcgaatcaagctgccatatcgcaacattgtagaatgcagtccatatggacgaaaatatcatcaccatgtttgtttgtccagtgtccttttgctgggtgtcatctggatggtgataatacgcagtttatgataattggaaatggaatttacggttttggattgattgttttgtgcagttgctgataatgtgatccacggttgttaatacgaacacaaaatggatgggtaacaaacgacttagccaattagccttgttttgtttcgtttggcagttgattagcatatattcagtgaattatattttcttttaagaaaatgatgcctggtactttgatcaatttatgttgtaaactgaaataggtccgagtagtagcgagcagccaggcactcgaatcactagtataagtctttgtttctttgttatcgtcataactggattaatatgtgtggattcatggtgataaaaaaaatgttttggccgaagccaacatttccgtgcattgatgtttattcataactggattgtatcaaacttctgatcttaggttattctgcacatcgcatcttgatattcctaatgcattcctgatagattagacttgaagcttgccctgtgttgagattggtggatttcataatgataaaatatgttgactggtgtttaatataccatcatcttctagtgcatgagcttacgctccgctatat

SEQ ID NO: 17352 - DNA, 630 bp, Oryza sativa
cggtaaatttaattcattttcaatttaccatacatattataacattgtcaccctttgagcgtgcgcttaggggctatttctatttgatattcttttctgagcgttgatttcaggaaaattctattcaacattgtggaagactccatgtccctatggttctacaccaagatcgactaagacgagtacgacaaatgtcgacaaagctccgtcgcagactctacgccttctcgatcgctcgagaacggttgctggatctcgacaaggaatatggaatgaagaaatggtgtacacctagacatatagcacataaaagcttagctaagagcagagaataacaggagctacattattataataaaacaagggcatctgtataaagaaaaaaagtaccatgtcttgaagtcttgattgtgagcacgataatagaacaaatatattagttgtcatacctccaaagcatcgataatgaactgcttcgaatcttcatcaacatgtctccagtcatcatgattgagagggaaacccttagttcttacaagtgtaccaacaacatgtggaaactctttagcagctttccctactggctgatcaaattcgttgaactccatcttgatcagtggctcgtcttct

SEQ ID NO: 17353 - DNA, 798 bp, Oryza sativa
  unsure (1)..(798): unsure at all n locations
cctcattttcgggtcggcggcctgcaccttgccgaagtagtttttcaagaccaagtgcccccaagaaaagattgaatttgaagccgttaagaaccaaatgcttgcatagcaaaaaagcaaggtgggatcatcgccatcgcaattcggcatcgtaatcaccgaatcggcgaagcgaatccgaatggcgcgtgacgggtgcatgcttatcacgagcaatggatgcgatcatgtcttataccttggtggtgccgtatgggttgagagcgctcagcttggaatcctcgacgcagggggtcttctccggctggccgtacaccgtcgccgacgacgagaacactatctgcgcgtaggtttgttgatttcagtgatcgaagcatgcatcggaatggaatcaatcaggtgatcgtgtagatgtatagtactgaccttcttgcagccgtacttggtcatggcggagtagaggttcatggtgccggcgacgttgttctcgtagtacatctgcgggtgcgcgacgctctccccaccgcctcnanngcccgggaaatggatcacggcgtcatacctgatcgatcaatggacgacgacgacgacgacgacgcgtttgattacgtgtggaaacgaacgagttgagatcaaaatcaaaaaggatttgagttagatggcttgtttgatcgaagcaaaacgatccaatccggacctcttggcggcgaacaccttctccatgtcgttcttgctcttgagaaccccctgaaaacgaacacaaacatgaatctcaatctcaaactcgccggctcggtt

SEQ ID NO: 17354 - DNA, 467 bp, Oryza sativa
tcggcaaagggcctgttggtacctggctgctctaacggcaactctttctcgatgttcctcgagtagattgacgtcgtcgtttcgctgctcctcctgattctcgtcggagtacttctgtactcatgtactctgatgtcgtagctcagtggggagcatggcctctgagccgtacacgaggaagaagggctctccttgttggacgttgttggtgtggtacgcacggcccatagtaccgaggggagttcttcgacgcacttcttgtcatgtgacatgagcctgtcgtagacacgggtcttgattccttgtagtactatgccgtttgccctctcgacctgtccattgctctaagggtgagaaaccgaagcgaagcagatcttgactcccagcccaatgcagtaatcctggaagtcggcactgatgaactgggagccgttgtccattatgatgcagtgaggcaatccatattt

SEQ ID NO: 17355 - DNA, 330 bp, Oryza sativa
agataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagcc

SEQ ID NO: 17356 - DNA, 32588 bp, Oryza sativa
  unsure (1)..(32588): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaacacctaaattcccgtgacttgctgagtacgaaagtactcacccttgctctatataaatatatatagttcctctgccttgaagtgaagatgaagtgaagtgaagattagggtttcgtcctggttcccagccgtcgcctgtggtgttgggtgttagttcgttggttccgctgccgctgttgctgttggtgtttcctcgtccgcgtcgtcggttgcattctcgggccgttctaagctgcaacctaagttaaggtaaataagtcctctatttattttaaggattgcaatgattcatatttgtcaccatgggtaccagcactatgtcctgggactggtactgagatcacggtttcgtaggaagcggttcacgtcgtttttcctacgacacgctcctgtcaggtgccgttgtacggcggtgccggattggggtgtgacaagaacactttcggttcaattggatcgataaatttctaagaaagataataatgcccctaaaaccacatgcttcaaactgcatgatgctatagtaaaaatttagaaattatacaactctaaatttaccatcacattatattccatcttagctctagtttcagctcaaaatattttgaccatagaggcatccttgtttttttgaaaaatttctctctccaattgagtcgaaagtgtcatccaacaaattatcaatttttaagtatcttttagccgtgacatgtttttataatgtctactagtaaattgtacattttttaagtgtctgtagcaaattttgccataaaattatgtattgtatcgggacgaaagacatagagagagtagtgtgttagcaagctctgttgctgtctgatttactatgtttttcattttgctttttctgtcacccttagtgattatgtataatttctctggtacttaaaataaaaccagcaacgtttggcttaggtttaaaaatacttgtaaatcaattctaaaaccttaatttagctatgtcttatatgtcaacgagaagctagccaagccaggcaaagcatgtctctctcttttattttttggaatttccatggtagaatttattaagaatccctaatattgaaatatgaatagccgcaagtcccagcgtgtaaaaacagcttagttaggcagcctgaaccagaagaattagtggtgccccgacttaaaacgacgtagaccgccaagaaacgaaccaaccggcaaccgccgccgccgccgccttcgattcgattccgatcgagttggagaaggccgccgctgcccaatggctccgctaccctcgccaccgctgctggccgaatcgctcgcgacgctgcgcacagcctcgccgtcgccgcccatcccctgctctcctcgccgcacccggccgttggtttcagctaggttcgcaagaacggccggccgccggagccggagcacggggggaaggagagaccttaggagctgtgcctatgcggcggaagctgagtacggcagcgcggaggatgaggtcgccgacgacttctactccgttcttggcgtcgtgagtgttctggaacattctgttgaacaattcctttgcaataatttcggtttacagtttattaggttagtagggaagaactgtgcattttagactggaatcattagagatcaatttcttctctgtaaaaaaaaaaatcctacttttggtgagggaggaaagatgcttctttttttcagagtggactcagacaattgttctgaacttctgatgagtgatgagtgatactctgatagtggttttcctttgagacgacggatttgctgctaataatgacccctgatttttgcatctccagatgccagatgcaacccctgaggaaatcaagaaagcatactacagttgcatgaaagcgtgccatcccgacctcagtggggacaaccccgaagtaacaaacttctgcatgttcatcaacgaggtttacacggtaaaacccttcaatgaaaccttgggtccttgtgattgcatatggcaattgtcttggaagatgtgttttgcattgaattcttttttgttcaaaacgctaacatgaggtgttgaagagcaggtgctgagtgatccggtgcagcgtgcagtgtatgatgaaatccatgggtatacagcaaccgcgaccaaccctttcttcgatgacagtgcacccaaggatcaggtgttcgttgatgagtttacctgcataggtactgacattttttggtatgaatagagctataaaagatgctatttggttcttcataaagagatttgatatatttcaccttgttgatgtggatttaggatgcaaatattgtgccaatgtgtgccccaatgtatttagaatcgaggaggattatgggaggtcaagagtatattcccaatcgggtagcacagagctaattcaggaggccattgatagttggtgatgctctgaaacccaacccagcataatactaggactgtttatctgttcataacagattactgaatgtgttattcatgtgtgttatatttccatgtccagcccagtcaactgtattcactggacttctgctgcacagctttctctccttgagaatgaaatgcggagaatagagcgggtgaatgtaagtaatccttctttcagttatttagatgtacggtatatttttgtggtcatataaatctccagttctttggtttgattattaggagtttaggaccttatggttaacttctataacatagatgtaatcacaaaaactcctagttaaaataaacggtgcacaagaaagtttcttatatccctgttcctttctttctgttagcatttttctggaactcaagtgatattttacaggtgatattatcttgttttctcctaatagcctagtagtacactaaagggaatttcaattttgaacaggttgggctgatgagtgctgggatgggagtttcagttgatgtattccgattggtaaatttgtatgtctttattatgtaaatttggcatgtactatctaaatttctctgtttgcatatcctcaagattctttcttccatgtctatgttaaggctaatagagtatagataaagcatacttttgtttaagcatacagattatattatgcataatacttctctatgttgttaattttacttgttcttaagatattttctatttaacaggctagcgtgcgttgggaaaagagacagtcaaaagttttggtatggttccttcccccttcgtcatctttgtgtttctcatagagttagatgtttttaaggatttcgttatcatttacctatttgtatctttgcaaatgggtcattgttttgtaaactaaacattttatgtaaacctttattttgttacaggaaaaaattaggacacggatgacaaacaaaaagtattcagatataagtagttcttggactgatatctggggatccccaactcgataccaaggaaatggtaagctaaaacaaataacacagtttgttagaaataccttgcatggtaaccatgcagaccagcatgtattgtgtaaatataattgttgttaccaaaaatataattattgctcattcttgtatttctgaatccgattgagatttgctgatgatatcagaagaagaaggaacagagagagcgaagagagcagctgctgctgctaggagatggcgagaatactcgagaaaaggcgcagacaggccaccggagtacaaacttccagaggcagcgggcaataaagagtaatagcagaacaaagaaatatttctatcctgcttacgttatctgatagcatttcgtcacctgtacatatagccttattgtttgaagagagctgacatgtagattgctctctcccaattcctcatttttcatttgtaatatatagctgataacaataacctgtagaatacaaacgtcaatagttaaacattcggaatgtaaaagatgaatatgtgcacattctccttcaacaatggtatacatcctgaagatccatcttttcttgtgtgtgtttgtgcagatgaattccggggcaaatttcctttggcagtagtctggtaacccccaggcatcgatgatgaactgcaacatctgccaaaggacaacttgcccagcaatgcagctgcacatctcatggtctcaacctatttctatccgtgtgccacatttagtttcatgtgtagagcgcacagttcactgatcattgtgcagtgatatttatactcgctcctgcatggtgaaaggcagcaannnnnnnnnnnagcacaaggccttttgcagctcctcctgcaaaggcacacggaggctgataggatatactgtaggacaatgcctgctctctagattgtgcccacttacaggaacaaagtctgaaatggagagatcattgtagtgcatatatctccaatctttttaggtcatggggctacttccccgtttattcttagcctagcttcttgctgtccagaccatgtaaagttaagtagcatcaaatatctgctgagaaatctagctcaatctgattttctccactggtttcagactttcagtcacacaggtcatttcatcaccataataatgcagcagtacacaacgcaatttagtagcaagctgatctccagcctccaggaagcctctgcagctaccacccagagctggacatatcaccggtctgtcggacaggctcaaagggcctcgatcgtgtgctacttcagaaaaaaggcaggattttgcagattgattccccttgagaccactggaaaacaaggatcgaatcaaggggaaaaagtgcccgcatgcgagatcaaaagagagaaggaatagggatatccatgagcatgttcgctgccggtttcttggttcctgcgctgaacccgtcccactcccaccgcacgtccgcactgcattgccctatttgcccatgcatgatgcagctcgtcgatcgatcagatccatgcgcctgccaaggttaggcaagcaaaggcgccacgacgcgcgctgtgaaaacccgaactcgataaacgtgtttcgcggggactcgcccgatcggggcactcgatcgagctcacgttttcttttgtgtgtacgtgcagcggcaagataggcggagcagcgcgcggcaagggcgagatcggtgaaaccggtcgtttgctgatgtacacgagttctatctattataatgacactaccattatatatactgttgtgtgaaacgatagaaaagtgaaacccacgtattagtgattgtgattgtaatgataatgttattatggtagaagatcctcgtccttctacaggttactactcgtacgtatcgcgcgcgccccgcgcggggtactcacgtgtttttcaggctcatgcggctgcaatacaaggttgacgcgagcgggagcgttctgcgcgtggcgtacgtaggcgcgcgcgcgagagatcggtggaatcggtcggttgatcgatcgacgggcagcacagcaggctgggcgcggcgtacgtgggggttggcgcaggcggtacgcgtacgtacgtgctgttctcggctttgatcaccctccggcgcgtgtcacggagtgacggacagtaacacacaaacacgggctcgttccaaacgttaaaaatttggttcagtataagacaggacttaggctgcgtttgggagcgcaagttcccaacctgcctcccgacgaaaaaaaacaaagcattcaatcatagtgagattcaattatagtgagattaattaagtattagctaaaaatcttgaaaaataatttaatataactttttaaagcaacttttttgcgaagatatctgatctgaacatgttgaataggccagatttacatgttgagactttatttcccctcctcagaaaattttgtatctatgctactaccttcgtcacagaataattataattctagattgtttagtacatattataaggtttaagaagcgaaatactatgatttttcttactaaatagtgtatagataagagtggaagggtaattaagggtaaaatatggagaaatttaaatgagaagtgattaatgagaccattaatactctgttgcagtaattattttgagacaaattcaaataatagaaatacaattattataggacatccaaagtactataaaagacactagagtggtgatgccaccacaactacttttgtaccttttgtaaactagcataatgccatggcattgcaatggattttttctaaaaaaaaatagttcattctatatatttttgaagtctctaaaataagttattcttatcgtctaatagtacatcatagagcgacgaagaattccataataagagtgtttgattaacatttttttgggggggttgatttgcttgcgtggataggaaaaatgtaaagttttctcctcacttttcacgggcctcatatggtagttagggtggtgatggcatcactagttcaccaccaccaacatctttaaagtagtatagattagtgcgagtctatatactattatagaaaacagtggtggataccaccattatttttgtatttttttataaattagttcatgatattttctaatattatataatagtctcatatttattcatcatatattcaaataagcaaatatgtctatggcatattatatattttattctatacataataaagcatgggtatttagtgtttaaaaaagtatgttcgacaacctctaaatgaaatgccaatttgcacttaggctgtgtttagattcaaaattttttcgtcaaactttcaatttttctgtcacatcaaatgtttggacataagcatggagcattaaatgtggagaaaaaaaaataattgcacagtttgcatgtaaattgcgagacgaatattttgagtctaattacgccataatttgacaatgtggtactacagtaaatatttactaatgatggattaattaggcttaatggattcgtctcgcagtttacaggcggaatctgtaatttgttttgttattagtgtatgtttaatactttaaatgtatgtccatatactttaaaaaattgtggcacaggaacagacgaactaaacacagcgttagccaaatgcatcatgcatgcagcatgcagtgatcgagttcgtccatgttattgaccgggaatcagcacgccggccggcatgaatattgaatgcagaatgcgtgatgcgtcgccgatagtatagtccagacgacgactcgatcgcatgcagaagaagcaaagaaatgcagaccgatctgcagccgaggacgacgacatctctgcgcactatggtaatatgattacaagggaaataaaatgtgatctttgtggcctcaaatctgcattgctgggcaagtctcctttggcagtggcttttgcgtggtttgatcagctcgatcggccactgccaagggagacctgcccagtaatgcatgggccccataaagtcagagacacctcgctggtctttgcctgtatgcatgtatagctagctatatctgcttctccgaggattcgaattctcatcgtatttataggcagcgtgcagagaggccagcatagtcacgcaagcaccgcgaggagatcgaatcggcattattcgtagcacaatatatatgatatatctgaacttctgaagatatttaacggccccgatttttgtgattaaacttttgcgcagctaactgtttcagtttccatttgacgactgctcgttttcgatcttgcgctgggcgatctgcattgtgttggtgtcggctggtgtagttgctcatttcttctctttcttttaatggaaaacagcgcgagagtgccttttcattgaatagagcaggagaaaatacaactcctagggataaaggaaaaaaaaaagagaatcactatagctatatactatacagagtacgcgattaactaacgcaaccgcttaacccctgctaaatctcaaaagctagcctcttctttgattttcgttagaaggaaacacgttgccatctctttgtgatcaaagattagcatatttctctctttccaaatttcccaactaacaggatgagcgatcgaagtccctttttcggggcgttgggcgtatttgcaaggttctccaaccactgttggactgactgggcttcctcccattagttcggctccatctgctgatagcccacccatctagcgacgaggtgccagatcctcttggtgtatctacaagtggcgataaggtgcaacgccgtctcagcctcacagcgtcagtagttgctcatttcaattatcatgttcttgatcacctcttctctcttggatatacctggctaagagcatatgctggctgcaatgctgcagcctgcatgcagaaagcagctggaaggtcggagaaatgtagcagtgctgatttgctgaagcattatgccctcaattggtgttcaagaacaagtaatgcgaactgtttttttccttgtgtaacacgcatattccgtttaacttaaatctgcatccagaagtgcaggtatttctctctttgctaaatgaaaatatcgaagatgttcagagagcatgcgagcttcactttcagacctgatacaatgtccaaaaaatctcaactcctgtttacagaattacagctgaagaatttcaggtcgtgtatccaaacttatgtattgacctcctattaaaaggacttagcaaatttcaccatgaattcaccatcgctgatgaaaaggaacgaatgctagccggtcattgctgaagaggtgccatacctttatgtacggtgtttccttcagagaaaaggccagcaactgcatgctctcgaatagaggaagatccaaatatccaatggaatgtaccctgtagcagtaccatcatctcaattcaaaccatgagaacaatttgagctcgtggctgccgagggccaacgcaaagcttagaatcacaatcactgatctactgaagatcaagaaaggcaggttgcttttagtagtagataggcatgcagatgagcgacagggaggaccattgctggagcacaatattccaaaggaaacctgaaagagagatcaagagatggtgcatcggcaaataaaggttcatggctcggttgttcctctcgaatagtcctcgttctgccaaggagcatatgccatcttagatccatatctcgaggccgatggcgagctatataagcgaggtcaaggcacaaccatgttcttccaagagagcttgcagcaccaaaaaaaaaaaaaaaaggttcttccaagagagcttcaaaattcagaaatgttaaggttcaggatttcagattcagccacagtatgcagtgtgcgaccggcgaattacagggcggtttctcctttggcacgtacggaggcaaggcatgcggtgaaaaatctctagctagccatgcgtgccaaaggagaattgccctgcgattcaccaacacagccatgcagttctcgtcccataatgcaatctcatttcgcaatgcatgttcagaacttcacattagctcgcttttgtcactgaatatgataataatggactgccttgctgcaggtttactcaggatggttctcacagcaggcaatcgctcctgcagttgctctgcatgattagaaataggacaaatagggtttattgatatggttaagagcaagagtcgctggcttcaaatatttcttggagaataattaaaacttgtgacatttcttttctctcttctacatgcatgtcaaaaaaacgatatacagaagaatctactcgcctacagatcgctacagttacatgaaataaattatgcatataagttagctacatgtaaaatctaggggttctcagcgtcaatgtttcatcttggagacttagttgaaatacactttccacaaaaggcaagtcttgatagagcccgtgatcttcgtgtcctcatcttcaatgcagagagctgcagtgaaaatggtcagcatgtgtgagaaaagatcaccgcatacagaggaattatgagaaaacaggattagcatattatcatcaattgatcagcaacaaatgttatatgccatataacatacagcagctgttcttttagtactaaactgagtattgctaaagaatacccttttacaaagtacttttgtttctatttggcatatgtttattagcattacctttcgtctagtagtgcttgaagccttccaacaaagtaaactcgacttaggctccaatctcctgcaaatagatcaataatccaaaatcatacccaagcttcttatataatgtggatgaatcctatttgatagctctattcatgtggaaaatttctaggataaaataagactttgcagctctaaaaatttttcataaactactgaatatgtgcagtgctgtatcaagtgcttgttttagtgcaatattatttttttttaatttgggtatcatctgttcccctccagagtatctgctgaaaaaagtactcctctagtacaagagagtagcatagaactacttacaaattctcttgctctagcttctctgcaatcgacatagctttttgtctagaccaacctccttgttgtgaacaagtttctgccttgttaatgacatgagcaagagataccttgccccttactatgctgttttgtcggccatgctcattattcacaacttctcgtccttgaagaactatgttttcttttctgacaccggcgctgttatttggttcactatgccagtccacttgagaaggtcctacttctataatttcaccttcagtcaatatatgtggatctgattgcacccatcgtgtctgatttgaattagcaccatggaccacgttgtctttttgaagtctcctaattaagttttcacctctggaagaagcggaactatgtctagtgaaagacctccttaatgccacattggaagtgctatcctcaggatacggtgaaatagctggaacatgacctgcccttgcatcatcctttggttcgtaccggatttcaagtgttatagcagaagcaaggacagactcaaatgcatgtagaacttgttcccttgacctctcagctttggatttattcacacgagagctgaacattagttgcacagttggtgctggaggaaaagaactaagtgttagaagcaagatatattggaaaatggaaacagtgtagctattatttcgccaacacaatattcttaaaacaaaacatattacacgttttcaaggaatctggcatgcttagttttttggggggctatgtgtgtcttaataacatcaacaaagttttaaacttgctctcatcaattctagcatgaaaatttagtcaccatgtggagatgcatattattttatttacatgagatattttatggtccttgggaggtatgcggtattgagaaatgagaggtagatatatcttatagtatagaaaacatgtactattacatggcctaggcaccaagattgacgcatattacttgaacaaagcgatttatggtgtttggagggtactagaggtatcaggcacctttacttcaataaatttcaacggttgagatgtttacaggcacacatagcaagccattctatcttattgcttgattacttatgaaacagcatatttatccatcgcattacttaaaacaataataggtcatccttggatgtattctgcaatgaaatttagacatgatataactagtaatatacagagaatgagcaagaaggaatatcttgcctgtgcctaggctgacagaaatcagtcgtgcttctttagccagcatctttctcactgaatctgatcggatatgctctagtacagcctgccaaatcatctcattgtcactttttctgtatctagataaattcactctagtagcacgcgctaataatacatggttgtctggtgtatgttcaccaggtccctttcctctccgggtgcctgccatgttgttgtcagaatcaacccccagattagcatttcttggtaaaccatgaggaccagcatatatgttagtgtgatctatagcagtgctccttcctatgtccccctcagggcaggtaagcaggccctggttaaagcttgcacttgtggatgaactcggcagaacatattgtttatcaggagcaagttgaagcagagcagctgtaagccacgtcatcttatcattagagaccctcaactgtttttcagcttcagagagtgttttcaaggcctggcgtagtttttccatgtcatcttttgatactgtaatccatatattaagatgttagattgtgtggaagaagaatgtttaggtaacatgaatgctactaaaaaaggagagatcagcgatccacgtactactagcccagtcaacaatgtattctttctataaaggaaaggcgtaaataaaatatgtactagtatagccagatctataaaaggataacaatacattggtgagaaaaaaatgctagagcatgacttttacaatacatgactcatggatggatcaacccaactataaatccatctgaagagagtgataaaaagggagtgatattgcttacaggttggacatttgaagaattttcttcgaaccctttcctgcgtgaatgcataggtgccagcaaggatgtcagtaattattgtggcaagctgagacatcagggccaaaggctcaacacctgtttcagtaatatctcttaaagttttcacggtgttcacagtgtcagcagacagtgccaaatcaagcaaatcaaccaatttatcatcagaaaccaagccgacctgtccaaagcaaacaatgtccagttgttattgtcaggtaaatttttaaatgaagtatttttatccaataatataatagcaggttattttattgctactgttagaatttatacaatgtttagtaaacaacatttagaatgcgcacaatgtttagaaagcgaaaattgagtaaaaagactgaacttttccagagtactctttagcccgccttcatggtccaagtgtcaaaattttgcacacgttcaacgctaaacttaagtatgtcaaccaatgctagagtcccaataattaaatcaatagcatgtttcagaattatagaattacaatagcttgaacaaagaatgttttactactatcatttaaattctctctgaaattagaaaccagtagtatactcaataaagaagaaattttgataactattgttggatcacttacaagttcttggacaagcgacattgagattctctgcccaagcaagctcagctgatccaaagtcatctctgcatccctcagtgacccatctgaccgggaagcaataagtttcagggcatctctatcaacatctagtccttcgctagtagaaatccactgtaaagtgttgacaatgtcacactccttcagtttgggaaagaagaacttttggcacctcgacacgattatatgtgggagatcaagattggggctgatgaggataaaaaccacacgccgaggtgcacgttcgatgaccttcgatatgacactccacgtatcaggtggcaatgtgttgcaatcatctactataaacaccctgtgctgagttggtacaggtgaaagcatcacattatcaaggatatccacaatgctgtcaaggtcaatgttaccaacaggcccaatctccactaagctcctactcttgcccagattgtgtgcgatacaagacgcacatgaatcacagggcctcgggtgctcaggagaatggcaattcaacgcctttgcgaacacccgagcgcatgatgtcttgcctgtgccgtgcggcccgtagaacacatacaccaacccaattttcctcttcaggatggcattggagagagcctgcaccaccaagctctgcccaatcatgtccttgaaagtcttgggcgaatacttctgcgtgaggctctggtgccggcctcgatgcgagccccgtgacctctgccccgaccgtgcctctgatgcgaggtcagaatcaagctcactggtctgattcgagaatatcccgagctcccccgagaagctcctggcaatgccaccgatgccattgcgcacgccgtcgacgagcagaggcaacgagtctgagtccgaactggtcgaggtcagcctcgccgtgaccgggaaatgcggatgcgaacgcgagccgtccatgtgaccgcacgagcctgcggaggtggcggcaatggacctccgcgccgccgacgccgacttggggtcggagaggccgcacgagaagctccggccggccatgtcgaggaaggatttgccgcggtggtggatgcgtgaccaattccaggggatgccgcacacattgcgcgagtcctgcgacgcctgcggcctctgcagctccaccccgcactcgtcgtcgtcgtcgtcgtcgcctccgacgacgccgaagaggtacttgttgccgcagacggcctcctgcgagctggagttcaccgagacggcggcggcgccgtccacgccgcgatctagagcgccgccggtggcggacgcgggagcggcgcgccggcccgcgccgcccttgaaccggcgccgcgggccgcgagacggcttgggctgcgggttctccgcgagctggtcgagcagcgtcttgagcgcgccgccggggcgggagctgtcgtcgtggaggtcgtccccgagcccgagcccgaccccctggggctcggcggcgaccctcgacgacgagtccaccgagcggcgggtggacgggtcccgcagcgagcgcgagcgctgcagcgcgagcaggtcccgcatcagcgcggccgacgccgacgcggacgaccccgtcgggctccgcctccgccccgacgacgcgctcccggcgccgagcccgtgcgcgtggtggtgccgcaggtggatgcagttggtcaggtgcgcgtgtccccgcatgtggtgctcgccgctgccgccgccgccgccgccactccccatccccgcggccgctgtcgccgccggcgccggcattgcgggcgatcgatccggactcctcgcctaaatcatcgcgtcgcgtcgcgtcgcgtcgcgtttcgcggcgagcgaggccaaaaggagggtggtgggttggggggcgtggcctcgggtggcgtccccgaagtggccgtgctttcgacgtcgcgtcgcgtccgcgaccgcggcgtggggtggggggagtcgtagggttcgagcctgccgtttggccgttggatgcatctgcagatctgcaccctcacgcccgcgtgtgattactgtgccggttcggtaagtttcggggagctgagaatggccagatgatagtcagtttttaacaatataaaaaaactggattttctagtttctatttttattttattttctaaattttataactatatcttctcataatatgtaccaaaagctaaatttttttggaagaagcttctgatcttgagagaagctgcggtagctagaagattcccaaacaggctcgaatatatttgagagcataagattataagaatatggaaaagctgaagtcctaatttctgatttccaattcattttgtgaattctataactaaagatttttaaaatttgggtgaaaatctagattgtttggcttatgccagctgaatattttaggagaaaatgtagttggcagaaactccccaaaatagacaaaagctcttctagacaatttaaatttctgtttagattctaaaaaattatagatgtaaaatcgtaaaaatgaattgaaagtcagcaactagaaaacacaacttctacagatttttagaaactagctatcagctacttcttgtttcttaaaattttgaactccattgaacaagtctgagaccgtctgtgacacgagattattacccttgtgctaaagttgagtggtctaccgctaacagtggcaaaatggcgctaatagagctgcttgtttatgctttcttttcgaggctatgtattgaggctaaaaaaaggaaaggtgctaaactgctgattgcacgttgtgtcgtgctacattttagtttagataggtaagttgttggtttattaaggtgagctaggatgccattcggtgggagaatctctctacgagactcgacacgctgctgattatcttttggttcagagcttttccttttgttgacttcacgttgcctacttggtctatgctttggcaccgtaccacgaacgtgcatatgaatatgtgatactggccgacagcgtcggtaattacttattactgtacctaacaagttaaccggagtaacgtaccagtaggtaatgttaatgtcaaatcatgagaaattatcgtgccaagtacacgacagagtcatcgacccgtatgagagtagtaccgcggtatagccatggtgggtccgtaatctagcagtagctgcggtactctagctgtgggcctgcatgtgttatctgtttttttttttgttcacagtgatacactagtacatccatccaaaatgtagagtaatatttctaacatattacgttgtctcgaaataaagttatttctccgcctatcttctctcaaccaatcacaactattcttcttcatctactttctcttttcaaccaatcacatattttctccaatcattctcatctacagtattttcttaatacacgtgctaaccatttaagttatcgctatcctatggtttggtgattattgcacgaaaccacgtaattatcgtgatatatatagtaattttaaaaattgaaaatatcatgatagccgcactgttttataaattgtgatggtgacagggattggggaggggtgtacagcccacgcggcagtggcgagcactgggcagcacggcccgggctacgagtagactctacggccccttataatcataggaatgaaaaaaacgaaggaatagcaaaaagattctgacaggaatacaagtgtaaaacagaggattataaaacacagcaaaaacatagaaataaccgtttgattgagccgcagaaaaaacactgaaatttgaggagagataaagactcagaggattcttaacatgaggtaaaacctcatgctaaatttcctccaaaacttacatgggaagaggcattccataggaattttatgggattacataggattcattcttttgattcaaatggctatataggaaaaattcctataggaataaaatcctttaaaattactatgaattttctttgaatcaaacgggcctacgagtgaaattgctaggcccagaaaatactccgttcgatctgatcttcctgcattcttcatcagccagatagcactgtagtttgtgcggatgaattcacgcgaattctgagggtttattttcggtgcacaacaccagcaatccagccaaaaattgaaaacagcatatcacaatacaccgggaaacgtttttgaaagagagggctcctacccccaatgggcgcggaaatcgaggcgaatcattgtgttctctcgtccaactgcagctctcggaacagaacgaaaacgaggagaccgaggagaagatgagtgcatcgtagtacactcgcaccactggaactccttcctgtgctcctggcgcagtagcttcagttcgccgcgagtcaaaatctgaaacctctgatgacaccctcaccagtactgcaaactgacatatgggcccccacagaccctcgggcccatatgtcagcgagcagtacggcagaggatctagattgctgatgaagcgtgtgcctcacccgatcttcaggtaaccagtgtgtatcgttacatggtacaaaagtatgctcaagccctctttgtttagatttataagctaacttataagtcgaatagtctaaacctaaacaaacaagtatctttttcgtttggattttttgaagccataagccactctaacactattaagccaaaagctaggttggataagttttttttggcttatgtgaggtagatgtattacttaaccactaaatttagtacattaaatccactggcttataaatcatataagccaataagctgacttaaaagtctaggccaataagtctaagcctaaacaaagagggcctcaagctgccgggcaatattatcttttttgacgctgacttatttattttctttactctgaatgtactccctccgtttcacaatataagtcattctagcatttcccacattcatattgatattaatgaatctagatatatatatttatctagattcattaacattaatatgaatgtggaaaaagttagaatgacttatattgtgaaacggaggaagtagtatattatcttcagtcttacttcaccttgcaccgtccacacagtaaccctgactgaagcacagatcatacagtacatgatacgtgtagtaccatttttactgtatcagggtccaatatggagtagtcctagactctgatgagaagttgacaaaacatgccctggtgctctggtgagaaattgctacaatactctctctttacatgtgggctgcttcacacacagcacggcagcatgtagccggaatactgcctaaccctatgaggacatagacaaagtagcaatctgtcacaaaattgatcagtgaagctataagccagctaaatactgaggtggagaagagaagagaggagagagagaggagaagtgggctgtaaacttacagctggcttggacataagaaccaagaaactctatgagagagataagtgtgccatgtattaattatgaagagctaactatttgttaggaacctaattgggctgtatatgggccaagctagccaagtcaaagcgaggcccaagcaagcagaagggggcagcatacaaaagcagcagcagcagcattgttggaaggcatcgaacagaatagaacccggcacggcggctcagcaacggcggcgacttggttcgggcttgaaccttatcgatctccttcttcctccctacttctgctagtaacttgtatcccctattcaatcccatttccaccacaaagcttgagttgtagtaatacaattgcagctcaaaaccacctcgaccttcattgcttgtactgtatattggttcattgagatttagatattgggttgctaacaatctggtatcagagccgttcggttcactgggattcttgtcatggaggagtttgggaggcagccatgcaagagggagcaggaattaggttgggaaagttttcatccaagcagcgcccaccatctgttcgatgaaatgtcaagcccattggaggtgtttgaggaagacgttcttcttgtcatgagtgaggagaacatcacatgggatgaagcactccatctgttacaagaggaactgaaggatgcccaatgtagatttgatgagaagctagatcgttttttggaggtgttcggcttgatgggagacaagagcaatcaatctgagggagacaaaaggagcaatgaatttaaggaattcagtgcctccatcaaggagctcacccccaccaccgaggctgctgcatttcaatcaccccaagcatcaccttcttcagcgcccaccaagtgttcgatgatttgctttggcctcgacaccatgtccgacctcaacatggcagcagcggttgtgtgcgccaccacttctctagcctccgtggagttagtggctagagggaacgcaacctgtgaaccctacgtcaacacccctggtcatcccaaggagacgcacaccaagtgttcgatggttggctttgaggtcaagggtggcaccgaccacaccaaggtcacatgccataccatgatgggtgtgcctgatggcgttctagtacctgaagcatcattccatgaagcgtccaagtatccaatcctgtagcccatcacagttggatacgctgtgacagattggcgtgctcacccccgccgatcggaagatttatttataagagcaggtacaataacaagctataagccaactataaatatattttaaagagataaaggaagagagagaagaacagcgagctagagatctgtagccaactgcagcacggactccaaaagcaatgcgtgtatgacaggtgggaccaggtattaatagtatagtaagtaactattgtacaaatttgctattacattggctatagataatttagagttagtagtgtgctatactattaaacttgctctaaacaggccagatccgacaacggcaatctatcagcagcgattccagaggagaaatcatgaacaacgatggtccctgttatggcgtctgcttgcttcatcatttcgtttaggctaataaatcaaaattttaaatttaatttaaaagtttagatcgcacaccgtactgtttgtttgcaccattactgtagcaccgaatctggacaattgatcggaaaagccaaaattatatgcagtcgttaacttgaagttcctaatataactgctgattcgtactcgtagtactttgttcatcctgagtgtctctctctctgtcgttttggctgatatgtctgtctgcactcagccgcttgtcccactcccaagtcccaaccgcataacattgtgcttcaaccttcagatgtgttctctgcatactagaacaatgtaagatgctcattcgtgctgctggactcgttagttcccatcacaagtcacaaccccagcatgttgcagcagtgcaacatcctgtatatgggtttatatatgtaatgaggtcgtacaagtaacaagtgtacaactctagcgcaagcaagttcagagacaatgctgcacagaaaaagcctaattatagagtaactgcagaactacgaaagtaacttaaacttcatttatgttctgagaaatacagtcctgagtcagcgatcaatgaacgatttacatcatttacaggatctgtttttctattcacataacataaatcttcactcaaccatcacggttcacggatcaaatttgttggctcactcaaaacgtacttgggcagttcatacttggcacctgcagcagagttttaaaggttgttattagtcttgcgtgatatagtggagcaaaacagtataggtggtgaagaaacagcgagaattcccaacgaagatctgctcacctctctcgtcataacaaagcgtcatgtcagaatttgaaacaacaatcccagcactgttcactatggtttgtgcaagaggtaattcagcttcagcagcagccctaagtgcatcccaaatctctgtaaagatacaacgagctaccagttatttaactaaggcgatatttgtcagagcacactgttaaaattaagcaattgtgttcaaattttaagccatgctacagttgtaaaataaactccaatgccaatatgaatgatttctacaaactttcttaaattcgaacataacagggcttgttgtattgccaaaccaaataaagattattcagaagagggcatagataaagatggaccttagcaacttagctgcgaaatatgatttaacagtatacaaacattcaattgattttgtttgacatacataatagataaatgtcatagatggaactatggaagagcgttttcccaatcagccttgaaaaatcagctaaatacctttctggcctccatagtgtggagccgtgtcccagaattcttcacgcatctttgagagttgtgttggtgttattgcctgagtgtgcttccaaggttttggctttttgagcttcttactgttctctgcattaaagaagaaggttcaacattacttattcattctaactcatgtcaaagaaatctaataaaaccttgctaggatataaatgcatatcaagcaggattctagttccaggaactgttctgcaataaggccttgttacaacacgacttatttataaacctacattcatctactgtgaatagatgtatcataattttctgaacaaaaaaagcagattcatctttggctcttcactaacttggcctgtatttaaagtagcaataccaggcaatccaactttcgaaagaagtataaccagtgctaaaaaaaattgaagtttcattagcgagcagacaaatatcccaagtgtgaggctgaaatttcacagatgagtgtgtctttctgtaatgttccacctaataaagtatctataactagataaggtgttagaaattgatcttttcgataagcaagacaagatttagcaattggtgaaggcaaagtgcttaatctgaacaaacttttgattattctacttcgagaataatctgtcactttatttctctcatcatagacaaatgctacttttgcaacatacaaacaaaatagcttttctcctttaagaaaatgatataaccaccaatgctcttggcattcagaatactggtagcgttatctctccactaaccaaatgtgacctccatgacgtaggaatttgcactactcactctacttgtatcagataccatccccacatttcgatacattaattccatgagagcactgtcaatcctgcaacataccattactagcagcagatttgatacactacatcacagtaatgagtaatctacaggtgatactaagtttcatccaagtcaacagttctactgcagctggatacttgcaagacgcttaaatcgacagctcaaagtactatcggattatcagttccggtcacaattcgatcaataaacgagaagactaatcaacaatagaacgaacaacctactcctagctaacaacagctctggaaacaattgatctcggatctcagaatctgagcagaaaacaagaacaaagacagacaaacgaatcgaagcatcaaggaagagagagtaagagtaccatcaactttgggagtggatccagcgcagcccatggcgacgacggccgatcgatcagacgctcatgtgggggggacgcccttccagaagcttccggaagcggagccggatctcgcggcgggagaggcggggtgtagtagtgggagacgaggaagaggacggtggatttaataagggttaataaagtggacgagtaggagtaggagacggcaaagcatcagcagcagcagcaaattcagcggcatacgagcggcaaagccagtggaaaaagagaaaaaaaaaaaagaaggcaactgctgctcaggtgacgtcacctacgcaggtgaggtgtcccgccacgtcacctgccgccgcgggcccacgtatcctcccccgcctagacctgttccacgtcgcgacggggcacagatgtcgctgccgagtgggccccacgccggtccacgcacggggatcgcgcctccctccgcttcccgctcttcgtggtcccggttcagtggaccaacggaggctgacatgtgggccctacatcccagccggtccacgtcggttcacagcaccggctcccccttcccgtcccttcccgtcgtggtgccctgcacgcatcctttccgccatttttccgccgcatctggagctctaaaacccaaaccctagccactgcgccccgccgtcgccttcgccgccggcccgccgccgccgcttcagccatgaacgcctttcggttcctcggggacatgacccacctcttctcggtcctcgtcctcctgctcaagatctacgccacgaaatcctgctcaggtgagcccgagccgtacagtgggggtagggtttcggccgcttggttgggggtgggggggattctccgctcacggatctgtgtgttggcgcaggggtgtcgaggaagacgcaggagctgtacatgctggtgttcgtggcgaggtacatggacctgttcacggactacatctcgctctacaactcggtgatgaaggtggttttcatcaccagctcggcggcgatcgtgtggtgcatgcggcgccacccacaggtgcggcgcacgtacgacaaggatcaggacaccttccgccatgtggtgctcgtcgccgctgccttcgtgctcgcattgctcttcaacgagcggttcaccttccgcgaggtgatgtggtctgaccttactttgcttgttcaccgcactgttgaattgatgctgcaatgggacgcccgataaagtggttaattctgctgaacctatgtgcattaagaaatatgatatatctgcttaatatgttttcccatgctacatttcgttgctaggaaccgtaattaaaattcgtgtacaaggctgctagtgctgtgcaatgtaaccttaacaaatttatctcagtatgagccaccctagcaatctgagttcacagtttgcactgacttgaacaagactataggcacaatcatcgttttgttcagtgcagtgaagaattgtggataccctattaataaaatcctacttaagtaaggcaatgcagactgccgacagatgtttgttgatctatatgctatttgctgatgttgtattgttgttagacttcaatagtggtcaaatgccagacaatttctcagacctcattctagttgttttcaaagaacactgctacagtaggagactcatctgaaggtagcatatccatagaatgtaacaaaaggttaggtgaataacacctatacctattgaattaatttagaattttagaaacctatgtattatttgctcagtatacatcatcctgcactaatcaggatttcttccctttgggtaaatagaatctaatcccatttttctgtagtttcaattgtatggtacagattatattcttcgaagtggccactttttttttctagagcacacatacttcttcctcttgtttctactggaaccaattagtcagaatgatgcatagtaaagtagcacattagtaaaacacggtcatgttgcatttacatttgttagtatgatacacaaattaacataatttcaccgttcagatctgctgggcattttcgatttacttggaggcagtggcaattctccctcagttagttttgctgcagagaagtagaaatgtggacaacttgactggacaatatgtattcttcctagggtatgagttttaccacacaagctttttaccataacatatttatacatgattcctgtattacaagagaatgaaacatgtttgcttttcatgcttcaacggcttctgttgcagtctccaagtttatgatggaaacatgaaatatatgcatgcattaactatttagtttttgtttggtccttaggcttgagaatattgaatatgcatgtatttttttttctttatggacatatgacatgtcacatgttccttctgtccatttatattgctggtcataaattttggcacatgaaatgcatcccatctattctttttttgacgtaagaaggtagagctggctctaccttatagccatttccttaatagaaatgaggtagtacaaagttttagtgaaggaaggaaacgaagaagaaacggaggggactttacattagttttggtatttacagatttaaggttctatctgcagtagctgcatcccatctattcttagttctctttcgtcgatcttccatttttcctggttagttctaggcttgattaattaagcctacatttttttaatatacattgtgtccagattcggattagggcatgctttaaatagtgaacgatcgacatgcttctaggttcccagttggtctctttcaagtctcacaatacttgttttgcagggcctaccgtgcattttacatcctaaactggatttaccgttacttcactgagggtcaccacagcagatggatccgtaagcgcctgcccctcgtatgcttgtgtttcatatcccatgttctatatatgaaaagaagttctgacgatctgtttcttccagcttggattgctggtttggtccaaacagctctttatgcggatttcttctactactatttcttaaggtaaactggatactgttgtcaaacctcatttgcagactctctgggtactgacaattccatgtcggttgttgcagttggaagaacaatgtgaagcttgagttgcctgcttgatagttcttcgccacgccagaaaatgtgcacatcacatgagaattatcgagattagttgatgctggcagagacttggtaatgaagtgggcagttgcaatttgtactgttgactatgaaaattgatgatgttcatgtgatggtttcccttggcaaaggctattacgtttcagaagctaacagttgctactgcacagaagtagactagttcctttttggacctcatactgagatggaaaatcacacccaattcatttggcttgttgtttgcagctctattacacttggtgtaaacaaacagtgtgatttccggtgtcttgtaaaaaccaatgcactccaaactactccgaaataccagaaatattgattgtgcttcctggatcctctcaacgctacttcagcatttgcctgtggaacagatcaactgttcaattttagcttttcaatcgtgggagttgtcatgtgatgattaaactactgaattataatctgattgtcggatgatcgtgggtcagtcttctatcaagatttatttcgtctatcttacgacttaacgtcgttcacgtttagcattagtatatacttctacttcgtgctgatcttggagtaaccgcctttgcagcattttagcctgtgtcatcagttttctgaacatgtgtgtcatcagtatcattttactctctttgagatcgccgttattacaaaaataacgccaccttgtaaatgacagaaataggcgaagtgattaatttttatatcatactactaccttgtaaatgacagaaataagggaagagattagtatatggcttttgcgatattagtatatgacttttgcagccctgttgaagtccatgtcatttgcaaattgcaattggtccacgaactcccaagtcccaacatattgccgcaaaacataactaacaaaacgtctctgtcttatcgttcaaacaatttcctcacaagcctataaaacccaaagattgcaatcgtgaatggtcaaatttgtttgttatactttgttttgacacaaccgagttctccccatcctgcaagcaatcgctcgccggctttatctccgtctccaatctccttctacgaccagacgcgaacggcgaaccgcaaccacctctgctgctacgctagccaccaccaccaaccacgatgtgcacgctggagcagcgcggccgcgtgttcgtgctcacgctcaccggcgacggcgagcaccgcctcggccactccctcatcggctccatccgcgccgccgtctcatccgtcgcggcggcggcggcggcggccgggccgggcgcggcgctggtcaccgtggcggaggggcggttcttctccaacggactcgacatcggccctggcgggatccccccctcgcgggtcggggagctcgtcgtggcgctccgccccctcgccgccgatctcctcgcgctccccatgcccaccgtcgccgccgtcacgggccacgcctccgcgggcgggttcctcctcacgctctgccacgactaccgcctcatgcgcgccgaccgcggcgtgctctacatgagcgagatcgacatcggcctcccgctcccgccctacttcgtggccatcctccgcgccaagatcaccgccgcgcacgccctccgcgacgtcaccctccgcggcaggaagctcaaggccgcggaggccaaggagatgggaatcgtcgacgtggtttgccccaccgccgctgaaacggcggccgaggccgtcaagctcgccgagcagttggcggcgcggaagtggaacgggaacgtgtactcgtccattagaatatccatgttccctgaggcttgcaggtccgtcggaattgtcgaggagagcgatgaggagaagaggaatcactttgcttctaagctatgaggatgtgaaaggtatgagtctccaactttccatcccaactccccaattcagctgtattcctgaattgtttgctgaattactgtttatcattgggttaatgtcatggataacactagattgctgaattactgtttatcattgggttaatgtcatggacaacactagatgggaaaaaacggttcagtatgattcctgttggttttgctatgtacaaaacattcacatcaatatataggtttcgctacgtagaaattatggactttagatgtagtaatgcttaagatattgactttcattagatatggtatgcattcaagattaactttttctcaattattaaatatgatttgatttaagcacatttatatgcacacaaaatggatccaacatgtaaaaataaggcactgctagaaggttcattctaggttgagttgggtaatggtttttggtaaatcacagtaaggaggcatctgactgtttcttccctgtctgtctatcgtggtgttaagctcatttttaactgctttgtacatagaatgcgtgtccattagatagtctagaagttttgatatatgctatctcatgagccaattcattggcacagtatcaatttggtactgtggtttgtgacataggaaatcgcaccaaactgttatttctactggaattataatttgattccatattcttatgttattgacttatttcttgcatgggaatacagtgcacaaagatttgtcaagttgtttgtaatttagcacgtctgtttcatattcgtgattatttactgttccatcatttcacatgttgagttgacaatacactttctacctttgtaaactaacttttataatttataacttcctctggtttattgaaaaatggatattatacttagacttcctgatatgaaatctcttccccttagtttttctgatctctgtacaatatgacggtattgcgtggccagaccttaagaaaaggctcctgtattttatagtgggaatttgattaagaatttatcattgtttgtatctcaaaatatatgaacttaaatactactagtattttctctgttcccttttgttctataaagcatgttaccttttccaaacatgttaatttagtgttagtttctcacatatataccttttaccctagtctctctgttaaagtttaaaaggggtgcacttatttcaggattcaaaccttttaagtttagactaacaagtaagctaattatatatatatatatatatatatatatatatatatatatatatatatatatatatatataggtttagcgatacaaaagtgattccaagatttgtttcttaatatacttctatatggtcatgtttatctaattagaaacaatatatagcttcattttgttccatatgaagttacattgtgtcatgtcctgttgtaatgttgagcaagcacctaataaacccacaagtctggcggtttatagttcttgcatcaaccactattcaagcttctgaactcaagatcatttttctcctcctcctttttcagggattctgtggaagtggaccattgagctcttctcaacattatgtgtacattggctagccaagtagccatggatgctttgtatgaaggaccaaataatccagtatatataatttctggaaagcttgtaaactgttgctctatctgcaagtggggaatatattccagttcctttgcaccaccttgagtccttgattaaagaattaatgaaaattctcactgcggaattaccatatgttctccctggaacgttggaacttttggacaatgttccacgtcattgtcaagaatcaagatgacagttgacggcactgtgccaactgccaagccggtgtatcagacttaggccctgtttgggggagtttctagctgcggtagcttttcgcagaatcagaaacttcccccaaatagttcagcttttaatttaaattctgagaagttgtaattgtagaatgcaaaaaatgagctagaagccagaagctgggttagtattagtgcaggtgccgtgcatgacaatggtgtctttagcggcttctgccattgccgttgtggattaccgacaagcttgaggaagtgaagttagagtatcttcaatagcctctccaaacactaatatagctagctctccaatttatttgttaagctaaactcattccttactccaacagcatctccatctatactctctattctgagtctatgacactgggacccacacgtcagcctctactacctccttcctcctcttctcccccatcccctccacaatttcatcgtgagagatacaacctccgcccccacgtccttgggctgctgctcccacaccaccccgtccttcgcctccaccgccgccccgccccttcccatgcgcatcagcagcaccgccagccccaggaacagctcccccgtcctcactgcgagcgacctcctctcggtcccctcgggcggcagcggtggtttcaggtcgtggcccgtggcggcgcgggtgagaatgaagcgacggaagccccgcggctgcgcggtggtgggcacagaggcagaggcggaggagggtggctagggcttgggagggaggccgaaggcggtggaggaggaggagaaggcgaggaaggagggggtcatgggggctcgtcgatggccaccggcaccatcgctgcgccctcggccaacagcgccgttgccacgccatcgccaccaagagaggaaggatgggactgggagtggtggtaggacccacctttggctagtggaggaggctggctacatttggttagccggaggagcaatttggctatctggatggagagtttgctggagctcgttttttctttaacttagagagtcaaatagagagtcggttggagatgctcttactaggctagagaagcagcagctgaatttagcgagctccttggcatgcttgatgaaaaccaggagtctaggacgaaatgccggagctaaggataatccagagtgtaagacactactatattcttatgttaactagtgttaagcatctatatctccgacgtctctttaaaaaccactagtaaaactcaacttataaaatatacacatactactaattcaatatgctaatttaaatatcatatttctctcagtgtgtcttgagcattgtgtataacggtataagtcagtggacactttgctgctagtacaccaatactatgggctaaagttcggcaagcctcttttttttcctttttgttaggccacacactatgcaaaaagttttgtggcaaagtctagatgattttgtcttcaaataaccatatttcccttagagtggttgatggtttttctgcaataacatatgtccgatttgcatataggagtatttgatttgctgtcaggacgcaatatttcgggaaaaaagtattgctcatcacacttaacgaacaactttctctatatgccagtgccttcgtcctataatataacaatctagtatcaaatgtaacacatcttaatagtatgaatatgaatataccttattcagattcatagcattagaatacgtcttgtctcatactccctctgtcccataatacaaaggattttggagtgatgtgacacttcctaatacgactacgaatcttgtctattgtttagattcatagcattagaaagtgtcacgtccctctaaaatcccttatattttgggacggatggagtattatgttgcaatattattagacggcggtagtagtagtatacaacaaccgaatttcttaccgatttgatctttgctcaaaaatctgtacacgcctcatgtaggccctgtttagttccaatggtgaaaatttttggcgtgtcacatcggatatacggatacacatttgaagtattaaacatagtctaataacaaaacaaattacagattctgcatgtaaactgtgacacaaatttattaagcctaattaatctataattagcaaatgtttaatgtagcaccacattgtcaaatcatggcacaattaggcttaaagattcgtctcgcaatttacacgcaatctgtgtaattagttttttgtctatatttaatattctatgcatgtgtccaaacattcgacgtgacaaggtgaaaagtttttgcgttggaactaaacaaggccatagtgatgtgtgaatctaggtgatttgacgattattttagacccaaatcatgcatcatctcgtgataaataccatcacgtaggagtaggggcggattcaacgtgggtgcagggggatttgagtcccccctacacccaccgaacccatgaatacccccctgagcccccttcatttttttcgccatggttgataagattatatagaaggtgctaaagatctcttaaaagcattttagcatagtttaatactaagatgatggtgttttatgccggtatactcggtatgtgagtctccccctttttttcctgatctgcccctgcgtaggagtactgtacacgttgcccccattccattccac

SEQ ID NO: 17357 - DNA, 1198 bp, Oryza sativa
tgtgtctcttatcctgttgtagattaggggtttactggtgagatgtaaggtggaaaaaatatcactattgcagtttatgtgataggatatgcttcattgttgtgtttgggagctaggataacgatactatgcccatgtttgatgtggtgaacccagttatttcatattagtgatgagctcacttgcttgatatatggtatggtattgctcatttagtctgcttagaaagtaaaggtgagaagtcgcagcttcagttgatattaccacttgaacagagcaagatgttatgtaaattatttatttggttatgatatttggaaattcctaaacctcctcgattgctcaagtgaaccgcaatgacagctatttttcaaaaaacattgttcaacaaaaagttccaagtgtaacgtttatgttcttattcctgcttttcgcatctgatacttgccttgcacaaaaagtatgctatacagatttgacatctctcctcatattgttgaagcctgataatcccatgttctgattccctttacgttttctatgatgcaggcttttcataaggtggtccgaagttgggcttcaaagaaattcatgactggatggtaagtctctgaaggatgctgcctaataaatttctgctcgttcttctatgcatctgagtactgtctaccagtgaacagtataattctttctagctaaaagaaagttctatttatgctacagtgtctgtgatggtttatcatacatgacacggttgttgtgggtatgtattatagcatacttaaggaatgtggttacaattcaaaaggtcaaatttatgggttccagaattaataaaatcttccagaattcaaacttctgttctctttgcagaactgagagtaattcaggcaagtgctttggcaagatcactaggttcattgctggttcgtatgatagtgggtgcctatttcttggaatctgggatatagtctttattttttaaaaggaaatcagcttggagaaattggttaaatgccaagatggtcacgtttggttggaagttatgtagagttatagattgatactcgtgtggttgcttgattagtgattgtgtatatattcacatggcaatgacaacgatgaagcacacaattagggtttaacactgttttcttatgctatgataatttcaatgatagtatatgaaattatcttt

SEQ ID NO: 17358 - DNA, 21991 bp, Oryza sativa
attagtcctagctgatagttggtcagaggtctgggaagcttggcatttgaatgatcaatgatgtagagcaaattcattttatgtttgaacttgatcgcatatgagtggaatgtgggatgcttgttgcctattacttttttttttcaccctatttattctacaaatgaatcctcaggtcttggctttatcacttctgttaccttcatatttgtggttggagtcttcatgtcatcttgggttggagcatctgtccttagccttggtgagtggattattaagcgcatgccacttgtccgtcatatctacaatgcatccaagcaaataagtgctgcaatatcaccaggtaaacctactgtcgcactaatagcatgtctgcaaattagcttgggttcaaattaactctgctgatttctaattaactctggtttctacagatcagaacaaacaggcattcaaggaagtggtcatcataaggcatcctcgtattggagaatatgcatttggtttcattacatcatcagtctctctccaggtaagacgactattaactattatttcgcttgagattacattacattaagatgtttatgtcatttgtacaaaaataataaaattgttgatatccgttcagcttttatattagcatgtagtaaatgtctggtttcagtacctaatttcatctcatcatcacgtggtaacagagttatactggtcaagaggaactgtactgcgtgtatgtcccacccaaccatctttatattggtgatatcttcatggtaaattcgaaggatgttataaggccaaatctttctgtccgtgaaggcatcggttagtcataagcatgtcctttccgtgtcccatttccacttgatattcatgaaggtagttcaactttgttctgttataaaattccttgatttattcttaacacgtcatgcagaaattgttgtatctggtggcatgtcgatgccccaaattctatcaactctggacccacagacaattcttggagacagaacaggagcaagcagaagctgagatctctccttggttgcaacttgactaaaattatcagaccaagtacagtgaactagatcctgagcaacacgatgtattagtggtctgtcgagctctaggatcacaaggatctgtaaattagtagaagtaggtgactcatatattccttgttcatccgttggcagtttgtaccatggtttgcactttctaccacgttctatacaagaatgcttcgtagttgtaacgccttctttacttcttactgttttgagcgttgacagcacttgcctttaaccatgttgaaggtcatcctggtgaactcttgaaatataaagccttctcgcactgtcttgcgtgcaattttaacatcgttaaaatctctaataattcgtcgtgaactcgtagcgtctaggatgacattaagattaaacaagtggatgtttgcaacaatagctatgcttgcataggcaacgatatactaaattaacaaaatacgacgttgtagacaatacacaggccatgctgtctggctgctaaaaactgttgcaacatatctattccagaaagattattcagtattcacgaatgaaaatggctagtaccgatcatcctctcaaggaaaggccaagaatgtctataagcaggttcgaaaaaccacaccgcagaatgcagtccaccattttcaaaatgggactgaattttgcagcaaaccttatctgaagtctcttgctctgaattctgcaacgttttcgtatcattcacctccttggagggggaacaaagttaccccatggattgtacttattttcttctgatcttaaccgttagagtccattgtagcttgccttctgggcgtggtatatcccttggcaaacggaggggcagctcaaactccccaagggatgccaatggtgacggcaggtgaagattgtctgggtggatattgatattgagttgccttgcaacctgttgattaaattgagatattactacaaatctgaaactttggaacaaggagtgtgactgagctggaggcgcacctcggaaacaatttcgtcctttgtcacaggagaccgcagttcattcccaactgagatgaatctcctcaacacctatcaaaataccaatgatcatcaatagttcaatgggcaatatcacaattgccggctaatgtgaacgagtataaagaaatagttggttgattgtaatatgaaaccaaacaggctgcagcaggattcacgattttggagtaataatcatactaaccaagagagcattatcaagacactttgctgccgtttgatactccttcagtttctcttcctgttgctgttcaaaagttttcagaagtaaatgagtaacaattgaaagcagaaggaagtacgtgactgataaaccagaatatgacactttcagatctaaggccctgtttggcacagctccaactccaagttatttcagagttgggttttcttagctccataaattcttggagttggagcagctgctgattcaactcgaaatctgatgatattatcagtgaaaaaaaatgtggtttcaagaatgaaccaaaggtggtttcaagaatgaacaaaagtgtgcacattacagagccaggaaagctactgtactcaaatttagtcactgaagatagtatcataacagtgttgagtaaataaagcgaaacacttaagcagtactaagtataatgactaccaaacaagaagtaaaagaactattaaaggcactatgttcaatttttttcatacactgaatagttcagatgtgcatgtaagaaaattaagacagtattgtaaccattgtgctcagaaatgtatccaaagtataacttctacaaaacagaaattaacagtgtgttcctatgttggcatagagctgaaatgaaaatatgaaatacaacttcagaactttatacaaaaacatagtacacggcctaagataatctgtagctccaaagagtacatatcaaatcaattcagcacttgaaacaatataaaaaagcaacagaccatgaagaaattgataaaatggtatctgttcaatgatgtacatcattaccttagcatcatcatcttcttgtcggacttctttcaccacctcctcctcttgacgttggtaaagctgatcaaacaaataagaatgatattttcaggcacaaacttatagtttacactgcatccaaacaagtgacaagtcgacaacaagtaaacttgagtagtgataaactagtgggaccacagtaatttaaaccttatttgcgcataaacaaaactaccaacaatccaagaaatactatgacaaattgtgcatgaagaagtagaattcaccatccatagcaaaaatcacagaacctataacctatagtgcaattcatatacccatatagattcaggttatagaaacaatgcaaacattcaaataaccaagctgtagtaaagatgcttgtaagtagctaaaatatagctattacatgttcaattgttcgattgtttattgtatattgaagaactaaagggaacaaaccttgcgctgctcatggatgagtagagcgaatttgtcaatgtttgggacagcgagcatcttgggcataaggtggttgcggaagtgtcctggggccaccttcactacctcccccgctttccccagcttatcaatcgtctacagcattccaggaagaaaccattgagtgggaaaacaacacagttttaactcctaacatttccaatcaccatatgacaaaggcaccgccatgagatcattttgcaccatgaagtgtccaccagatggatgatcgtttctcaattgaagaagaactactagctcaatacgagcggtataatctgaaatttctactccaattatccctaagacgcgcggaataatctgaaattgctactcacttgactaacaacatttcgctcaaatccaaacgtcgaatcaaataatcgacccacaaacccgcactcagatcgtcgcaatgctatacgcattccccaccttccagtaacctcgcacgcatcaaagagacagcccaaagcgaagtggccgcggatcgaaagggacgagctggagaacaggctgttaccgtggtgaggatgacctccagcttgcggtagcggaggccatggccggagaagagcacggggttggcgccgccggctgcggcgaggcagtggcggcggaggagcgcggcgcgggcggacgccatggcgacggcgaacctgctgggtggagtctccgtcgtcctaggtcactagggcttattacttgggcccatatgtttgggccttgtgggccgaacatgacggtttgggcccactccaaccgatcacgattggacggtcgcgattcactaatcgaacggctcccgagaactgcacgagtcgagctcccccgccgtcaaggagtcaaaccctaattccccagatgcctctatataagcacgagcaagagaagtcgtctccatcatcttcatcctccacgccgctatctatcttctttcgcatggttgcatctgcttcctcttcttgttcgctcgtctcgggttgatctgcgatttcagatcttgttctttccgtttggtttttcctttgccaggtattttgcaatggttaatttactttttcgttgttcgagtgggggatttgatttgtgtttttggtgtcgaggacggtgaagatcgtatctattggtctcgttcgtcgtaactggcaaattgtttttgccttgccgaccatcctgatatatcaccacccatattccgagtcctctgtaaccaaatcaattttcgattcctcatgagatcagatcttctttggtgattttctttcgtttggctcttcttttggattcattgtgcagttatattggccgatgattagattaaaatatagacaagcatatgtctgaattttcatgtggaaaagcctaatcttctctatgaggtcagatttattgatgcatgtcattgtgttgtatttttcgtcatctttatccttttcgtttacttttgaggcctatgatgatcaatgtggaaacctttctctctgaaatcttgtgaggacataccctactactgccttccttctgaggtctcttatcattgtttggatctgactaaaaatcttattttgatttttgatatggttttaaaaactatgattttttaagaggtttgatgccgatgtggatgtaaattggttgcaaggtcgagtgatgagcaaaaatgcatagttcagatgatcaaaccctagtggttatgattactttgaataaatagtctttcgctcctaactgacggcctttacgcacccatctcaaaaacggttactaaagatttatttattttgccatatttgatataatttatgttctctgattttgtctatcttaacagcccgtctttctatttgtgttaaacttgagcgtgaactgatcttgctgtagtgctgcatctgtggatacaacaacctaccatgaacctaccatgatgtgatggagatgcgatggaaagttgggagattgggggaagttgtgtgtgaactaaacgtggattggggccctgtttagttcacatcaatcttcctccaaattcccaacttttcatcacatcacaatcacataaactctaattttttttcaaactaccaactgtcaaactttttctcaatttcaggatctaaatgcagactggattgtggattgaaaattgcggctgaagaacgtgaacattgaatgcagactgctacattcgcactgttttgtatcagtccgttaattctacaatatttagctgtttagtaattaaacaatggtcctgtcatcttttgtaacctgttaagattgatattgaataaatcatatttgcgtattttaacctagtctttttaatgtttattttagcagtggatgctgctgtgaaaagcccatgtcagtactactctattttgatgatcaggcccatcacaatgtaaacccaatagcttccttatctagctggcccaaagtatttatagaactattctattctttcggcttacgcacggctcgcttcgtcggactccgctgtttcggccgcaacatctgccgctccttctccccttccctatccgtaaccctaaaatctcctgctgatcctccctctgttgaggctgcgggaggctgaaaattttgggttcccccgtcctggaggaaatgctcgtacttttgtcgatgtgcctgcaagattttgtccttttgtcgaggtgtgaatctgagctacgtttgtgattcctcctctttcccgttcgtttgtgggcaatttggagatgttaacgcgatggcgtgtttggcgaatttgcgaggctctttcccgttcgtttgcgccaatccgcttctactttggctccgcctagtaagcctgaaatttaattgcattttactagtttactacggagatagtctttcgctttaattgtacttctcccgtttcgtttcacaataagtcattttagcatttcccatattcatattgatattaatgaatctaaatagatatatatatctaaattcattgacatcaatataaacgtgggaaatattagaatgacttgcattgtgaggggaagtagatgtttttttttttcattgagatgatttcccagcaaatttactcttgtggtagtgggatatctaagataaacctgatagaacaaatatccgtttttgtgccgaaagacacttcggtgggtggatgtttcccctcacgaccactatgctcttaaaaaattacactcgtaatctgattaatttctgattcctgcttttcatccgtactttatttcgaagaaaagggaaatgtgatatagacttatgtctgctgtagacctgtagtactacaggacagtgaaatgtgatagtataatgccactttctttttgccatgtgatactaatttactttgtgcgttattccaagtcttgagatatccttcttgacaaaggtcattagaatattcttttgcaagttgccaggtggcctttttgtggtgactggattttggtgatgatttgcagcctcaggcctttttgatcctaacagttttggatcctatttgtcttcgtatgattgttctcatgcttggcgagaagagtgatgaaaatgttgccatcgttttcaaagtagcaaatatgaagggtatgattcctgtcctagctatgaacctagtgtataaattagcaaatggaccaattatcactgtttggtttcttttatgacttttggaatttttatgttagcgtgcttgctgtacatagttcacagacaactgtacatacaaaagtaaacgtgcacaccagccaccagatattacttgatatcattggggtagctcaagttctgttaggatatgaatatggaagaatggaactccttgtgacaggttatatatctgtcctgcactatgctgttgtttagggaaaaaattagcaacatttactaatccaatgttagtattgattcttaaagcatcttcaggttttgctagaattagctaaaaaaaatataacgaacctagcttgtacaccacatttctttgtaagagactgtcaaattgagaagatgcttgtcttatactccctccgtttcaaaatgtttaacaccgttgactttttagcacatgtttgaccgttcgtcttattaaaaaaagtttgtgaaatatgtaaaactaatatgtacatgaaagtatatttaacaatgaatcaaatgatacgaaaagaataaataattatttaaattttttgaataagacgaatggttaagcacgtactgaaaagtcaacggtgtcaaacattttgaaacggagggagtagttctggaaacaattcatccctgaagaacggtagtttataataatgttacgtaaagagcagtagagtaatgtagagtgcgacttggaacagtagcacggaaaacggagcgatccattagcgcgtgattaattaagtattagctattttttttcaaaaatggattaatttaatttttttaagcaacttttgtatagaaactttttacaaaaaacacaccgtttaacagtttaaaaagcgtgcgcgcggaaaacgagggagataagttgggaaaatggacgtccgaacacagccttagcagaactttgatccaaaaacctcttgattcttgctgtccaaaccatggcctctcattggagtgataaaccttcacaagagcacaaaccatgtcctgtagtactaattgctggcgcgcatgttttgatatgggatccatgccatgtgagaggactgttcactcttaacaaactgacacaaaatacactggagctgtttcatcaataacctaaagacattagcattttgagagtggctatggctgcaaaagtccaagtggacacccaagagatcatggtgcacagactgaattactgaagagggactgggagaaagttatgactgcatagcagacaagctgcatctagtgaacctcactgtttactacatcactagaggacaggttgcttaggatatattctccaaactaaaactgtaaggaaatttagtaacagacaatatagtctggatgtattaataagtggagaattcagtaggtaaacagactcttgctactgtcctggccctgtttctgaaaacaatgttgtctctatagctctgttcaaccttttttttttttcaaatggtcaggctgttgcctacgttttatattaagaaggtgtcccatttaaaaaaaaacgagaccaaaccttacaatgcacagttaattaggggaaactgagcgaaaaccacactactctaactaacctaagctaccaaaagcgtgaaaaaagaacaatggtggagcccaaaacaaccatcgataaagagcttgttgtaagcgacacaaagacttcgactttcacgaggcaagtgctatcattgccgagcttgtcgcctagtgacacggcagctccgactccacggctatcacatcatcgttgccaaaagcatcgcaaaaacgagcaagtcaccgattgtccactttgaacatcagcccaagccgccagagcaccacttcttgaacacagctagcaccaacacccctcgaagactacaacgtgttatcgttgccaaacttcattgcaccacaacaaaacagctccgacttcacctagaagaaaacgaagaaagttggacgctcaccacatccaagaatggaacccaggaggtgaaggcctcgccgggggcccacgaacgaccatcgttgcacgggaaggttttggtagtgagagaaggcgccataacaacgcctccaaggagggaaacgacgcctaatggcgccgctgttgtcaagccaatcaaaggccagccaaggctttcgccagcgtcatccaaaaccacacaacccacccgcacttcgtacattgccggaccaccacatcgtccctctagccaccaagcctagcccgctgccatgccgttgccatcctctgctgcacgggttgaccaagcgtgacccgtcgccacaagcgcccgcaacgccgccgacccgactagatccggccaaggcgaccatggatccggctgtcaaagctcggccagccgctgccatcatcaccacgagcgcccacactccgctgcgccgccgccaagattctctcccgcaaccgccggtgagcgcagcaggcggccgccactgtctccgcgccgacgagggcacgcaccccccctccgttgcacgcgcccagccccctcctctgtcactggcctcccgcagccatccccgcactggcaagggcgcaccggcccccacctcgccttgacagctcggtgtcgtccttccggccggtagggcaacggatctggccaaggggcgccagatccggccgcccccatcacagggccgccaccacctcacgcctcctggcccctccaagatcgacgacgccgccggtggtgagagcactatatccggccggatccgagctcggcggccccggagctggacgtcgtcgccagcgccatgccaccggcctctggcccagatccggcggcgccttccccgcctccacctcttccgtgcacccgcctcaatgccggcattgatgtggccggctccatcttttggtcctccgcgccggaaccgggggtgaccgccgccgcgagccccgccagctttgccggccactcgctcaggcggcggcgaggcagagatgagagttggaggggggcggtggcggctagatttccgccgctcgagtcgcccacgcaggaggcgaagcgggggctgtttccttggcaatcaccgtcaagctagaaaaacaatcgggacacagttctgttcaaccttaaaaaccagttttccctccaacgtatcagttgtttttggcctgcaacacaatttacttctatccacggtccattgctggacagtggtaaaatacaaaaatacttgtgagatccgaggtgcaaaattagtagactggagattataagaaggctgtgctgttttcatcagctgtgaattttttaataatcgtccttcataccatgtcacaaatttaagttactataaaaaatgctcgtgcgttgcaacggggaaatctactttaatcttattattgttatatggtttagttaagatgaaattcactgtgcgagtttgcttggatatatatatttttagaaaatcatgagctgcagttagaagtccgatcgtctcaagttagcatgcaagtttttttaaaacagatttcttatatgatttcttctgtattaccaaaagtgaacgatcttaaaaaccgactcaattacggatatatattttcaaaagcaaacgaacttaaaaaccgactcatacacggatgacataccaaaatatcggcaaaacatcttcaatttttataatagtagagatagagaagagatatagattaaaaccaaaacataaaatcaaaaccgactcaaatacggatgacgaaccgcggaaacatctttaatttttataaccgactcaaacacggatgacagaccgcggaaacatcttcaatttttataatagtagaatagaaatagatagattccaaaagcaaacgaacttaaaaaccgactcatacacggatgacgtaccaaaatactggcaaaaacatcttcaatttttataatatattagagataagttagactggagattgttcttgccgctgtctataaatttaagctatatttcatcagaactttgatcaagccacaaagccatttcttggcatccttgtttcgaggggacctttgaacaactaggtacaacagttgtgtaacgctccgcttttcgtgagtcgttaaaaactaattcggcaaaatcctaattgcgaaaattttcgttctttgtgtgagagtctaagttgtgccaaggatctcaatttaatcccgttgttccctctcatcgaaatcgaaatcctccacctcgaaaaattccttttccgattcaagtctctgaaatcaaattctgaaattcaaatccttcctttgaatcctcgccaaatacttctacgaatccagaattattcaaatctcgcctcgaatccttcccttgacttcaccttatgttcctaaagtcaaagtatcaaggttaaattccaaaaatccttctcaaattctctccaattgaaacccccccaccaaatcagttctcttggaaaaagtctaaattgcgtccttcttggttgtgggccgtttctcccttgctcggcccatttctactcagctccctccacctccatgtgcgctgcacgcgccgagagagagaggcatcgcctctcttcttcctctctctttcctcgctctctctctctgcttcctttctctctctcccacgccagcgctgccgccatcgccgcttcccgccgtcgccgcccaaaacccgccaccgccttcgctctttcccgcgctcgcgcgtggccgaccggccggtcgttgccgccgtcagccctgccgcgccctcgcgtccgcgcgcacgcgctcgcgcgtgggtcgccgccgcaccagcctcgctgccctgccgcgctgcaccgcgcagccgcacggccccgcgcgcgtgctcgagccgctccacgcttttcttgccaaaacccggaggccgagctctccctctccctcctactcccttcccgaatcggcttggagcgagcctctctttttccccttctttttccctttcccaaccaccatcggcgtcaccgcctgccaccgcctggaccacgggcgcgaccgccagcccgcgctcacgacccgaaattcggccgtctgatccaccgccttcgccgcccaaagcatccacgccgtcgccactttcgcatcgcccatgaaaccgccgctgccgccagccgagcgcttgaccgccaaggtcggttctcccctcccaaaccgacatcgcctcaccccgcgcctataaaacccgcactcccctccctcgttcggctcctagcctctccaccatcgcaccgtttctcaggccaagaacgctcgcccaacgccgcggcctcctccgtcgctggtgttcccttcctcgccgccttgcgtcgccgctcggccaacgcggtgctgcccgccgtgaacaccatcctccagacctggcgccgccctccccgaagcccggccgttttccttcgccggcttcccgtttgctcgccatcgacgccgttcatcgccatcggtgagctcttcacctaatcctcctcgttgccaccctcctggatcaccgtagaacactcccgaaccgccgctttgatcgctggacccctctccctccccggcggcgttccgcccttccccgcaccgcgcctcgctgtcgccggcctctctcagagtctctccgccccatccgaccccgagaacaagttcccagagtcctagagatgctcccgccaccacgaattgaccccattctctcccggcgtgttttcccccttttgctcgccgccggtggcagccgtcgaaatccgccgcctccgtccagttccggccacatccgagccgaggaatggagtctgcgtctccttttccctccctccggtggtctcccttcctcccgcctcgcctcgcggccgctccgccgacgcgcgccgccgcctgccgtccatctcccggtcggtctcgtcttcctcctctcgccggcctgcgtggctgccacgtaggcgccacgtcggtgccaactcggctagaccgagtcaaaccggccagcctggctagccccctccgtgcgcacggaccacggtgcgccatgcggctgcacgtgggcccgtcgcgcctcggtccacccggcgcaccaatcgtgagccgcatccacccgaaaccctaaacgccgcccgcgtgctcccatccctccgtgaaccgtgtcgccgacatgcgggccccacccgggacctcgcatggtgggttcggtccacccggactgccccctttcccttccgcgcgcccctaatgggccgcctccttgcgcccgcgccggcccaatggctcggccgagcctccttctacccattgggccgcgcctcacgctcggcctaaaagtccatattcctccctccgtccaagtcagtgtccatctctcatgagctaaaagtccaaatttgctccctctcaattttattctctctcaccttcttgttgaccccacttgtcaatgagtcaaagatattcttgagaatgtcttttccaatattccacaaatatttctcttttctataaattcaataaatcatttttccctctttcagaaatcaattccttattccaaaattccatgaatcattttccttggtcagtgactgtcaataatattcttgagaatattatttccataaattccgacaaaacatttccttgtccagaaaatccatttagacctccaaaattcatatccctcgatccgtagctccgatcgcctccgttccacttccagtaattccgtaaaattgagatctatttaatggcactactaattagtctaaataggatctttcttttggtcctttgtttaggttttcgattgtttgcgtatagttgcggttatcggattttcgtcgatcgcgggttttctcgaagattcgtgaagcttcgtgaagaccttgagcaaggcaagtcaccctttgatcaattgctcctataattgaaaagtcattattattttgtttgcaacttgcattattagaatcacacacttaacttgcttggcctcggtttgcgtgccaaaccgacggacctacccagtagtcgcactaatttctgtaggtcgtactaccctgattccttgtcgctccacccttgtggtacctcggtattcgtgctctctgagcgcgtataccaaatatcccacatacaccgttgtttgtcgaaaacttgggaaatgggtttgtgaagccttcaaaacccgacatgtggtgtcggtgtgtttgaaaataaaatgaattgtgaaaactcgcgatgcgggggttgtgcctatgtggcactgtcccgtattcgcatataaggaccgattcctgtgggaaactcatcgaacataatcaaagtgcaaccacaaggtggaatgagacaccctggctaagtaactagtcggttcagggaaacctcgcatgccaatagttgggaacgccggggcggggtcggacaaaccgggttcctggtaaggcaaggacgagaagcttgctcacttaccgatcaaggtggttggacttgatttgtgaatgcctaaaatggcctatacttacatgaggatttgatccttctatgtggcatgaggtaaccctgggtcggcttgggaaaggctttgtcgcgaacctctgacaccggccagtgtctggagtaagttcgtgtcttgtgggtaaagtgtacccctctgcagaggtgggtaaagttcgaacagccgtgcccacagtcatgggcggatgtgaggtggttcccgttgcgtagatttgtttgcctgtgctttgtgaaaagttgttgtggtgtgggaatcgtaaccagaatcagcctatgtggcagatggacgacctgagtggtcagaaacgaatctgtgtgattcgggatgtctgcgggcatcatagactaggcttcccgagtggaagcgggttgttgtgctgctgggcagctggactctgggagtccgagaaaatgaaaaaggctctgggagccgattaatcaagtggaatggctctgggagccgagaagtaatgatctgaaccaggaggtcggtacattaccaaatgagctgttgaaaaacatctcttaaagtcgaatcgagacgcaagtctcttttcggcccaaacttagaaagaaataaatcacttagtgatttcaaaatgtcttcaaataaaagatttgcaaaacaaccttgcctctcttccaagcttgcattaaacacctaagttcccgtgacttgctgagtacgaaagtactcaccattgctctatataaatatatatatatatatagttcctccgccctgaagagaagataaagtgaagtgaagattagggtttcgtcctggttcccagccgtcgcctgtggtgttgggtattagaccgttggttctgctgctgctgttgttggtgttcgcctcgtccgtgtcgtcggttgtattctcgggctgtctgagctgcagcctaagttaaggtaaataagtcctctatttattttaaagattgctatgattcatatttgtcaccgtgggtaccagcactatgtcctgggactggtaccgagatcgcggtttcgtaggaagcggttcgcaccgttttccctacgacacactcctgtcaggtgccgttgtacggcggtatcagattggggtgtgacaagttgctctacaaggtcattcataagatatgggccacaaatctatagatgatgtctgtcagctatgggtgataatggtgggttcgacgtgcagttccaatagccttccaaaagaagcaaaatattttggtttaatatttttttttaatatacatattgtcttgttaggatttgctccattattattcatgcatgaatattttctgcagtcttaactactccaaaatgttgatatgcaattactttgcctatcagctctgaatgagtgaattcttcattactgatgtttcgttgtccctgtttcacttggggtcaaatgctaatttcttcatgcttggttaatgaaaatcctttttctcttagacagtgtgcttctcttagacacttgggtctggaggactctactgttattaatgtattaataaatttacttcagttgtgaacttccctactgttctcgaaatgatagctttattactataggctagtgttgatgcctcatagaacacaaactctccaacataattactttagcaaggtgaaaacacattccagattgtagactactacgagatagtagtatcatgtattgtatcatgagtaatacttaataagcgtgctttacattaggtggaaaaatatattgagataacaaattacgcctgctttagctgttatatgcatgcatgttcctactgacttgcttggtttacccattaaatgacttctgttattaaagcaaggaaaaccaggagttacatgccaaaactccaggagtacccttcttgagatcgactggctacaaaggaaaaggtacatcttcccatggagttttgtatacaatcttgtgtaacttttccctattaacagtacaaatattatgtacaatgtcaacatatgtcccctgaatgtctaaattcttgaagattgtccatcaaatacgcttcagacatatgttccctgaacatctctgcatctgcaagtcagtttcttgcacatgcacacacaatataaatgtatccgacctatcttgttaaggatttatttgtgattaccatgaacagtgcctttgagcaaacacttgaatgcatgaggtaataacacacatcctatttactttggtatttgcatataagatagagacattaattagccaccccaaaaggggaataatcgactacaccactgtacatacagtacatgccctcccaacatggtatcttcaactggacaacgtttgtgccaattcttcttgagagtatttatctcccctgctacccttcgaaatcagatgtagctttgctagttcattattccaccatgtgtgcttgacccaagtacccaacacaatcatgtattcttagttagatcaagagaacaccatcatcaagcatatcaaagctaagccattctcatgaatttctggggaggaaaatgagtgcaagtgaacttgtgatcctatttccttgacagttgacaccttctacaaccaaaagcaccattgatccatcaaaaaccgccacaagaggagagttgcatgcatacctcctgctgctatgtgttgttcccaccagcttgtttgggttcaagggccaatagttgttggcgcagggccatctggactcgctgctgctgcatgcctgaaggagaagggaatcgacagccttgttcttgagcgctcgagctgcttagctcctctatggcagctcaagatgtatgaccgcctcagccttcatctacctcgtcagttctgtgaacttcctctctttcctttccctgccagctaccctgattaccccacaaagcagcagtttgtggcttacctggagagctatgctgcaaagtttggtatcaatcctatgtacaaccatacagtggtgtgcgcagaatttgacgagcgactgatgctatggcgggtgaggactacacaggccactggcatgatggaagatgatgttgagtatgtgtcgcagtggctggttgttgcaaccggagagaattcagaggccgtgctgccagtgatcgatggcttggaagagtttcgaggaagtgtcatccacactagcgcatacaagagcggttctaagttcgctgggaagactgtccttgttgtagggtgtggcaactctggcatggaggtgtgcctagacctgtgcaaccacaatggttaccctcgtattgtagtaagagatgcagtatgtgatttttcctctatgcctgttagttttatacttgttttatagtttatgccattctgtgtaatatatagttgtttatactttatattcattctttgcccaataaaactcacatgtagattatagtatgtgggatgtttacttgttggtttcctttagttagttctttgacctaatgcctgtgtttgttagaaagtgcaccaggagcaacacttgccctatacttccatggtgtttgtgcatctttaatatttgagcaattcatggcattcatccaaattattttggtctattgattacttctctcttaaaatgttttctgcccaaagtcgaacctcctatgttgtttatgtgtcaagcttagtaacgatgccctatgtcgggctccgtcagtggtttcaattgttagtgaggttgttctaagttatggcgagtgttgtgtggttgttcagccagccggtggttctgtattcttttcttgcaacccacctagggtttttatttccacttgttgaaatataattagcagttttactgtctgttttagttttttttaaaaaaacttggttgtaaagtctaattttttatttagagtttttttttcaaaaaaaatgaaagcactaagtggtgcatggcaccttgtcactgcaatgagaacacatcgttacgaaacactagtacaatagattgagaacctagttttcttgacaaaggcagtcctttctgatggctctaaaattttgaaatggcatgggtttggttacaaattgctaaatcagcttatattgttagatatagtatactgtgttgggtacgaggaaataaggatgaaacccatactttcacaggcatattactcactgtaaaattagttctgattaacatttgttccaatcaccaagccaaaaaaaaacaaaagctttaacctcgttagcgtgccttaagaaattttggatcatgggtttgcaggtgcacatcttgcccagggagatgctaggtcagccgaccttccggcttgcaatgtggctgctcaaatggttgccgatccatatcgtagaccggattttactgcttgttgcacgagcgattcttggtgatacatcacaatttgggttgaaaaggcctagtcttgggccacttgagctgaaatcactgtcaggaaagacacccatccttgacattggcactcttgcaaagatcaagtctggagatataaaggtttattttcactatttttccaaaaatattcatgaacattcatagcctcttacaatcatgggttgatttattttctggatgattttttcttgtgaaggtccgacctgccataagaagaattgcagggcagcaagtaaaatttgtggatggtcgttcagagcagtttgacgccattgtacttgccaccggctacaaaagcaacgttccctgctggttaaaggtatatggcaatacagctgatgttccttttgctgtagaagaatttcagtatttcttttcctgaaaaacgtgttcaccaatattgagtcacctagaaaggttgagcggtcttcaggctaggcggctagcaccataaggtggtgggcttgccaacctaggttcgagcctcacttttcttaataaattccgatatgagggctcctcctctcgtatccagtgttttgtttaatattcagtcactcaagacaacctacagccaatttgaaacaagttcatacaaatgaaatttgtgtacctcctgactctttggcctcttttttggcgccatttggctcactttgagcaggaccaagggctgttttcagaaaaagatgggttgccaaggaaagcgtttccaaacgggtggaagggcgagaggggtctatactccgtgggattctcccgtcgtggcctgatgggaacggctgccgatgcgagaaggattgctcatgacattcatatgcaatggaagtcgtccaaagggaggagtcgtccagccaaaccttctccttagctctgttgtagatgctccatggatggcgagtgtgtgtaccgtcctgccgtttttggagctgttttgtttttgattggccaaccgatttggcagaaacagccaaggccgggtgtaaacatcatgcaattcgcggaagcgacgattttcaggttccacatgttagagaactttgctctgtttggcctggccttggtaatgaatctactcttgttttggcttgcgtgatgatggcttgcgacccctctccttggaaaagcaggaaagggaaagggcatcatgaacaggagagggagacatcgctgatggggagctgagaggcaaaaactgtaacagagatccaaatatccaatgcagttgctattgtgcttgtttattttctgatctaattaacagttcaaatcagctgctacaatagtattacagttggtcttgccattttgctttgattcatgaggtggtgccacttgcagttacagtagcaactgcactgcactgcacagtaaccaaatctccaaaactgacagcacggagaaagacctagggtcttaccggctagcctcaccacctcttaacaaacatcgatgtgagatttaaaaattgacagcatgtggctattggatatgcggagttgacattttggttaagactggcaccaactatacgcttatgtttgattgctgagatacatacgtttcacttgctggttgttttactaatcaaattaaaatattcggcaatatgtttatacatagattatgagaaaaacaactatactagccagaaactaaaacatctgaaatcagttagcatcaaacgaaattcaatctaatcaataccaggcggagccacgcatatgtcgcgaatactgacaacaactaaacatatgcgtgtctgcaccctcttaatttctgaaagagatctgcgacttgacacccattaattgggatgttcctctgctaattcgatgtcatgtagtactagtacctgtcatctacaggctcttttgtgggaggaatgggtgttctaggaaccccagaaactgcaagttgtcatttcgttaatgaaatgggagaggtcattatatctttctaaaataagagtgacgtgttctctctccgttttaaaaaaaaaatctaatcatgaggatgtatatctttgacatgtacgttgtccaaatacatctctagaaatttttttttaaaacacaggagtagtacttcaggacatgcacaattgtttatgtactgcctccgttttaggttttaatactttttagcattgcctatatttacatagatattaataaatctagacacacatatatatctagattcattaacatatagataaatatgggtaatgctagaaagttttataatatgaaacggaggacgtacatgagcatgcagccatgcacacgtcgtccaatatttccagccaaagagagcaaaatttagcaaacgtaacggatatttccgtttgtggtgcagtaaaattaagacgctaatctttgacgtttcaactgttactatcccttcaagcaatccatgaattttcttctcctttctgacttattttcttttccaattcctagtttgttttaaaaacggtgtgctgtggtgatgtgtgcgcgcgttcgccagtgcttctctttactccaaaagagtattgggccaggcccaaacaaaaggcccagcctgagcgatagttgaaagcccattagccgtacaaaaatatacgacaaaacacattttgtaaaggaaaaaaatgaaagtatactctttttaatagtattctgtgtttatatacctgcatagaaaaaaattgctcaaatatacctctaccacataacggagacacgggaccgcctcagtgtcgctcttccatgccgcaggaccggtgggtgcgca

SEQ ID NO: 17359 - DNA, 27438 bp, Oryza sativa
gttatacagtagaggtatatttatgcaaatatttttcatgcaggtatataaatgcaaaatattaatgaaaatatatattttctttttttttcttgttaagtactcgacaggatcaaacggacgcaattgaccacgcatgacacatataaaaccaacactacgtgaacaaaaactatactacaacgattacgacggtttgatatctctccctcgttcggcgaacaaacctgcctgaaccctacacgttaattacaaattacaccacgatttagtttaaccagtgcgtgcgtgcgtgtgcatgtggacacgtaatgcaaaacgtagtagttttcgtaaacaatcttttaattgcggtctcgtgccgttgacgacgccttaatctgcacacgcttatggggagagagagagagagagagagagagagagagagagagatcagtagatcggcagtagttgaggtggttgatcggtctatggctgctcactcttctctcagcttggtgtacacagtttgagacgcgggagaggtgaaggcagcttgcacgcttgcccacccccaccttccccgctcacaccgcccttcaccttccacttccagtcgcagctaaccctcgcagctgcacctgcacacgtacgcctatatatactcaccgcgcgccgccgccgtgcacctgtccgtccgtccgtccactgatcgacgacgacgttaacctcgccggccggcgctaacaatggacggactagaggcggcggcgggcgatcagcagcacgggcgcctgctgattcctcagctgccggccgcctacctcgcgtcgtcgtcgatggcggcgcttagccctgcgggggacgactgggcggcgtcgctgatcctcccagatggggggtcggcggcggcgggcgtgggcgaggatgatcttggcggaggagtgatggcggcggcggcggcggaaagcagctgcggagggagcagcaccgtcacgagcagtggcgttacggaggcggcggcggcggcggcgacgaccacgcggcgtgggaggggcaacgggaagaaggcgggcggcggcgggaggacgccgaggttcgcgttccacacgaggagcgagaacgacatcctcgacgacggctaccggtggaggaagtacgggcagaaggccgtcaagaacagcgacttccccaggtatattatatatacattgcgttcttaatttctagctagcggctaacgtgtacagggcctacaggctactcatgcatgatatatattgcatgaatccattcatggcttgtgcatctacacgtacgtatggacaatattgacgttgaaaatgcattaattaatggggctactatacctagaaggctagaacaaaggaattgctatgaattttagttaccttaacctggcactggatttaggagcgcaaaagagggaggaggggcaaccttccggtgaagattacgacgacgggccatcttctcttcaattatagcgacgacgagctccttctcttctctgacgtcgacaacacccaaactgcaacagagaacctgcgttttatacccctcggcagggtttacattaccggttgaccactaaatttcgaaccccatcgatatcacggttttcgataaatttcgatcggttttcgataaatttcgaccaaatctattgtttaaccttcgaaattccaatcgaaacttaattccgagccgtatcgaaacgtcgaaattttgtagaattcaactagttttcgtcgaattgtgaaccctgccgctcggtacttgtaccacgcggtaccaaaacccatccggccgttgatttcgcgtgggtaggattggaaaagggaaagaagcgttgtttgtcctcctcatctatcccgtagcgtgattttctctcccgcaagagcgccgccctcttcttttcggactcgagagctagcgccgccgaagaaacctcgaccccaaatccgaaaccctagccgccaaaaaatcgcgccccaaatcattcgttctgccgtcttggccgacttgagtgaagcgaagctttccatcccagagggggaaggctgtcgcgccgtggtctgaatcgccggagcaaccaccatacatcgccggaagcaaactgccgccgtttcagtcttgcctagcctcgacagcatctgccggcgtatgcgccggtgttgccgcaaccgagggatttgttagggttaccttcagatcgatacagaatgatgtgaaaagacctcgctacccttccaccgcacctggcgaagcggtaccgtgccagggataaaaatggtaccgcaagctactgtgcaatcatatccgttagatctcaccgaacgaacggcctagatttggtacctcgggggggggggggtgctggacgataaaaatttcctacagattatggtttgcagtggggtcgaaattggaggggaggtggaggggtgtttccctttatagtgatgattgttacttgtgagtggtgaagaaagacagttggcgagacgttccagagccacggagttggagaagggtagtggcctagtgggtacggttggcagcgagggtggggaagatggtggcgctagtgcacctcgccactgcctcgtttggggagtaccagaggaggagatgggaggggagggaacggagaggaggcccgtttgcttgtcctagcttacaggtgttgttggcacatttcggtgtcatcaacgttaggggcggtactttaacgtaggggagacaatggcgctcaataaggaggcgtgatcttcgatgtacaccatttgcccgtacatgactcacattagtgagtgagttgtggaatagtaggaaatgggaatatgataaggttagtgtagcgcacaaatcttttggctcaatttaggccgtcaaaaactggtcgaaatttgttcatatttttcaagtgcctaaaaataaatagttccataaaactaatgcagtttataaaatgaaaacaaatctatactccttttaaaagagggcaatgctggtggcagtgaatctgccatcaccaccaccacctcatttattttttttattccacgcctacttcatcatgttttctaccaactattcatgtattttaatgttatagaataatccatctatcatatttttcatctgtacaatataagatctacagggatgaaattgtcccaaaaacctttaatattattttgttttaatccgtagtgtatgagtatttggctagtaaaataaaataatatatttgagaaaatctgtcacctatatatattacggatccaatgaaaatacagacatgtgtcatggactctagcctatgtatgaaagatatggagagatatagagaagaattacagatgatcaatatttaatgacttcgaaaatttaccagctggattagcttattgagattggggtggctagttttgggatagggcaagcggattcacaatgaaagccttgatggcgaaggcaacaatgggcacatccttggctgtgcaagagaatgaggctaatggataatgtcaatatatagtacgtttgagggagttgattggtgagtttagaggattcaatagtgtgtgagccatcgaagggcgaggcaaaacatggtgaggatgcatggcttgatcgcacgggaggcagcgagcagcagctataggagagagggataggagagagggaagccctgccgatcgatgtaggcaagctggcaaggtaaccatgcaatattggggaaggccggaagggtggagggggttatgtgatgagaggcttaattagggccaaaaacagttactacacaaattcttgaggaactataatattgcctgtgtgctgcaacgatattttaattgatgaaatgatcattaacctagccactattatcattatttttttatacatcatttcttaaattttacatatatttatgactaatatatgggtcatacagcttcacaatatcatatttctttcctaaaaaaatagatagggtggtggggcggttgacatgtgggacttttggcaccacatgttctttactccaaaagggtaaggagttggtggtggggtagtgaaagattcaccactcaccaccaccagtactattttttaaagaagtatagatgtaaattatcctaaagttttgaatatttggaaagaaatggagatgataaataacgtttgaatgaactttttttttggggggtgtaaatataatgcctttttaatcttcagatatatatcccgcttgaaaattcatgcatcagttcatcatgctctccaattcatacaagctcttgtcttctctacagcatgttagttaagtaagggtaaaaggtaggatggtgtttaggagaaagggaaggagaggggaactcctagtaggatatagaggaagctacgctaggacggcgaggcaatggtgccatgagtgcacaacagatcgagagagcatatattgggagtactgggcctgttctgcagctgcagcgcagccgacaccaacagtgtcgcacgcacacggtgcagttgcagttgtcgcagccagcttgctgaacaggcccactgacattattgattggaagggtacatcgctagcctatattatattggaaaaagtacgaattacctccctcccctgaactatcacagtcgaccgaattaccccttgaacccgaaaaccagacattgctcaccctaaacttttaatatcggacgaattacccccctcgatactgttttgtacggttttgacttgagcttgcacacatggcgccaatgtagcaatccaatcagaaaaaacccttcctaggcccacctgtcatacctctctctctccccggtcgctctctctctctctcccccccggatgccgcgcagccacagcgtgagcgccaccatcgtccgggggagcctcgccaccgtgacgaccctcgccacccccatgggcctctcccccgccgccaccatcgccaccgcgtctttgccatttgcgcccatgctaccgaggggaagccgggacgaacgaacagtcggcggcaggcgggcggtgggcagcggcgcgagacgaggagggggaaggaggaaggaggatcccaccgccgtctcgctccatgtcccgccgccgtcgccgttgcctttcgcagctgcctctgccccctccggccgtcgtcctcggctccctgcccatcgtcctaccccccctccggccaccgtcctcggctcttcgcctgccgccgcctcctctgttcacagagagagagagagagaaagagaggggggaggcagagaaggagagaaaaaaagtgttgacaggtgggccccaccgttttttatttgtttttgctgactgtatcgccacgtgtgtgccacgtaggctgaaaaccgcttcgaatctagttagggtggtaatttattcgattttgagagtttggggtgtcaaatgtctggtattgtagtttaggaggtaaatcgtactactgcaatagttcggaggggcgagggtaattcgtattttttcctattataatagtgtcatatttggcctatcattgtaacttattaacatatactaacatacttcctctatagttcatgttaaataaaaaaacagagtataaagatcttaaattaaagggataggggtgcaccattagtcaacaatagataggcatatacgtgttccatggcacttcgtgcatccattgcaaatcgttcaacaataatcagctagctacactcatgtacgtacaagtgtacaacatgattaattaactctgttcactcatatacgtggatgtcattatgccaagtactgacgagacatatcacaggagctactaccggtgcacgcaccacacttgcaacgtgaagaagcaggtgcaacgccttgccaaggacaggggcatcgtggtgaccacgtacgagggcgtccacaaccacccgtgcgagaagctcatggaagcgctcagtcccattctcaggcagctccagctcctctcgcagctgtaataaattaattaattaatcaaccgtgtaatccacttctaatcaagctctaatcgtgcacaaaactgcatatataacttgacaagctaagtcgatctatacagccaaattaattatacgtactcggatgggaaagagaaggaaaaaagggttgtcctacctcccatcatatagtgcttacactgctactactgcttactcatacatacatgtacacacggtcaagtgatagtgttaatatataaatcacttagatatttacacgttcatgtctcctgatgttcacaaagcttacagaaaatgtactttatatgtgcttcagctagcaccttgtaatttgttcgagcaaatatatatgtatacgaatctttcatgtttttatttatatgtatttaataatcattgttttctataaatcccaatgaatttacaatgtcctaaagaaatttacattgatacatgaggtccatcataatttttctattagagtgttacataagcaccacgtcaactaaaaaccgggttgaatacaaccttgagatggcatttccactggtattaggagatgagggatgcgttatattcggctttgcggttgaggaattactgtgattgaaattcgaccataagatgagggacatgaagaaaacttaagccttattcagtttgtttccactttcaaccttactaaattttgacatcaccaaatttaaataagacaacaaactaattaaacacatttaaccattatacctacaaaattttagcagttctatagaagctttctctcttaaaactttaccaaaatttggcaaagacatcgaagcaaacaaaatcaaccctacggaaattagtactaccaaaatagatcaaaatttaacattaccaaaatgtgatttgggaaacaaagtgaacaacctaacctaaaccacccacgaggcaaacttaaaacacctcaatccgtctccacagaaaaaattctcgacaggggaggcccaaacccaaacatctagccgccttatggcccatgcaataataaaaggcactagatttggcccatgaattactcagctgaggggctacggaagaaggacggaccagctaaggcccacttaagctccgcataaccatctcgccgccggccgagccgcctccctccgcgccgccctctcaccaacccgtcccagcgagcgctcgcgcggcggagatcggctgccaccgcgggcgggatatcgccggccaggaagcaggtaagcctcttccgcttccctcgctctactgcgtactggctggaagagctttcggtgcttctcctctctgtgcggaagccgcagaggtagggttttaggcttttaggcacggacgacgacctttgggtggtgggggattaactggcagttggggaatttatggtcgaattggaccagttttcagcgattggagctcgtcagagtcttaggtgtgggtttggatcgaaggagctttctgatgttgctgcagaaaatgtttactggagtaatgcagaaattgtcactggagtagtgccttggttctgtgagattatgccggttgaactggccaaagattttacctcgtcgtttgatggttagcagtgcattggatttattttggggtaaaaccctgttcgtgtgagatctgtgataactgataaccaagtgcgcctgtacatgttttaatcagatctgttcgtgatggcacattgtttgtcatggttcctaaatcatacggagtatatattagaggcgtgaactaccacatgctgatgtgggtgggatgattttttactttgtgctgtaattgggttttgtgtaaaaccaatagagcagaaccaagggaactaatcttctgaataataagcagcgttttagaattttagattaagtaattttgcaaggtgttgtataacaagctatttaggaaaatagtctcctgggcttctggcatggttcatttctatgcatacctagttggggataaatgtcagccagatgtatgtgtagtccgaatgcctatatgattaattcatactaaattctaatgtttgttcatttttcaattttgatgtttcagttccctgaaaagaagattgtgcaacagtccaggaactcgaagatgaacaagggtaaaatttttaagttagcaaaaggattcaggggaagggcaaaaaactgcataaggattgctagggagagggtggagaaagcattgcaatactcatacagggatcggcgcaacaagaagagggacatgcggtctctttggattgagcgcatcaatgctggtacacgaatccatggggtatgtaactgcgtatccagtaatgcttgaagtctcagtgtctcacgtctcaaggacatcattttttttatccatcgctcttttatccttgagtataggccgaataatctatcaaaagtataacttttggatttcaaggtcacgcactgcaggccctatgtctaatatactgttttaactgactaccccaggtgaactatggcaatttcatgcatggattgatgaaggagaatatccaactcaacaggaaggtactttcagagctgtcgatgcatgagccatacagcttcaaagctcttgtcgacgtctctcgcactgcattccctggaaataggcctgttaagaaggaggggctagcgagtattctttaaaacaaacctccccaagtcttgttacaatcacgtctgaatgaaactggtattgttgccttcagcctgcagccgtacaggaaactcaatggcagatattgcatttgtaatactatgtaattctgtttggaaagctgtggaagagaaacacctagttacatgtgttcttcttacctgttattgttggttttttttggataatgtgctctgtttaccttgataaatataacagaatggatgattatcattgtttttgtactttctgcataataagcttgggaggcagccaggtggccacttattttctaatcacatgggaaactgatatgttctctttaggctgtgttcgcatgcaccttttcccatccccttcccctcgttttccgcgtgcacgcttttcaaactgctaaacggtgcatttttttgtaaaaagtttctatacaaaagttacttaaaaaaatcaaattaatccctttttttaaaaaaatagctaatacttaattaatcacgcgttaatggactgctccgttttccgtacgcagaagttgggttcccatctcccccatccgaactcagcctactctttcttcgtactttcctccagctgaagtcatgtaaccttaacatctcaaatttggtgagtggattgcatcatctaatcatatttctttagaaaaacaggtgcttcatcgacaaccactgcatgcatgttgctatatgatgtgcctgcgtaatcgtggcatttcctagtactgctgccaggtaccaacctaccatgttctgtaaaattgttttcttcaatcaactgttctgttaaatctgttatgtcattctcaaactgacaagttacccatcttctaatgcctcttctttttcgaacatttctaatgtctcttgtagtcttgtccctgctttcggaagacccagacaacttaacccaacacacaaaactataggttgatctttgcttttagatggaatggtttctgaatatttttccaaacatgttagcaaattatcccagttctgtgtattaaaacttttaccagtttgtacgaggggtcacaatccaccacgttgtattaccgttactttctgcatcatctgaggaactcatgagattaacctgctgttaggtaagacgatgacaatctaaaaaaggattgaaagagatctcttccgggcaataggcaacccgtcgttttctccccgccgtgtttgatcctttcttggatcattactgtacgcgtaggcctttgggctagaggcgagaaattcagtcacccacagcctgtccagagcttagctcaacaaatcgcattgaattggcagtcgatttcagcatatgggaaaaaaagggacatataggtcggcataatacctgatagctagtagtaacaagtagcagaagccaatgctcagtaacagcctgagataaaactcttagagcagactattagtgagctataagcatatttaataagataaaagatgagagataagagtagtgggctacagatctgtagccagctgcagcgcggactcctagacatatgacaggtgggaccatatattaatagtatattaagcaactattgtatgaattggctatagatgaattgaaactagtagtaggctatactattaaacttgctctgttgcaggttgctggtaatatgttcatatatgttgcatttacatcttgagttcagacgaatccgctatacctgcatccgtatccaaactgaccgacagttacttaagaaatagtacgtgttgaatttgctaatagcaccaataatctcgttgcagcatctaggtaatctaaaataccactttttctccgatcccatgaaacaaaattaaaatacagagaccaaaaaatttcgagcctattttctcctttgttttggtatctatagttagcaatctgtcgtacttttaaatgttactctaggttaaatcctgcaacgaagtaatgaagaaattgttaagcaactctgataggtaataccatatgactatatccaaggcctccctgatggaaagtcagaggtagaacatggatgcgatagcattgtcagctaggaccctttatttattctgttctccattcattcttgtgcatgctggatggcctatttctatatcatcatatcagctggaatctattgattaagagcaaagcatatgcaaagagacgtgagtaagctatcgactatccttccactaagctcccttggttagttataaacctacaatgatggtgcttactagcttgctaagacaaagtcattgacgtaggggatccattgaccaaccttgctaagttcaccactgtttttccagtttttctttaagtatcctgtagaattgttcatctctttgcgtaccaacatgatatttatttttttgagaacatgatatttattcgatgcacgtatatatttgttttgtgtccatgagctggctcatcatagaatgttagttgaatatctgatcagcacataggcaaatcattagatgctaacaactcatatccgtaatcaatatacaaatttcctcgtttcatccttgttttcgtcgcctcagtaaatctagagaagcactacgtatcaccaattttattctcgtttaatccgatcaccaatttttttccgcacaaaagaacaataaccctttggtagttggtagaacttgtcagctagcagattagaaatttcccggtagagctgtagaattacgtgaaaatcgtggacgaaatttattactaccactcattttttaacgaaggaagctgcggttttctgttcagtgctcgctcactcaccgggcaccagcagcggcagcttcaggccaagcgctccactggagctaactgaaatgatgctgttcaccacgaggagctggagaggaaactactcgtaggcaggaatgaatgtttcgacgaggcaatcaatgggtgtcgccctgcctgccccgacgacccggtgatccgatgtgatatcgcactgggtgggcagccaccggacggcgctccccgccacgcacatgctcgcggctcatcatggctgtgtactggtgtgtagtagctcttgccttgccaggtgcggcactggccggccgagccgcgcgcaccgatctcagtcgtctcgctcgcctagccacgttacgcgcagcccacgttaggtcacgcccaccccgacggccgacacgcccgcgcccgttacgcgcagccacgcacgcacgcgcgatgcgcggcacggcacgccacggcgcgccgtgctaccggacgatcgagaggccgacgcgaacgcgcggcatgcggtgcacacggatgctggcgcgcggtggagtgcatgggttggcgcacgcatgcccacgagcccacgcgaggggacggacactccgggcgcgcaaggtcgtgccagataatatacgatcacctgttggatttgctcccgtggccacaacccacaagccacaagccggcgatcgcgcgcggtggttgcgggtcaatttcgctctcgcgccgtggttcgggctcgagcctctcatcgtcacaccaccaccaaacgcgacggctcaccatgtgaaacgtgaatccacctcgtgtactagcttcaagtgagtgagctcacggctttaacgtggaggcgcggagttatgttttctcgggggcggctggcttgctcccgatatattgctgtgcttgtctccgcttttctccgcggcgcggccccggcttggactcgctttccgcgacacgaggctgtgcttttctccgcaggagagagagagaacgggagagtggtggtggtggctgcaagctactactactcctactgcaaccgcgttgcattaggtcgcgttcgcttggactgttctgtgagctaggagtatatctaatcttcctcccgaatcgtcaaactagtttggtggtgggctagctgcagccagccagccagccagccaagggagcggcgcattgcgtgcgtgcgaggaggggaggagggggagtgatgagggcgggaatcggcagcggcagcggcggcggcactacgccggtgcggccgcgatgggggtctggtgtgacgacgccgcggtcgctgagcacggggtcgtcgccgcgcgggtcggaccggagctccgacgacggggaggagctggtcgaggtgacgctcgacctgcaggaggacgacaccattgtgctgaggagcgtcgagccggcggcggggggagcggccgtggcgtcgtcgtcgggtgcgtcgccgtcagcggtggcgccgccgaggcgggcggagccgcctggcggggtggcgtcgcggtcgaggtcgccggcgatgcggcggacgtcgtcgcaccggctgctgcagttctcgcaggagctcaaggccgaggccatggcccgcgcgcgccagttctcgcaggacctcaccaagcgcttcacgcgcacccagagcaccaccaccgccccgccgggcatcgagtccgccctcgcggcccgcgcggagcgccggcagcgcgcgcagctcgaccgcaccaagtccggcgcgcagcgggcgatccgcggcctccgcttcatcagcggccccaacaaggccagcaacgcgtggatcgaagtccaggccaacttcgaccgcctcgcccgcgacggctacctctcccgcgacgatttcccgcaatgcataggtcaatctcttccccaatcgcccccatccccttcccaaacattccagtctccttactttccccagctgcatttgagatgcagggatgacggagtcgaaggagttcgccatggagctgttcgacaccttgagccggcggcggcagatgcaggtggacaagatcaacaaggaagaactgcgcgagatctggcagcagatcaccgacaacagcttcgactcgcgcctccagatcttcttcgatatgtaactaccgtgccgtaccaatttgtggactgattattgatttgttccgttaatgtgactccgttttggtatgcgatttattcagggtggataagaacgcagatggccatattacggaggctgaggtgaaagaggtaataatagtccaatgctgaggttgctttttttttttttacttcctgtattactccatattttcctgtcttttggggatatattttttcgaactgttttcctgggatattttggtttatggagtatttggatgattgtgctgtccatttccccagctctgtaggtgtgtgtacttgttttttgttgtctgcaagtttatgttcctgaatttacgcataagaattatggaacgcgtagcttggaaaaaagaattcctgactaatggaggcccccttggccgaactggccggaaagcacccgcactggctgtctgcacacactagttttttctatacattgaggtaccttgttctagaacatgggaggggtgtgttgtaaatttactcctactatggatggagatggaagtttgaagattaatacagtatagttggtgggggcatttctgtcatgctgcgtaattattataatctgttcaaatgatgcgtggaaagaggcaacttttggattagagcttaatttattcatttcgctgaggtcattgtgtaaagggccgagacaggttgtttttttttatcttttcttgctcgatatgtgaggatggtttgtgatcaataaattaatagtggggtttggcttttttcttttccagattattatgttaagtgcttctgctaataaactgtcaagactcaaggagcaagcagaggaatatgcggccttgatcatggaggaacttgatcccgaacagcttggctacattgaggtaaactagcatgtttcttctgccatctgtgtctgagcactgatagaaagaattacacaatggttggttccatgatttcctctgacaatctacaactatccactgatgtttccttttctcttttcttttttaaacatactgctacagtgctactgatgttaataggttggtttaggagaaacattcaaacagataaatccgttacttactgttttgtaaaaatgcgagagattgcatgtatggtgcttttcactctatatattccagcatgtgcactcatacactttaccctgcagcgctacattaacttgtttctctaaagccctgaaatgttgtcttctcaacctagaaaaactactggcatgaaaagaaataaggccatccaatttaggaactgtttatacgctaagaattaatggttagaatcttaaggaaggttaactagccaaatccttccaccgatttatttttctttctcccttttgtccctccaaaatctatttaagatccaaaatgctgtggcaactggtgataaccatatgaaataaatacataatgcaatattatcttttgaacaagtaattgctgctatgattttgtgcaatattctcacatgcaaaagattacatgtccaacagaccaacactgtcttgatatattggggtggcaattcactctttcaataagatgtcaattgctgcttatgtattttagtatagaaatacaatgtctttaacaccaaatactacagcatgcactaattctttgatattcagtagtagtagttgcatttcacaagttccattttattttgttttattatgcacttgcgtgtctttgttagacttctacgtttttttggagatcataagagacaagtgctgcatgtaaaagattcaggaggatattcaaagattcaaatctgtgtccctctttttaaggatgaaataattgcaagcatgttctacaagattttagcatgtatggtgcactcatgtgggaaccatgtgtgccaccagatgcaattaaaatcttgtggggaccttctgcattttagtgagtcatttgactttggggccttggattgatgtgtaccgtttgcctgccttgtattttctgagtgcaagaagtgtaattaatgttcttgtatgttggttgtgtctatgacctgcagtttctgagatgataccatgacatattttaattaattcaacgagaattagcttattgtctgatgatattatggtagttatgaaaaaaaatatattaatgtgttcttctgtatcattgaaaacaagacaatcacaagcattgaagcgatatgcaagtaaaacgcctaacatattcataaactaagaagaattctaaactttaaatttcagtagtaagttaataattttggtaacattctaaatgttcagaaattctttttggttcatggattgtagaagaacccacttgtcagcaacagaaaatatctttgaaaagtctctgtgttattttaggcatattgttttttcagtttgacctgcttactggttactgagacagtaaactacatttatgtgacaccccttttctcgccgagaattatgtgatccttaaaaacactacttgttgacatgacagctctggcaattggagacattgctattgcaaaaagatacctatgtgaactatagccaagcattgagctacacaagccaggcactaagccagaaccttgctggtctaaggaaaaggagtccaatccggaaaataagcaccaaattaagctactatctggaggacaactggaagcgcctgtgggtacttgcactgtggattgggataatggctgggttgttcatttggaaattcatacaataccgccaccgatatgtctttaacgtgatgggctactgtgtaacaactgcaaaaggggctgctgagactcttaagctgaatatggctattatcctcctgccagtatgccgcaacaccatcacttggttgaggaatacaagggctgcacgggcattgccgttcgatgacaacatcaacttccacaaggttagcgactagactatctttgttcctttgttgtcctttaaaacatggagaaaacacagagtagattcaagatttatcaattgatttggttggaaaaaaatatgacagcacacagcatatactttggttaaggacatgataccatgcatgatgcatgtttgtacctgtggggtttatttgtcatttatgtccatcactatgaaggggacaatacaacttttattgataggctgctcatccatactctttgcattaatgctcctaccatcaggacaaatagtttgggccatggtctactggactctcatttacatcatggtcgatgcatgttaaaagatgggttatgatttatgaatagccacaaaacatggtcagataaggtgtttctattttgatatatataattttactggcttggcttatcctagatgaattaagcctattataaatagtcattttcattagttctccacagccaggagcctaaacaagctcgtgattgttcatctttgaagtttgccatttgcattagagagcattattttcttgattgaatcatagtcatgcaagttcattcctgtcagctaacagcatgcctgtatgtgatatgcttctgaatcaccagtttacattccaaaatatgtatattattgcatggactaactaacttaaaggaggcacaagagaatataaagtcatttggttggtatcatgcagagggcacataagccatgattggaccatatcaatcagcagatggtatagttgatgtcacttaagacagttcatgccaaatatctcttcctatgggatatagcagtctgtgaagtagaagaagcatgaggttcagtttagtcttattttcactagaatgcacgagatgcatttaattttactaagcaaaaaaataaaccatgattataatatgctttttaatggcactgataatgcctttgtgtcatccttaaacaaacagacgcattaaaatacatatggtagcatggccaattcggacatttgtgtgacatgttgacaatgacccagagcaagaatacagctaagggtgaatgttttgcttcttgtaatggcagactattgcagcagcaattgtggttggtgttatccttcatggagggctccatcttgtatgtgattttccacggctcataggttcatcggaggagaagtatgctccactagggaagtattttggtgaaactaagccaacatatttgaccctggtcaaaggagtggagggcataactggggtaatcatgcttgtgtgcatgattatcgcttttactcttgcaaccaggtggttccgccgtagcctggtgaagcttccaaagccatttgacaaattaactggcttcaacgctttctggtattctcaccatctattcatcattgtgtacatatcacttgtaattcatggagagtggctataccttatccgcatatggtacaaaaggacggtgagataattatttttcatttctccttttctctgtacctgtgtaccagaacagtttcataagcttctaatataattctttcctacagacatggatgtatcttgcagtgcccgtttgtttgtatgtaggggagaggacactgaggttcttcaggtctggcagttattctgtccgtctgttgaaggtggcacacatgcatcacaaaattgtattacactatttacatactgattttgtgtacggtcttctgacacactatttatttgcaggtggccatctatcctggtaatgttttaacactgcagatgtctaagcctcccacattccgttataagagtgggcagtatatgtttgttcaatgtccagctgtttcaccctttgaatggtatatgctcttatttcctaatatgcttcgcctggagtttctatttataagattgcaaatgtcatgtttatgaacaccttatttgtagagtaggtagatcagtatagctgcttagatgtttaatgattctttcccctttcaggcatcccttctcaataacttcggcacctggggatgactatctcagcattcatgttcggcaacttggtgactggacaagagagctcaagagggtgttctcagcggcttgtgagccaccagtgggtgggaaaagtggtctccttagagcagatgagactaccaagaaagcgtacgcttatgctctatgtttagcaataattatatgcttgtgcagttggggattttcatgacattgttttggaatgcagcttacccaaattgttgattgatggtccatatggctctcctgcgcaagactacagcaagtatgatgttttactgctggttggattaggaattggcgcaacgccttttatcagcatattgaaagaccttatcaacagcatcatcaaaatggaggaagaggaagtaagtgatctttatcgtattttcagttgcatcttcctgatgcctaactacagtaatagatataattggttgtaattctcatttctctgtgatctatgtatgcatttatataatatcgtctgtgaagaccatgagagacaggacaggacaaactgattaagttcttcacctttctttgcaggaagcttcaggtgatctttacccgccaatcggacgcaataaagcacatgttgatcttgacacccttatgaggattacctcaaaaccaaagagggttttgaagacaacaaatgcttatttttattgggtgacacgtgaacaaggctcttttgattggtttaaaggagtcatgaatgagattgctgaactagatcaaagggtaagtgggtaacttatgtgagctaagccatatattttaagtaatgtaatgttctattttgcatctttttcttacaacctttcttcttgatttataccagaatattattgagatgcacaactacctcacaagtgtttacgaggaaggggatgctcggtcagcactcattactatgctgcaagctctaaaccatgccaagaatggtgttgatatagtatctggaactaaagtaagtcacgtctcaccacttgacctcatgctgtactcctataatttgcatcattgttatttgaacttaactattctattactttttttgcaggtccgtacacattttgcaaggccaaattttaagaaggttctttctaagatagcctccaaacatccttatgctaaaataggtaagttatcatattgcgatataattaaagaagctatcctttttttaatctatttagctgtgatatactcatcaggatgtgaactttctggatcaacaaaactgggactagcatgtgcatatgactgcaacatttgtaattctcttgacatgtaacaatgcatataccagaaaataggaggggaggtggtgtacgaaattgagtagccgtgatctgttgaagtacttgaaacttaagtctgtcattttggtatttaagtaatagcaagacgtaaagcaaaatgaggggctctcaagttcaagtacttgtgttcttctgattaatttttgtatcaattctatcatcttttatcactgtaatgaaggtaattgtgtttgtttgtgtataggagtattctactgtggggctccagttctggctagggatttaagcgatctttgccatgattttaatggcagatgcacgtcaaaatttgagtttcacaaggagcatttctaaaatcaggtaaatgccaaatagggaaataatagaagattgtgctacttgtatgacaccttttcttttacacgatgccttgttcacaatggaattaatagcaagggcgagaagcatagaggtgctatcacaacgcaccctcctggctacggccagtttgcactgtacacttcttgcttgagatactcagaagatacaataagagtgccaagataagagttttggggatcatctggtacaaaatatataggacatcaatcatggggaaacataggttccaacttccaagtgcatcggcgaggtgattgctcgtaacatgttgatctcctggatttggatttggttttcgactataatctggtgtaggacatagaaggctaccatgagcacaaggctaattaattgtatattgcgtgcagctgagtggtcaggctacaagatttgctctaactttgtaattatatacagagatgggaaacaaacaaatatagtgtgatttttgtaagtagtgtaggttggtagtgattgggtccagattggtggctcagattacattcaagcttgtttttttgttgtgccgggagtgtacaacgtgcattgttttagggatggttttacacacatacagatgatgtaatcatgtaatccttgtagcaaaggccttgttcttacgttaaccttctgtctgtacatgtttggcttgtggattgtgtattggaaagaaaagatgcagtaaacagtgatcttttgttgtgtgataaatttgcaagatgaatgctgccaacctgttgaaaggaagtcgagaagactcgctgacgctgagcaacgagagttttcaatgataagttgtatatgtgtacccaaaacattacgctgcattatttgttcctgctaaattgcaaccaataggccgtatacgtgcctcggcctcagtcttagctgaactggagctctgcgtgccgcacgagtcacctaactctagtataattatcaatttatcaggcatactagctggcaattaaaaaaatactttttagattctataaaaaagtattttttaaccctaaaaatcgtagtccaagattcaatgcgctctatacaaatatagcctggcaagtcataaatcccagtaacaagaacttgatatgatgacagaaacggtggttgtgaacgcggggcttggcgtcggccatctggccccaatggtggagcttgccaatctcttcccgcggcacggcctcgccgtcaccgtcgtcctcattgagccgccggcaaagccgcccagcttcgccgccgcggtctcccggtccatggcttccaaccctcgcatcaccttccacgtgatgccctcgccttcctgccacagcaacgtgcccgagctcatccgcgccatgaatgcgccactgcgcgagtacctacgctcgtcggtgccctctgctcgcgcggtcgtcttcgacatgttctgcgcctgcgcgctcgacgtcgccgccgagctcgggctaccggcctacttcttccagtgcggcggcgccagccacctcgccgtcggcttgcacctcccgcacgtgcaggccgagataaacgccagcttcggggagatcggcgacgagcccctcctgttccccagcgtcccgccgttcaaacccagtgacctccccaaggcagcactcgaccgcaacgacgagatgtacagatggattctgggcgtgttcgagcggctcccggaatcccgcggcatcctcgtcaacacgttccagtggctggagacgaaggcgctgcgcgcgctcggggacggcgcgtgcgtcgtcggccgccccacgccgccggtgtgctgcgtcgggccactggtctcgcgaagcggggaggacaagaagcacgggtgcctctcatggctggacgcgcagccggagaagagcgtcgtgttcctctgcttcgggagcatgggctcgttccccaaggagcagctcgcggagatcgccattgggctggagaggtccggacagaggttcctgtgggtggtgcggcgtccgcacgccggcgaggcttcgctctcaggtttgctcgccgggtgtcacggcacgcacggcgagctggacatcgacgagctcatgccggaggggttcttggagaggaccaagggcagggggctcgccgccgggtcgtgggcgccgcaggcggacgtgctgcggcacagggcgaccggcgcgttcgtgacgcactgcgggtggaactcggtgctggaggggatcgccgccggcgtgccactgctgtgctggccgctctacgcggagcagaggctgaacaaggtgttcatcatggaggaggtcggggtcggcgctgtgatggcggggtacgacggcgaggtggtcagagccgaggaggtggaggcgaaggttaggtggatgctggagtcgaatgaagcgtcgccgatccgtgagcgagtggcgctggcgaaggagcgggccgaagaggcgacgaggaaatctggctcgtcgcatcaatcatttgtcaagtttctgatagactttggcgtgaccaagtgaccggtcatgaatcttgtttattggtgacaatgtaaaacgggataagtcaattaagaattatagttattataaaatttaaaaataagtttatttgatttttttaaaatttaaatctatatggaaagtatttgaaaaaaaacatattgtttagcaattcagagaacgtggtaacggtatatgagggattagctaagatgattaggcagtttcgaagggcgtggctaatgcgcgcgcgcgccagcaacagccttcccacgctgtttttttctccgcttttctctctttttttgtgatttttttcctttccttttgacttttttttctgattttttaatctttagcacacatgttttcaaaatatttgagttgaatatttttaaatcttgactttaaagttttcaaattttaacttaaaagttttcaaatcttaacttaaaaattttcaaatctgtacttgaaagttttcaatcttgagttgaaagtttttaaatctcgagttgaaagttttcatattttttcaaatcttaacttaaaaatttttaaatctgtacttgaaagtttttaaatcaaagatgaaagtttttaaatctgagttgaaagttttcaaaatttatcttgcacatttaaattttgagctgaaaattttcaatttttaaaatttgacttcaaaagttttcaaatctaacttgaaagttttcaatcggttagtagaaaaagtctttcggaaaaaaataatatcttaattactgtcattatctactaataacttaattagttaggctaaactatccggaaacgcaaccttaatatatatcttataccacaacaagagctagtataaaaaagaccatgtcaaaaaaattatacaatcaaaattgacaaagccatcttctcttatgcattgtatctgttacaaccatagccactatttgttccacatttccgctgatcatgtcgctgatggaagagaggataaatagagaacaaagcaaaatctgaaaaaaaaaaaaccaattgcacgttggcttttgaaaatcgcaatagtcatatgtcccgaataacagatccatataactgctaaaaaaaacatcggtgaggctacgcctcgaataagatctgttcttacactgccatccatggacacaatcacacctcctcacaaccggatagaccaccaacgagagagagagaggaccgtcattccaaagagcttcatcatcaactccacccagacaacgacgccatggatacgaaaacatattcaaacgtgcctctatggatgaaacaccgaagcaagatgaccacggaaccaaagattagaagatccgtcatcaccatcaccattgatgaagatgatgaaagataactaaatttatttggatgaaaacctaaaccatcacctttgaattgtaggatttagaaaacgttggaataggaaaaagataagatattgatagaatgtaagtgtaaaacagagtattgcaaaacgcaggaaaaacataggaatgaccatttgaataaaccgtaggaaaaacacaagaattagatgagagagatagactcaaataaaatttaccaagaggttaaatctcttgctaaacttcctccataatctctataggattgtacattccataggaaattcaaaggattagatatgattcaatccgttgttttaaagggcttcataggaaattttcctataggattgaaatcctctaaaattcttatgtttttcttccaattcaaaagggccctgatactctttttgtttcaaaatacgagcgttcgttctggtgagattgggtgagaaagcaaatcatattccgcgcgcacgcttcccaaactattaaacggtgtgttttttgcaaaaaaaaattatataggaaagttgctttagaaaataaaattaatccatttttgaaatttaaaatagttaatactcaattaatcatgcactaatggctcacctcgttttgcgtatcttcctaatcttctcaatccccttctcctcaaactcaccgactttatcctaagtcaagctcctctaaatttgatcaaattttaataaaataatattttctacagcaaacaaatatattataaaaaatatttaataatgaatttaataaaataagataagcaattgtccctttttcgctattaatttggtaaatttttttaaaaaattaacctaggttaaaatcaaaacaactcatgttctaaattggaagaacttgtcagacttaattggtactcctacaattttgaagcatcttctgacctaaatttcctagtcaaagattcaatgcgctccagataaatatagccaagacaatcacaggcaatcacagatccatcaacaaaaacttgatagcatgaaagatatggtggtggtgtagctagagtcggtcacatctggtccctacagtggagctggccaatctcttcctgcggcacggctcgccgtcaccgtcgtcctcattgagccgccggccaagccacagcttctccgccacggtaccctggtccatggcttccaactcgttctcacggtatcaccttccacggcatgaacccgtcctcattgagcatgcaggcctagtcctcccgccactacaatttgtctgagctcatctgcggcatgaacgcgccgctgcgcgagtacctaccttcgcttgtcggtgccctctgctcgtgcgctcgtgctcgacatgttctgcgcctgcgcccccaacataatatcgtcgctgccgagctcggagtacgggcctacttcgtccctccactcgtgtgccgccaccgccagccacctcgccgtcgccttttgcacctcccgcacatgcagaattgcagaccaagataacacaccagcttcggggagatcggccacgagtccctccggttcccctggcgagtcaaccgaagcgtggccactccgtgagcgggtggcgctggcggtggccggtgaggagcgggccgaagtggcagtcaagaattctggctcgttgcatcaagcttttgtcgagtttctgtgaggctttgggggcttacacgaagtcaggtgcaggcctgcatgtgggctgtgcggtaaccggctggcgaacacagccttaagtactggccggcaattcgatatgttctcttgatgggcttttagtctaaaggcctcggactatggctcagccgctcaggtgaccaacatctgccctggcacgaaaagtgtgcagtcgtgcaggttaacgaaaagttagtggttaacttccgcagcaagaatatagttggttctttttcagggttaaggtcgtgcgtgaatcgagccaaaataagactaccgtgtgttagcaatatattgtagcatgaagtatacggaaccatttggtgtagctccttagggcatctttggtaggtttttactgcagtgttctaattaagctgtgctgtacagcgtaatcgttcggctgcacaaacacatagctgcgggaagctactgcttgctattggatggctgtggctactgtagctacagctaggccgtccgaacaaagccttaatcggcacaagttttctatattatttttatatttaaaagctctcttaacgtttatactggtacctttcacattacgatgggttcatatggggatggactgcacatgcccttagacttggacaagatccaatgtattattctcttaactaatcgtttggtttttctggttttctttttaatagccaaccatttgattattttttcccccgaagatggggtggttacgcaggcaatgtagggacagggccggctctacaattttgagggccctaggacaaacttgacaacatgatccttaacgctctctcccctatagagagacgtgttatatgtatattcacattttttgggttgttcagattaatgtcattttaaaccatatcaatttttgataaagttgttaaagatgtgcatccatttagtttttttaccaaactttagtaaatacataagaaatcctgctaaaactaggcaatatcactaaattgtaaaaattttggtattgccaaaatttggtaagatttattttggctacaatatgaatggccccttcattttcaaagtgtgttttcaaatctaatcatagagagaaatgaacattgataatatttcatatatatgtttttagaaatagaaaaatatcaacacttaaactgatcttgtttatttttcccatttacttagcaccataaaaatgcttcttgagtaaaattacaacttatcagcacctaaaattataaaggaaatatatattatcaacaagaatctatctatacatacaattttgattgttgaatatagaatctttattaattcactaatcagtattatgtagataatagtagataaccaggagtggtagatagtatgtaattattcactaatcttaaaataatacttcggctcatacagtactcatacaattttaggcatgggcccctagctaggtcgggccctaggccgtcgccctcattgccatgcggcccatgccccagagccgggcctgtgtagggaggatgggagtacgattgcatagagatgacgacgttggctatat

SEQ ID NO: 17360 - DNA, 18712 bp, Oryza sativa
cagatatgatcaccagtgggactcataccgagcccgcatgtgtagagtctttgtttcctccacagtagggtgaaaaagtggaatgctaggggatgggatacgtccctccaacgggatagctcctctccacacgcgattcttatccatacactcacttgccgccatcaccgtcccccgccgctgccgcgtccgtcccccgtcgcctccttcgccgccgccgcgcccgtccgccgctgccgcagcgcccgtcccccgccgacgccgtcgctgtcccccgccgccgtggcggcgtccgtaccccgtcgacgccgccgtcgccgccgcgcccatcccccaccgtcgccgcgcccgtcccccgctaccgccgccgtcgccacgcccgtcatctgctgccgccgtcgccgtcctcgtctacaagggacggctgctggggcgaccgcgcgtgtcggggtgctcctctcccaacgggatgcccaactatatctagtaggaatcacctgatacctgataggtatcatccgatacctcgcaagtatcacgtgatacatggtagaaatcgtctgatacctcgcgagtatcacgtgatacgtggtagaaatcgtctgatacatgacaggtatcgcatgatacctcgtgagtatcacgcgatacgtggttgaaatcatctgatacctgacaggtttcacatgatacctcgcgagtatcacgtgatacgtggtagaaaatcgcatgatacctgataagtatcacatgatatttgcaggtatcacctgaaacgtgtgtagaatcgtctgatttctgataggtatcacacctgatacctattcgggatcatcctgttgtgtagaattgtctgatacctgataggtatcatacctgatacctactcaggatcatcccgttcgaaaatgggataccgttatatagcagcccccggagaaaaatcatgacttctggatagaagctatcttgccacgatacggtagcacgacaactcgagagaatctatcattaatgcgatggacatgctcaatagctggtgcatgcaccgcatgttcgcatccgaaagaagcatgaaatcccgtgagacatgtctataccattcttgagcaagcgaaaactccaggaactttaatttaatttctctacctaatgtcttattttaataattacatctattcttcttttttattttagatttattcttaatatcagtacccagctctaagtccttatattttaattaagagtaaagtccttatattttaaaacagagtgagtattttagttcttaatagtgcatttatttgctgtttgttgatattggtgtatttttctataagacgattaaaattagagaattttgactctcaacaaaactaaaattacttacaatatgaaatgggagtatatttcataacttcagagaaccttcactgaaaagaatcgatatggcccaaaaatgataaggacggagccacagaccgttgaagtatactcctttcattttttaaatagatgatgccgttgacttttggacacatgtttgatcatttgttttatttaaaaattttgtgcaaatgtataagatataaattatgcttaaagtcttttaataataaaacaactcacaataaaataaattataattatgtaaatttttgaataagatgaatggtcaaatgtgtgcttaaaaatcaacggcatcatgtattgcaaaataatagagggagcatttttttcttcgtgccccagaatgacaaggactatacacggaaccatggactgatgaactactggtctatttgtactccctcttcccttcagaaagcctcctttcattttttaaatagatgacgccgttgacttttggacacatgtttgatcatttgttttatttaaaaattttgtgcaaatgtataagatataaattatgcttaaagtcttttaataataaaacaactcacaataaaataaattataattatgtaaatttttgaataagatgaatggtcaaatgtgtgtttaaaaatcaacggcatcatgtattgcaaaataatagagggagcatttttttcttcgtgccccagaatgacaaggactatacacggaaccatggactgatgaactactggtctatttgtactccctcttcccttcagaaagcctgtactgtacctttatgagccgggtcccgctcctgaatcctaactagaactagaacacatgtactttataccggcttctgaataacatgtaaatctgtagagttagtacagtagatacatagcattataaaaacagaggaggaagtgtatttcggcttgttctttcctagccactctcctatccgactagatggattctaattgtccgaatgaacattcgcttgtatgtcaacaaaatgctttcaatatttttaaatgataagatagattaatatgtaatatttcgctccacaaacatgtaagttaaaattcaattttgtataaattgtaataaatataacaatttagacattaactagcatatgtatattcatgttaaatttgttatttttttactcataaaaatcaaatttaaacttatatgtttatggtgggtgatatattacattgttttgtttcttttcgtgctgactccgttctgacttccgaccacttcaccaaactgggctaattgaccgctttactattgaggcattgaccaccgtcttttgatccacaagttttcttcgtctccctctagagaacttttatattggcagaatatactatcaacaaattgtaccatagaagtcatcttgttaacgtgaaggaaaaccgtagtgcgatattaagtacgatgtgtattgctatcaataggaagcagcgatatataatattcatcagtttttaggtgaaaatctttgaagtgtaaaagtagtataattggggtataattacaatgtaactctcgtatgtaattgagtaaaacatgttggtgcttgactagctagggttgcaagcttgctactcccactagcgcacaaatgtgcgaattttttaatttcctctcttcacgcaaatctcggtacaatattccaacgatcaaaattcataagttttgaggggaaaacatcggcgtaattttttttagcaattccgatcaatgaatcaacgcaatgcccatcaagccatgaacatcgaaaataatgagtgaatgacaacgttgtaccgaccgcgccgatgtgcaatcctggtccaacaatgccctccgagcctcccctcaacatattttgctctacaaaagttctctactaactcggaagagcaccactcatcccacatcgatcgacgccaaactagctagctactagcaaattgaagccaagatgaagaagaccatggtgctctaccctggcctctctgtcagccacttcctcccgatgatgaagctcgccgacgagctcgtggagcacggatacgccgtcaccgtcgcactcatcgacgacccgctccaaaagcaaatcgccttcacggccaccgtcgaccgcgtcatctcgtccaagccctccatatgcttccacaggctaccacgcgtcgaccaccttcccgccgtcaccaccaacgacggcgaattctacctccccgggtatctggacctcgtgaggcgacacaacgagcccctccatggtttcctctcttcccatttccgcggaggcatacaggccctcgtcgtggatatgatgtccgtcgaagcgctcgacatagctgagaggctcaaggtccctggctacctcttccacccatcgaatgcaagcctttttgccttcttcctccagattccgtccatctgtgcagagagtaaacggagcttcagtgagctaggagacacccctctcgagatccctggcctccctcccatgccggcctcccacttcatcgacaatcggcccgaggagccgcctgagagtgaagtgtacaaggccgtgatggatttggttcgcaggtacactaataaatgctccaatggcttcctcgtgaacactgtcgactcgctggaggcacgggtggtgaacacgctcaggcacgcacgccgtcaaggcggccgggcgttgccgccgttctactgcgtcgggccgttggtcaacaaggccggcgaaaggggagagcgacccgagaggcacgagtgcctcgcatggctcgaccggcaaccggaccgcaccgtcgtgttcctctgctttggtagcaccggcattggcaaccactccacggagcagctcagggagatcgccgtcggcctggagaaatccggccaccgtttcctgtgggtggtgcgcgcccccgtcgtcagcgacgatcccgacaggccggacctcgacgcgctcctcccggcggggttcttggagcgaaccagtggccaaggcgccgtcgtcaagcaatgggcgccgcaggtggacgtgctccatcaccgggccaccggcgcgttcgtgacacactgtggatggaactcggtgttggaggggatcaccgcgggcgtgccaatgctgtgctggccgctccactcggagcagaagatgaacaaggttctcatggtggaggagatgggcatcgccgtggagatggtcgggtggcagcagggccttgtcacggccgaggaggtggaggccaaggtgaggctggtcatggagtccgaggcaggcgtcgagctcagggcgcgcgtcacggcgcacaaggaagccgcggccgtggcttggaccgacgttggctcgtcgcgcgctgcgttcacagagtttttatctaacgcagacagccgacagacatcgtgagttcgtggccgtatcgtgaactccggacatgggtggaggcataagtctaacgggtgaccgttcgagcgcagcccggacacgctagcgcattcggcccagtccacatgcattaggccaatcatgatatgctattccaagaaaaacgtactacctccgttttttaatagatgacaccgttgactttttctcacatgtttgaccatttgttttatttaaaaaatttacgtaattataatttattttgttatgagttgttttatcactcatagaactttaagtgtgtttatatcttatacatttgcataaaatttttgaataagacgaatggtcaaacatgtgagaaaaagtcaacggcgtcatctattaaaaaacggagggagtataaattttgttgtatatgtaaaatttatatatacttggtacttgctgaatacccataatttaccaaaaataaaaatatattataatattgtctaaaagaaatacagataagattcctataggatgtgttataatccttttgctatagtaaatattcaccttgttttggtttaatatatactccctccgtcccaaaaaagacaaaccctggtttccgtgcccaacatttgaccgtccgtcttatttgaaaaaattatgaaaaaaattaaaaagacaagtcacgcataaaatattaatcatgttttatcatctaacaacaatgaaaatacgaattataaaaaaatttcatataagacggacagtcaaagttggacacgcaaacccagggtttgtctttttttggggcggagggagtacgtggctatccattgaatttgattgtcttctaatattaagaagtagtaccccatcacatattatgagattcaccaatcacatgcgccttgttgtcacgtcgtctatctttgaaaagataattagttgtaaattgaagcaccgtaaatgcgaaatcaccatgtgcctcgctgtcgacgggtacatcatctaccactgaaagaataattagccataaatacgagcaccggtgccaaatctagaacttgtacctggatgaacacgttccaccaccagaaatataataaattgagttacactcacgttgtagatttgatagtaagttcaacaatactatctttgtcccaaaatataagatgatgtggcagagctatagtttctatggcaagctaaggtctggtaatgcgttaaatgtgacataactaacttgtgtcttggtaagttaggacaaccatccgaatagccccttatatttctttttctttatgtatcagagagtttcttctcacatcattgaggcgcactgtacacctaacagggaagtggatttcttttctgggaggacatctccttgttttgtagtgtttgaaaagtcatcaaaaaattataaaaaatgccaacaaatagatttgtatatgataatttttttacaaatatacaagttaaaattcgacttatacaattcagaaaaaacaacaaatttgatcacgaattacatgttctattcgtagtaaaatttgttattttttttccaattgtacaagttaatttgaacatgtatgtttatggagtggcatatcacatattgatatatcttaatttttttaatttttttaaatattttttcgggtgacataaaaaataaaggacatccccttaattcatgtagactttcccaccaaaaagaacttaaatggtaggagctcaggctcagcacccacccacccccacactacccatctcatcaaacagcgttccgaatcatcaatgatcgcgttcattcgtcgagctttaactgccaccaagctttcttctcccctcaaacgccagatcgtcgggagaccactcagtaatttccgacgtagactgcaaaccagctagaaaattcagagcccacaatgaagaagaccatcgtgctctaccccggggtcgccgtcagccacttcctccccatgatgcagctcgccgacgagctcgtcgaccacggttatgccgtcgccgtcgcgctcatcgaccccgccttccagcagcacaccgccttccctgccaccgtcgaccgcgtcgtctcatccaagcccaccgtacgcttccacaggctcccccgcgtcgagctccctcccgccaccgccaccgacgacggcgacttcctcctcctcgggtacctggacctcgtgaggcgacacaacgagtgcctccatgatttcctctgctccatgcttcccggaggcgtacacgccttcgtcgtggattctctctccgtcgaagcgctcgacgtcggcgagaggctcaacgtccccggcttcgtcttccacccggcgaacttgggcgcctttgccatcttcctccagcttccttcgatccgtgcagagggtgagccgagcttcagggagctaggagacaaccctctcgagctccctggcctccctcccatgccggcatctcacctcttctcccaatttctcgaacacccagagagtcaagtgtacaaggccatgatgaacgtgagccgcaggatgttaccgacttggaagagaagcaagatattttcagagaatcagagagaattcggaagaagaggagaagaaacagagagaaagacagagatgtagagagagagagagagagagattgagtttgtattgagttggaaattctgtctttacatgtcatcctcccgattctctctccctcctttatatacagctagttaacccagtttccacccttatacttcgggttgggcctagttacacgaacatgccgttgctgggccgtactctgaacagagccagcgatcttggacacttgttcctgttcatcatcaggtgtgccggtgccggatgtaacattcccccttccttgaaacacagcttgactccaagctgtggcagaaggaaagcgatgccttaactcctccagatcttcccaagaagtggtggaagacgaagtaccagaccaacgaactaaagcttgaacaatcatcttatcaccacgacgacgtagccgctgttgcagaacctctactggagtagccagatgcccagaatcaggatccaatcgtggtaatgttgattgaacaacttcagaagcagctactgctttcttcaattgagacacatgcaccactggatgaatcaaactggtagcaggtaattgcaacttataggcaacagaacccacacgctgaaggatctgaaagggcccatagaacttgaaagccagcttctgattagcacgagtcatgacaaattgctgcacataaggctgaagcttcataaaaacccaatcagcaaccgcaaacacacgatcagtacgcttagaatcagcctgactcttcattctttgttgagctcgaaccaaatgatgatgaatcaaactttgcatgttatgacgatcctgcatccaactatccaatgcactaggcaccccaaccgaatccactgagagcccaaaatgacgaggtttatgaccaaacattgcttcaaaaggagtcaacatcaaggcagaatgaaatgaagtgttgtaccaaaattgagcaagagataaccactgactccacctagatggacaagcatgaacaaaacagcgcagaaacatttccaaacattgattcacgcgctccgtttgcccatccgtttgtggatgataagaagagctcattcgtaattgagtgccagaacgccgaaacaattccttccaaaaaaatactggtgaacactcgatcacgatcagaaatgatggccagcggtagtccatgtattgaatgaattctgtccatgaataattgtgccacagacacagcagtgaatggatgggataaaggcaaaaaatgagcaaacttagtgaacttatccacaatcaccaaaatgctattataagaggctgaacggggcaatccttcaataaaatccattgatatgacttgccaagcatgttcaggtatttgaactggttgtagtaaccctggataaggcacatgttcaggtttagcttgttgacagactacacaactgtgcacaaaatcctgcacagtttgccttaaacctggccaagcaaacagctgcttaacgcgctgataagttacttgaattccagaatggccccctagagcagcagtgtgcaaatttgctagaacttgctgctgaaactgccgattattgcccacccaaacacgtttcttgaaataaagaataccattttgcaactcaaaatgagcagaatgaggtgtaccttccttaaaagaatgcaaaagctgaagagcttcgggatcagatttataacccgaaacaacatcctgtaaccaatccggtagaccaacagataatgcactcaaaattggaagaccatcagaagatctacgagataaagcatctgcagctccattctctaatcctttcttgtaaacaattcgataacgaagacccaacaacttagtcattgctttatgttgccaagaggtggttaatcgttggttatcaagaaaggccagactgcggtgatcagtgcgaattaaaaattcctcgtgttgtaaatacgagcgccaatgatcaacagcaagaataatagccagactttccttctcataagtggaaagaacttgagtccgaggtcctaaagccttactcaaaaatgccaccggatgctgatcttgcataagcacagcaccaattcctcggtcagaagcatcagtctccaccacaaacattttctggaaatcgggcatgaccaacaccggtgctgatatcagactctgtttcaaagtgtcaaaagctttttgatggtgttgagtccagataaaaggctgccctttacgcaatagctcagtaaatggcttactaatgatgccaaaatgtcggacaaacttgcgataataccctgcctaacctaggaagctgcacacatctttaacagatacaggaactggccattgccgaaccacctgaatcttttctggatctgttgaaactccatcagcactaataatgtgccctagataagacagttgagtctgtgcaaaagaacatttggataatttgactcgtaactgatgcttactcagagtctcaaacacctgacgcagatgattcttgtgctcctccaaagtgcgactgtataccaaaatgtcatcaacaaagaccaagacattttgacgcaattgatcagctaaaactgtattcatcaccccctggaaggtagctggagcactcgtaagtccgaagggaagcaccttgaattcaaaatgaccattgtgagttttaaaagctgtcttagcctcctcaccaactgccatccgaatttgatgataccctaaacgcaaatcaagcttagaaaaccagcaagctcccgccaattcatccattaactcatcaattattggaagaggatacttgtttttgacagtgatagcattaagatggcgataatccacacaaaacctccacgtgccatctttctttttgactaacaaaacaggagaagaaaaaggactagcacttggctgaataattcctttttgtaacatatccttaacttgtttttcgatctcatccttttgagcaggtgtataacggtaaggtctcacattaactggcacagccccaggaatcaaaggaattgtatggtcataatctcgagcaggaggtaatccacttggttcctcaaataaatgagagaattcctgtaccaaagactggacagcatctggaattgaggataactggtctgtagaatcactgagggcagcacataagtgaaccaaacctgccactgagtcgatactgtgcagatgctgtaaatgctgactagaaatcaaagcacaatcagacgtattggactgcaccccacgcaacaaaacttcatgacccataactatcaagtgaatagacttaagctgccaatcaatgtgcattggactatacttagttaaccaatccatgcctaatattgcatcataacctcccaaagccaccactttaaatgtggtcaagaacttctgaccactaacaaaccattcagcagaaggcatttctttctgacaatgcaacacctgtccattggccaccttaacagacagaggatgagctaagaactgaactccagtaagacggtcagccaattgatcactgacaaagctagccgaactaccagaatccacaagcatcagtatattcaacccctgaattttgccttgtaaccgaatggtagactgagaatcagtaccctgaacagcatgaactgacatagctaacaatgaagaatcactatcttcagaagatatgccagcctgatcctcatttacgttgtcaggaaatagtgcaaagagctcctgaacagcgtgaagctgaactgttcctgaacatttatgtgtcggcgaccacttttcggcacataagtaacacaaaccttgtgcacgacgaaacgatcgaagtgcactaaccttgtcagaaagattagtaccccgattgagctctccacccttcttctcctcagatttcagagccttggttggtggcaatggtaatggatatgcatttttaaacttctgcgatccatccccaaatttcctttgctcttgattccgctcagacaactcctcctgtaatagagccaaaaccagagcagactccaaatccttggggcaatgtaacaaaacagctttgcgaatgtcaaaacgcaacccttctatgaactggtgaaccaaattcaaagtgttatacataggatcatacgtcaacaactgattcatcagatcatcaaaccattcataaaactcgctcactgaaccggtttgtttaatctgatcaagctgtcgaatcagttgccgatgttgatttctatcgaattttcggttcaccgcttcacagaatcgaccccaatcgacaaaaacttcatgagcacgagatgaacgtagccaagacgctgccctccccatgaagtaaatggtggctacccaaacccacaaatttggatgagttccataaaccccaaaataatgctcacaacgcaacctccaaccctgtggatccgagccatcaaactgaggaaaatccaactttggtagtctatgattgaacccttgctccccatgcaaatcccgatttccccgactcgaatttgcgccaaactcaatcccatgaggaacagaaaattcagtgggaatttggtacgtacccttgaccggaggtggcccgagagtatgaactacccccgatgccttcccccggtgaaaatttgcgacgcggtggccatctggaccgagttcgctcgccgctgttccggaaaacaacggcggcgtgctgggcgtaggaagcagaggagtttggtgactcccttcctccgccatccttgacgcctgcgaggtgttcgacgaattgccgccctcctcgctctgcttctccaacttgaggacatgcagcttcagctcctccatgtcgtgctgcaacccttgtatagcagcatcaacttgaggtcgccatccagccacagatttgtccagtttgagcagcatctcttgtgtctctccttgcttgacgaccatggttccgatcgccgcttgaatctccaacaaagtcttctcgaatccctcgttttgcttcgccatgtcgtcgacttggatctgaagatgagttttgaactgaggtttctccaggattgcggctctgataccaaatgttaccgacttggaagagaagcaagatattttcagagaatcagagagagttcggaagaagaagaggagaacaaacagagagaaagacagagatgtagagagagagagagagatattgagtttgtattgagttggaaattctgtctttacatgtcatcctcccgattctctctccctcctttatatacagctagttaacccagtttccacccttatacttcgggttgggcctagttacacgaacaggccgttgctgggccgtactctgaacagagccagcgatcttggacacttgttcctgttcatcatcaggtgtcggatgtaacacaggaacgcgcaatgttccaaaggtttcctggtgaacacgttcgagtcgctggagccgcgggtggtgaacgcgctcagggactcgcggtgtcaccacggcggcccggcattgccgccgttctactgcatcaggccgttggtcgagaaggccgacgagaggagagatagagcagagaggcatgagtgccttgcgtggcttgacaggcaaccggaacgcagcgtcgtgttcctctgctttggcagcacaggcgcgggcagccactccgtggagcagctcagggagatcgccgtcggcctggagaagtccggccaaaggttcctgtgggtggtgcgcgcgcctcgcgtcgccatcgacgacgacgacgactcgttcaatccccgtgccgagccggacgtcgacgcactcctcccggcggggttcttggagcgaaccaccggccgcggcgtcgtcgtcaagctgtgggcgccacaggtggacgtgctctaccaccgggcgaccggcgcgtttgtgacgcactgtgggtggaactcggtgctggaggggatcaccgcgggcgtgccgatgctgtgctggccgctgcactcggagcagaagatgaacatggttcttatggtggaggagatggacatcgctgtggagatggccgggtggaagcagggccttgtcacggccgaggaattggaggccaaggtgaggctggtgatggagtccgaggcaggcagccagctcagggcgcgggtcacggcgcacaaggaaggcgcggccacggcctgggccgacggcggctcgtcgcgctcggcgtttgcccggttcatgtcggacatggaccgtacagccaacatccgctaggacaacgtgaattcgtgaccatccaagacacaggatattacgcctttccagagtatcgtgcatgacgctcgcccaaatctgtcctttcttttttttgtttctgattaagcctaatgacgttttcactccttttttagcaccattttcccctgaaacgtacgtgtgcgcaagaacgggtttccccgtgcacacggccacgcctacgtgttcattgaatattttctcattgtaaactttactaaatatgttttaaatgtatatgtagaaagtttccttataataatggaaaattaaaagtgctcgtgggcatgtgtaacatcccagcttatgacttaataggatttatagaatactcatatcaacaagttgcaacttttttccgaaagccgaacaccgactaggaaattcttcccgggtgcatacgagtggtttggggcaatttcgggatgggtgactgactggaaaattctttccggatacacacgaatgagggcagtctatgacatctgaaagctgccagatgtaagcgggcccggcctgggagaggcaagatgttacagcatgggaaagggaaaaggctgaaacgagaacataatattgatcattttgactttgatctatcgtacttttgagttcacaatctcactgtaaatttacgaagattttatccatcatataaatgctcatattttttaaattttttttatataagagtacgtcaaaatggttaacagtatggttttataaaattttagaatttacgtattaaaatttatatagtttttcttatttagaacataaattatgtgctacgtactaggagttttatgatatagtgctatcaatcataaaactcagatgatcataaaactcgaccaagagaacagacagaaggaaagaaaagcatatgatcacactgctatgatatagtgctatcaatcattcaagaatgcaataaacacagatgagtaaggccctgttattttcttatgaagattatgattttccctccatttccattagcatgcttttcaaactactgaacggtacgtttcgttatggaagttgctttaaaatatcacatatatccatttgtgcatcaactttatctccatcaacttggtctttatctcgttttatgtgaaaagcattggccccaacccgcaggcctacatgggctgcagaaagggctgtcagggattgcacgttagagtatctccaacaatctctctatcccactctccaagccaaaatttagccattatagacaaaaaaaaacgtattccagcagaatttctatccggcttgccaagccatccggctggctaaactcccccagtgagtggccagatttggccatgctatttggcttgctaatggtgagccccaccttccttctctccccgtctgcagccgctgtagttagtcccgtcgccgtagccgaggaaagcggaagtgggaggcgccccactgcggcgcgatagcaaggagggaggatggcgagccggagccgaagctttgccgccccgctgcccctaccctccctttccctgccctcttgcgccatctcccgtgctcgcctcgttcgccatctgcacaaccgccgttgtgccgtggtctggatcgccatccactcagttgcctatcgtcgctgaggtctgggccgccatccgccaccaccttcatcttcaccacctcccgtgctcacctctccgccaccatcgtcatcggggccgccatccccaccgccaacttcgctgtcggcgtccacggatatggatcggaggacctcgttggaggcagcgggtgcaccgacctcgagcgcattggggaatgctatggcggcgtgggcggggaccaggggtggcagtgtggcggtggggatgagagaggcggtggtatggagagagaggagaagaataggagagagggagaggaggggttgaaaaagggtagtgagcctaacatatgggactcactatttaggttggacagtgtaatagagagtctattggagtgaaatacaaatttggccatccaaatttttgacaaactggccaaatcaatatttagagtcaaatttgaagagactgttggagatgctcatacccaccagctcgatggagttgttgtgtacatatgtgtgtgaaatcgttgtaggaatcattgtcttgagttatatgtcgtgatgaacaattggccatggtgatggttagtccgattgttgaattgttgtggttgtgttggtgaagggtcggtgtacaggtggtccaaccagagcttaagtccgattagaccggatgcgcatgggcggccgaactgatggctgaggtgcaattagaccagaacattcttgattatattggattttgagttatttttttatgttaattccgtgatgtttatggcttccaattatttcgtatgtgtattgggtttatgctaatgtgagtttaagtaagaaaagtcggatatggtttcttcgtttcccatatataagtgttgcttaaggctgaaaactgtctatggtggattggaattgacttaagtatagttgtcctaacgatcaagaagattatacaatatgctaaggctaaagattgaacaataaactggagatggagtttttgtttggcataagcgagatgtgtgtagataaaagaaaaagtcaaagttgaaaagagtactatctgaagtaggatttagggtttgaatttacaaagagataaaataatacatggtttgggaggcttttctatatatagaagtaggattcctaatttaagtaggattttggcttttgtggagtgcctttatgtacaaataaataaggttgagcatcaagaggtaacacttttttaaggtgaaaaattagggttatctttaggtcttgactctcgagttgagtttgaaagttgagagagaagtgcttggagacactttataaacacatcttgatgtaatataaagttgatcagcttattttgtcgagttgtgtttttgtcttctaccagttgtcttgcacgagcaccagcggttagactggaggaacactgactgtcagatcgagatcccatcaacagtcgaaccaacgatgtaaagatggtcagactaaaattccaacaccggtctaccaactttctgaagctagctcaaggaacgtattaatggatgaacaacccaacccttagggtccattctatattttagagctcggttctttcaacttaaaaaagatttttttttatgatctccttgttcaccttctctggtagtcttgcttcttatgcttaatcctacaatatgaactacatcgtgttaagtgattccatctaaaaacaatccactatttcccttaaattcagcatgtgctctgtgaagaggccaccaaccttgtttctccaccgttcccatatggtgatgaaatgcgcgattggagtctgtgttaatattatctactcgccgcgctcgatctcaatcccctttcagccgacgagcaggggcaatttggtctcatcaagtagaattccaacgaaaatggaattgaaaatgacgaaaatggagaaaatggcaaagtagctgtgatctcgcgctttagattggcattttagcgaaatgcgtttttgggatggcatttcagcgaaaccgctttttgaacgtggccaaatgtccattttctccatgggaaggggagctggtggtggcaggggagcgatggggcgaggggaagggaaggaaccgatgggggcgatgtgcggtggtgctggtggcgacaatggacttcaaaggaggagaaatgtgactgtggatctaggtttttgactgggagaagaagggtagagagaagggttttgtccccttttagcccgtgcaatccattttttctagcctattgtgcgctcgacttggtgagctaatctaaatttctgcccccgtgatgtaccctttgccgactgttggcgtgaaggcaattgttttgtcgacagataatacgttgcccatgaatcaccgacattttgtttgtctcaaaagactagaatcgccgacacataatacgttggcagtgctatatacatatttgcctacaaatgatgtgttctgtgtaccgacgttttgccaacagtagtagtcagttggtgaagatgggccatcatgtagtgattgtctaaaataaatataaataagtttacctatttaagtacagttatggatttccgtatccaacgtttgattgtccgttttatttaaaaagtttataaaaaattaaaaaaatagccatacataaagtactatttatgttttatcatctaataaaaaaaatattaatcatcaaaattttaaataagacagacggtcaaatattgaatataattggatataaacagtttaaaactatactcttctaggatagagccacgaaggtaatattaaacttgctcctaggagagtatagtaccactacccacctcaccaaacagacccccatcataaatggctgatttaattgggctgtactccctccgtcccaaaaaaagataaaccctggtatccgcgcccaatgtttgaccgtccgttttatttgaaaaaattataaaaaaaataaaaagacaagtcatgcacaaagtattaatcatgttttatcatctaacaacaataaaaatacgaattataaaaaaatttcatataagacggatagttaaagttggacacgcaaatccagagtttaactttttttagggcggagggagtatatatggggcaatctagttctcttctcccctcaatcaaacgagccagaggtaggtcgggagaccactctacagtctaccctccagtgcctccacagtacaaactagccagaaaaattcaaagccaccatgaagaagaccatggttctctaccccggcctctccgtcagccacttcctccccatgatgcagttcgccgacgagctcatcgaccgcggctacgccatcaccgtcgcactcatcgaccccgtcttccagcagcacatcgccttccctgccaccgtcgaccgtgc

SEQ ID NO: 17361 - DNA, 17022 bp, Oryza sativa
cgacttctccctcctcgggtacttggacctcgtgaggcgacacaatgagtgcctccatgacttcctgtgctccatgcctcccggtggtgcacacgccctcgtcgtggaccctctgtccgtagaagccctcgacgttgccaagaggctcaacgttcccggctacgtcttccacccagggaacgccagcgccttcgccatccacctccagcttccattgatccgtgcagagggtcagccaagcttcagggagctaggagacacccctctcgagctccctggcctcccacccattccggtttcttacctctatgaggaacttctcgaggacccggagagcgaagtgtacaaggccatcgtggatttgtttcacagggatattcaagactccaatggcttcctgatgaacacgttcgagtcgctcgaggcacgggtggtgaacgcgctcagggacgcgcgccgtcacggcgacccggcggcgttgccgccgttctactgcgtcgggccattgatcgagaaggccggcgagaggagagagacagccgagaggcacgagtgcctcgcatggctcgaccggctgtgaaaatcagaggtgcagaagcgttgaacctcgttagtggccgcacctttgttaatatatggtgataacaaccatcaccgtggtttttacatccatatagcatgcagtctgttttgatggatagaagaggctaacaacctaacaaactctatcttatccaatctaacagatctcacacgcatgtatacaatatagtttcacagcccccctcaatcacaaccttcccaggttgagattgtgcttaaagttctctaactgtcttacaggcaaagccttggtaaaaccatcagcaacttgatctcctgtaggtacaaaatcaatctctaatagtttctgagatactctttctcgaacaaaatgatagtcaacttctatatgctttgttctggcatgaaaaacaggattagaagaaagatacttagctcccaaattatcacaccacaacttggccataggcggactctgcacttgtaattctgtcaataaagtctgtacccacataatttctgctgtagcattagcaagagctttgtattctgattcagtactagacctggaaactgtagcttgtttgcgtgcacaccaagatacaagattatctcccaaaaaaactgcaaaacctccagttgatcttctatcatcaagagatcctgcccagtctgcatctgaataagcactaacaagcatagacttggacttgcatagtttcaacccaagtttagtacactgtttcaaatatcttaagattctcttaactgcagcccaatgaacagtggttggtgcatgaagaaattgacagactttgttaactggaaaggcaatgtctggtctagtcagggttagatactgaagagcaccaactacacttctataatttgttgcatccagaggccctagtaagtcaccctcatgagcagataatttctcactagtagacaacggtgtacttactggtttacaatcaaacatatttacccttctcaggagatcacaagcatatttatcctgtgtaagaattatttcatctgttaccttgtttacttctatacccaggaagtaatgaagatctcccaaatctttcagggcaaactcctttttcaaatcctgcagaagagctgacactgcctcctgtctggagctagtgactattatatcatcaacatagataagaacaaatatgattagtcctcctttgttataaaagaataaagatgtatccccttttgatccttgaaaaccaagatcatataatttcttgctgagcctggaataccatgcccttggagcttgctttagcccataaagggctttatcaagcttgcacacatatccaggaaaagattcatcctcatatcctggtggttgtttcatgtatacctcttcttcaaggaatccatgaagaaaggcattctgtacatctagttgtctcatgcaccaacccctagacacagcaatagacaagacaatcctgatagtagcagctttgactactggactgaaagtatcttcataatctataccgtatctctgtttaaatccctttgcaactaggcgagctttatacctgtctagacttccatcttgttttcttttaattttatagacccacttgcagtctataacatttctaccttgcttaggtggaactaggtgccaagttttattattcatcaaagcctcatactctatatccatagcctttttccagtttgtattttgcaaagcatcagttaaattttttggttcaccagtcacagtaagaaaggtattcttgtatttaactgtgccatcggtatataccttctcttttcgaatacctctttgcagacgagtagttgggcgagacggcgcttgagtcacttcctcccctgtcgcgaacggctcggatgcagagatgtgtgatggtgacgggacatcatcattgctggcaggcgtcgcggtggcgtgactaggttggctcggcgaagagctgtcggccgagtgatgcgtcatcacgtcaggagaggcaggaaaatgtaccacgtccagggatgtggcagcgccgggttgactggcagcggtatctgatgcagacggtgatgcagcggtatcctgatggatctgttcagccagattttctgtggcaccggaagaatcatctgcttcatcattttctgcagaaacaggctgcacattgcttccaaaaatttgattagcaggattaacaggaatattagccatattgtcatctagctgttgttccccaggatttgatgttggatttaggagatgtgaaggaagcaataaaatttctgaacgaagtctagcaccggcgtttgtgtgaagtttagcaaagggaaaatttgtttcatcaaagataacatcacgggatatatagacacgacctgtggagggatcaagacacttgaaccccttgtgtagtgtgctgtaccccaaaaaagtgcactgctttgatctgaactgaagtttgtgtgtattatagggtctcagatgtggccaacaagcacagccgaacacccggagagaactataatctggggtttgattaaacaagtgctcaagcggtgtgaggaactgaagtagttttgtaggtgtcctattaataagatacacagcggcttgaaaagcttcatcccaaaattttagaggcatggaagaatatgcaagaagggtgagaccaacttctactatatgtctatgctttcgttcagctgagccattttgttgatgagtatgtggacaagaaacgtgatgtgtgattcctatctttgtaaagaaggagtgaagtttttcatattcacctccccagtcggattgcatggctattatcttcctattaaacaaacgttcaacaagagcttggaattcatgaaacttttggatgacttcagacttatgcttaatcaaataaagccaagtaaatttactataatcaccaataaagctcacataatattgtttgcccccaacagaagtgagggcaggaccccaaacatcagaataaataagttccaaaggatgactcgacatactagaagatctagaatagggcaattgatgacttttaccctgttgacatgcatcacaaaccgactgtttatttgactcagctaaacaaggaagattatttttgctaatgactttctccacaattggagaggctggatgacccaggcgactgtgccatcgctcaaaggatggcttgatggctccaaaggcttcttttagaggacgaggacgttcatgaggtgatgaagatggaagagcgtacagtcgcccccggcatggtcccctaaacagaagtttcttcgtggccagatccttaagattaaaatatttagagtaaagctccatgtaagcagaattatcagagacaagtctattggcagaaacaagattcttatttgcattgggaacatataggatattgcgaagatgaatatcacgatttggggttctaacagtagaatgaccaatatgactaatttccatacctgcaccgcttgcggtgtgaacttgatcttgccccttgtagcgatcgcgaaccgtgagcttgtccagttcgccagtcacatggtccgtcgcactcgtgtcgacgtaccaatttgtatcaatcccataagatgttgccgatcctgcatatttttcatcgggaacaaaatcttcatcatagcgataccagcagttgattaccgtgtgtcccctcttgtaacagagttgacatttaggtctgttgtcgacgcctcccggtggtcgtgcgccgccattgttgccgcgtcccctgccgcggttagcgccattgttgttgccgccacggccgcggccgccgttgccggtgttgccgccgcgttgttgtcctccaccaccgccacgtcctcggttcgccaaattgacagaagagtctccaccgtgacgaagcgcgagacgctgctcaaagctgagcagctgagagtaggcttctcccagcgtcatggtgtccttgccaacgatggtggagatgacaggttcatacgtgtcgtcgaggccggcgatgatgtaggagatgagatcatcgtcatcaacgatcttgccggcagccgtcatctcatcagcgagggccttcatcttggagacatactcgttgatggagagagtgcccttcttggtgttggagagagcgatgcgagtgttgatgaagcgcgccctcgtgacggaggagtacatctcctccagcatctgccatgctgctgcagccgtgccgcaggtggccacctgtgccagaacgtctctagctagggtggaaagcaggaatcctaaacctgctgatcggttgcaacccaatcatcaaattctggattgcgaacagtgacttctttctctcccttgtcgcctgctgtcgtcgtgatcagggcgttgggagttttggtggcaccggtgagatgcccctcaaggcgagctcctcgtacagccgccatgacctgcgctttccatagcgcatggtttgatttggagagtttctccgagatcgcgttcccgccgagaggattcccggccgccgtcttcgacgaactcgccatgagttggattagatgcgattttgtggatggataggctctgataccatgtgaaaatcagaggtgcagaagcgttgaacctcgttagaggccgcacctttgttaatatatggtgataacaaccatcaccgtggtttttacatccatatagcatgcagtctgttttgatggatagaagaggctaacaacctaacaaactctatcttatccaatctaacagatctcacacgcatgtatacaatatagtttcacaccggcaaccggaccgcagcgtcgtgttcctctgctttggtagcaccggcacgggcaaccactccaaaaagcagctcaaggagattgccgtcgggctagagaaatccggccaccggtttctgtgggtagtgcgcgcccccatcgtcgtcaataacgatccggagaaaccatacgaccctcgggccgatccggacctcgaagcgctcctcccggcggggttcttggagcgaaccagtggccagggcgccgtagtcaagcaatgggcgccgcaggtggacgtgctccatcaccgggcgactggcgcgttcgtgacgcactctggatggaactcggtgctggaggggatcaccgcgggtgtgccaatgctgtgctggccgctctactctgagcagaagatgaacaaggttctcatggtggaggacatgggcatcgctgtggagatggtcgggtggcagcagggccttgtcacggcagaggaggtcgaggccaaggtgaggctggtcatggaatccgaggcaggcaaccaactcagggcgcgggtcacgacgcacaaggaagccgcagccgttgcatggggcgacggcggatcgtcgcgcgcggcgtttgccgagttcctgttggatgcagacagccgacagtctcactagggcacctatggatctggcacatctaccttcaattcaaacatactatgtatctttgttattgttatatgagtccgataaactttaaaataagtattttatcattgacacgtgatgtgataaaccatgaattcacgtatcaacatgataaaggcacggtggcttttaagtcagaggatctcaatccaacatctatttgtcttttaattttttgtgttgtctaaaatactataaaaaaattatcgtttaatttaataagttagatcgatatatgtgatatatcactatacaaataagaaaaaataaaattaatttatacaattaaaaaacaaacaaatttgactcccaatttaacgcatagttccagtaaaaattgttttttttctaacgtgcagatccaattttagcttataggtttagaccccgtttagttcctaaatttttttcccaaaaatatcacatcgaatctttgaacacatgcatgaagcattaaatatagataaataaaaaactaattatataattaggggggaaatcgtgagacgaatcttttgagcctaattaatccatgattagccataagtgctacagtaacgcacatacgctaatgacggattaattaggctcaagagattcgtcttgcggtttccaggcgtgttatgaaattatttttttcatacgtgtccgaaaagcccttccgacgttcggtcaaacatccgatgtgacacccaaaaatttttctttacgcgaactattatgcagtggcatatcatatattcatctatcttcatacacacgatataaacaagaagatatcctctggtaggttaaaaattcatcactatagtactttctcagtcctaaaatatagctatttttagcacagtaccttgtcccaaaatgaagctatttttccaactacctcctctcaaccaatcacaatcattctccttcacctactttttcttttcaaccaattacacaccttctctaatcattctcacatacttttttaaataccagtaccaaccttaaaaatacctacattttaaaacggaggaattatttatcaccctatccatctacatgtgccctccgtcccagaataaccgtttcaggaattgtcacttcagttcagattttttgtccctaacccagcaggccagttagtactcacacgtgaacgttcctgctcgctgttcgtaatacggtagatgcgttttttttttaatctccaggatcagaaatgataccaccagtctcagaagatagtacatgtagatgagttaaatttccccccaaaaaaagttaaatttgttattttatatttattactcatatattaaatttgaatttaaatgtttatggaatgacatatattatattgatatatcatgtcagttttttaaatatatatataataactatttgaatactacctctgtctcaaaaagtagttttgcactacttatataccacatttgaccgtccgttttatttgaaaaaaatatgattcgtatttttgttgttattagataataaaacatgcatagtactttatgtgtgactaatttcttttaaattttttatattttttagataagacgggcggtcaaacgttgaacacagaaatccacaactacaattaatatgggacggaggtagtaccatatacttcctccgtccaaaaaaaataatctagtattagtattagatgtgatatttttaagtacaacgaatttagacaaaagtctgtctagattcattgttgtattagaaaatgtccaatccaactaatttaacttatacaagttgatacaaaaataacatatttaactttgtatttaatgtgaattttcacattcaaaattattattttgtttatacactatgaatttaatgtggattttcacattcaaatttattattttggtttctaattgtatagatggaatttgaacttgctcgtgtatagtcagtcatatatcacatatgaatctatcttattaatttttttaaaaaaaataatgactttttaatcgacatgcacaaaacgagtaatgtctcatatgaaaaaaaaatccagcaccatctacacgtaaccctcaatcctcccaatacaatataacgaagccaatcccaacaaggcgacatggggcatgtaacggccggggctacaaaccgtgtaaaaaatgaagggattatcttaaaaaaaactgctgcaagttaatggctccgaatagtttttttttgtcttttttgttttcgttggatatacttccgtatcggtttccaaaaattgtcttaattattccctccatatttattttgagatagaggttgtagctcggttcggatccgttttgtagcaagttacccggccggtattcaactgctcgctgtttgtagtaatacgggaagatgtgattttctttttaatctccaggataaaaatgatacagcggtcgagctttggttggaggaaggactacagcctacagggaaaacgccgtttgcctttgtccattgaatgcttttgttgtggtcggtcaccttcgatcggatgcatttctgattctttcttcttggaaaagaagggctaaagattgtcctacggggctcggtgctgtagtatgggacaaaggcagaggatgtgaacccgtatgactttatttctaactctgtatcacgatcaccggactaattgactttcccgactaataataaactctatcacgatctctatctgattcgtcgtgtccttattttactcctgtagacatcaccactgacggcggttcctaaaaacaatcaggcttgtgaatctcgaggcctaccggccaattaatttaatcacatctgttagttggtggcggcacagacgaacgactagaagccatcgatgtgtatcctgccttgcctgcgtgtgatgatcatactgtgatcccatcttgtgcagtactccatccgtttcacaatataatcattttagcattttacactttcatattgatgttaatgaatctagatatatatatttatctagatttattaatgtcaatatgaatatgaaaaagctagaatgacttacattgtgaaacgaaggaagtagtatacgccagacgtgagctctcttccttcctcgtctaccagtttactgaactgctgactttagtgaaagagtagtcctcataattcctccaaaactttataaagccaacgtgaaatttgtgttggttatgcaggtcacattggggcgtgtcaacgttgctcaccatggcttaccatacaacccctctatatatacttgtggctgtccgatttgagggcatttgtttccgtcttttttacatcccgtttgatcggaagttcggaacagcagcgagccatgacgacaaagacctttgtgctgttcccgtcgctgggcgtcggccacctgaaccccatggtggagctagccaagcacctgcgccgccgcggcctcggcgtcatcgtcgcggtgatcgatccgcccaacaacgacgccatgtcggccgacgcgatggcgcgcctcgccgcgggcaacccttccgtcacgttccgcatcctgccggcgccggccagcccggaccccggcgcgcaccatgtcaagcgcaacctcgacacgctccggctcgccaaccccgtgctccgcgagttcctccgctcgctgcccgccgtcgacgcactcctgctcgacatgttctgcgtcgacgcgctcgacgtcgcggccgagctcgccatccccgcctacttcttctttccctccccggccagcgtcctcgccgtcttttcccacctcccgtattactaccgcaacgcgccgtcgttgagggagatggataaggcggcgctcatccgatttcccggcattccgccgatccgcaacgtcgacatgctggcgacggtgaaggacaaggagagcgagacgaccaagatcaggttgtaccagttcaagcggatgatggaagggaagggcgtgctggtgaacagcttcgactggctggagcccaaggctctgaaagcgctcgccgccggtgtctgcgtgcccaacgagcccaagcagagagtctacttcatcgggccactggtcgacgcccgcaagaaggtagggagcggcgccgagaggcacgcgtgcctcgcgtggcttgacgcccagccgcaacggagcgtcgtgttcctctgcttcggcagccagggcgcgttcccggcggcgcagctgaaggagttagctcatgggctggagagctccggccaccgattcctgtggaccgtgaggagcccaccggaggagcagtccacatcaccggagccggacctggagcggctgcttccggcggggttcttggagaggacgaagggcagaggcatggtggtcaagaactgggtgccacaggcggaggtggtgcagcacgaggcggtaggcgcgttcgtgacgcactgcgggtggaactcgacgctggaggcgatcatgtcggcgctgccgatgatatgctggccgctgtacgcggagcaggcgatgaacaaggtgatcatggtggaggaaatgaagatcgccgtgtcgcttgacgggtacgaggaaggagggttggtgaaggccgaggaagtggaggctaaggtgaggctggtgatggaggccgaggaagggaggaagctcagggagaggctggtggagacgagggacatggcgttagatgccatcaaggaggctgggtcttctgaagtggcatttgatgagttcatgagagatttggagaagagcagcttggagaatggagttcgcagctgatcaagcagagtatgggtcatgactgcattagtgtaccaatggcgtcagttaccacatgaaatgtttgcgatttttgttaagttagaagcaaagttgtccgcatagcgatgtttttttcgtcctccgatgacggacgcaattgtctcccgtgtccaaaagttgcagtgtcaaccatttctgtataagcaaattaaaataatgcatagtcttcaaacctgaccaatactagcgaccaattattcagagccacacaaacaacatgaacccactagactggaaatcactggctctagtcaaatgcaaattctctaagctaactgaaatgcgaaattaaaaaataaggaatactagaagaagagtatagagtccatatagaaatacaatttaaaaaatagaaaataggaaataaaaaaaggaatattagaagaagagtatagaatccctacaggaatttagaattgaataaatttcagaataaaaataataaaattaaaagtagagcttagagtccatatagaaataaaatttgcaaataactaatattcaaaattaaaaaaataatatgggaagaagagtttataattcatataggaatataatttagacatactgaaattcgaaatttaaaaaataaagaatattgaaagatgagtttagagtccacatagaaatacaattagagatcattgaattcagaattaaaaataaataatattagaagaagagcctagagtctatgtagaaatataatttacaaataacaaaaattcagaattaaaaaataagaaatattaaaaagacgagtctacagtccatatagaaatacaatttagaaataactaaaatttaatattaaaaataattaataactatcacgtatatacagtacaacatgaatattacacattgatagtttggtaaagttagtacaaaatttaaaattatgttatcattttaatatattttaataaaaaaagaaaatataataatgctagcctcgcaatttgcgcaaacctctatactagttcttattaattttttaactcatccctaattatatggatctggtccgttacaccgtacagaataaaaactttcttttcttcgtcattgctcacgaaaacggccgtgacgtgagctacctggtctctccttcctcacgtagacttctacaaagcccatgtgaaatttgtgtcgatcatgcaactcaccgtgaaacgtttcaatgttgctcgccatggccttctttgccaagaaatgggttaccattcaacgccgctcgcactatttagcttgtgggttgcgagattatattggtaagccaatttgagagcatttgctacgtttttatgcatactgtttgatcggaacaactcgtagccatgacgacaaagacgtttgtcatgtacccgtcgctgggcgtcggccacctgaaccccatggtggagctagccaagcacctgcgccgccgcggcctcggtgtcgtcgtcgcggtgattgacccgcccaacaacgacgccgtgtcggccgacgcgatggcgcgcctcgccgcggccaacccttccatcacgtttcgcctcctgccggcaccggacagtcctgacgtcggcgcgcacccgatcaagcgcagccacgacacgctcaagctcgccaaccccgtgctccgggagttcctccgctcgctgcccgccgtcgacgcactcctgctcgacatgttctgcgtcgacgcgctcgacgtcgcggccgagctcgccatccccgcgtacttcttcttcccatcccaggccagcgcccttgccgtctttctccacctcccgtattactaccccaatctgccgacatttatggagatgggcaaggcggcgctcctccgctttcccgggatgccgccgatccgcaccgtcgacatgccggcgatgttgcgggacaaggatagcgaggcgaccaaggttaggttgtatcaattcaagcggatgacggaagcgaagggcgtgctggtgaacagcttcgactggctgcagcccaaggccctgaaagcgctcgccgccggcgtctgcgttcccgacaagcccacgccgagggtctactgcatcgggccactggtcgacgccggcaggaaatcaaggatcggcggcgagaggcacgcgtgcctcgcgtggctggacgcccagccgcggcggagcgtcgtgttcctctgcttcggcagccagggcgcgttcccggaggcgcagctgttggagatagctcgtgggctggagagctccggccaccgattcctgtggaccgtgaggagcccaccggaggagcagtccacatcaccggagccggacctggagcgactgcttccggcggggttcttggagaggacgaaggacagaggcatggtggtcaagaactgggtgccacaggcggaggtggtgcagcacgaggcggtcggcgcgttcgtgacgcactgcgggtggaactcgacgctggaggcgatcatgtcggcgctgccgatgatatgttggccgctgtacgcggagcaggcgatgaacaaggtgatcatggtggaggagatgaagatcgccgtgtcgcttgacgggtacgaggaaggagggttggtgaaggctgaggaagtggaggcgaaggtgaggctggtgatggagaccgaggaagggaggaagctcagggagaaactggtggagacgagggacatggcgttggatgccatcacggaaggtggatcttctgaaatggcatttgataagttcatgagagatttggaggagagcagcttggagaatggagttcgtagctgattaagcagagtaaggctcacgattgcattagtgtatcaatggcgtcagttaccatgaaatgtttgcgatttttgctacggaattgctattaagttcagaagcacagtagtgcgcatagtgatgttcttttcatcctccaatgacggatgccattgtctctcgtgtccaaaagttgcagtgtcaaccatttctgtataagaagattaaaataatgcagtcttcaaacctgaccaatactaacgaccaattattcagagccacacaaacaacatgaacccactagcgtggaaatcactggctctagtcaaatgcaaattctctacgctaattgttagtcatccaaaatagtcctgagtaggctagagaatagagatagcgcaggatggacagtgacaacttacaagaggatggaaccatcactgaaattcaggtgcctgggaataccaaagaaggtaaaaatcatgtcttctttttttttttttttgaaacgaaaaaaaaaatcatgtcttcctctctggccatacttgtcaattaggaaatctggaagtaacagaccgctagcaccagatgctgcgtggtttaaccttattgaacgaaacctaaacaagtttctgctagtccataatgggtgtaagttgaaactgaagcactgaatctgctaacctgactaactgtgacaacctgcaataaaacaccaaatcggacagagcataattcagagcaaaagtgtcacctctcagcagcaatcttgtcgagtcgccgatcaggcacaagggatcatccctgatcatcttcgacgcttcatcatttgcagcgctgcaaatcatccacgaaatcagagaacgccgtgcacgacggcccgccgtctgccagcgcctccgcggccatctccttcgccattgccagccttcctctgagcttcttgccttcgtcggagtccatcaccagcctcaccttcttctccacttcctctgccttgacgagctcctcgtcgtagccgtccatcaccaccccgagctgcatcccgtccaccacgagcaccttgttcagcctctgctcggcgtactgcggccagcacagcatcggaactccggccgtcgccgcctccaggatggagttccacccgcagtgcgtcacgaacgcggcggtcgcggcgtgccggagcacctccacctgcggcgcccacgacatcaccaccattcccctctccctcgtcctctccaagaacttctccgggagcagagcacccaggtctggctcagaacgcggcagggagaacttggccgggtcctccggtggtgggctccgtaccacccagaggaaacggtggccggaattctctagcccacgagcaatctccttcagctgctccgccgagacggcgcccatgctgccgaagctgacgaacacgacgctccgctccggctgcgcgtcaagccacgcgaggcatgcgtggcgctctcctttcgccgcgtcctcgcccttcacgatcagtggcccgatgcagtacaccggcggcgtggggcggtcgggcacgcacgcgccgtccccgagcgccgtcacggccttcgcctccagccattcgtaggtgttgatcagcatgccccgcgcctccggcatgcggcggtagtgatagaccagcgaagcaccgatcacgtccgcgcagtcgagcacgttgtgcggcatgtccgacgccgggatcggagggacgccgggaaagtggaggagcgccttccccatgtccttcaagtcgccctccgtggtggcgaagtagtgggggaggtggaggaacgcggcgaggacccccgcggaggaggtgaagtagaagtacgccgggacgccgaccgccgcggcggcgtcgagggcgtcgacgcagaagaggtccagcacgacggcggcgacgggcgggagggagcggaggaaggtcagaaggattggcacggtgaggcggatcacgtcgagcagctgctggaagccgtcagggtccggctcggggtagtccggaggcgggaggttgtggaaggagatggaagggttggcggcggcgatgcgcgccaccgcgggggccgacgaggcggcgacgtcggcggtggaagccggaggggtcgggacagcgatgatgactgcgaatccacggccgaggaagagcttggcgagctccaccatgggggcgagatggccggcgccaaggatggtgtgcagcaccacggtctgactctgttttgaattgggctccattagagcgagccggcgacacggtgagtctatgcgagtgttaagggaggtgccttctcgcgaaccacttgaggggagagtttaagcctcggttgctcgtataatttctacaaaacttcaatgctcagcctacaggtttgaaactcgcactgtgcgctgctatataacggaatcccgttttcaaacgggatgatcccgagcaggtatcaggtgtgatacctatcagatatcagatgattctacacaataggatgatcccgagtacgtatggtgtgatacctatcaggtatcagacgattctacacacgtttcaggtgatacttgcaagtatcatgtgatacttatcaggtatcatgcgatttctaccacgtatcgcgtgatactcgcgaggtatcatgtgaaacctgtcaggtatcagacgatttcaatcacgtatcgcgtgatactcacgaggtatcatgcgatacctgtcgtgtatcagacgatttctatcacgtattgcgtgatactcgcgaggtatcatgtgatacttgtcaggtatcagacgatttctaccatgtatcgcgtgatacttgcgaggtatcggatgatacctaccaagtatcaggtgattcctactggatatagctgggcatcctgttgggggaggagcacctcgacacgcgcggtcagtaccctgcagccgtccctcgtaaacgaggacggcggcggtggcggcagcgggggacgggcgcggcggcggcggcggcggtggcggcggcggcagaggcggaggcgaggggggacagtcgcggcagcggcgggggacgacgacggcagcgagtgagcaggaatcgcgttgtggaggaggagctatcccgttcggggacgggataccgtcccctagcattcccgatgatttaagcttacaagagtactactccgtggattctacagaaaaggggatacacatcgctcattgctgacctcaattttcattcctgccaaattgctgtcagttatcgtgtattctccagcccaagagtgtccatgagtgtacagttgtacatagggagtgaattttcatccctggaggggatatccactcgttgtttgcatatcactcaaatggttatgaaaaaaattgaaaaaaattaagaagatgtattaacat

SEQ ID NO: 17362 - DNA, 13217 bp, Oryza sativa
  unsure (1)..(13217): unsure at all n locations
catgttaatacatcttcttaatttttttataaccatttgagtgacatgtaaacaacgagtagatatcccctcgagggtgaaaatagtttccgttgtacacacgagtctactgaagtgtggaagtctccagcctactgagacagagcttttgcaccatgtggtattctctacacgctcagcttaattgccagatattaacaaaccgaaagtagaagaggaacattgatcttgcatattgtgatagagcataatactattccatcatgtaagcacggctccagagtgtaatctacaagtgctgactgctgaagcagctaatcagcctgaagaaactctcacaccttctgctcacatcagaaatacagaaaaatagcacagttcacagcgggtaaataatgcagatatgtgattttgtcacattccagcagcaatataaatcattccaactcaatgttcatcttttgtgcttgatcgtttgcactgctcaatgttcgtcttctacgctttttcctttgtagtgtttccaaagttcaaatccttcagaaattcggtgaacgccaacgacgacgacccgccgtctgccagcgccttcgcggccatttccttcgccattgtcagtctatccctgagttttttcccttcctcgaactccatgaccaacctcaccttcttctccacctcctcggccttgaccagctcctcatcgtagccgtccatcaccactccgagctgcatgccatccaccaagagcaccttgttcatcctctgctcggcgtactgcggccagcacagcatcggcactccggccgacgccgcctccaggacggagttccacccgcagtgcgtcacgaacgcggcggtcgcggcgtgccggagcacctccacctgcggcgcccacgacgtcaccaccattcccctgtcccgcgtcctctccgtgaacccctccgggagcagcattcccaggtcaggctccggacgcggcaggaagaacttggccggatcctgcggcgggctacgcaccacccagaggaaacggtggccggaattctcgagcccacgagcgatctccttcagctgcttcaccgagacggcgcccaagctgccgaagcagaggaacacgacgctcctctccggctgcgcgtccagccacgagaggcatgcgtggcgttccccgttcgccgcctcctcgcctttcgccatcaacggcccgatgcagtacaccggcggcgtggggcggtcggggatgcaggcgccttccctgagcgccctcacggacctcgcctccagccattcgtaggagttaatcagaataccccgcgcctccgggatccgcccgtagtgccccagccgcgtagcgcaggtccggtccgcgcggtcgagcacggtgtgcggcatgtcggaggccgggatcggagggacgccgggaaagcggaggggcgtcttacccatgtccttcaagctgccttccgtggtggcgaagtggtgcgggaggtggaggaacgcggcgaggtcgccggcggaggaggtgtagtagaagtacgccgggacgccggccgccgtggcggcgtcgagtgcgtcgacgcagaacaggtcgagcacgagagccgcgaccgaggggagggagcggaggaaggcgaggaggggtggcacggtgagacgcatcgtgtcgagcatctgcaggaaggcgtcgggatccgggtcggggtactcgggcggcgggaggtggtggaaggagatggaagggttggcggccgccatgcggtcgaccgcgggggcggacgaggagaagaagtcggcggtggaggccggcggggtcggcacggcgatgacgacggcgaggccgcggcggagaaggagcttcgcgagttcaaccatggggatgaggtggcccacgccgaggcaggcgtgcagcaccaccatcggattggggtctgcctccatcggcgccggagattcggcggccggcggcggagagagtgacagactgacagtgcgagtggaggggaatccgtgggcgagagaatttcggcgtcctgtgtttcgtctctccaccactagtagtggcgactgacgacgtagcgtactccatttgggttgcggcggaattgcctactgctccgtggtagcggatgtatggcccatcagcccatatagtgaaacatgacccgggctagatgcctagattgcgtcctgttgctcacgttccacccaatggcccatgtgtgaccttccttagcttctagcaacttttgctgaaagcctgaaaggaatgaaactgcagaggtgaagaatatgattagaggtttggaataagttcatttatggtctcttaacttgacaacgagttcgatttcgtccctgaaccgaaataccagatacaacgggttcctcaactatcaaaatcagtgcaaataaggcctcacgacggtttgaatagcgttttcacttttcagctgccgtgatgcctacgtggatggtttgaattgtcctcgtcttacgtggcagtgagccggtgatatggcactggaagcaaaatataaaaattaagaattaaaacaaaaatataggccccacatgttagtaaaaaaaaaaagtgggacccacatgttagtaggtcccaccctcttctcatctgcagtggatgacggcacgtcaacaccttttctcgtctccctcccagccatctctcttccctccttctccttgagctccctcacttgccgacaaccgctgccggcgacatgcgtccaactcctccccgactttctccctatcttttggcccctaaacgagtccaactcctcgccctcgcgccacaggtgcgcccctctaacttgccatcgccatccccgtccctcggtcaactccacctagggctgtcaaaaaagctcgaggctcgtgagctgctcgaactcggctcgctcaaggctcgactcgagctcgactcgtcgacgcgagcttcacgagccgagctcgaattgtttgacgagcctgtctttactttctttttcttttggcagtgagtaatagcataccgagtagtactaccagtagtattcatttatcatgtcaacatcacctagctgcttgcagagtggagtagtactcctactagttagtagtgctaggagtagtactactgcatgtctgtcattacgagcgccatcgtcaccaaaatccaacagtccatccaagcaaccaatgcgactaagctcgatagcaggctcgagctcgagcgagctcgagccgaacccatctatgagctcgaggcataaactaggctcggctcgagctcgactcgaatatgtaccaagctcgagcttagatgggtaagctcgctcgagctcggctcgttgacagccctaactccacccccgccccggcgcttcggccgcaggcaaggaaaggcaagggatcacgagccacaagttgcatttcttccaccacttgttcagtgaccctgcaatcgaggtttcaaggtagaagagaagggaggcaaacaaccagtggtagagaaatgcgaagatccggtggaatgcggggatgtggagaagacatatgatatttctccctcattgaacgcctgagaggaagcattatctttttccaatgaaacaatattttacaatacgaataatacttttttttctccatttcattcaggaagaattcaagttatccttgcccccccccccccccccccaaaaaaaagtgggaagaatgccagtgaattagtgtcatgtgccaagtggccacattccaattcatgcgctcaatatcaactctgattactcctcggaaacgagtaatcgccagcttattgtcaaccccatgtttttttgccgtctccacgtgtttctcatgtcatttgtttagtctcgaagtgaaccatcatcaatcggtgctctgattatatgcaccagataatcggattccattgagaaaagaaatatcagtatatctagaagaatcatgcgttaaacgatatcaagaatcattcagtcaggacgacccggtttttcttttcacgcagtttggaaagatgatacatacaatctttcccatctagaaggaagaaataattattcagaagtcagaactcacaaagacccccggaccaatcacagtccgtgaaaattacacggctatggactcagcagcaaacgtagtcatcatctcaagcttccacgagtcaagcgtacgtgtcaaatccggcgcatgacagtgtcgcagccacgacagtggacttgctcggccacatgtataaatcgaagaccaagaccaggaacagcggagcaggttcgagctaggtggtgtgatccattcagacaagtaactaacaaaaacggtcgtgtccgttcgtgacatttgctatagctagctagctccagctcccatggcgacggcggcggagaacaagaacgagccggcgcggccattcgcggtgccatccccgtcggtccacccggcggcgaccggcgtgggggaggaggaggaggcgcaggcggcgacggggtggcggtccatgcagtacctccggaagcggcggcgcgcgctctgctgctgcggctgctgcgtgaccaccctggtcgtcgtcggcctcgtcatcctcgtcctcgcgctcaccgtgttcagggtgaaggacccccgcatcaccatgaacggcgtgtgggtgacggccatcagcaccggccccggcaccggcgccggcatcgggagcaccgtggcgaccaacgcgacgctcaccgccgacgtctcggtcaagaaccccaacgccgcgtcgctccggttctcccggagcgagacggacgtgtactacaaggggaagacggtgagcgtggcgtacgtccccgccggcagcgtcggcgccgaccggacggtgcggatgaacatcacgctcgacctgctcgccgaccgcctcgcgtcggtgctcaacggcacggggctgatactcgggcaggagtacgacctgaccacctacacggcgatgagggcgagggtcagcgtgctggggatcatcaagaagagcctcgacgttcggatgaactgctcggtcatcttggacgtcgccggcatcgccggcgtgctgctgcccggggacggggccaagtcgggcgtgcagactaggagcgtggattgcgttgcaatcgtgagctgatcagcggttttcttgtgtgagtactgcattgtcattacagcacctcattacatatgaatatgtatttttctggatgtatattctgctactctcgtatgtatgtttttctggatatatattatgctactttcgtgtgttcacagatcgaattctctctaggaaataatacccaatagcattattatatgcctgtgtttgatggattgggtagacccgatttgggtagcagtctcacagccctgagttacatgaactttatagatgcagacgcactaccatgtttactgacgatgcataaggattaattagctaaaaggatgtaaagaaacctttgcaacgccagtaaaatggtgatttgaatagactgcatgaaaatgaaacaccatatacctctgccagcaagataggagtgcattgtcaaccacaacagcctcagagtatgtataaaacagacaggaaaataaccaattaaaggtgatatacagtagatagcattctgatagcattccaggtttcctctgtagataccagctatagaaaaaaaaaactagcttcttaccagcacagatggccgtgctactgtgctagaagcctagaaatgaacgaccaagggaatgtaactaatgaaactggacaatacataaaacttatcaatttacataaaacaaaaattatcacaaaagtttcaagaatcacatacattacattaggggggaaaagcaaaacaaaaggtaatgtggctaaaaaaataattcagaacttgaactaccgattgtccctaacgattttagctattgacttgggtaaggtcccgtgccaaagaaaattgttaggtacaaccatacagtaattagaaaataataacagcacagcacacaaactgcatgtatcaaacatgaaagaaaaagatcaacctagactatcacagtcagtgaattggaatttagaggtgtagctggcaggtactcatacaagtgcattgagtttagcacacaaaacattctaatcagtgaggtattcgtaactacatcaagtaaaatgaaaaaaaaatttccaagtttttgctgctcaaagttcaggcataactagccaacagataccaaggcatgtgcagagcatgataacatgttccacattagctcttgttgttcaaccccatatgaagttatgaacacatacacaccccctcaagattccatgaatgaaagtggggtcataatagagtccctccaagttccaactcacataaccatcttcagatggcgtcaaaatctgcaagctgtctaacctcacagtgcaaatagaataacaaggaaatgacaagttaaaatagtgcacccaaacagaatgtcaccatgagaacagcacagtgctagatgggaaattcagactaaaacaaaataactctgacatcgactattcataacagtataagggttattattcaataggtagttgtctaaatatgaaactagtgggtagtcacaactttccagttaacatgaaaaaaccttcttactctgcaattaaagaatcctgaatgacatagcacacattctcacatttagggacatacaagttcattacagctgttactagcttaattcatggaaaacagcggtatatatacctccatagaaacaaagaacattaacaccgaacatgaactaaactagtaaacacaaatcaaatgaccaaagtggggaagtatgaccatttcacccaataaggataacagttcagaattcaagctaacttaaaaaacaggatgaactgatctggagaagcaaccggcataacagttatctcaaatgttattacttatacctccctgaaaagttcaaaataactgatcctgttgaggaaaacacaattgcctaacaaggcaagtgatctacaaaagcgaataaatgttctctgctacttaatttatgactcaggaaccaaacattaattcaaaaaagtccacgctacatacatcaatgcgcaaaattatcgataatccagtagccaactgtatttaaaaccaagaaatatgtcgagtcccgacaaagaccgttagttaggatattccccttccgttacagcatgaaaatcattatgatgataaaatgctatatcctgtgataaataactttttttttcctttcatgtccttgccgccaaagaatggtaaccaacatacaagtaatgtaagtgcaataatcatatatatatatatatatatatatatatatatatatatatatatatatatatatatatatatatatatatataactggaatgaagcaattcagatattgatcttgcacatacaactgtagggcaagtaaccttacttggtaaaagctactatatccgaatggaaaaaacaatgtatatacactgcatgtctgcttcagtgcaacgatctactgctactaagcaaaacttcctcaaagtcaaggctgtcctagtccacaatctcacctaaatggctaaatatactaatattgccatggatcagccaaacctcatctgaacaataaaacaatggatacaccatcccatcgttgataaccagtagaaaatggtgccaaaaaacgaatatagaagagaagacatgatgcacccaattccgtcacctgtggcgccggcggtcggcggcgtactgtgatagcgggacgagctccgacagcggggtggcgagcggagtggagactggagtggggatgggcgaggaccggcagaccgggcacgacgcgctccgccgcagccacgcgtccaggcacatgaggtggaacctgtgcctgcactcgggcatcatgcgctgcatctccccttccttgtactcgcagaggcagatcgagcacgcggcctcggcgtccgcccccgtcgccgccctagagaagggcaccttggggtacgaggcgatcaccgcggggtcgagcccgacgggcgacgacgccgcgccgcccccggcgccgccgcgggacgaggagcccggggagtcggagtcgtccgcgacgaagatgacccgcgggacggtgatggagatgtgcccggagctggacgcggaggacacggcgtggcgcgcggagtggaccccctggccgccgccgcggcggacgaccccggccccgccgcggcgggagcagaagtagaaggcgaggagcagcgacgcgaggaggacgaggaagccgagcgcgatggcgaccgcgtacccgacgccgagcgaggagaacgagtcgaggaacgacgccatgacggcggcggcggtggcggcggcgagaccgtggggcggaatggcatggcgtgcgggggggcgcggctggggtgggagaagagccgaggaggggcaaaacgggaagaggggtattttgttttaggtttccggaggggtggatctggtagttggcggcattaattgccggtgaggagggggaggccgaggaggaggggatcgcagttatggcgcggagctggagtgcaggacgcgcgccgtgccgcgcaccgcggtttgccggtttcctctgccgctcgctgccgagccgagggagcggctgggtgagtgagcggggagggggccaaggggggaacgaaacgcgtgaggctttcgccgcgtcgctctccttggaaggccacacggaccggcggatgatgggccacataggttttggcgattctcagcgcgcggaccgaggagaccagactagagattaatgggctgggaatatccaagtctgacaaagggacatacatttgctggttgactaagtctattttaactcccttcttatcttgcttatgattgaatcgcatctctcaaggctcaagcgcaaaaccgggtataacgcctctccaagacaaaaactggtgcaaatcgacttcttcgatggtttaggaaacgtttttttttctaatgtgacaggttggtcatgattgactcggtgagtaagcaagtaagataagagtgtaagacccacgtgtcagggactactctattttccatctctcccgatggtagcaaggcagcgataaggcggtagtagcagccggtgaggaaggcagtccggcgaggcgctcgacgaggtcgggacgagagcttgggaggttgtggtggtgcaggaggacgcgagagctcagggaagaaggagtagtgggtgttgtcggcggtatgggagccgaagaggacgacaatcttcacggtagcagagcatgtcgtggagagaggagaagggtgcaaggaggtcaaccttctaggcattggactggagatcattgttggggggggggggtgatgtcacaagtgaaccctcctagggctggcgacggagcctcgtctcatgagggccaacgtttcagcgcaggggacgatagcggggtaggtagccttgacaatgccatgagcccccagcatgtgtcggccaacacccctctcctcgccaaccctcatgtcgactcgctaggtagtggtgggtaggacctaacggctagcgagatcgctctccgcctagagatctgaggacgattggcccaccgcaggtccttgatctacttgcacaccaagagcagcaatggacacgttgcaatcatccaccatggcgaagccaagaacagcagcacaaccttgttgaagaacccgtgctttgcgtgggcggtcaccatggccacgtaggaaacgatgtcctagtcgactgggaacttgtcgaggagtgcccatggaggcgagctcatcgcgcgtgaggtagagctcgatgagcccgttgcaagcagcgcgacagtggtcaagatcgagcttggcgcattgacatggatggctggcgcaccctcaccatgctcccctcttcccttgcacgcgccgagagcctcccatctactgactcagcgagtcaacctgccacgtcagcgaaaaacgtttcctaacatcaaagaagtcgatttgcaccggtttttgaaaatgtgggaggtagggttcgacttaccgtcggtaaccgcgcggttaccactgttaccggccttatcgcgggggtacggtaatagaaaaaccgcggtaaccttcttaaattcaaataaatttaaaaaataatttgaatttttgataaattttgcacggtttcgtacggttaccgcgcggtaaccgtgcttaccgccggggcgcggtaaccctagccccggcagtttgggaaaccctagtaggaggcgttatacctagttttacggttgagggatgcgattcaatcgggagaagagatgagggagggaaacagactttgttagctgggtcgggatcgagtagttagttcctagtaggctatgtacgaaggtcacatgatcgattgggcctttttagagcttagaaacctggaaatgtcgtaatatcgtgcaaaacgtccgtttgatctcccccactccaactttcatcgtttatccatacaatcgaatgcggaggtttattcatttaacaaccggttcgttttccctctcttggggtagtttggacaggggacaacgatttcatttgatgtggcatctagatgatactcgtagtataggatgtgctagattttctttttgaaacggagggagtacatagtatttctattagaaaaaaaaaacagtggaacctacatggccgggactctatttcttcctccccttcctcaatatctctcctgccactagtggatcatgtggggccatattttttgtttttatttgatttttttttcaatcggactgccattgacatgtgtgtcacattagtgttttttttttctttatagtgtcacataaacaccacgtagccgtataggataaagataaggtcaatgtatcatataactgacacgtaggatgaaacggctttcaaattaacgatagtggtaaattggtctagtcttaagaaatggaaatcaggcgacacatgggatgaaaccgcttttcaaattgacgagagttaaatacttaaattggtccagtcttaacagttgtgggagatttcatatttgatttgcggttaagaaatggaaaccagatttgggctattgtaaagggaagcaaaataagatttttcctaatatatatctcggcctcctccactagttgactgcatgaggatataccatggcttttagagagggatcgcattccaatccacgcgttgatgagaagatcaatatagcatagcacatgataattggggaaaaaaaaaattccccgttgccggggatcgaacccgggtcacccgcgtgacaggcgggaatactcaccactacactacaacgacttcgatattcagttgtcgataggcacatatttatttatcggtatctttgcctcgtttgtaaatatgacatgatagactagtgatcggccatgccagcctggagtaatagcatatgctattacgtatttgcatgtaacacaaaagggttttaagtgtttatcgtcgcaattagatgacacaaaagagtataataagatctaggccggctatatacaccattatacttaaaaaaaagctaaatcgtactttatttgttttacattataagatattttggataaatgttagagcaaggtcaatagtgcagcccactgctagctccaaatcttctatagccaattcatacaatagttacttactatactattaatacttggtcccacctgtcatacacacattacgtcatggagtccgtgctgcagctagttacagatctgtagcccgctgcttttctctctcttcctttatctctttaaaatatgtttatagctggcttatagcctgctattgtacctgctcttagtgagtttagatgaaacatagagagactaaaacatcttccgtataatgtataaaacggagggactacgtaacagtgtcgcccacacaactgatggtacactttgtccctttgcctttgcgatgccttccgaagagacactgggctacgagcctacgagagcacttgagcctaacctggacttggcccgcaagaatcagccagccaggcccacaccacaaaatcctcctccttttcaaactccgcaccttcgtctagaagcttttaactcgcccactagctcccttccccttggactctttggagttgttggaaggaacacgcgcggacgcgcccacgacccctccccacggacggatgccggcgaaagcgcaggcacgccacgcgtcgtcactcgtcacggtgccagtaacctcctcgtgatctccacccccttcattacttccccgtgctaaaccccaacagaggtcccacacgatcgctgacaggtgggccctccctgcgcgtgcaagccgattagcgctaattacccgtcgtctcgaggagttattaccacgcttaaccgcgccaattacttcgccgggttaacgcaggacttaatcacgcggttgatcgtgcccgatccaacggccaggatcgcctcactccgcgcataaaacccaacgccacgactacggagaaaaggaggaaaaagaaaagcaaaaaggcaaaaagagttcgtgcgaaaaaaaaaagaaagaagagttcgactgttcgagcgaggagggagaagaagagggggagagagagagccagcagctagccatggcggagcacaaggaggaggagtcgttggtggagtcggtgatggacaagatctccgacaagctccacggccgcgggggctcgtcgtcgtcgtcgtcggactccgacggggagaggacggccgacttgaaggccaagatctaccgcctcttcggccgcgagaagcccgtccactccgtcctcggcggcggcaagcgtaagacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 17363 - DNA, 923 bp, Oryza sativa
cccaaaggaggacaacggggaaacaatcgtcccccaggatgcccttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaaataagaccttccatttccacctct

SEQ ID NO: 17364 - DNA, 538 bp, Oryza sativa
caaatgccacttcagaagacccagcctccttgatggcatctaacgccatgtccctcgtctccaccagcctctccctgagcttcctcccttcctcggcctccatcaccagcctcaccttagcctccacttcctcggccttcaccaaccctccttcctcgtacccgtcaagcgacacggcgatcttcatttcctccaccatgatcaccttgttcatcgcctgctccgcgtacagcggccagcatatcatcggcagcgccgacatgatcgcctccagcgtcgagttccacccgcagtgcgtcacgaacgcgcctaccgcctcgtgctgcaccacctccgcctgtggcacccagttcttgaccaccatgcctctgcccttcgtcctctccaagaaccccgccggaagcagccgctccaggtcgggctccggtgatgtggactgctcctccggtgggctcctaacgtccacaggaatcggcggccggagctctccagcccatgagctaactccttcagctgcgccgccgggaacgcgccctgg

SEQ ID NO: 17365 - DNA, 283 bp, Oryza sativa
cacaatggaattaatagcaagggcgagaagcatagaggtgctatcacaacgcaccctcctggctacggccagtttgcactgtacacttcttgcttgagatactcagaagatacaataagagtgccaagataagagttttggggatcatctggtacaaaatatataggacatcaatcatggggaaacataggttccaacttccaagtgcatcggcgaggtgattgctcgtaacatgttgatctcctggatttggatttggttttcgactataatctggtgtagg

SEQ ID NO: 17366 - DNA, 611 bp, Oryza sativa
  unsure (1)..(611): unsure at all n locations
atcactcccaactagtagcctttatcgatctatataaaccacatgcatatgcctgatttttcttcactcatcgacacacacagctctagcctcttgccacatagtccaaagagcaatagagttttctaggattgattcagcaatggcagctgtagcacgagcactactcttcgccgccatcgtctgcgccgccctcgtgatggctgtcaccgccgctgcggacggcgaggcggcggcgatcgtcgtcggccaggccaagtgcggcgagtgcaccaggaagaacatgaaggcgcaggatgctttcaagggtatatatatcatgatatatatgttcgtcgctaattaattgcgtggtcagttcgatcgaacgatatatcaccgtcgttgattaattttttggtgatgttcaggtctccaggtggcgatcaagtgcaagaacagcgacggtgtgtacgagagcaaggccatcggcgacctcgacggcgacggcgccttcagcgtgcccctcgccgctgacgacctccacggcgccgncgactgcttcgcgcagctgcacagcgcggcgagcagcacgccgtgccccggcaggagccgttcaagatcgtgccgct

SEQ ID NO: 17367 - DNA, 17649 bp, Oryza sativa
tcaccgatgactatttttctattttcatatgaaaggtttatatttgtaagttgactattgccaaataattaagtggagtataataattcattttatgagtcaaaataattttacgggtagtaaatgatttcaaatggaaaaaatttcaacaacaaagttatataacttatcaagatttacaacttttagtttggtcatttttcaatataatattttttttgaacagtttgaatttgaatttaaaaatatgacaacttcaaacaacattttcaaatactaaatgatttcaattgaaaaagtcatcaacaacaaagttgaataactcatcaatacctaaaacttttatttttgttatttcttcatccgacaaaatgttagtaatattattcacaaattttacatatatgtgttatagtttataaaagaatcagataagagatatgtcaattttgtgaacaatgttactatcactttgttgtatgaagaaatgaccaaaataaaagttttagatcctgatgagttattcaactttgttgttgatgactttttaagttgatatcatatagtatttgaaaatgctgtttgaagttgtcatattttcaaattcaaattcaaatggttcaaaaaatgttatatagaaaaatgaccaaaataaaagttatagattttgatgagttatacacctttgttgttgatggctttttcagttgaagtcgttcactgatctaaaattctatttgaacttttcaaactttgaatttcaaatttcaaattgtttaaatagagtcagatggagaaatgaccaaaataaaaattttgcacctcgatgagttttacaactttggttttggtgacttttccatttgaaatcatttaataaccccaatttgatatcctggcatagggcttaataggattaatagaatactcataccaataagttacaactacttttccggaagccaatctccaaagaactttgatgttaagcttgcttgaactttgatgttaagcttgcttggtctggaacaatttggggatgggtgaccgacctttgatgttaagcgtgcttagtctagagcaatttcgggatgggtgaccgaccgagaagtttgcacttcccacgagtgagggctagccaaaaataaaatgtatttatttttggattatactcatctgtaacgggcattaactatcatctgtgatgggctataattagtgcccgtcatagataagggtcatctgtgatgggcgctagttgtggcccgattgagataggtcatctgtgacgggctatagtttgactggtcgtctgggtcaaagctatcggtgacgggctttacttaggtcccgattgagatagattcatccgtaacggccgtttgcccgattgagataactcttcacatcagtgacttctagcctgtgacggacgtcatgcccgattgagaaggggcttaccgcccgattgagatgagggtatccgttctagtgaatgttgatgtattgaagtatgaattattatatgtaattgtgctcgatgaaaaatgatggacatgtgccctttctgctttgcagttttactagttatgctaaatgttgatgtattgaagtatggattattataatgaacctatgtactttaattacaacctattgttgatcagttcgaagttggaatataggttgatcagttcgaagttggaaacctggaacctgtgtggttgtgttcaatcatggacttttggtaaattatttatccaaatgatgtgtaacaactgtctctacagaaccacgcagtctaggccatccgatggatggacgacccacttacacataccacctcacttacggttccgttattgtttcgtgtaaaggggtaaacccgagagtgatatggctagagcgacaaacccttataagttggttttacccttactaaactagtaatgtggtagtaatgtggtagtaaacatacacatagctctcatggataacatagggtatatcctaattggccctgtatgtcacatacttctcccctcagaggacccgatgtccccatcaatccaacctacctatgtgaatttaggtgcagttttttaaataattatatacaagttatatgaaagttataatgtagttatagtattgttacggtgtaattgtatgtaaccacaatgtaactatatcctaactattgtataattgtaatgtagttacactatacctggtaaaaaaaatgtagttacactataactatgaatctctatataattaacttgtatgtgaatttacatgtttttttaatacttatagacaagttatatgaaagttataatatagttatagtattgttatggtgtaactgtgtttcaattatatgttatagatacatttgaaactttttcacttaaaaaacttgtgtcccttctttcaacaaccacttagatacggctggtttttgccataattcttttatttattagtataattttgatctcataatttacaagatcattattatactaataaatagaaacatatggttaaaggcgtatctcttaaagagatattaaatatctataacataattttttttgtttgtagaaaacaaactagcctaacatcacatctatatgtacagacaaaacctggtaatatatataataatggtccaaaagccaaatgaaaacaaacagattaagaacaattcaatcatgcagtactttggctgtgcaggcagcaagctattactatttccctttttcataaaaacaaactagtactacagtactagctttgcattcacctaactagagacaggcgagtacttaattaaagctttacctttgcttgctaaacaccaccaatgggaagcattacgtacacagtgcccgtgtgcatgcatgctactcttcttaatcgatcgatgcagctaagctggttcctgatcaaaatcatcaaataatgtacggcgttaattaattcattttaaaccagcaaattcggcgccaaatgctaattgtgtactagtatccagcttctgctcgatcgatcttcgtctgcatgatcatatataaacgcatggttgatctgcttcttgctcatccactgatcagcaacgagtagaagcggtagagtttgctaggatcgattcagcaatggcagcggtagcacgagcactagtcctcggcgccgtcgtcgtctgcgccgccgtcgtgatggctgtcaccgccgcggcggacggcgaggcggcggcggcggtcgtcgtcggcttggccaagtgcggtggctgctccaggaagaacatgaaggcgcaggatgctttcaagggtatatatatcataatgatgatgataaattgataatatgttcatcgataattaattgcgatcgatatatcaccgtcgtcgattaattgtttggtgatgttcaggtctccaggtggcgatcaagtgcaggaacggcgacggcgagtacgagagcaaggccgtcggcgacctcgacggcgacggcgccttcagcgtgcccctcgccgccgacgacctccacggcgccgccgactgctttgcgcagctgcacagcgcggagagcagcacgccgtgccccgggcaggagccgtccaagatcgtgccgctgtcgtcaacaacggacaacggcggtgataaggctaacaccttcgtcgccgtcgccggcaagaggatgcgctactcgtcgtcggcggagtgcaactcggcgttcctgtgccccttcttcgactacttccacaagagaccccaaggccccaagccgacgccgttgccgaagccgacgccggcgaacggtggtggcgcggcgaacggtggcggagctgcggcgccgtctcccagccctccggccggcatatcacagctgaattaattaattcgtccattccatcaatatcgacacttgcttttttgtttgatttcatggcatggttaattcttttggttcttgcatggttgatttcccaggtcagcttgttggtgcagaataaatgaaagttgtgagatgtgagaggagtactgtgactgtgtgagagatcgatcgatggatttatgtgagaacgatgtatgtgttgtatctctattgtttggcatatctaatgtgttattcgttgtatgcatgtaagctattgactgtgctttcgtccacttcgcacatacaaaaagttgaaattaaactcggtattgctagtcaatgggcatctatccttataaactactactccagctagtttggtgaggtggcgtattattgcttgctacagtgctgctaattgctttgctcgatgtactgctgctgctcactaattggcccaagctagcccaaagcctggctactctatttgttagggagtaaagtacactttgactccctcaagtataggtaatccgatttgtattcctaaaacacaatagcagacgtcttgactctttacctattaaaactagtgtaatttaactccctcgataattttgagagccgttattgctgacgtggcatgttgacctagtccaacaaattaagttagcatgtggggcccacatgtcagtgacccttctatttcttctcttcctttaccactcctctccctctccaatatttcctctcggtggcagaatgccaacagtgcagtggtgggatgtagtagggcgacggaaggtggtagatgagcggtagtactccaagcaccactccccgacgagccactactaccaactctaccaccagagctcgccgccagcaaggttgcgccgtcatggagctcgacgctgaggcacctacggcggtcgaggacatggagcgggaggcgaaaggaaggaggggtgatacaggtgcttctcatccacctactagtgagtcccgactctcttccttgacccatcctcaatcctcatcaccggcgttgttcatctccgcttagctagcatgagcaccgtcagccctgccgcatcttcactgtgctctcccctttcttttccgccaccgttcctataagcactactagaaaaatgatttttcatgcggttggcatattattttagccggcggccatacgcgaaaaccgacagcaaaaatatatcgaggagtggggagccatggaccgccagcgaaaaccgactttcgttggcggccacgctaagaggtccgccataaaaaaaactctatttttcgaggcggacctcttaggtgtccgccagcgaaaacgtgattttcggcaggtagcgaagaccgcttcaaaaaaaattgaggccaataaaaatccaccgcccgcgctgagtactccgtccttatccttctcctcccccttctcctccctcccttctcccttctcctccctccctaccgccggctcccgtcgccacagctccgccgcctcactgctcaacggggagggcctcgggagcggcggcggggcacggcctccacctctccgccgcgggccacgcgacgacgagggaggccggatccggccgccgcgacgacgggggaggccggatcagcctcctcgacgacggggcaggccggcgggcgacgacgacgaaggggcctgacggcggcggttgggggaggccggatccgcctcctcgacgacgggggaggccggcgggcgacgacgacgaaggggcctggaggtggcggctgggggaggcctgatccgtagctgccacgacaggggaggccggatccggccgccgcgacgacgggggtggccggatctgctgccgacaccgacacggcggcgggggagggggcggcggggagcggatccggcgcctcctccctccccacggcggcagtgaggtggcgacgacaagagaccggcgacggcacgaattttttttttttgcatgtttcctgatgaatgttgtgatgtttgatttgtgtacatttgttctgtgcatgttgtgatgtttgatctgtgtacatttgtgctaatgataattttgtattgtgtttgaatttggaaatgagtagccaaatggatttttgctggcctttgctttgtgacgactgcaaattccgccagcgaaaatccaaaatggccgccactaaaaagttttcgtagtagtgtagtaaagtcatagcaatgacgaggagcgtggccactccatgacgctctctatcttttccttcccgagccacgtgggcgcccggtggcaaattaaagcttggcccaagcggtgaggcggtgcgtgcagaggaggcacttggcgatgtctgccatccatctccttcattgatgtcgccttgcttttgctagctgccatctgttgaaaagacggtggggaatcctatcggcttctcctaactgccgcataagggaggagtggagaaataaacagagaagagcgaaggaggaaaaggaagggacaactggcgggcctcacatgcggacttagtcggttagactaggttaatgtgccacatgagaaaaactactctcaaaaccaagtgaaattacaccaattttaatagttggggtgttaagatatctaatattacattttaaggatacaaattagattggacctatatttagggagtcaaagtggacttgtttcattcgctgccctacaactgctactgcatgcacgttagctagcttctcaacacaaagcaacccaagacccgattatcttaacgtggcccaactcctgctcttcttccttttcttttctcaattatttcagggtcacatagtacctctccatttaaaaaaaccacccctcccaacatcagtgttttttttagcgaaaatcggtccactaggaaaagccgaataatttctatactgatactagtataataggagtcatatcctcctctttccctcaccatagtatatacctcctcctagtgtacgaactcggcgattaggagcgatggccgctttgatttgtggagaaggagatttaaggagaggagaatgagtgattttttttggaagagtttggggcttctgtttgggaccaaaagctcaacatgcattgagacacatcaccctttaaaacttaaccattggatcatttttgaaacgcacatgtagttcatgacatccgttggattgtttagaacagaaatgactatctcttcctgtaactgagaaattaaagtctttacttatttctattcatgactttaatatgttagcttttcatgcatgtgtcaatttatttgataaccatagtccacaaaggttaagacattcattacaaatgtatcatactattgttataggttcaatttgaattggtaaaatatattattgtgattagaatggcaccaacaatatttaacaatgttctcataatattaaagcgttagcgtaactatttatataggattggaagtagtacgggacaactgttgggctataatttcccttttttttaaaatatatcagggagtaattatatttatggcgcccataaatatatatataggctaatgttacaaacaaattcccattttttcccctcagctttgggctgaattccaccgaggcagcccagcccactccagaacgccagccagcctgcctgccacatggggcccatttctcagatcacctcgtccacctcgcgcctctccaacgccgccgccgccgccaccgccaaccgccgcacaccatggccctcgcgtgtgcgtctcatttgcgccgcctcggagccggagctccggcgagatccttccacgcgcatccgtaccaaggtgggtataccccctccccgattttcttccgtgctttcttttcttggtgattgaattggatttggagcgtgattcctgcgcggcagccaaggtcggcgtggtggagttcctgaacggggtcgggaagggggtggagacgcacgccgccaaggtggaggaggcggtcggcggcgacctccagagcctcctccacgcccgcactctgcggctcaagaagctcggcatcccctgcaagcaggtaatctccttcagtcgagcctcttggttcatctctgtatgtgcagattgagcaacggattgtgattatgctagtttcctctgctattcagcatttcggaatgtgattatatgttttggttagatttcgttgtatgatgctgccgttattagatgtcgtcgttatttttgtttcatagaagcgaactgatccatatgtgtgcttataacaatggctcgttgtattatgcctacatttttgtttgagaaattgttggatgcatgattaaattttgagcaaatttcacagaatcatatgctttgtgttccaagttgcacaaaaaccacaggggtttcggcactcggcacttaacaactataagtgtcgctttctcaggaatgtttttgttatttcatctgagtggatttcaacttatttttagttaacagattagctaatgctatgtaattcggcatgctttgaggttaacgttttctgatggtaattttgtctgtgtgttatctaactcttggctttgaacgaatcagtattgtactaggttgcttatttctctctagactgctctggataagcatttgaccatggaaacccttatgttttaaaactaaacttttttcttttgattaataagctatgtcagtgttaatgttttttctaaaggaatatagataagtgttatgtggataattttcttttgtttggtcaagtttcagcatccaagtagtgaaagttaagtaattctggcatagtctcatactttgaacttgaagggaacttacctctctgatctgagatgttgatatattacccttttgttattgggaatgacttcaagtgaattactcaacagcgagatgtggtattccgaaccatgtttttcgtagagcgatacatttttacttaattaagctatgaaattaatcaattttttaatgcttttttagatgccttagtgaatttgacaatgctaaggtgtctagaatttgatgtgcaaaataacacaaattttccttcaagacaattgtaatatttggatgccaagaaagttccatggttttgcattgtacttaggctggattcttggttgtgaaatatacaatttgagttttacatgatattctgaagtgaacacacatgtggcttatgacctgcatgctgaaggaaatattcagttccttttgttaagtaatgggaacctgatcccattttgcagacaatgtgaagacattggctaactagtaactgtatacaaatttggagatgagttagacatctccttgccatgtttgtctccctcccgatctctgtttttaccgtttcttattcttcctttcttccttgagtttcttctctctccaatttgtatttgtccagttaaggatgatcttggctgtctgctgttaatgcattgtttggaaacttactatgtttcctttagaaagcagtcaaatcaaatatagtacgtccctttttttaataccttaagccaatccctttgaattatttgctgccagcatattgagactggaatcttcattagcatgtcatgatgttttctaggaaatagaacacctttgtaggtttgtcggtaatattgcttctcctaacctacagcacaagcatatttttttattatttaaatctcaagtaaaactctgaacattgctactaatattgaggttgatcacccgcccaggaacttaaaaggtagggtgctcacctaagctagtcgatacttgtaacatggttgtggattaggctggtggaatcatcttgataacagtatctttatttatcaactattttttatctgttctgagttccttgttgaggtatgtgaaaataatttttaggggatctattaagttctcttatttctcttttatacttgtgatgcagaggaaattaattttgagtttcgctcacaagtatcgtcttggtctttggaagccccaagcagaatccaagaaaacacagtgaagttgatttgtattgaagtggaccactttgaaaactgtttgctatcattatacttacctgggaaaatgcaacgaaagttagtttctaatttcccctagaattattggtagtgctggacttgagaatttgtcagatattgagttgtagtgtaatagtagtttctattcagccgtctgaaaatgtgcctatgctttatagcaacccttgcatggaatctgaaagttccaatcttatgcctttttagtactttgttttaatgtttttcacttgtgcgaaaataataaagtttaagctagcaatatgtcctaccaatagtagatgctttttactgttaggttaaactattattatttgtgttaaggtatttcgtttcttgtttgtacatctcagtttgtcgggttgtaaaataccatgtggagtatggagagaaacattcaggctatatgatttttcccctcttcaacatgttttatgccgaagtgatagactttttctttttcctgttataagcggtgcacatttgcacatatgagcacagcccaataggattggcccaagggtttgaactgggctacggttgggttgggttgagtggtgggctggttagctacgctattacaccctctacctctgtaaggctcaggggagaatagctaatatggtccctaaagtttcgctcctaggtcattttagtccttaatctttcatattgtctaaacaagtcctttaaatttgtcatgtgagctaatatagtccttggtcccaccaaaatcgccacatggacatgccatgtcaccttcctatgcaaaatctttatgatttgtccaatttacccttatgcataggaaaataaaaaacaaaaggaaaaagttaaaaaaaatatatggtatatgtaagagtaaaaatatacctcaaaagggtgaaaaaagaagtattttttttcctatggttatgtctaattcacccttatatttatttttctatgatatatgtaaggctaaattagacaattcatcatagattttgtatgaataatgacatggcatatccataggatgattttggtggatccaaggactattctaggccttatgacaaaggttaaggatttctttgaaccatttaaaaagttagagactaaactgatcctacagagaaagtttagtgataaagtagctattctccctaaggctcagcaagaaacaagaaacagcttagaacaatcctcatgtacagtataatcaggaaatatctaaacttttgggtttactagtaagtccttgtaggaagtgcatctagcaaaaatatcttgaatatgtattaatttagtggaaatttgttcaagttgaccttaaatcagctggattagaaaatttcatggaaattacgatttccccttttcgtcccaggaattgtacctcttatgcaattctggaagttaatagggccaagttgagtctttgtatagcaacgtacgaccatagtaattaaacacatcctagtgcataatattagaatgtctttaattcggttctagattgggtgaatactaatttatgggatcttattacgaagtggaaagaacacaaatacacaaataaatatcatattaattaaattaattccaacaaacaagcaaacgaatcctgagacaaatctacctgatactaacacacctgtattgactcaaacctcacaaatcaacctgaaaccttattcgatcgacccaagaaactcaaaatcaactaacacaaagctgtctgcgctactccaaccttgacaacaatatatcataatggcattaagctaacgcagagcagaaatttaaaaagaatcataataatgtgtgagctcgatcgacggctcaattagttcctcgccggcgggtggtacgggctcggtgttccgtacgtcggcgtcggcttagggtgcggcggctggtcggggtgcggcttgggcgctggcttggtcgacggtgcggcgggcgccggcttgttgtggtggaagtggtcgaagaagtgcttcttgatgggctcgcagatggtcgccgacgcgcacaccggcgacacatagtgggtcttgccggcgacggcgacgaaggtgcgctccgacagctgcatgaccctcgacggctcctgccccgggcacgccgcgttgttatgcgccgcgctgtggagttgcgccacgcagtcggccccgcggaggtcggcggcgagcggcacacggaaagcgccggcgccgtcgagcttcccggctgccttcgtctcgtactcgccgtcggcgccgttcttgcacttgatcgccacacggagacctgcgcgcaaatatatatataaatctcacttaatgtacagtttactcctctattcaatgaaattggcagcttgccttttctaaaaaaaaaaacaatggcaaatcaaataagataggtaggctgtattgatttaataatcctaagctgaatttaataaactaacaatagaacaaacaaataatcctaagctgaatcaaacagggccttaataagctaacaattgaacaatgatagaagatgcattgcttagcgggacaaattgatattatatattattatttgaaaatgtttagaatactaagaaaatagtgataatcaaacagggccttaataagctaacaatagaacaatgatagaagatgcattgattagagggacaaattgatattatatattattatttgaaaatgtttggaatactaagaaaatagtgagaaaacctgcgttcaaatggattcgaaccagcacgcttctcctggcagctccctgccagctgagatatgtgctgtcctcgatattatatattatatattattataaatgtactttcttcttccttaacgtagtgtagttttgatataagaatttgtccataaaagagtataatattacattggtccactagatctttttaatactattatatatatttttctcttttttaaccattgacccaataaaactccctcctaattattttctcaccccttctcgttttttccctgtattaataaaaggacataataatcttataacttttccttaagatgtgtgtgtttgactagttaaaattatacttatctagacatggagtgagtaataaataatttagaataagttacctaggtaatgctaagtaatgctgatgtataattttttcaaaagaaattacaattttaaaaacatggcacgaataattcgtacataaaaaataatccgaaaaagaacggggacacgatctaatcatcacgcacccttgaaggcggccttggccttcatgttcttcctggtgcagtcgccgcacttggcgaggccgacgacgaccgacgccgcctcgccatgggcggcgaccgccatgaggactgcgaggagagctagcactctacctgctgcagccattgctggactgtgtggagagatggaaagagtagctatctgatcgagctaggtgagtgaggtgatggatgaagaagatggtttggagatgcatgggtttatataggcttcatcgatcgatcgatcgatcgcctgctagctgcaactgtgtgcatggatgttgataaattgaattgatgatacagctcacttgatctgcgggcggtgaaaggtacagagtacgtagatctgtagatcgatggagctgccaactttcgcgccgaattcactgcttgtcatcaatgctggatccgtggatcgtagtgaattatagtgagtaaaattaaaattatgaagcgaaaaattctccagtttcttcttgtactagaacgaaagcatatggaatgtggttcttctctgacatgataggcagctagcttgactttagggagatgtacagtcgatcagtgtactggtcagggttcgcaaatcacactttggtgggtcccggtagaattgtggctaattaagctaatctttgatttttcctttttagaaacatactataaacacaagatgcgcacacacactctctcatttgagaaaacgaaccgacataacttaaaattgacgaagtttcaatagacacctcacaatcaacgagtacgatgtcacgtacaaataaaattcgggtggattgattacactataaagaacataaccaattgagttatactcaccccataatctttgaatttagccaaaagttattacgagtaaatttagctaaaatatgttcaaatctcaatttcaaaaatattatttatttgcttcgaactttcaaaaattttgggatttggtccccccgaaattgccaactgtaccattggtgagactaattgatagcacaataatgacggatacgtacgtacgtatacatcagaagatcagtacaggtagattactttaattcgtctacacaaagaaatatttcttttatggcgaatgaaacctaatatctttagtaataaaaagggcgtaaattatgctcacgatataagatttaatagctacgtgcgatccatcaaaaacttttttaaaaaaagcgtactgatataataacttgactagtgcgatgataaaatgtggtacaaaattattttgcatacgtaagaattcaacctcggcaaggaagcacgtgcaatggttccctttggcagagctatacaggaatgcacaacttacctatcgaaataaatgtactcactagactggtccatatcatctctgacaggctcaaatggtcatttgtgatgggtactatcctcgttagagataagtggttagtggtaagtccacctcacctctgacaggtgaaggcccatcaccggtaactatctcctaaacagctcctaagttctggcccgtcattggatgctatctctcaaacgactcttttaagttctagcccgtatttggtaactatatctcaaacggctcctaagttctagccgatggccaccctgagcttgggggccgccggatctggctgcccaaagcacgggagccaccgcgaagatggagattatggcggatgttatgaaaataaatgcacaacggagacacgaattttacatggaaaaacccttgcgggagaaaaccacgggcgccgaccggcaatgatcactatagaggaattggatacaaacgcaggggatacattgcgctgtcacaccctctccgtgcagcttacaagggatatatataggagaaatctaggagtcctagtggggaaagacttagagtcatactaggaaactaatcctataaaggagagtcctattagataactaatccgaatatattgtgggtccaaaattcggatcacatatttaacaatctccaccttgatacgaatttcccttgttgcataaaaatcttcaatctccaaacaacctcatgatgataaaatcaatgtgcgccaaatagtcacttggactataatcataacacccttgatccagaagaggcattgggaatagatcctgaatctactagtataaaccggtgtgaacctagcagagacgcgaaactaatgcacaaacttcaaactcgccatgggaataacatcctgaatctgctggcattaatttatggaatcctagtagaaacgcgaaactgatgtgctcaaaacgaagtacttagatctccacatctccctataaccttctgatatactgggcaaacggacatagcaattccgccggaaatttgaccatctccacgtgatttggacagcaaccttgcagctccctctcgacgactttgcttgtgtgtcctgaaatatgtatgcgcagctgataaactggtcacgacagtattagctcctcctccatgaaagatgtgccaacttgcaacctcacttgccataacaagaatattacatctcaatccagaagcagtagatcaaacttcaaactcgccttaaaaataaaatcctgaatctgctggtacaatttgtcaaaccctagcagaaacgcgaaacactctgggtgcgtaaaacgaagttgatctccgtgcagaagctcctggtagactggcttgtgaatatagcaatctggaacgtgaatttgtgtccccctgaacagaaccaaaacaatgcaaggcttaaatccctggtgcgaagggcgtgtgcacgtaacaattccaacgtgaaatttaattcacatgaacagaaccgagaaggctgctgaaggcttggacttttctccttcctcgggatgcgtgcggaatagatcaatggcttcaaccctgctgctgcttctgattttctcctgcgttgcttgatggacgtgattcagatcgatgtgttggagcacctgcttaaatcgatctggtcgacaccgcttcgggtttgcttcaccggtgattcaatctcaccgaattgatttctgcgacgatgacgacgcgttgctgctgtggccgattctccgcgacgtgcgctgctgctccttccccggcggcatcgacgacgaggccaatcagatcgatactccgatccgaaaaatcacaccggtggctgtgtgattagtagatcgatccctaatgctataaaaatagatgcacaacggagacacgaattttatatggaaaaacccttgtgggaaaaaaccacgggcgccgaccagcaatgatcactatagaggaattggatacaaacgcaggggatacattgggttgtcgcaccctccccgtgcggcttacaagggatatatatatgagaaatctagaagtcctagtgggggaaagacttagagtcatactaggaaactaatcctataaaatagagtcctattagataactaatccaaatatattgtggatctaaaattcggatcacacatttaacagcggaggtggagaagacgaggtcggcgagctctcggccctccacccagcctcatccttcacccagtgcgcctccctcctcatctccccttctggtgatgatgagctaggcagatttggacttctcgccctccgcttcaatctttgtcttcccctccaccaccaagcagtgcagccttcaccccgagttcccgtaggtgccggcgcggcctccgaccctacgcacctgcaggctctggttttgtcccaaatctactgccgcctccaccttcgaccacgacctcccaccgatgccgacgccaatgccatcaccgccttcggctccgtgcacctgccggcaccgccttcgtaaacatcgtcatccgctaactccacaggatgatgacaggaagagagtgggctgagagttcgagagttcgagagagagatgagaggtcaagaaagagatcgaaagagaaagggtggagagagattaaaaatgaatttatcattggtggcttctattagtgacagggtgaaaaaaaacctttggagattgacttttcatctttaacgggttagatagacaacatgtatagagctgaaagttaaacttgccactaacggccatagtactaacctgtcacaggttacaggtcacttgtgacgagcctatatgcgggctcgtcagaggtgttgtctgtcgggcgcacatatagacccgtcacaaaaaccacttacctatgctgggctgcatgcatcctcactgtttttctttttgatgagggggggggggaggggattttagtcccggttcgcaacccaaaatattgggcccactgaatcttattgttttttaggttgactggattgtcacataagcgacatgtag

SEQ ID NO: 17368 - DNA, 5009 bp, Oryza sativa
agcttcacccaactccactcccagttttggtggagctgaaactgtttggctgactccagctccaggaggggtggagctggagctgtgccaaacaggccctaaacgggctcttagtgatggagaatcgaaattgtgccacggggtacttacaggcgcacaacggtagcccccattccgcacactgttttttactatatatatatacattaaagttatgttaatttatagagaattgacatatatattatatactacctccgttttttaatagatgacgccgttgactttttctcacatgtttgaccattcgtcttattcaaaaattttacgtaattataatttattttggtatgatttgttttatcattcatagtattttaagggggaattaatttcctatcctttggcttaaaattttggattaaaacaaatggtcaaacattggaaaaaaagcaccggcgtcatctattaaaaaacggagggagtatattatagttataatgtaattacattgtatacaatcgtattgtagttacgttcaaaagtttaaagagagttttttttaactgtatagctagtctccaattagggaaccacgttagacgatttgccaggatcagacagtattgtaccttacaattgagatcaaacaagttgcacatatattatgcacatccctgattatattaattacttgctgataccaaacaaatagacacacacacacaaattaaacttgtgagtaaaagctaatgcatcaaagaaaaccattattctgcagacaaactgacatgacaggaaatcatatgcaacaacaccaaacgtactaaccaaacgaaccatgcatgcatgcaaacttccattgcttaattcgccggagggctagggttgtggtactctggcgcaggctgcggcttgggctcgggcttaggctcaggcttgggtggcacgggcttcttgtggaagtggtcgaagaagtgcttctccttcttgtggatgtggtcgaggaatgggtgctccggctcaggcttgggcttgggtggctccggctttggctccggcttgggtggcaccggcttcttgtggaagtggtctatgatcttcttcttgattgggccgcagatggtcacggacgcgcacaacgccgatcggtagtgggtcttgccggcgacggcagcaaaggtgccctccgacattggcacgatcttggatggctcctggccggggcatggctcgttggtggcgctgtggagctgagcgatgcagtcggagctgtggaggtcggcgtcaagggggacgctgaaggcaccggtgccgtcgagctttccagtggccttgctctcgtactcgccgttgccgttcttgcacttaatcgccacctggaggtctgcacaaaagaattccaaataatattgtcaatcacttgtaatcaactgtatcttcctctcgatcgacgatgtaaatcagctcaatgatcaattccaaataaattgttacgtactcttgaaagcatcctcagctttcatgttcttccgggtgcagtcggcgcacttggccgtgccgacgaccaccgacgccgcctctccgccgacggcgaccgccatcaagacggcacaaacgccgaggagaactagtcctcgaggagcacctgccattgctgatcagctaatcctagatagctctgtgtagctaaatattgctgatgtgtagagatggatgaagtgaaaggtgaggcaacgcgtggtttatataggcatcgatgaatacaaacacagcttgcttgcattattgatacatcaatcgatggatcgaccagctagctatgagcaatgcaaaaagggccaatttggcgccgaatttgcagatgggcgaattaaggccgtccaaactgaatgatttgatcacgtacgtccaatatagtcgcctctgcagctttacctacgacatcataataatctatcgatcggttggtacgtatacgtaggatctacgcaccgctttatgcatgaatgaatcataacaataattaagtacaataatcgaactgggtcttaactccttgtaaactgcggttgacctctgtttcagcagtgagttacagtgatcggctacttattgcaacactttccaaatgtactgcattcatatcgtgctacattcgtccaaaagacaatatatatataagcaaattgtccctatatataatcatagcattcaaattttgttctgaaaagaatgtaattctaaattactactaccactactacaaagatagattctcctggacaccgcccccttttgttttcatgcggtctgtaagtggaaccgcacggaaaaatagggggaccggcgccgggttctcgcccgcatggaaaaatgcattttcccgtgcgggcgtcttaatccgaacgcacgggataattgtcattatcccgtgtggtcgacttaagatgaccgtatagaaaaatcgattttcgcatgcgggctttttaagtggaccacacaggaaaatacctcccacctttccctcccacccacttcaaatttttcacatcctctcccttcctttttcccttttattctccatcaaccacccccctctctctctaccttatctcctttctcagccttcccggcttcccacctcctccccaccttcccggcttcccctcctcctccccctcccctcctccgtcaacagcgggcgtcggtggcggccccttccactcgtcctccccctcccctactccccttcccctctgtcaggccgacgatggcggtggccgggtgaggcggcgaccgagcgaggtcctgagcagcgaggcggaggcgtcgtcgtccgttcgtctattcctccgtccaaagataaccatggtgggaccctcctcctggtcgtcatcctcgtcgtgcacgttgtcgctcgggtccctcgacgacgatgccgtcgtcacgtgcgtcatcaaggcagcggcggagagcaggtggcggcgagcgggtggcccctttccacggtcgtcgtcctcgtcgtgcctccctttccacggtacaccagcgaagcagcggtgagcgggcggcccctgcccggatttggcgcgactgtggcggcggcgggtgggctcgacggcgatgacggtggcgggctcggcgacggccgggtgcgtgcggtccggcgggcggcggcgattttcgctttttttaaaaaaaattttggttttttcggttctgtgcaggcggtataatttgaccacacgggataatcgattatctcgtgcggtccacttaacacgaccgcacgggaaattgattatcccgtgcggtagagctgcccgcacgcgaaaatattgatttttcaagacacttgggtgcagacgggcaaatcctctgcacgggaaaatcatttcgaccgcatggaaaaatgttttttgtagtagtgtacatccgtcccaaaatataaaggtggaattaaagtgagaagatttgaatggtgaaaaatcatgattgaagcagggtaaagtggaattaaagatgaaggatgcaatacatttagaaagtacaacatgccaatattgcaatacatttagaaagcacaaccacactattattacaaccacatgcaaaaaattacaaaatgataaaagggacctaacaaagctagaataactcaaacactaaacatcctattattggacggccaacaattatttaagataaaaaaagtgcacctttatgatggttgtattaccactatcagtattatcactagtagatcgaagtgagatctcaaaccttgatttatcattactacaattaataaaaaaattctagtaccaatagtggcagtagtataaatagatacgagaaccattaaattaaaaaagatgaaaggcctatattgatctgtactaagagtaagactattgtaaaacatctcgctgtctagcttcaaggctcacaccaattatcatatgctgcaactttctcaagctgaagaataacgttttcctcacaccaattatcatatgctgcaactttctcaagccgaagaacaacgttttcctttgggagggcataaaatcgttttctttttgttgggaggacgaacatgcggataattcaatttagggccaagagcctacatatatgtactgagatgggccaaggaagaaaaagagcctactattcgttaattgaaattttctttgctcggtacgtccacttgtatttcgctgatggtttttggctgtcaaggctagttgagttcatggtagtgcaagtcacgcgcactttacaaggacgaaaaaaagatgctatcacattactcctaattaatcacaatgcattcatgtggacaccgcatagaaaggtgtatgcatcctgcgtataggtaccaaccggctgaagaaccgcgtcgtacctaggcaacgtcgtgatcgaatgtgacaaggatccagattggacgtacgtgatcaaaatcattcagtttggacggccttaattcgtagcatctgcaaattcggcgccaacttacagccgctttgctgatcatcgaccgatcgatcggtcgagctgtattcaactattgatcgatcatcgatgatgatcgatgagcacgagaggctaagcctatataaatcgcgcgttacctgtctttctcttcatccattcagagttagcaagctcttctaattcatatatagaactcagaatggcaggtgctcctcgaggactagttctcctcggcgtttgcgccgtcctgatggtgctcgccgtcagtggcgaagcggcgtcggtcgtcatcggcacggccaagtgcgccgactgcacccggaagaacatgaaagccgaggatgctttcaagagtatgtagcagtttaccttacatgcagcttagctacgttatacttcctccgttcccaaataattttatttttcacacgttccacacataccaatgcaaaacaaaagaaaactagaattctaaaatcatttgtggatttctttgtgcagat

SEQ ID NO: 17369 - DNA, 25825 bp, Oryza sativa
  unsure (1)..(25825): unsure at all n locations
actgaagctaaaatagagtgaagtttagaagcagcttcactttctcccaccccccatgcaccccttcccttgtaagtgtgcggagccttgtgcaagcccagcttgcacagacaatggcctgggctccaccagctgcacgcatcaattcaccagtgcctaattaccttagtaatcacttttcttagtcaccggcaaggcagtacaatgcaactagtacaatcgcaaactcgctcaacacaaacttttaaaacaaatgttcatattgaagttatctatgatcaaattatataggcttgtatatacctcatttgttgttagacttgcccaggctcatgaaaatttttgaatccgccactgcttttaacctgcatgtagagaaattagtaaagtgatatgttggatttctttctcttttgcttttttgaaatgtttcatatcgaaagtggaatacagattgcagagtataatatattgggtcaaaataagaaacttactagctgtacattgttaatctaagttgctaagtgcctacattgaatataaactatacttatacttactagtttcttgccaccacacaatgggggaactccactatttcaatgtcataatctccatcttctccatgtaaaaccagtccaaaataagccatttatacaaagacttgacaaagataagcaaaaaataagcattacaatatattacatacacaagaaggtgcagtattgtcattttttgaggttcttatccaacttgatgcataaaccaaagcatgaaccatgtctcgcttcaaaaaactcctgtaataatcaagaattcttcatccaatgctaaaagtggactctgatgatacaatactagctggaatagtcaagaaccttcttgccttggacacaataggaaaccatgagagtgagaaggggtcaaaaggggatcaagagctaggcttttgatgttctagggccttataagaatatgggttgtgacttgctgagctgtgggctactctagctcgtaaaacacacattccagttcgagctggcacgttacccgtaacgagctaaaataccagctccatttgcagatctaggggtggtcccaggaccacccaaaaaaatcctagcccaatacatatatacacatgtgaaaagagaaaaaacaacctagaatacctggatatggcagtcaagtggcatatccatatcagatacgtgaacagatatggatacgtttccatatgtgccgatacgtacgggatacgtatccaacaatttcgtaatttccaaataaataaaacaaaccctgatacgtcgctgatacgttttacgcccacctccgaatccctttccaagcgcagggctgccgccgccagacacaacacccgcacccatcgtgcatcatgccctgcctggccgccggggccaagaccgtcttccttgtgctctcgctcgaggcacagcatccccacacgattacaggcttgtagcgccgccgccaccaatgccgatgaacagcgcgctgctaccaccaacgccgatgaatgtagctccactgcagtgattcatttagcagtcatccgatggatctgaaatctaagtttcagagctagtgcatccatgcatccaatgctcctatgttgagttgtgatccaaatttgtttgcacataataaaggccagcttctgctggagcgaagcggaggccgtttgaagccggaggcttgggccggagtgaaaaatatcttcactattcgttatccttttaaggtttcaccttcatatatatacctcctgtaagccaccatttagcgtcgtaacttcaccccgatataatgaagatattttgctggctggcgcccgcagttttttttctcctgctttgggagggttttccacgttaaatctagtgtcttctgtgattgatctgttgttttttatcgtttatttgcctatcgtttcctaacatcctaccctcgaaaaactagtgcagctgctagataataatgaaaagaagcctcggtggattgtggcagtctggcagacaagagcgggtataggagaaagcacattgatttttctgtgaataatcagcaggtagcagtccgcaagtttattaatttttctgtgaatgcattggttttcacaatatgttaagagagtttattagttttaattttttattacatatatagacgtatccccgtatatatgtttcttgaaaaatgccgtatccccgtatcgcgtatccgtatatatcctcgtatccggtaacataaaaaacaactcccagtcactggtagagaaaccatctttggtcggtcgacccaaatccacaatagtcccggttccattaaaaaccgggactaaaaatgatttttcatttttagtcccggtttatgagagaaagatctttagtcccagttgttgttaccaaccgggactaaaaatcatcttgagtcccggttcataactctaaccgggactaaagttcatctttagtcctagttgattccatgtcaggacgtgtcagggccctaaaatctttagtctcggttagtaacaccaaccgggactaaaaatctatttttagttctgattgatgttactaaccgggaataaaaatcaaagcatactatataatccctagtaccgatcctcttttcccgtccatacaacaaactccttactctatctcttttttccttctaacttcttatctctttccttatctctaactcctagccttcttctctttccttttttccttccattcacagctagcgaagaagagggcgcgcgggcgggccagcggccggcgcagcggcgcggcggcagccggccggcgcggatgggaggcggccgtggccggccagcttttttttttttttacaatttatgatttatcctgtgatgtattcgatttgtgtgtgatccgaatctgtgatgtatttttttagaacttgtgatgtaatttttttaagagtttgtgatgtatttggagatgatatatttgagaatttggggatgttttgtgatatgtgatgatttggatttgggatttcttgataggggatggtgtgaaatcaatattcaatactaaaaacaatgaaaaagagagaaaaaaaagaaaaaatatctttagtcccggattcgtagtcctggttggaaaaccgggactaaggggggttacaaacgggactaaaaaacacttctccaccagtgcttattactatattatgatgcacctttgatcaatttatacttgtaactcttgttatatctatgagatatatatatatatatatacacacacacatacatacatatatacatatatatatacatacatatatatatatatatacatatatacatatatacatatatatacatatatatatatatatacatatatatatatatatatatatatatacatatatatatatatatatatatatatatatatatatatatatatatatatatatcacctatatagaaatcttgcatatgccattggccagctttgctcattagaaaaatgaaattagccaaggaagcaaacgagccataagcttcaggtccatcctatgtcagagtcgtgcatgcaggcagatatgctagctggaatgtactaggttgcttaggtggattcgatcgaaggaagggattttttttcccattatatagataagatgcgcaccgtcaccacatgcacacacatcatactcacacactcatgactatgttcttttttaacatacggtaaaagagacggagacaaacaacaacaatttacttaaacttctgcaggctactatttctgcaaataatttgttatatatttatcgataaattttttaaaaaaatttgacatatgtaattgttatgtagtgtagttacattgtaacttgtatgtaattacaatgtaacttttacatcattttaaattgttagattcgtttcaagattcgtgcaagcgaaaaaattacagtgcatgcacatgtgagaggattcactcctatgatgtccattttatggaaatagcatgtttcgaagggatttttaaaagttacatacaagttatattgtagttacatgaaagttatgatggaaattacaccacgattgtattaaaattatatttattaaatcgttggaagaaaatttatcgataaatatatatgtgatcccttctgccaaatactagtaggcatgtatatgccgacaaatttaaacatcaaatgattcaagagccaaattaacccacacaatatatataagaaagaacaatagaatcttaatcatgcaatttggttgaagctgtcctatactattatccttttctataaaacagattagtagtactatgctctgcaggagtactactcgattaaagcataactttgcttgctaaacacacaccaccgatgggaaacaacagagcatcaagggtgaaacactgcatatgcaatgtgcacgttcacagtgcactactcttaaatcgatcaaatgtacggcgttaatgattttaaacctgcaaattgggcgcaaattgctgatcatgttgtaatataattagctttttctttcgagggaacgtaatatgattaactgacgcctatataaaccaagcatggcctttgctgcttcttccctcatcgacacagcagtaagaaactcccaatattaaggaggagtttgcttagattcattcaacaatggcaggtggaacaccaaccctaatccttggcgcccgtcgtcgtctgcgccgcccttgtgaggctgcacccccccttccgaccgggaagccgcggtggccctcgtcgtccgcttggccaaatgccgcggctgcttcaagaagaacatcaaggcgcaagatgctttcaagggtatatatatcatgcatgatgatgataatatgttcatcgataattaattgcgatccatatatcaccgtcgttgattaattgtttggtgatgttcaagtctccaggtggcgatcaagtgcaagaacagcgacggcgagtacgaaagcaaggccgtcggcgacctcgacggcgacggcgccttcagcgtgcccctcgccgccgacgacctccacggcgccgccggctgcttcgcgcagctgcacagcgcggcgagcagcgcgccgtgccccgggcaggagccgtccaagatcgtgccgctgccatcaacgacggacaacggcggcaataaggctaacaccttcgtcgccgtcgccggcaagaggatgcactactcgtcgtcggcggagtgcacctcggcgttcctgtgccccttcttcgactatttctacaacagaccccaaggccccaagccgacgccggcgaacggtggtggcgcggcaaacggtggcggagctgcggcgccggctcccagccctccggccggcatatcacagctgaatttttaattcatccattccatcaatatccacacttgcttttttgtttgatttcatggcttggttaatccttttggttcttgcatgattaatttccaggtcagcttgttggtgcagaataataaaagttgtgagatgtgagaggagagtgtgactgtgtgagatcgatcgatcgatgtgtgtgagaataaaattaagttcgtgcagaagtgcttgtgtagtacctccatttattggcatatctaatacactagtaataatatgtccgtgctaacgcaacggtgataattttgattgaaacgcaacggtgataattgataatgtaaaaggcaaaaggtaatatttaagattcacgaataaaataacgatagagagatttgtattgttctcatgaatgttattacactgttaataacttcccaaaattggccatgaatagagttctgcaatattttcatcactgtgagtgaaacttttcaaaacacaaacaatagctcatggtatctaactttctataccacatatacaaatattacctgcacgttctacaggtgctattttttcaaaacatgcatcgcctggaaacattcagcaacttctgctcctcactggtcaccttcctccttatagagcacctcaagaagccacataaacttctctatcgaacgcatatcaggagaagcaccatattgaagacagtgtattcgcctaccacgaggcacacgcttataaagatatattcatcacttagcattagtaatttaactcccaaaatatttggaaaaacatcccggtttctactaaggcaaaaatatgtagcaaagcaaatatataggcattaagcatttaatagcaaatgataataaattatttattttaactgaaagcgctaggcttttacatggctgcaattttgttcgtgtaaatgagttgaaaaaggtaaaatggacatgaatactatgttaaatctgcagataaacttttcggatcatggaaatgcatttgtcaaatttcatatgttcagatcaaatttcattataccctgcgaatacacaggacgcataaatcatcaatattgcacagcaccaagagctaggcaccacggaaagcagtccaaaaaaaccataggatgcatgcaacatttcaggaaaattaagaatgatatgatgtggttcaggagaaggagaaggagaataattctcactcatattcttgtaaactatttaattctgatatataagaaaaaatactgaaggaacataaagagaataaaatccagtatcaacaaacacttttgaaagtgcagtgtgacagtagaattcttctgtttgaccttttttcagtgaatagtttcagcatatttggttcaattttaaatgaacaacaatagtcaggaaacctattcatctagatcatagcattttataaacctgctgcgatctctctagaatctcccatccaagaaactctaagcaattaaacgttcctcttccctgccactcaccagcgattctcagcctagcttctcctgcggttgtagaagacaatccaacgcataatcacacacgaaaggaacaaacagcacctaagaattccagatatacagaacaggttgcatgtaataatgtcgagcacgcaacaaattctccacaaattggatcaagaaagagagcagggaaaataatggaaaggaccggacctacgcactcggcggggggagcagatccatctcccaccgcctgacgtcctccgccatcgagaggatccaaacttgcacggttggaggggctgcgtagcaagaccgaggacggcatttgggcacgagaaagacgatctgtcctaccaaaaaaggagtatttggttgagattagctttgttagaaatgaaaagacaaataagataagcaagatgatcttgattttagctgctagaattaaggccatgtaataacaaatagaagaatttcgaaaaattaaatgatttttccattcaatctaacagtgttttgactttgtgattccttcatatggaagggcagccaatttgtaacaaaggcagaaactgggactatcatatcgtaaaaaatttctaaactagtgcataatctcggaagtgaagcctaacctattttccttaacagctaaacacatttgaaacaaaggcagaagctgagacacctgaacagaacaatttgttaagctatttctaaatctagcaaatcaaatcaaaactttggagctgcattagtttgactacaaataagcgtgcagatcgatgcgtgagaccctggggtgcagtggcgatcgaacctgaaatctacttctctttttttttctgcaatgtcccctgtgccggtatgaagtatgaacatgtgtgccgacgttcacctatacagctccagcaatcatgtgccatcatttttattgatggaagagtagaaaaaaatctaataccatgggagattgatttattgcaaggagcagggtaatctggagatggcaaatcacaatagaaaataattcaacttaccagccgtgaccagatgaatttccagccactataggagcatctccaaacctccaattctgatattttggctatgattataggtctcgagcaagcaaactgatgttgcaatgattttagcttcatggaaaaaaaattggggacagatcagcagcatgctaaatatgccatcaataaaaaagttacttaacaggatttacaaaatcatcagagagccatgatctgactctatccctcctaaggttgtgctcctgcagaacaaaaaagaggcaataagcaagtttcaccaacaaaatgcgtgaaacgaataataactcattacacagatttcagttggcaactaaacattgaagtttccgggatataatttaggggaaaacttactgctagcatatgggaatttacctgttcaatatgccagttagcgagccatagcttctggtccattcctgctcaactctatgatcttgctgcatgcaccaaaacaaagcaaaaatcgagtcaaaccaagagcacatagcatcaaaagccccagccactcaaagcctcaacagaagggatgaactgatgcaaggaatcaagttcagggacgtactccctctcctcaagagcaatctcatgaggagatcgggattaacagagagagatgggatctttccttgaccagctgcgcgattccctccttgcccgcatccaccgcacacaccggtccggcagggtccatgggtgtacctcctcattacagccccgaccttggatatcgatctcatgccattcatagccatcctcccggtgcagcggcgccggccgcctccgcctccaccgctggcagtgccaggatggcgacctggtggggagcaaagacggtggcctccatggtggctcgtctcaatggaggaggtgcggtggcatccgtaacccgtagtgctgggggcggggtagggtttggggatttggaccggcggcgcggcggcgataggcgaggggcaggggcatgccggcggtggggtagtgtttggtgattgggtacggccccgattggcgaggggccagaatcgcgccgcngatgggtaaggggacgggcaaaaataccggtgcgcgagagagaagggggcgcgtgagacaaggagttagcgagagagaaagaaggcgcgtcggcgcgtgggcgtgaccgcgtggggaggagcgcgaagggagggggtctcatctggcacgttcgatcacagttagatgaatatgagccattggatttgatgaatgagtaatgtaggtgtaagagtgagttggtgaattatagggtagattatgcattgtatgcatatagctattcctccttcactgtgcaacattattaaacataatataatttaagtattttacgaaagggaaaatagcttcttttatctactataaaaaaatacccgtgtgttgcaatgggtgaagttatgttaatcttattattgttataggtttaactaaggtaaaattcattgtgcgattttgctcgattttcttttttataaaatcatgacccgcagttaggagtctgattttctcaagtttcatgcaagtttttttaaagagatttcttatacaactccttttgtattctcaaaagcgaataaacttaaaaaccgactaaaacacgaatgacgtatcaaagtaccggcaaaaacatcttcaatttttataatagtagagaagtgcgtcaggccacgtcgtacccctcccacttgctgtaccatcggcctaggcacgatccaatatgactcgtgctgtgccggaccagcctgaatgcatgaaggcccaccgtgctcaaccttggaaaaaaattatattttgcgttcctcatctatttgggccattggctagattaagtctattttgcgccgcagctatttgtgccatatataccttatatagccggaataagtttattttggctcgctcatctatttaactccttgattgttggaccggaccatgccaaactggcccatcgtgccgaggaagaggcccacgcaagggcccgacactgccagtcggaccgtgccatgtttaggctgggccaaaaccccatactatgggccgagccattggaccccgggcctttcggccaactataagtgctactgctacgtcttgtcctgcccgcgtgctgaaacatggatgggccatgcatgtaggtctcctgggcctgtgggcaagatgcaccagcatcttgtgcgctacacgcatgcatgcttgcaatccatcacatcaacctgaacccaaatccactgtacgtgcatacgctgatatatatgcatggataattggatatgcacttgtctacatatattagcctattgcaaataaaaacttaaaataacttactactggctttttttatctttgggtatatattccacgtgtgatcaatcgtttataatacggaattggaacgagatatactccctccgtactcgtaaaggaagtcgttttggacaatatttaagtcaaacattaggaatataaatcatgaataacccttaagttgttgagtttgaagatgtaaaaattatatgaatagatttatcttgaaaaatactttcataaaagtatacatatatcacttttcaataaatattttataaaaataaaaagttaaagttatgttttggagaccgtatcgctgtccaaaacgacttcctttacgagtactgagtagtatatatctataaaactattactccctccattccattttaagttacatagactttgaacaaacctaaaatgataaaacaacaaaaaggattaaaatgcatagagtacattaaaaaggtttaagtccatttaaccccgccaagattgtattagtctaaaatataccccttaactttaatatcgggtattacagactcctcaacttttgaaaccgtttaatttattcccttgtccaaaactaaagagtaaatttcagaaaactccatattgtatgattaaagttgtggaaaccatatgtattaattatgatgtgtggcacaccacaagatttatggtctccatgtttcataaaaccccatctttatttaaatcttaataaatttcagcatatctaaataaaattttgaaagtacagtaaagcttctatcaatctagtcaataacttaataattaaattttcatttgcactctacgttttttaattttaagtaaattcatgctcaaaatgcataagggtggagttttgtgaaactttgaaaacaacaatacttgaggttagatgccgcgtgtcataatacatatggtttctacaactttgaccatacaacacgaagttttctaaaagagtaaattgcatccatggtgcatcaacttggcaggtgggtgcaatttagtgcaataacttgagttgagaaatgaacgttctagtgcaataatttggtaggtaggtgcaatttagtataagaactttataagtgatcgtataaatgcaacaacttgcaaggtaggtacgattttgatacagtaaattaaaaagttatgctacaacttgattatttggagcattttttttataaattcaatttttaagtactaattttgacaatatactagcgcatatttcacagatttgataagtgtatttatatttttatcataataactaataactgaaagccaattaaactatatgtagaaattattatatttcggttgatatttgataagatgaagaaaacaaaaaaaatcttaaaggtaattggatgtaaattgtactactatgtgcttataaggcaatatccatatgattactatgtaatggcatattgacatcgtgaaaaaaactcaccttgtatatgcttagccaagttgatgtacaaaaatactaaattgttaagttcttatactagaacgcacccacttgtcaagttgttgcacttggacgttcaattttcaagttcttgcattatatcgcatccacatgccaagttgttgtaccgtgggagcaatttactctttctaaaatttactcaaaagcgaatggttttggtctttgtgattttgggacttcactccgataacatatggagttaaatataagtattaacaactaattcaaaataagagcttaaactaattaagaaggggcaattgcaaagaaagatggtagtaattcacttatactctaacacggggaacgagccatgctagcaaggaatgatgggaggcagcgtgcagggaaggtagtgaattagtagcaacattttattcatatgttaaaaaaacacaaagtatttttctggttattcatgaaagatagattgaaaaataggaatatgttaggaaggatgaattttgaagatactctccaacatctatttttgaccaaccttctgctcaagaatactaatttatactgatccctccatttcatactataagtcattttaacttttttctaatcatttttttatgtttgactaagtttatagaaaaaaattagcaacatctacaatatcgaattagttttactataaatgtaacattaaatatattttgataatacgtttgttttgtgtttaaaatattatacttttctataaatttgatcaaaccaaaaaagtttgactagaagaaaaaaacaaaataacttataatatgaaacggagaatgtaattaataacttccctagctaccatatcggttttctagatttttgaagtttttgcaccttgggatggatgccacatggtatcttttgcaacagtgctccttgattgagtgggtgaaactagcagcacatggttcaacggtcatttgttctgtatacttgacgtgcatgctgacatcgtgtccggtgtggttaattgccgctggccggttgtagcgtgcatgcaagttgaagccatatttttactgatctctctgaagatacatatgtttccccttttacatggagattatcatcacaatggcttggagtatttgaatcacaagcaatcatacgattttcagaaatataagtcctattcaagtttgtaaatccagacaaaaatcaaattttgtcttggttatctagagaacaaaatagagttaccacggatctactactacttttatatatatatatatatatatatatatatatatatatatagagtttaagatgtttccttcgtccgttaataaaaaaatgataaaaaagtccgattgtaattaaaaaatcccagggcaaaaaaatgcggcaaaaaaaaaaagctgaccgattcctattcctactaaaaaggcggaaaaaaaaagtgcggcaaaaaacgattgtaaaaaggaaaactatgtttcgctattttttttttgcggttttttcgtcgggccaaaccctagcgccgccgccatgtcgatttgcatctttatgtgtttcctcatccaattgattgcaaaaatcgattctccactactctcgtcattttccccttgaatttccctttcagttcattatttttttccccaagttttgtggattgcttcgattttggtaaaaaaacgaaaaaggggatcaagtggatcaaaatctctaataattttggagatcgagaaagattcgaccgcatttgacagagaggatcaactccgccatcatacggacacggtactatgcgagctcgaccagattaccggatttgatgggaggtttggctccgtcatggtacgggcacgagattgttcgagctaggcctacagctccacttgtgggctgaggcgaagagagataggccgagcagatagaggtagcggactgctttaggactagagctgaaaagaaggaaggaatgaacgtccggtccaaaaacaaaaaagcatccggtccaaaacaaagggagtataatgtataggataaaaaaagtttttacccgtagcaacgcacgggcattttttttagtaaaggaaaaagtacgaattaaccccccccccccgaactatcacggtcgtccgaattacccccctgaactcgaaaaccatacattttacaccctcaactactaaaaccggacaaataaccccccgagcactgttttggacggttttaactggaatcagcatatgtggccgccaacgtggcatctggtcagcaaaataaaacattaaaaaaatctagtcccacatgtcatctctttcctcacaccaatccctccccaatcccattccccctgcttcccttctctctctcttgctttgcgtctacggctggagaaggaggagatggtggccggtggcggaggcggatcgatgcacggagcatgaggctcccgccgctcggcgacgtcggtgcgccggcgagcctccgcagaagcatgaggcggagatgagggacgagcacgacagccgcctttggttatgggggacgagcacgacatgccgcgcacgacacccgccgtgccctccccgaggaggactcgtcgcccaccgccgttgacacggagctcgagaggggtacctcaccgtcgtctccagggaaggggggagcagcagcgcagcgcggggacgggcggtgggcggcggcgtgtaggggcggctggcgcggggacaggcggtgggggcggtcagcgcgggaacaggggtgtgtgaccttctcgtttttgaagcgcgtgcggctgttgcggtcggcgcgcgagggccagcgacagttggcagcgcgggccatcagcgggcgagggctggtggggtgcagcgtcgcgggcggtcggcacgcgaggactggcgacaagtggcgtcgaggtggtgaggactactgttgacgccgacgtaaacgatacaattgcctggaccggtgaaacattggacttatcccttcgccggagatcgaagacgatgcagccccgcgtcgggtgccaagttccgccggaacgtaaaaacaaaagtagaagtaaaaaaggtggcgatgcgccgaattgtattgatcgtgaggacagattacatagaccccaggtgtacatatttatatccatgggttgatataagtccttgtcggacaagaaagaaactttcctaaagataaaaggaaaagataaagtccttataggacactaaacacactttcctaaagataaaaggaaactaacaaactattcctaattaatagataacttaccatgccgtattctctttaaactcggtctcttctggataagcttcctttagtagatcaatttccttaaccgaatatagcaagaatccgacaactgacgacttgacaactctcatcggctaatctcaggacttcgaagccgatgctgactctacgccgatgactactccgggcttaccaaatttcactgttaacaactacgtggcggagctggagcgcgcgttggaggtggtcgagacggagtccgcgagggcgcgtgtggagctggagatcgaccgtgcagggaggaaggtcgccggggaggagatggacgacgacgacactgacagcgcctccgccgccgtctcgcgccccgccgtgcccgtggtggcggaggcgacgaccgtgctgttgctcccggtggtgcacgaaggcgacggcgacgaggcgctcgcccacgcaccgaggcggaccaagacggacgtggacgtcggcatagtggaggtggacacggtgggcggtggtgccagggtgggggcccgtggcggagctcgccggcgaggctagcatccgcagccgccgtcgtcgccgccgacgctcgcccaattgtgcccgcagcagccgccgccgctcacccagccgcgcccgcagccacctccgctcgctcagccgcgcccgccgccaccgctcgccccgccgctgcgtgctttagcgaggggaggggatgaatccaggaggagagagaaggtgagcaatacaggagagagattgacaggtgggccccaccgaatttttttaaaggattgctgacttggctgacacgtgtatgccacgtaggatcaaaaccactccagagattgagtaggggggttatttgttcggttttagtagttgagggtgtaaaatgtctggttttcgagttcaaggggataattcggacgatcgcgatagttcggggaaggggtaattcgtactttttccgattatagaatggctagacagcatgcattgagatctatacagtttcttttttaattatatatatttaatatatacacagtaggagcctctaaatagcgacagtgctttatccattgaatatgatatgttagttaaaaaatactaatacgttagttaaaaaaaaaagtacttacatcgggctcgaaggagaacaagttcgcggtgaccagcgggcttgagttgttgttgtgataaggaggtgacagaggaagataagggagagaagatggagcatgatccttttgtgttctcatcacaagtatcacaggtgttctatgtgcaggaaccaaaagcacaaggatggcatgttgcacaaccatataggccgagggatctatatgatatgggtacagaaccatcagatagtgatgaggatgacccaacaagctagttttgttgtgatagacttcattatttaatgggatttgtctgttatttcgatcgtgtgatatgttcatacacttttgaagtattttttatcactaattttgttatctgccttgatatatttctctaactattttctcaatgaattttttcgtcgtgtgttcaaatggacttatttgttcagttgtttgtactatatacaaaatattgctgtgctatgaagaagctaagtatttcttttaggtgagttgttttggggacaaataaatgattttgtgctgatgaggtttacgctaacacccaaatatttgtttagcatcctgcactaaaaataacaatatgctgttctagtgcagtggtttccactagcgaggacactctataggtccagacttcgattcctttttagcccttattttttttgtccagttagctgtaacatgtaaatatattattagattaaattaaattaagtaaaagaaaaaaagagctagctgtaaatgtcaaatatatcctatcttactataaaaaaaattaaattaagtaaaagaaaaaaagagctagctgtaaatgtcaaatatatcctatcttactataaagttatcccccactaacttcttaagcttaacatgcaaagatgccacatcatcatccactaacaagatgccacatcatcatccactaattaacaagataccacatcatcattcactaacaatcatcacatttaaacatcatgcaaacatgctatatctttatagtttttataatttaagagcttttcaaatacaaacatgttaaattataatctaacataattatgtgaattcacatcatgtttcaatgtatatctttattatgttttatgatatcctatatacttatatagttcatcctcacttagttagtgcttaaatgattaatctatggttcaaattatctttctctttttttcctctaattaagtcatatcacatcaattgtttttagcctttagatgattaatctacggtacaaactatctccctacttttcttcttccataaagtcataccaccttactttttacgtttgaatcaccattctacatactatttaaatttaaattatcgtaaaccacattaatttacttaatctgatgttatctagttatcttacacgttattttttttattgttatcatactaaatttccgcagtaatgcgcagagtttcatctagttattgaaatattcatgaagtaacagaaaaaggaacacctgtaactgtcgatctattattaactcaataaaacaatataaaagccaccatattcactctcatgacctagaatttcccatattaataaaaaagaaaaaaatagagtccaagtgtatagattaaaaatatctgtaattcggaataataataaaaggataaaagaagtacatgtagaaatgcaattttgaaaagaaaacttaaattcgtatttaaaaattaaattaagacaagagtcaacgtagaaataccttttaggctgaaaaatatgaaattcggattaaaaatttaaaataaatattgaaataaaattatatgtataaatataattcaatctaaaagtcggaataaaaattaaaactacaagaaatagtccatatagaaatacaatttgaaactacctaaaattcagataaaaagatagcattgtgtacaaaagagttcatggaggagttcatggggtggcttggacatgggctacccattttttgggctagatctagcgtctggctggagcattctcgtctttatctcagcccgtggcgttgtgtgttgcagagacgcaaggtgggtgaagaggtaaagaaaaaggcctagttgacatatgctcatgtcgggtcatgcatacaggttggcatctagaatatgcgctggactgccatggtggattcagcctaaggaagcaaagagattttctttttccattacatagacaagatgcacgtgtagtcggtgacaccacactcatatactcacgtacactacgttattaaaatagacgaagacacaataacattttacttaaacttatgctggcttcgatttctgcaaatactagtaggcagtatatgctgataaatttaaacaggtaattatccaagagccaaattaaccaagacagtaataagaaagcacaatagtatcaataatgcaatttggttgaagctgtcctatagtatagaactatcctcctttttaataaaacggactagtagcactgtgtactgtaggagtactactcgattaaagcataacttttgcttgtttaacaccaccaattggaagcaagagcatcaagggtgaacactgcatgcagtgtgcacgttcacagtgcactactcttaatcgatcggtactgcctgataaaatcaaacttacggcattaattttaaacctgcaaattcggcgcaaattgctaatcatgatgtaatataattagctgatctcagctcactcccagctagtagcctttatcgatctatataaaccacatgcatagcctgctttttcttcactcatccacacacagctctagcctcttgctacatagagtttgcgaggatttatcagcaatggcagctgtagcacgagcactactcttcgccgccatcgtctgcactgccctcgtgatggctgtcaccgccgctgcggacggcgaggcggcggcgatcgtcgtcgggttggccaagtgcggcgactgctccagcaagaacatgaaggggcaggatgctttcaagggtatatatatcatgatgatgatgataatatgttcatcgctaattaattgcgtactcagctcgatcgatcgatatatcaccgtcgttgattaattgtttggtgatgttcaggtctccaggtggcgatcaagtgcaggaacggcgacggcgagtacgagagctaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtgccgctgtcgtcaacaacggacaacggcgtcgataaggctaacaccttcgtggccgtcgccggcaagaggatgtactcctccacgtcgccagcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaatataagttgtgagatgtgagaggagtgtgactgtgtgagatcgatcgatcgtgtaggatcgaatcacaagaactaagccaaccagagggggtgaatggttggtatacccaaaaaccgaaaacttttagcggaaataaaagttaccctcgaaatcgatggagatcggtctgaccgaagtagattagccggtctgaccgaagcgtagcccccggtctgaccggtgttgatctaccggtctaaccgccgtgatcgcctgccgcctactgtcgccgccgtcggtctgaccgccgtgctcccgccggtctgaccgccgcaatgccgctggtctgaccaccggtgagttgtcggttagaccgccgaaacccggtgaaacacaaatcgaagaactcttaaagtgaatgacgactttattaattctctctatgtttacaaagtgcaccaacaacactccttacaaaaatttcgactaaactcgaaaccctaactcaaaactcaattctattgctctctaaagcgataccgggaagcctcacgctccccctctatttatacatgaggtaggcagcctaaagccacgaaccaaactcatactaggagtcctaaacaccttaggaaaccctctagtacaagaaagaaactttacataaccaatcgtaccaaatttggactccttccaatttcgactccgcatcccatacgcacacaataactccatcgtatgccatatggaatctccatcaaccacgtgcatcaactctagccttagtatcccgcatgatctctgaccacaacggacgtcgtcttatccccaagccaactcccggtccatcaccgtaaatactctcccgagacatcgagtcacctacacatggaatagacaaagaaaccatattccgagaccaagctatctccaacttgactcattagcagtaaacaatagtattacatacgtataatatccatctagaagtcataatcatgaaataaactcggatatccaaataaacaacccgaaaccgaaaccgacacagtgtcggccggtcagaccgcgggctggccggtccgaccgcttgatcaccgctggtctgaccggcaacacctgcccggtctgaccggtccacataaaatgataacctgtagattcacctgtgaaatccaatcatctccaaaccacttcgtgaataaattccaaataacaaaaccaataatctctaatgctcaattgttcatcacagaataattatcaaaaacacctttgattttacagatcgatgtatgtgttggagacttggagtcagtgcataagcattggctttcaggtgataaataatttcagagtgcttatgtgtgtcgtgtctgtatttattcgcacatgtaatgcgacatgtgttctacataatgtaatttaaatatttataagattgttcatgttgacgtagaatcgcaatgccacaccttgagcacgttatgtgtaactcgcggcagcactcggagacgcgccatcatagggagtgggtagatgccgcccaacgaccacccgcgaaggaccccatcaggatgaacgtgcgtcggtttgttctaggctcagcaggccaactaggacgtcctctaataccgtagagacgagagatgacaagtaatcgaggatttgaggatttagaatttggataggtagcaagaaggagagagatgtagaatatagagggtttggataaataaattgattttgatgcatgattgattgcttgttgtttcaatcatccttggcccccttatatttataaaaggggtggacttgcttcctggggtttttccatatgcatttaggcatataaatcaactaagacttgaaaatttcggtctaaaacaagaaaacacgagaaatatctaaattggacttggactatgtgattaagatctaaccgcctggataccaatggtctaatctcagtgcattgtctgctttgaccggccacataatgacggttagaccagccttcgcgggaaagctctggcattttttaaatttggctcaaacttgctataactcgaccctactaccaaatttgattatcaacacatgccccccctgtctttttggcaaacttatgagccaaaaaaatactatgcatgagatcatctaagggcgatatccaccaataccgaccatgaattcctctaaggcttaaatgtttaatggtgatgtaagaaagctacgagaggcctctcttgttcagattgtattttgtttttctttggcctccactcttgcctcaccactttcttgtgtggattcttttgtgactgattcttttctctcaaccggctatgagatgagtgtggttgattatttaaaatgggtcaatgtggaaactggcaatgcccataatggataataatatggtatataaaaaggcatcatccacataccattaaaaatctataatacatttataccaagcgtaataccatggaaaaggagaagtaagttgccggtggtgcatactcgcttggtagatgaacttgatctccttggtcgcttgccatattttgatatctccagattgtcgtcttgcctcctaagtatttgtcgaggaatgatcctctctagcaggtggtcgtgagacccccccctttgtgagttcggccgggggaaatggcacgatgatcaagggcctacttccgcttgcggtctaatcgctagatcgctctcgtggctgtgtgggagatcaaggattatacaggttcgggccgttattgagtgtaataccctactcttgtgtatgggattatggtgaatttttacatgaggttttgagctctaagggaaacctagctgttcttcctccgagctcaagttctctgagagtcgtcccctttctcggtgggcgaggtcctccttttatagtccaaggggataccacatgcactgtttgcacctacccctccatcggagggggggcacatggccctaatcataccgctatcctttgcttcaactggaagcaacatggtcgcctggctccaggtggggcccagcgccgcccccgcctgacacgggggacatccctgtcattccctattattgtatgaagacttcggcggctcaccacgcgcgtggggcgcccctggaagcgtgccgatgggacagggcatacctgcccccactccgcctgacacagggcggaacgtgggggcactgcccccgtcccgtcgcctgtgaccggtcacaggccggtcaagctcgattgatatggtgttgacggtccttaaatcataatatcggaccgtcaatacctgcatataatgaaataaaacatggtatccaacttagtggtaggtattattactaatcatttccactagtattggtgaaatatgtgtatgcaagtaatttgaggagaaaacacatccgtcatgtgacaaaatgcacctccgcgcattcaggacgcgtttacacggattagaggcccaataagtcaataaaaaccatttagaattgggccaaaacatagcccaggttgttgggggcccaataagcaacctcccggctgaaggagaggccgggaggagagtttttgggtttggccgaacccaccagttcggacaaaccaatcctggcgcttcccatcatctgctttcacctggacggctcggatttctcccctaaggcagttgcagggtgttttggtcatttcccatacccctaaccgtcatttggagcctatataagaggtcacattctcatttccaagacacacaattttgagctgaattataagaggctctattgtatcttttgtacattataataaggtagagagtgaggggaagctctggaggagtgcccggaagtttggcgctcatccgacttctatctcgacgagtgtagcttcctaggaggaattcggggggagtaccggagctgtcggtacactctgctctgggttcggagaacctcttctataaagtaagcattcgtgttcctttcttatattatttaattactttgtctaagtaagatagattttcatctttgcgggttctttatctagtattcatactaagtgctctagtactaggactctggataaagaaggaagttcatgtacaagtattagagtagtaattaataacttagacgtggtgtctaggttagagattacctttgtttgttgtgtatcccacggatttgtcagaggtaggcgacaagtggtaacagccctgaatcccgtcctaataattctccacgttcggatacatcatagagctatagccggaaccacgctggcagaccagcaggggtcggtgcccgaagcaacaaataggaaattaccttcaacttagcttagataattaaaacacatagaaagtcctctctagcttgcctagcctatctatagttgttgtcattggatcgtcttagccttaggtaaattacacacgttccctgagttcgatatctttttggggtcacccgaaggtgaagtgctacaacagtattccgtgcgcttgcggatttatctgtggacgtaagaaataccaacacatgggtcaatcgagcggcgccgcacatccctccacgccgcattaaatgctgcttggggcggttggtgcaccgcgcattgaaggcgcggagcagtgtctttcgccccgcccgctctccccgccacgaggtggtcaggcgagggcctcggggtagcacgccccgaaagcccgaggagtgcgacgtggcaccccgaggtccctctggccacctcagcgctacccgaggggcggggggaggcgaggccacgtagccacgcgactagatgggaaggatacttccctctactgtgcgtacccccgggcccatttcaccgacagtattgaagtcttcaatgtggtcttctccttgccatcgggaatctccttctcttgcaattcaacggtctgtataggaaaaggtagctcatccacctgcatctttgtaaaagtcaatcgtcattcgtcaattgccgattgaacttgtctatggaatacattgcaatcatttgtggcatgagaattggagttgtgacacttataatatgctcgccgctctattcttcaagtgaaggtatggcgtggccatgtgacaatttaattttcttcttttactagtaattattcaaaaatcctattgcatttggccacatcaaacgtgaactttatttcctcttgctgattcttacgactaaccagcttaagagcggagcaaacggatggtttagagttggagttcaaaacccatttgtgtatgtatacatcaactgtctctttgttcaaagattcttgttgatcaactatattaacatgggcacaatcagacttaactttttgcgagattttggcctctttaactcggctctcttgagttaaagccttttgaagtaattggcttacatctaagaaagtatgaccatctagcttttcttttaaatattcaagtaaaccagaataagccaaatctaccaagaccttatcagaaagtgttaaactataacatcagtttcttatatatataaatcttctaatgtattcaaaagtaggctcgttatacttttgtttaaccgaggttaagtacgacaagtttaattcggtctcaccactaattaaagaagtaatcatgatatttttgttctaactcagaccaatcatgaatacagttggtgcaagtgaaataaacccaaaaaattgcgcgcatcaccaaataaagacaatgggaaaaagcctaagtttcaaaatactactagcactagcttcttcgcattgaataataaactggtcgatatcctctaaagtagaccggccatgttctccagtgaacttacacaatgaggcaatcaaaacccttg

SEQ ID NO: 17370 - DNA, 9626 bp, Oryza sativa
ctgaactagatcgcacaatctttggggaattttctggttgtttttcattcaactgaataataaacttacaactgtaaaactgagctaaataaactatttatactccatacataacagaacgaatccgaggcaaaaatcgtgccatcccacgatccgcaattctctgactcgctacacacacactcccctgcgctaaactcacgcacacgacacggtcttcaactcccagatcgccgcatcacccgcgcctgctaacaacctgctggcgacttattctccacaccgttgcaactgcaaaatggatcacgatggggccacagctgaagatacaatttcaacatgtagcacgaacactactactcttcgccgccgtcgtctgcgccgccgtgatggcagttgccgctgctgcggacggcgaggtggcggcggtcgtcgtcggtcaggccaagtgcggcgagtgcaccaggaagaacatgatggcgcaggatgctttcaagggtatatatatatcatgatgatgatgatgatgatgatatgttcatcattgattaattgcgatcgatatatcaccgtccttgattaattgttgggtgatgttcaggtctccaggtggcgatcaagtgcaagaacagcgatggcgagtacgagagctaggccgtcggcgacctcgacggcgacggcgccttcagcgtgcccctcgccgccgacgacctccacggcgccgccgactgcttcgcgcagctgcacagcgcgacgagcagcacgccgtgccccgggcaggagccgtccaagatcgtgccgctgtcgtcaacaacggacaacggcgtcgataaggctaacaccttcgtggccgtcgccggcaagaggatgtactcctccacgtcgccagcggagtgcacgtcggcgttcctgtacgactacttccacaagcaccccttcttcgactatttccacaagaaaccccaaggccccgaacccaagccggatcccaagccaacgccattgccggcgaacggtggtggtggcggtgcgggaaacggtggtggcggcgcccaggggaacagtggcggagctgcgccgtctcccagctctccgccggtctaccactgaatcgatcgatcatccattccatcaatccacacttggttgcgtgattaattaatttgcaggtcagcttgttcgtgaagaataaataaaagttgtgagatgtgagaggagtgtgactgtgtgtgagatcgatcggtcgatatatgtgttggagacttggagtcagtgcataagcattgcctttcaggtgaaaaataatgcgcgtttcagagtgctcctgtgtgtcgttgtctctatttattcgcatatgtaatgcggtatgtgttctacgtaatgtaatctctttatgtatttttaagattgttcatgttgacgtagaatcacaacaccacatcttagcacgttatgtgcaacttgcgcccaacgaacacccacctgccagggtgaacgaacgttggtttatcctaagctcggcaggcaagctagggcatcttctaataccgtggaaacgacagatgccaagcaattgaggatttgaggataataaaatttgagataggtagcaagaaggagggagatatatgtagaatatagagggtttggataaataaattgattttgacgattggttgcttgttgtttcaatcgtccttggccaggaatgctactgggcgagcgatcgcccttaatcgctcagggcgatcagtttttgcgccccccccccctccttccctccatctctccaccttgtttcctttgttggcaccgcattactttcctattttagtaaatttatacacctaaagtttacacatctaaagtttagagaccaaaaatttataagtcaaaagtttatacatcctattcaaatttgaatttgaattcaaatatttatatatatatagtatttctatacatctaaagtttatacacctaaagtttatagacctaaagtttataagtcaaaagtttatatacccgtttcaaatttgaatttgaattcaaatatccgattcaaatttgaatttgaattcaaatatttttcatatatagtatttctatacatctaaagtttatacacctaaagtttaaactttagacctaaagtaagtttatagacctaaagtttatatacccgattcaaatttgaatttgaattatatcttattcaaatttgaatttgaattcaaatattttctatatatagtatttctatacatctaaagtttatacacctaaagtttatagacccaaagtttataagtcaaaagtttacatactcgattcaaatttgaatttgaattcaaattttttatatatagtatttctatacataaatttttctaacttttatttttcaaaaaaatttgtgtagtctactgtagtataaagaggagaaggggaggaggaataggggagaggagggagtatagggggaggggggctggatccgatcgcccaggcgatcgcctggcgatcgatcgcccattagggccccccgtccttggcccccttatatttataggaggggtggacttgcttcctggggttttttcatatgcaattaggcatataaatcaactaggactcaaaaattttggtgtaaaacaagaaaacacgagaagtatctaaattaaattggactcggactatgtgattaaggtctaaccgcctggatacctatggtctaatcacagtgcattgtccggtttgaccggccacataataacggtcacaccagtcttcgcgggaaagctctggcattttataaatttggctcaaacttgctataactcgactctactgccaaatttgattatcaacacatgcccccctgtcttttcggcaaacttgtgagccaaaaaatactatgcatgagatcatctaagggcgatatccaccaataccggccatgaatgcctctaaggcttaaatgtttaatggtgatgtaagaaagctacgagaggcccctcttgttcagattgtattttgtttttctttagcctccactcttgcctcgccactttcttgtgtggattcttttgtgactgattattttctctcaaccggctatgagatgagtgtggttgattatttaaaatcggtcaatgtggcaaccggcaatgcccataatggatgataatatggtatataaataggcatcatccacataccattaaaactccataatgcaaaccaagcgtaataccatgaagaaggagaagtaagttgccggtggtgcatactcacttggtagatgaacttgatctccttggttgcttgtcatattttgatatctccagattgtcatcttgcctcctaagtattgaagtcttcaatgtggtctccaagtgtaataccatgaagaaggagaagttagttgccggtggtgcatactcgcttggtagatgaacttgatctccttggttgcttgtcatattttgatatctccagattgtcaccttgccccctaagtattgaagtcttcaatgtggtcttctccttgccatcgggaatctccttctcttgcaattcagcagtctgtataggaaaaggtaatgcaggtggatgagctacctttgtttctaattgcatttggccacatcaaaagtgaacgttatttcctcttgtcgattcttacgactaaccagcttaagaacggagcaaacgaatggtttagagttggagttccaaacccattcgtctatgtatacatcaactgtctcattgttcaaagattcttgttcataaactatattaacatgggaacaatcagacataaatttctatgagattttggcctctttaacttggctctcttgagtcaaagccatttgaagtaattggcttacatctaagaaagtatgaccatctagcttttcttttaaatattcaagtaaaccagaataaggcaaatctaccaagaccttatcagaaagtgttaaactataacatcggtttcttgtatatataaaatcttctaatgtagatcaaaagtaggctcattatactttttttaaccgatattaagtacgacaaatttaattcggactcaccactaattaaagaagtaatcatgatatttttgttctaactcagaccaatcatgaatagagttggtgcaagtgaaataaacccaagtaaatgcatcaccaaataaagacaatgggaaaagcctaagtttcaaaatactactagctaggcttcttcgcattgtataataatgtaacatcctcaaattttaaactaaaatttgactgcatcatgctggtttttgactagattagtacaatttaaaattttatttgaatccttttattggttcaagtattattcctttagaactcttttaacttaccctaattattccctttatcctaaaacttagtgaattttagcaaattctcacaaatttcgaactttagtatatttctttagtttaccccctttcattagtgagaattttctatactctaaaccctagtgaaaccctttcaaacttatagattaaattcattcttttctaggaaaaatattcaaaatttctgaaaacactattcattgccctcaaggtgttcgatgaaatgcccagcccaactatctcagcccaacatctacccaaacctttgcaaagtctaagtttgatccttggggaccacaacccatccaaaactgtggttcactttgccttttccaccccctttacttgcgccaccctggcatcctccatcgccgcacgccgagccgccgcgcgtcggcttcagggccgttcgcgtgtgcccgaccgccttggcgcgccgctagtcgttcgacgccctaagaccaccgccaccgcaccaatcgtgatgaagacgaagccaggatgacctccgccgcaagttaccgccgctcgacgctgtgcacgcccgtccaaagccgccgccaagtccgaattcgcttctacccggggtgaatcgcgccaattcttgccgcactgttggattgaagataagcggtggtttcccctatcacaattcaaaccgaccaccgccatgctgaccgttttaaccctcgccgctgccgcgcgtcgagcccggattggcgccaacacgtcgccagacgttttcacccatggtcaagtcaagccttcgtcagtaagaattcgaacgtggcctcccgccactcaaattgatcttgccctccctctcacagctccctgccacccctgccgtgctcaatttccaagctcatcaatggcgttgatggcgcccgagctcatccacttcttctggccctataaataggaccccaatcccttccttgtccatcatcgatcatcatcaaccataaccccacaaccctgaagctctgctttgccaaaccataccatcaaccacttccgcccgtcggtcgaacaccttgtgtgcgattgacttcacgcccctccatccactctccatcctaactaatccttagaacacctaatatcaaccatgctctagcatattggagcctaaccgaagctttgcgtcgagtttcacctcgtcgcaccgagctaagcactgtcgcccctgctctgctctggttctcaccgccgagaagtttttccggccgcaatccgtcgtctcagcctatctcggtgagttctttcattttaaccatctacgtactccctagattccatattcgcaatcggccagcattaccatgccaccttctgggctgccgacatgagctcgtccgtcgccaatggaggtgctcgtcggcaagttcttccacaccttgccgaaagtcggcaagctacctaaatccttctaagtaccccgtagatgctctaggaaccctccccgtgctatgcctaactctcaccaccccgatcaccttcacggcctatccatgtcaccgccgccctagccgttagcccacccacacatcaaattaacccctccgccgccactcgccgtcgccggagaaccctagctacctcccctcctcggccgcaaccccctttccccctctatcaccgccgaaatcgctaaccctagcaccgccggccgtaaatggggaacggctagaggttgaagaagagaagagagaaagagactgacaggtgggacccgcacacagtatcatttcacatttaatttgattttcaaactttagaagctcatatcttttaaaatatagatccaattccagtgaaacttggaccaaaattcttctaaaatcattctctatcttttgagtctacttttgctatttttctattttattttatttttcctatttttggattttatttgaattccttttgaatttgaattttatatgtttaaccctaggtcttgaagagtcctctgacatattagataatatcagtcaatctcaggacatcgagcaaggcaagttactattctaccttttgatcatttaagcctatattttacaaattatttatttatagccttctattcaatactctattttatatgcataattcaaccatagaaacccaaacaatttagtattgcttattttgcttacaatctggtctaaatatttcatacttagattgggacagtacgtaggaattggatgattttcgggtggctagtactgtctcgatcgatatagttattaccaggtacttatgtcgaacgaacaggtacgaccatagtttctagaatagggacatacctagtcattatattaattagcaatgtggtacctctgtatcgtggttcttatttttaagtcctcgagcaagaggcaactatagccacgaagggcaatttttaccattaccatgtacaagtaaatggtcgatgatactcgagtataaattattatgttataattctaaaccctgatcgagatgacgtggtgtcatacgagatcccccttaaataccccgggaacaccagaactcctctcgctgctgataacgttacgttcagagcgcatgaggactagagttcatggaacaggtaccacaattgttaataacctaatactgggtcatgactaagctaatgaatattggcaagtcgtggactgcgagtaaagcgtacatctactgtagtagaatattcatgaaactattcgaatggccgtactcatggaattgagtaccgagacccatatagtactctggttagaaacctaaagtctatgtatttacaaactcttgctttaatacttccagattgtttattattgtcttttgcaaagaactctactctataccaacacataacatgtttccatggtaacttgccgggtattgtgaatactcacccttgctcttataacccctttttcagatttgggtcaagaagaagactcctatgattattactacgatgactccaataacatagaaaatccctagaggttatacctccctagtcagaatgtataaaacctctatgtaatagtcttacttatgtgagtacctattcttgtaaaaccttagtattgtaaaatttaacgtatgcaatgaagaaccagttgcatattatgtatcaatatttactgatccaggggttgatacattaatctcagccggatccaagtttttaattttgggacccgacaaataaattggtcgatatcctctaaagtagatcagccatgttctccagtgaacttacacaatgaggcagtctaaacccttgaggatatggagcattataatagtggtcagggtagagtttttgatctatacgctttttaaccctagtatctatgccaaaagtgtttttgaaagcttcggcaatctcatcgctaagactcttgggttatgctcgtgtaccgctgactacaggatctggcaaaactcttacctgctcgtatcccatatgaactcctcgaattctacttaacaagaaattgattgtccgtataaatatatagcccctaggagagatcaaagagcatcgaatcataagccatagccacaagtcacatcgaatatcaatcaggaggaagtcaatagctagccgatgattctaagtcgttggattaattcttggtgaatgcttgttggtaggctagattagctagcttgctcccccattgtaatcagtttgatacattctagagatattcatataaactggattatggctattacccacatcggggcctgaatcaatataaaaatctctgtctctcgtttactttacggcaatctcgcgtatactttgataccaacatcttctatactttaaaaaaactattatataccgtcaacaagtatattctctaccattatacagacaagatgcacgtagtcaccactaaatacatacaccgcacttatacactcacgactgtgttccaatcatatgtttataaggcggatatgttgatcgaactatcacaaaaccacagatttagcatcaaatttatcagaaacctacatatttaaggtcaagtatcacgtaattaattatatatttaacattgaagttatcacaaaactacaaaattttgaggtcaaatctatagcaccaccattatgtttgagctataaatgttgtagttttgtgattaaattggcactaaacttgtagttttatgataattttgttacttaatctatagctttgtgaccatatatttcaaattaaatctgtagttttgtgataaacttaacactaaatctgtagtttttatgatataacaccttaaatcagtagttttgcaatagtttgatcaaagtatctgtagtttttgtgaaatttactcatttactgaaaaatagtatcaatcatgcaatttggttggagctgtcctatactatagaactattctccctttttataaaacaggctagtagtactgtgcgctgtaggagtaccagtcgattaaagcttaactttccttgttaaacaccaccaatcggcggcaagtgcatcaacagtcagcactgcatgcagtgtgaatgttcacagtgcctccatgaactactagctgctactcttaatcgatcggtgtctgatcaaatcaaataaaatgcacggcgttaatgattttaaacctgcaaattcggcgcaaattgctaatcatgttgtaatataattagctgacctcagatcactcccagctagtagcctttatcgatctatataaaccacatgcatagcctgctttttcttcactcatccacacacagctctagcctcttgctacatagagtttgcgaggatttatcagcaatggcagctgtagcacgagcactactcttcgccgccatcgtctgcactgccctcgtgatggctgtcaccgccgctgcggacggcgaggcggcggcgatcgtcgtcgggttggccaagtgcggcgactgctccagcaagaacatgaaggggcaggatgctttcaagggtatatatatcatgatgatgatgataatatgttcatcgctaattaattgcgtactcagctcgatcgatcgatatatcaccgtcgttgattaattgtttggtgatgttcaggtctccaggtggcgatcaagtgcaggaacggcgacggcgagtacgagagctaggccgtcggcgacctcgacggcgacggcgccttcagcgtgcccctcgccg

SEQ ID NO: 17371 - DNA, 1374 bp, Oryza sativa
aggaaaatgtaactgcattcggctatagtgcatggcatgatatatgcacgttatacacattatgtgtaccttttcaacaagacaataatcctcttacatggggagttgggaggcaaacaaaaaatatggggaacaggcaaaggttgagaatttttgtagctcaatgtttttgtaccatattcatccccatgcaaatcaatttcaaacaacaaaataaatgatggaaccattcaaacataattcatatgagagaattacagaataaaggataatgtctgtcactaattaaaaagcaaggaggtggaatgaaaccttgtaggagcgaagaagtgtgtattcataatatctcatcttttttacatcttttgaaacctctaccgtaagctctttttctgtcaactgcctaatgcggtaactgcagcaaacagagaatgaggcatgagaaagacaccttaatatgtaatcaaaatacaaaatgaaaatcaaccatcacatacctaggaataatgtccctgaacacagcaagcaaggacatcagactaagtttaacaaccttctggtctttgtcattgcatatgtttaacatatcatttagagatctaatatgtgattcaggatcttcaagcatagacatccctatttcagccagctgggccttctttttctcaaataattcctcagctgaaagttcctccttcacctcctcctgtcaatcggagcaagtacaagacatatgtgaaaaaaaaagcattaactaacaaatagcaacatggtgattttaagatcttgaagggttgaaattgtgggcccatcatttgttttaatattgacccaacattttacaaacatgcttttttctccatggttattcttgcactgcattctataggctgtatgattaatagtttaatacccagaactcatatacatactgtgatgttcacagttccgtaccatctgacctagcgttttctcgaaaaatcttagcgtttcatgtcaacaacgaataagccagagagcactaaactaatacaggtatgacagtcaaattatatatgtggatgtatgttgatcaacaatgatgcataggatacttccatactgacaaagttgcaatcaagcaaggccaaatcatatattttttgtgctaccgttatgaagaaggcatatatatagtacatagcatatggtttttccaacaaccaaagcaaggaggtcgagacagcttgtcttcctaacaggcattaaaattatgtatcataagcaaaaggcttgttgaaaaatgaatctctgtgatgcaaaaaaagaacaaggtaataccagcacttttgattgtaattttccatttgaagcttgagtattctatagtgtcac

SEQ ID NO: 17372 - DNA, 21480 bp, Oryza sativa
  unsure (1)..(21480): unsure at all n locations
tgcaggttatactatactatacctgtgtatcacgttcaaactatgatatatcagattataacatcagatacaattgtttgaggaaagcaaaacaaaatagcaaatccaggattcaagggaatcctgatacagtagagcgcaatgatgctatttcatctggctaacaccagcatccatgacttttaacccattaacagaggcagaccagctcaaatttacagcatatcccagagtctgattacatattttggatacataaactcctgcttatatcccattcctccaagctgattttagtgcatgtgtttaaaaccatgaaaataagtatcaagtcaaataataaccatgaatataattttcaaacaatcacgaaaggatcttgagtataatacatctatgtaagtgttgttcttgctagctggccctttcaccatgacagcaaagaatcgatggcaacatagattttttttttataaagcaacaactaagagtttttttaccacaagcagtggaggcagccattcattaagttttagaagaagcacaagtacacgcccttgtttacctaagtattggggggaacaatatcaaattcatcacaaagaagaaaacaaagtgcttgcagcacccccttcactaataacgatcgacatagcaatgtatggccatgtacctcagtaataaggtagaaattttattcaaccagcttctcgttgaagttcctcacctccatccttgatcaccgagaaatcagatgcctgcaaaaagcaataaatggtcagcatggtcaacatttcttatcaaggcaaaacactataatgaacatatagtgggcagactattgtactcatgttgacctacgcctccacaccatgccgcctcatatcaaaaaatgttttcatttgtacgacaattgcgcactacatttttaggaacatcaataagatattaatattaccttcattcaattcatatccacacaaaaaataaagaatctctgcatgtccattttaacaaaatgattagctgctagctcatcttgttcttgaaaatattttatcctattctgtctgagagaggcaatagagaactgaggatatacaaaatgatatgaacatattaatttagattgcagcactaaaacacactatatctagtgttgtggctgtcaataaccacctaatatgtgccttatggaattggaagcaatgaaccaatgagatcaaatcagtggtggaacaaaattagtttatcctaaacagttataggaacaaaactatatataaattattacttctagaagcaaccaagtatactttttgaaacagagtcttgccattttgccatagaaagtgtgctttagtagcccttcaaaaatatttttttcacttgtccagtatgcatactgtcagctgaaaagagttcattactaaccttgaataatattgaaagcactattcagaaaaggttaatcttttaagtgaggatggattatagttggactaaccatcttcctttgtcattttgatacagtatagtttaattgttgttgatctaccgtgtcaaatatagtgcatgcgacatcatgtaaagaatacagccttaccctctgagttgttattcaggtcatttctcatatatttattctattaggactttcaactttacgtgatgcatcaacatatattaattgttattatgaagataaaacatggcagcatatgcattcagcagaacttacctagaactatattatattggagagatagatggcatgagggatgagtctagtcgccaacctagtcacgtccagccgggatcgatttgcagccgccggggagagagtggagaggcgatacggtgtgcgatggtggtggaggtggtcgaaggggagagagcggagcggagatgcagaggaaggcgtctactttgaagctgctcaattaatttatccctagacaattcagaggaaccaaaataatcatttgtaaactgaaatgagattaaaatgcagatggaaacacacagacatatccaaggagtggatgctatagcagaaaaagacagattttataacgatggcatcaaatgtagacaaatatccacatatgaaatgcattctccatcagttcaaattacctcaatactgtatagaactattgatagagccgcaagaaagcatgcattttttttccgtaagagacagatgaactattcagatatatagggaggatttagcactattagacagtgaaaccaaacaatgtccatcagctttaagttaggttggacaccataccaggtggaggtgtaggggaggggggaagcgggtggctcccgtcgatccggcggtggcacaggtggagcggctgcgcagccgatggaggaggtcggttggaggctccctatgacggcgcaggtggagcggctggcggctcccgtcgatccggcggtggcataggttgagcggcagcgcagccgatggaggaggtcggagtgcgtaaaatttcaggtcaacgcattctccctcatctgccaagcaaaagcataaaaacttgatgtataatataagaagtaaaactgaaacaaagatagaaagcaatatgaaccatgagtatgtctagataacagagaaacctactcagatttgctatttaaatttggttgagataaatgcatattacaaataattaagggaggcagagctgaggcaagctttagctaacaggttatttctacttgattgcaacgaaagtatcactgcgaagaaatgctcagcatcgatagtgagctgtgcagcccagcatctcagaaatcaaggtacattcgatttcatccaatggaaaatcgcatcagttgttcagtatttacagtcgaacctaagatttggaaataacagcctcaatctcctatggggaaaatcagtaactccatttgcttcaagtgactctatctagcatcggtctcactgaaatcaacaaggcaaggcacagatcgttcaagcgtaacaaaaccaaagctattgcaagaacataggttgaaactgaaagggagagaagatgaaatctagggtttgggtaacaaacacacacctcgagaacaaacgaatcgaaacttttcttgtcgttctcaatcctgctcctgtgaggaaaaaaaaattgaacacccgattaaaagaaagcaaggcaggaggcgcctcgcccactccaccctgctcggggcgagacaacactagggcaagggcatccgcgtgaggggaggagaggaagagattagggtttggggagggggttggcgacgcttgagagaggaataacagatacctgggtggggcgtcgccgtcggcggaggcggtggactcctccatccccggtgcacagccaaccctccacatccccgggagcgcgacggcggaggcggcgaagaggaggtgggcgcgtcgtcggcggttggatcgctaccacgatctggcctggccttgtgggggagaagcgattcgcgggggaggagcgcgatgggccggccgatgggctcctccctcaacaccgtccgatctcccgatcccacggttaataataggtcgtgtgtctctagtgttaagtagagaagggcggagtagtcgtcgagtatatcgcgtaaaagaaaaaagaaatctccccgtctccttctccttgcctcctccgctccttctcgcgccgccgccgccaagacgagtcgcgtcgcggctgaacaggggagggccgggcggcgatctccatctggcgagcagcggaggggagggatcctgatcctggtgcgtcctctttctgattcatctctctctctctcccaccccacccccacccccaccgggactggaatttgcttgcgttcatcaaccctactagcttctcttctagatctggaagaagctcttctcctcctcctccttaatttgatagccttaaacctctcttaattcataattcaagtaataacagtttgtttcttcacccaaacttagaacccccatttggatccgcccctgttctcttctctgttatatatattgccttctagaaaatatttttttagaaaataattcagtgtccgctcagagaccgagcaccctaataggcagaggtcgaaatctaccaacaaatgagagttgggctgtgtttagttcgtgtgccaaaattactttgaagtatacagacacacatttgaagtattaaatgtagactaataacaaaacaaattacaggttccgtatataaactgcgagacgaatttattaagcaggctcaaaagattcgtctcgcaatttacatgcaaactgtacaattggttttttttcgtccacatttaattctccatgcatgtgtccaaacatttgatgtaacggaaaagttggaagtttgaagaaaaaattttgaatctaaacacggccttggtaggaccaaacctaccaacaaaagctagcggcttgtctcacatcaagtactggtcatgcctggtatatctgcgaaaaggttggtatgaacaatctccacacaaatgttatcagcttgatcacctagtattgtgtcgaacgggtgtccaatatgcttgtaagttggttaataaggtatgtgaagttatgctgaccgcatgagatacacaactagtaaccaattcaagtgctactaaaagtggtcaaggtcctcgttcgtacctcgaccagagattgtagtgatcctcccacttttacgagtggtcgagatacgactacacctggtccttgttcgacaagagatagtagtgatcctcctacctttacgagtggtcgaggtatgactacacctggtactcgctcgaccagagtgttagcgatcctcccacctttatgagtggctgaggtaagactacagctggtcctcatttgacctataaatacaagaccccaaggaggagaaggaatgggaccaatacaagagaatccaagacaatccaacaagcctatatatacccagtacatagctacaaaagccgacaagagggatctagagctatctccaatatcgccaagttcttatttgagaaaatggactattactagccgtcgaacatatgtctccaatatcgccaatattagattaggtcgttatcaatattgtgtactcgtgtgatattgatatataatggcaacactggtttcgatcaaacctgtataaaaatccttgtctcccgtttcttttacctcaactcgcatacgctgttgcctgcgagctcagaggcgagcgagaggcatactgtgcgcgaccccggtcgagtgacgggtgctcagatggactagggctgagattacgcccccttcatgcctacagaacaagggcccacccgacccacgggaggatgggccaggttgttcttgtccaagccctccccccttaacaacatcttgtggagcggaggacgggttgcgcttgggccctcgctacctggtggcacaacgcggcctgcgttgaggggcccagatcggcacaagtcccagccctacctggccacatgttcttctcaagggtcaagactgacaacagacagatcacactgagatttccaaatccggtgccgctgtaccccgtctccgctagcgccacagggtgagcatccaagtttttcccccttccagttccaccgaggcacacaactcgaattctccctcttcctctcctcttcggctcttccctccgaagtggttagccccgaagagatccagccaagtggcttcctttggctagctaggaagtaagcctagacctggctcgcttagattatatcccaactcctgctttgccgcattcttccatgctagggcgatctccgattggggaggtactaacctcttttttcctgccatttttgtctcctgtcaggattttgggcaaaggtgggggtgaatttgcacgagggttttggttgatggcgaacattcgggctcttctcatcgggtaagatgtggatgctattctaccgatttatggtaggatagtgtttatgttaggcgatccactgcttgatgatttgcgcgtgttgacatcccgcaggttggtacgtgccaggggttccttggtggacattgggcgatgcgtttcttcttcaaggtataacgttggacgattagtcgcaagattgttttgtttgattgttctcctggatccgtgtagaattattcaattgttgctggtcttcgtgtgaacaccaaattcgatgctagggttagctgtcaatcctgtgtctaatatgttccaattcattttggtctttgaattacattattgaatattgttgaattgggatgccaagtttggggcatgtgcttggtaaaatatattgtgaaagttgcaactgctttattatgtcgttacatgtagctttgcattgcacattttttgacagaatgtttatcttccaggccttcatatctagcgtcactgggcagacattacaaggttagccaaaagatttatccccttcttatccacagtgtaacttatatgccatcttttcaggttcccatggaaattcgttggttatcctcaacaggtacatcatgttatcccatccttccaatatatggcatattgtagtatgcatattgcttctttggtgtggatgtgttgaaatagtacatcccttggataggtcgttgtattcacaggcgactatagattatacaagacagaatatttaatggcttatggaactctgtgctctcgtcatagtgcaattgttggaacttggaacttatctcctcatggcttgcatcaattgaatatgtgaaatatatatattttatcataaataacatggacatgcgaagttttacttgtttatttgcttcttgtttgttccacaacattatcaagagaaatctcacttgccgcaaagagaagttggtatgctaagcaagacatccatttgtacattatgatacgattattctaagtagcgtaggttagttgataaagtacatccatttgtagagttaagtacgcaatccgtaagccattaatgtatcattctatttcctttgcacatttgtgtggtgtctttagtgttctggaagcaaacaacacggaagcagcgttagttttaaactaatcgacttccctgcgcacctgcatggctaggtatatacatgttcttttgtatttgaaaatagagtatgtatttcatatacagctattgggcctgctcggctgctgtggcagcagcttattgggctgcagcagcaggccatgggcactgtttctgcatgtagcagctggatacgtcccacagcacgtgagcagggcccttgtacctaatgctgtaaatacaaatagtctttttattggagaaaaaaataaaggatttggatccctaaggattaattcctatgagtgtcattcggtttgtaggaatgctgtacaggaaaatcaaagaaattttcctttccttaggaatttttccatctactcaaacctcttggaaaaaatcctatggattgatgtgtacatgcattcctattcctccacttttcctattcccatgggttgaaatgcctccaaaccgaataagccctgaagatgctagtatagtttggacagatcacaattaacagtgcatacctttttccttatatcatattattatgttggtttctagaccttgagagtgaaatttgaagcctttttctactgttataatatgtaatacaaagatatcctttaaatatatccttaactctctccaacagggtttcctcctcatctggtggttgggatgcctgcattatcccctactatggtaaaaacataagcatcggcatattaatatttactgatggctcattgtgttccccctgtctacatcattggcaatctaatatattttttcattagaatcaaggtaacattgcaaaatggagaaaacaagaaggtgaaaaggttaggattttgctctgggatatttcataatagaattgaaacatcttgtttccaattcagagttctttatttcttttttatatattagtttcgatcaaaagttatctgttgtttgcagatagaagttggtgatgtgatctgtgagatagaaactgacaaagctacgcttgagtttgagagccttgaagaggggtaatgtcctttgtttgagctttgtctttggcttgaagcaagatttccatgttatttccttaaaatcagtgctccctccgtcataaaatatagcaacttatagcattcaaaatttgtcccagaaaaagggactgaactcgtttaatcgtagatctgagattatctgtatcatcttctttgtaaaaactagttaattaggtattatcatcttctataaactagttatctatggcagagattatctatatcatcttctttgtaaaaactagttaaagtcagtgctccctccatcataaaatatagcaacttatagcattctttgtcccagaaaaagggactgaactatagcagagattatctatatcatcttctttgtaaaaactagttaaaatcagtgctccctccgtcataaaatatagcaacttatagcattcaaaatttgtcccagaaaaagggactgaactcgttattattctagtagcttaagcactgaaatgactgctcttcaatggctccagtccaaatattgtgctggtgctataaacagtggcaaatgagagtagcctttggtgtttagctggagaccatgtgctcctcctacggtttcttaccctggacgcataggggctgtttagttgccaccctgatgcaaatatgcctggccagagccaagcctgagaaaacaaacttgtttggttggtgcctaaactccttcatacccagcctggcctgagctctccggcagattcattagcctgactgaggcgatgaaatttggtggcctgagctccatgcagcggcaggctgagcagagtgcttccatgagtactactgtagttgactaatctcatgctgcagctggttgctttcttttatatgtatcatgcacctagaacaatagctttttattgggaagtgtactggactggttaaaatactacagaaaaaaataatacctaattaatacttacattttccatgtacatatatggatctacgattaaacatagtttttacaaagaagatgatatagataatctgtttttacaaccaaacatatttttctcaagcatatgcctcatgcatgaatcatccaaacctacgcaacactcagccacctattttttttgggataatgctcaggttgccaacttaacaggcccttagtttgtttctgggtgatctggtcaattaacactgtggtgcgttttctagttttgagggtgtgttttttaggggccccttcttgatccccctccgcccttttgtatttttctttcttataatgaactgcggttctcctgtgttttgtaggaaaaaaaataacttctctgcttactccctcatctcaaccaataacaattatcccccatttaatttcacccctccttaatctctgtgaaactctggaagtacttatattttggaatggatacagtagtatttatccagtatgtaacaaactaaatgttgtttttcctagcttgtacatatacgttgctaagcatgagtctagtgttttttgtagctacagataagtgcttatcattagaattcccatttggtgatagaacatgttatgattctcccagaatagcattgagatattacatatttttctaatttccactttatatgtacgtcttataacccttctgcctatttttttctcgaaaaaaatcttttgcctgtttctttatgccatttggattgtgggttagaggttgggaaatgatggttctaatggatctgcacccatgtttaattggaggaatgggatatgctgaggctctgggaaacggatatggagacctaatgttagtgaaacggtgatctgacaaaagtgctcattgtttcgtccaatataccgttgcggagccattatcctatccaacagctactgcgtaatcaaattccattcccagcgtgccatttgaaagaacataatgtgtgatttactggttaactaatccaaacatgttgctgttcatccatacaagtttagccaatctatttttctatgttgaagcgaatttgagaagatatattcctttatttccctcttttgtcatatgacatggaaatgggcagaatgttcacagtgcaattttgtttaatctattccattacagcatgagaataacatgacagatgacagatcacagttatgtgtaactacctgcataccatggttggctaacatgctttacattttacaaaatgaaacattgatgttcttctcctagcctcctagatgtattgtggatttagctttgttatgagcttttcacacttgccttttttttttcttttgtgacactatcttttcttatggtgaatatttgtttaacctgtgttggaggatatgcatcttaattcctagggcatcggaaatagactagagacccatggaatgtacacaaggaatacgctagggaatatgccatggaatatacacgtaatgtaaataactacccttgttagggccatgcaagcgaggagcagaatgaggattttcccttcccccaatctctctctctatccatggatgaaccctgggggcaacacactctttacacaaaagccgttttcactcctcgatctcttccctcacttggtttcctaagactaatggtacccgtaccccgtttgttgtttatgcaaaaataatctgtgcgtaccctttaaatttctgagtgactatttgtcaatgttacaggtatctggccaagatcttagcacctgaaggttcaaaagatgttcaggttggacagcccattgctgtcacggtatagcttcatttcattgaaccgttcatttctatgtctgaatcaactgcttatttacaccattggcttgtgtgcattttcttttttaatttggccatgaactgtttactcatgccatgttcttgcaagcataatgtcatactaactatccacaatccattggaaggttgaagatcttgaggatattaaaaatatacctgctgatgcttcctttggaggtgaacagaaagagcagtcaattgcaagtgaagcacaaaaggttgaaacggatgctgcaaaagagagctcgataataacccgtataagcccggcagcaaaattgcttatcaaggagcatcgtctagatcagtctgtactgaatgcatcgggtccccgtggcactcttctgaaaggggacgttcttgctgcattgaagttgggtgcctcctcaagttcaaccaagcaaaagaatgctccagctgcaccatcatctcagccaactcatgatttccaagctcaatcagtcaccattccacaacaaaatgatgcatacgaagatatccccaacagtcagatacgcaaggtattctttgtttcattatttttatgataacagacatcatgaaatatctagtcacactttatgatatcttgtgcatgtgaagaaaagctaaaagactaaaagcatgatccaaggctgatctaatggaaattaatttcagttcattaagtctaaaacgtcaagaacaaattttcatactactaggttattaatatataatagcatagtttgtcacattttgagttgttaaaatgttgaaatggccgttaggtcattgacaggcttgcaatcaccttcgtgaggacatggttttgcccttgcccatgccaaactctgcttatcccccatctacctatagagatgtctgtagagtggtgtaaagttttttttgaacaactatgcataactggtacagccactggtcacaaaagcatgccgttttagatgtcggcattgtctgaaaatgcagctttgaccactaatttctcttgccacatatttgtaaaagttaaaaggaaataataatatttggaaattatgttttgagacaatctacatgtgatcgccatatacatatatgcaatataaatatctaagaacaaattgatgtttaaactttgaaagtttgattggaagcatatccccaaagacattattttgactatgggagtaataactagagattggctttggctttgtgctttcaggcgtcaattttatagccttttatcattaattcattttcttttctttttctcatagttgccttgttgagcctttaagaaaatgaacttgcttaagtttgtgtttatagcattacaatgcatagtgaatgatgcatcttctattcttgttctcagtgtccaacaggttcttttttatattgtaggtgattgcaaaaaggttgcttgaatcaaagcagaccactccacatttatatttatcacaaggtgtgtattcatctaatgcacattttgcaataccttggttgtgctggcataattatacgttacattgttgtcagatgttatactggatcccttgctcgctttcaggaatgaactgaaaggtgtgctatttatcttctttaatttgatatatgaagattggttagctaacctgaaaaggtttttttttctttctcatgctttctaatatttcagagcaacatggggttaaagtttcagtaaatgacattgtcataaaggctgttgcacttgccttacggaatgtaccagaagcaaatggtaattcttatctgaattcatgcaaatgtgaaacttggtggttgtgttactatatctttgattgtaatagcaagcatatcaggtgcaaatccttgttacccttcttgctgtacatttaatgtccacactgatcttgaacaagtaatgacagttttcaatctgtttgatcttggagggctcatgcaccatcatccgtagttatacttccagcattattgtttttacatatgctagtgtcgataatgtcacaagatccacaagatcaaagtcagtgaacatgaatcattctcaagttgttagatggcatgcgatggagatttgcatgttggcaccgagaaggcgcacatgatacatcaccgttggaatactatgagctatactactggcagttcacaaataacatggtggtactggtggatataggctaattttgtaacagattggcaaagggtagaaatactatcacctgactacaatcatctcaaccactattgatttgcaccgcccgaccaaacggatgaatccaacgatgtcattgcattggaatgttagaaacttagaatttttgctgcaaatggactaactgaatattcaatttacacatagtggtttaagtcaacttctttgtttggtctaatggatagctcatcattattcttttctcatgaatttccagcatactggaacaatgacaaggaacaagcccagaagtgtgtttcagttgatatatctatcgcagttgctacagagaaggtattgaaattgaaaagtactgtttataatttttattagcctatccatgcacattaacaatgacctttgcaactttagggcctgatgactcctattataagaaatgcagatcaaaagactatatcagcaatatcctcagaggtatgagagaatgtttaaaaggttcaaccttactgtcatagtttcagaagttctttagcatgaaatgtcacaggcacatgtaacgcttgtaatcaactatcttaagacatggtcttggaatgatttagaaatgtaaaatctgtggtcaacagttttcatagatacctgactgctgggactttctttggaaagttgagaaccatttctggaaagacctgggttttgtctagtggaagacaaaagtctttgtatatgaaaggcaggactataagtagatagttgcatctcgctatcagttatcatatattcctgattttcgacctttaaagtagtcttcatgtttatggttatgagatataatcagttttcctttccctatcactgtaggttaagcagttggctgaaaaggcacgtgctgggaagcttgctcctaatgaatttcagggagggactttcaggcatgtgatattttacccttttgtcattgcttttgggaaatcctgtactgctgttgatatttgaatgttttgacattgcttctgcagcatctcaaatttgggaatgtacccagtcgaccacttctgtgcaatcatcaatcctcctcaggttcctacctcctatccttcgatgaaatgggatccttgaatctgtgctgataattgttaccgtcatttttctcagtctggaattcttgctgttgggcgtggtaataagattatcgagcctgtggtggacagtgatggtacatttccttgaccatgtgtaattccttctaaaaaacaaatgcttttgtattttaactcatattgatatgtccacttgttcaggaaccgagaaggctacagtggttacaaaaatgagcttgacattgtccgctgaccatcgtgtatttgatggtcaagtaggaggtactgatatccttagacctgtagtttaaatgttcaattagccatcattgttttctccttttatttgttttaaacataagagtaaatttcacaaaactacaggttttgttgtccaagttgcaaaaaaccacacatactttgacacttggcgctcaagtacatatattttggtagtgtagtttcacaaaaccacaatatcaatgaatggattaactcgtgatatgacgtggctgttccacttaggacaaggacgtggcatcctattaccaaccatcgcacgaaattaataggatgcctcgtcctcatcctaggtagaacaaccacgtcatctcacaggtgaattcattcattgatagtgtggttctgtaattacactaccaaaatatatgtacttgaatgcgaagtgtcaaaatgtgtgtggttttctgcaacttagactataaaacatgtagttttgtgaaatttactctaaacataatcactgattccatctcttaattcgtctttcctttttgtttttcatgggaagcaggcaagtttttcacagagttgtcacagaattttggtgacattaggagactgctattgtaaatgaaagttagtactaatcgtgctttcaaatattctgttggaaaaaggttggccaagaaaaatctttcccatgcagctcggagcttggttgcttcacctccagcacgtacaaaagtaaccaattattttttatttttttaataaggttaaatctgcatttccaagttttttttcttaattaataatactgggattaatgccccaagaattttgcagatacagtgccatttcgtctttatgtggctgtgcaacatttaatcctttattagatcccgttgtttcatgagtatttctagctgacggagctcgctcaacattttttttcaatgatttctgatacacattgcagcaataagaaaatgctatatttttgaagcatcatcatcacattcttttcagtatagctccagtcttataattcttgcgttctttagctcttttatcgattaccgagcgatggttggatttgtacaatcattatttggaagttttacgcgtgccaaatgcatcacggtatttcacggggtaatgagaataatatatgttcccattttgtcttttagttggttattttattactttatccgtttcacaatgtaagactttctagcattgcacatatttatttagatgttaatgaatctagatatatatatgtgtgtttggattcattaacatctatatgtatgtgtgcaatattagaaagttttacattgtgaaacgaagggagtagcaatttccaagtggtggcggagctcgggcgatcacgcttgggaggttgctcggcctgacagttaaatctggcataaacgaatagtatgcaccatttattcatcaattagaagttgatctacatgatctctagcagatttataactaaggctatgtttggataatggcttagtttggataatgggatggggaatcttatcccaccttttagaaggataacttttaatcctagccgttcattctttatatctcgtttcatctcaacccttcactcatatcactatttcaatcccatccctcctaacctattatccaaatagcgcctaagagttcatatctatcgtctatctcaaaaggttgagctatccgtgttactgtggctcaaagcccatgcatccacatatctatcgtctatctcaagaggttgagctatccgtgtcactgtggctcaaagcccatgcatctagaaaaaaaattaaaaatttacttttttttctttcaatttacagaaatatacttgcatgacacatatttgcgaaaatatacctcatccgcatattaggttagcgggagcggtacggtaggcacggtcgcgcgaagtggggatgcgggatcgagccggtctcgcacggcagttgtgcggaagcgatgcagcccgcggaacgggtatgtgggagcggctgggatgcgggagcacctcgggagcggcacggtcccgttgaacgggcgtgcgggagcggcacggtcccgcggaacgagcgtgctggagcggctcggttccacttttttttactgtatcagtactgtttggcattgttcaaacagcggtactgcggatccaatgtgcggaaccggctcctgaacagtgtcgaaacagtgcagaacagtatcgaaacagtgtcaaaccgtgctatatgcatgcatgtgcagcttggctgctgggtcacgcgtggccggcctgcgtgaccgcgcggtgccgcgcggccggtccgcgggaccgacgcggtaccatgcgtccgtgctgcggaatcaccggtcccgtggaacggtagtgcgggaccgcctgcggattaggtatatttgtgtaaattttcgccacataggtatataaacgcaaaataataaaaaaagaggtatattttcaattttttctccatgcatctacgagtatttaaaaggaatggaacagagtgaacgagatgtgtgcagaattaacaagaaaaatcttcacctcctgatctcattctgatattcttaaaacaatcatctactccctccgttccaaaatataagcatttttagcatagtaacaagtcaaactttttaactttaactattgatagcaaaagaataaaaaagatcaatcatgtaaattaatgttactagatttatcattaaacaaactaccataatatgcaattctttttatttgaaacacctcatttttataaatattgttggtcaaagtagcatctcgaagaccgtgtcaaagtctaaaaatgcttatattttagaacggcgggaataattaaagtaatcccatgatagcacaagttgattagcaaaccctactaagagcatcttcaaaagactattcaaattggactctccaaacatccacgtagctaactatccaaatgatcttttcacgaaatactagaccatgagtgacaatgtacccaatctaggagctttatcaaccgtcaaaaacaggggagttccctagcccattatataactagatcaatgtgatgccagctatttatttaactccgttggcacaaaattatcgtaaggatcggttttttagggacacaattgacaaaaaaaaaatagcaatacaacccgagtctctctgagatagagcccaaatcgtacaccttttgtgtgnnnnnnnnnnnnnnnnnnnnnnnnnnnnnnnnnnnnnnnnnnnccgttcaatcgccgactttcctgttaccagttctttaactttcttaacttttcggtactgggcaagtatcagtttccattcatgatcttgcgactttgcagagacatatgtttttttttaggtaaacagccacccattcctcgagtctacttcacagttactctgaagagactcgaagagccgacagaaacacatggttgcaacttgcaaagaccaaatcgagtgcccatctagacagacatccaaaatccggacatggcgatttggtgaggggaactttcccagatcccaaatcttaccaagtgaaaagagaatttgaccatagaagcaggaagagccacgtcatttggtgcatgatggtcatccgattgaaaagcagacaaaacgaatcagaaccgtatgatcatgctgatcagtaaaaatatttgtataaaaacccatatattctcacatatttacattgaacaccttacatcttatttcttaatacattacattattgtctcccctatcattatttataactgtactacggagctgagaagaaaactcacatgcctatttatcctaaaataagttcaaatttaatttataggttcgtttatcccattaatttttagcatacatgctattataaatgatgcattacaacgtttcacgtaaaaagccagccacaatcatttccgttacttcttttgaaatgtccaccagacaaacatgtttctttttttttagaactacaaatatgtttcttaaaacttcttttaaaatttattatcagtagcacattataggatggttaaaatcgcgcgaatgtgtgacttcataagctagtaaattggataaaacctaaatattatgtggctcaaccaactcctgtggtcaactacacaccccatcaaaaaaaagatagatagattgactggtaaacaagtgaatgaatgattagatggcctatgggttgagccctacaacagattagcctaccattctcacaatatcggagaaaattaaagagagggtggattctgacacttttcgaggtgacgtgctcgcttccgcgtgtgtccatgtcgccccgcttcctccctgagtctgggatggttgtcggcccagctactgccattcctgcgcttttgccgcgccttctcccgcttttctcgccgtcgcactccattgtgttgccgccctcgtccgccactatcgcccgccgctggcctcgtccgtcgccgtgccaccgccactggcctcgtccgccatggctaccgtcgcactccactaagtcgccatcctcgtccgttaccgccgtcgtcgccctcatccgtcgccgcggcaccgccgctggcctcgtacgtcatggctactgtcgcactccactgagtcgccattctcgtcggtcgtcgccgccgccgccggcctagtccgccatgggcgccgtcgcactccatagggtcaccgccaccctcgtctgccacggctgtcgtcttcgtcgcgctctaccagttcgtcgccctcgtccgccatagttgtcgtcgcctacatccgtcgtggccaccaccgccctagtcccttgccattgccgtcgccctcttccacggtcgctgtgttcctcgtccaccctggtcgcctatgtccgccttgaccgcggcccctatccaccgcggccgctgccggcgcgttcttccgccacagctcatccaccgcgtgcatgcaccgctgccatcgtcctcttccgccgtagctgctgtccaccttcgcagctaccgccgttgttgtccactgcatccaatccatatcggaagagaagaagtaagaggaaggagagaggaagacatggaaagatgatgtgtccataaaagataaaatatttgtggtacagtaatttctattatatagacattaggtaaaacgtttactatagatgatatggctattttttttaagtcaatattattaaccttgctctatggtatagatggccttttggcccgcacggcccaccagccatcgggccggcacggcccgatcggcacttcgtgccgagccgtgccgacccatgggctgcgcctcccgcccaggcacggcccaccagccgtcgggccgtgccgggccggcccgaaggcgggagtggcccatcgtgccttttttatataagtctattttccttccctcctctttggactgtgacatatatatagcgaaaataagtctattttccgtccctcttctttggactgtggcatatatatatatagtgaaaataagtctattttctgtccctcctctttgggctaacatatatatatatagctaaaataagtctattttacgtccctattctttcgaccatgacatataatatgtctatttttagtccctattgtttatgtgtcgggcctagcctgcggcccatcgtgccgtgccggcccaacgtgccggtggagaggcccaggcacggcccggtggccgtgcttgggccgggccaaaacaccgtgccgtcggccgggccatcgggcctcgggcattttggccatctatactctatggtgtgtttcactctcccttgcttcaggggcagcaccacgccgtccgacctgtaccaaaatggagtaggccactgactagtgtggggcgagaaaatctcttgtgtgcccatgaaaactcacataatcccttctataccctcgaattttacccaatcccctgtgtacccctgaaatttcgctttgatcccttccatgcccctcccgttaggtttccttcattttcacgttatgtgtggttccaaatgtctaaaatacccttgtagatggaggagtggcagctagatagaaaaaattgaaaaaaatgtcaactgaacaatatgtgtattttatgagactaaataatgagcgtataacaaatttattgtggcactgaaaaaaatacaatataatgaactttttgtttggaaaaataataggatcaggaaaagctgactgtctgtacagttatcagttttctctatagaagaaattgttcctctgcataagaaattgattatggtaaaataagagcatgaataccatcatacatacaatagagatatccatacagaacacacaatatcatgcacagaacataatctttccatcatccatacataacagttcatatcatgcgcacccacaattccatttccatactcaatagtgcaggaaacaaacaactttccatttcaaacaaaatagtgcaaccaacaaaccaaattagctaggcagtatatcatgagcataatggcataaggtccataacagtgcatcaatacatcatgaggaagcaatccttacaatagcaaaatatgtcaactatgactagaccactttgtacggcatcacaataacaaaatccatcaataaagtctttgtagcacatcgcatttgagtctatcactttactgaaaataaaccgatcatattccaccctagcattttttcgatccccggctagtttgatttccaacaaatatgtagttaaggggtccatcctgtggatgaacacaatagtatgtatctatcaatgtatgtatctatcaaccaaaatgatctccacgcatacaactatgtcaaaattatgacgacggaaagttaagtcacttaccctacggggagccatgaaggaaccgtgctaagcattgaatctgccatgccaagttgatgtgttgc

SEQ ID NO: 17373 - DNA, 19091 bp, Oryza sativa
agtgttaacctgtattggggatgggagaatgggagctgggagggcggccgactttggcgcacacgacgggagggaggtggccggcgacgcccgcgcggcgggaggggcggtggccggcggcccgcgcggcgggaggggcggtggccgccggcggcccgcgcggcgggagcggccgtggccggctgcccacgcggagggaggggccgtggccggcagcccgcgcggcggggcgacgcccgcgcagtgggagggcggtggccggcgccccgcgcggcgtgacggcggctggacgacggcgcgtggccggagggcggcgggaggatgcgtcgacggcgcccacggtcggacgacgccgggacgacggctcgcgtggcgggaaggcggcgggacggcggcgcagtggccggagggcggcgggacggcggcgcaggactgcagcccggcggcgcgcagaggccgctcacgtggagagatgcgggagaaggaaaggggatcgaaactagttagggttggaaggggcattttagtatttcctaaaaatactgacaatacaacacacggtttgattaacatatctaacggaaacctgacgggaggggcatgggaggaatcaaagcgaaatttcaagggtagggattgggtaaaattcgagggtatagaaaggattaggtgagttttcatgggcacacaagggattttctcgtagtcgaaagccgtgtgatgttgtttccagctgcaagtcaaatccgatactactattcacaaagctgatagttccccttcttcctccctgtgcttttcccctttcctttctctgatttctctcaaatgaattactgttaccagttggtgtgattctccagccgaaacttcaccaaccaagcaggaatggcgctcctgctgccggagttcgacccggcggacgtccgcgccggccgcgacctcatccaccgcctcaccgccgacgccgccggcatccagcggggcgtcctccgcgagatcctctcccggaactccggcaccgagtacctccgccgcttcctgggcggcgccgccggcgacgacgacgacgtgcgagacgcattcaagaggcgcgtccccgtgtccggctacgaggatgtcaagccgtacgtcgaccgcgtcgcgtccggcggcgagccctcctctgccctcctctgctccgaccccatcacctgcctcagcaggaggtaaaatttccgcaaatcgggggcggcgttgctccgagttgggataaaccctagctctttgccctcactcacggtaccatctaatttcaatgcgaacggcggcagctccggcacgtccggcgggcagcagaagctgttgccgtccaccgcggaggagctcgacaggaaggtattcttctatgctgtccaggcgctcgtgaggaacatgtaagagcatgactggtgtggtgctttgctcatcattaatcaactggcatattcttgaatttctgtagcaattaacttgctcaattaatatactatattttttgcatttctactaggagcttgcacaccgatcatggtgaagacgacgacggcggtggtggcgagggaatgtacctcatgttcgccttccacggtgaccggacattgtctggcctgcccatccagtctgctctaactacctactaccacagcagacagtttcaggaatgcgacattggcgggtttgataagtgcacaagccccctggaggcaatcctctgcccctatggcgagcagagcatgtactgccagttgctctgtggcctacttcaccgatgcagagtggaccgtgttggtgccagctttgccgctgggttggttcgggggatcaagttcttggaaaatcactgggaggagatgtgcttcaacatccggagcgggcagctcagcgactggatcacgcatactcctctgcgtgatgcggtcactggacagtatcttcaaggatctaacccagctttagccgatgagattgcatccgagtgtgcgaggaaaccttgggatgggatagtcaggaggctatggcctagggcacggtatatccggaccattgtgactggttcaatgtcacagtacattccaattcttgaggtttatggtggcgggctaccgttggtctcaccaatctatgcatctacagaatgcgctgccgggataaatctgaggccacttgatccaccatcccatgtgtcatatgcattgcttccaaacattgcttactttgagttcttggaggtcatggatgaaaatggtgaaaaggtacaaggaactaccaggcttgatgacaatttgggtgaggtaaaagttgttgaccttgtggatgtcaaagttggtcgatgctatgagttgattgtcactacctttgcaggcaagctgttgggctactttttatcccttttttttcagacatggctaggtttatcttatatctgatcattgaaagctctcatcgatttcttgtagctatgcttgcaatcataatttgtgtttcatcgcatttttcaaaatcagttctctccaatgttaggtaaatttattgatatctggataagcatctttcaagacccatgacacctatttaagtcctcaattagcttgtgaatgagaagtccgaaattttatatcctgttatatcagctactatacgtttattatattcaggacacacatttagtggaacaatgcaaatttcgaataattacttcagatcccatggaaaaggcaaaacctaccatttttttacgaaatagcataatgtctgctattaacttcattaatggaggagcatacaaaaacaaggtttaaagttacaagaaaaagatagcacttgaaagttgaaaactcaatcataagtagaatggaccaagaaaaccttagagcaagattctccattaacagtagagcaccatatgagattgtttttttttttctttgttaattgtttccccctcaagttccattacttatatgtagtcctaatggtctattaattggattttgcttgtgtcatcctggctttgttttgcttgtatgatatcctatatttgtaagacaaattttgctacaggacactcaaagtttgtgtaatttgctggtggacatcgtaaaaacgtgccaccgttgaagaacaccctaaaaaactagtaatttgttagatgacatttccagtctaattggggagaaaactcttcaagaagacgagaatgcccatacggccacaagcttctaacctgttgttggagtgaaaatttggaaattatacaactctcaatatccaatcatcccaagtatattccaagcatatctcatatttcatcttcactctagcgctaggttacaggcttgtggctccaggggcattctcatcatttttctctccaattgggctagaaatgtccttgtggcaaattaccagttttttggagtgtcgtctagctgtgacacgtttttgtgatgtccaccagcaaattacacaaacctgtcctgtagcaaaattattgaacaagggtagattccaacattttagaaaaataggattctgaatcagcccaggtaaacaacatcctgtattttgactttgtgacttgtgcatttataataggtctttacaggtaccgggtgggtgacctgtttactgtgagtggcttctacaatgcgacgccattgtttcacttctcaggacggcatgatgtcatcctaagcatagattacgagaagataagtgaggaggaccttctcaatgccattgcagaaacagataagttccacctcaggcctcttggctacatgcttgttggtagcactgcatatgcagacatatccactttgcctggccactatatccttttctgggagctgaccaatacctgtgatagcaatgttgccattgacatcgaccaaactgccatggagaagtgttgcttggcagtggaagaccacttcgatgaaatgtaccgcaaaattaggcaccgtggctcaatcagtgcgctcgagataaggattcttagccatggtgcgtttgatgctctgatggacttctttgtgtctagagggacatcagcgagtcaatacaaaactccgacagccattcggtcgaaagaggcgatgatggtattggaggaaagggttgtaggaaggtttttcagccaagcaactcccagctgtcgttcagccgaatttgagaggagataataattgtactgcctgttcggttggcgtctcggtgacaggagagggcatgttccttatgaaaagttcagtcctgatcacgaataagtggcgcagcattgcaattcgtgcactggagaaggatgatccactcatctccatcttggcacgtcctttttcagtctggaatttggtctcaggagtatcatttcgtgttttcttgtaaattcagaaagaacttctgtactgctccttccacatagcctttgggcgtaactgtagacacaacccttgctccgaggtttataagttacctccgaatttactgattgactgtgttctcaagtccaagtttccaacctcactatctcgtttatctcgtttactgtgcgcacgcttttcaaactgtttaacggtacgtgttttgcaaaaattttctatagaaaagttgctttaaaaaaccgtattaatctatttttaaagttttttaagataataattaattaatcatgtattaatctattgctccgttttggccgttaagctttgcagcaaaaatgtgttacttacgttcctgcaaattttcgtatgaacttgttttgccaacttcatattagaaagagagatccattcctttttttaaggaagaacaaaaggctgtttttttccttcgctatattactaccttttgtgatcaaaattatttatggcacgtacatttgcttcgcctcattagcatatgcaacaatccacatatacaagctttttaaacaggcatacaaagtcgtgcaaagcgcgactatttggctagtatacagttggaagtaaaagagaaaaaaaagggcatcgcttatgtgctgcggggaaaaaaatgaatattgtcctggtagagactaacttattggatcctttctgcagccaatacaccatttctgctgaacccgacataaacacgatggacgtgagaaatcaccgtctctgtcttctgtcggaccctgcccacaagctcttctgcagcacggtccagagtgagctcctcaagagtcctgacatgttcgataccgtagggcaactgcttcaggtttggacagaccaagagcttgaggtcagttaggcttgccacagctcctcttttcatctcgatttcattcaggtgtggtgcacctcgtatactgagctccctgagcctgggaaatgagttctcatggaagtatatgttcttcccatcataagcatcatagagttgtagcttcaccaaatgtggtaacctctcaagattaaggaatgtatctctgtcaagccttgatcccacaagacgcagagacccgaggttattcagattactcagtgacatgaagtgacatgaagtgaggcagtgattcctgagacaatgtacctttcaagtacagcttctgaagtaatggagggggtcgaagtgcttcaagattcaacacttcttggctgctatctgcctggatcccgagtcgggtaagatgaatcatattggtgatggccaagaacagatgttcacagtggcaacagatattgcttgaaatgacagaaggcgcccaatgcatacgatcgcaattggcaagccatggcacttgtcaacaaaattttgtgccaattggagcaattctggtggacaatccctatttccattcttccagaatgcctctttacagaacaaatcccatgcatgggactttaccaatggctgcaaattaattatgttcgtctcaggtgcaagcaatgccacatcataattccttgatgtaagaattattcgtccaataatattggcaccaccaaatgcatccttgctatcaaaccaaacattcgtactccacacatcatctagaacaaggacataccttttgttctcaaggtaagagcgaatcgtctcgactagccttctgtagcttgatgcaccttcgtcatctgggaaatctttcttccggtcgttcttgcgaaactcttgaacagttgttcttagcagatcatccgcgtcatagctctgtgacacggtgatccaagcacaggtgtcaaagtcatccttgacagcattgtaaacatttgcaaccagtgccgtcttgccgattccgcccatcccccacacactgactatcctgtgccgctgctgctgctcatcttgcacccatctcatcagcaaatctctgttcttgtcaacaccaacgaggtcatcatccctcttgaagtgcacggagtctgatctccagtttgagtttgagctgcttcccaccaccgacttcacgcctctcacgacgacgcccttcagatcatacctaatcctcctctcggcagcgcttttcaggctgaccttgatgtcctgcaggtttgcggccaagcgagaccatgtgccgatcttgcacatccgcttgaatggcatccttccacctccttcgccgagctggtaggtgaactcgtcgacggcatcctcgatgccgaaggcgagcctcctgatttgcttcacgaacgcggaggtcgtctcgtcggcgtccttgaaccgctcggccgcctgcaagaaggcacggatgctctccagctcccccttcacatcccggatctcagagaagaggcgcttcagagctgatccctccagcccgagcaacgacttcgcgagctccactgcttcactcgccagggtattcccaagtttgacgattagtgagcccacaacaccctccgccatggcttagctagcttgagctaagctatcgttgggagttgaacacacatttcttcagtgtttcttcctgcggttggtagctaactcatcttgatcccttgtgttttttttttccaagaggaacaaccgaacaagctcagttgctcactgctttataaaataatccatctctcccaaaataaatcaacctagtatgggatgtgacccattttaaaacaacgaatctgaacaacctagaataggttgagttattttgagacggagggagtaaggctgagttggacagcgctggtttcggaccgtgcaagggccggtttagtttccaaacatgatttttcacgctatcacatcgaatgttttggcacatgtctgaggtattaaatgtagaaaaaaaacaattacgcagtttgacaggaaatcgcgagacgaatcttttaggcctaattgcgccataatttaacaatgttgtggtacaataaacatttgctaatgacggattaattaggcttcataaattcatcttgcgatttcctggcagaatctgtaatttgttttgttattaaactatgtttaatattttaaatgtgtatttgtatatccgatctgacatgtattggtaaattcttttgccaaactaaacaggtcctaattgaggttggtgtcgcgtaaagaaaaaaaaggttggtgacccgtgtgcactttcatgtactgtagaatcattactgtagatgtcggacggaaggtacaccgcgcacgcatggcgccgtttggtcagcagacaatttccaaggctcacctattttataataaggtaaaacagtttattagaaaaaaaattattttattgataaaacttttatatatttattcatagcaacttaaaggttaacgttaaaaaaattatgttaaaaatatctaacgatcaactttaaaatcaaattttagctttttttttctggtttattagaccaaggtggtgtttagatccagtgacttaactttaggccctgtatttagacactaatttagagtattaaatatagactacttacaaaactaattacataaataaaagttaattcgcgagacaaactttttaagcctaattaatccataattagagaatgtttactgtagcatcacatagactaatcatggattaattaggctcaaaagattcgtctcgcaaattagtccaagattatggataggttttattaatagtctatgtttaatatttataattagtgtctaaacatccgatgtgatagggacttccatccaaatagggtccaactgatgggatctcccgtcaagatgcgaaggagccttgaagaagatggcgccattgttctaccatcgcaaagcacatggaatcagctagttacaaaaatgcctacgattactaaggctgggttcgttgaaatgggttgggaacccatctcctgtgcatggaaaacgaagcagtccattagcacgtgattaattaagtattagctatttttttaaaaaatatgatttttaagcaactttcgtatagaaacttttttataaaaaacgcatcgtttagcagtttggaaagcatgcgtgcggaaaacgagtcggagggagttgggaactactctctccgtcccaaaaaaaaactcaacttccagagtttggggctgattggtacagcactaatctcgagacgcaagccgccataacaagttttacctcttgttgaagatcgaaaccgatgcagctcaacccgaaagcaagaactcgttgaagcaaaacgaaagtaaaagggtggcgatgcgccgagattgtattgaacgtgtattagtttgattacatggggctctggtctatttatacccgagaattacaaaatatgtccatatcggatacgactcttatctctaacaaactctaagataccataagtctttgcggcagacttttacccaaacatatctctaagtaaattacataaaatatcctaatcaatagatacaattgccttcttaggactctatccatgcgtggcaatcatcatgaagcacgttaacctaacccgacaacatatgccgtgtcatattgtcggattcggctcaatcggctaaccctgtccgactcgaactatgccgatcttagtcgtagccgattcgaacttcagccgatcctcactctgtttccgggacaatctctatctcgaactccgtctcgattcctcctccacatccgattcttggattaccaaatttggtcgttaacacacatcccttgaaagttggagcaaatgtttggagatagtgttctccaaaatcagcatgacgtaaatggtcgtcgtttttatgtaacccatcatcactttgatcttctagctcgtcgtcaatgcccaacaagtcttgtgcatgtgtagacctaagtaataacaaagttcttgatttatgtagtatataattgtcgtcaatattgaaatatgtttcagctaggagcaagttcacctcttgttgtagtttatttgcacggctacatgtgattggtccttgaaatggtgtacggattgtctctcattagcggctatgtcagatgattgtcttgtgtgttcatgtgacgggggctggggcatatcataatgttataatatttttttaaataatttcacatgataaaaaggatcaacttggtaccgcttgacaaatatataacactaattcaaatctacatgcagggagaaacatgtgatcatcggttttacttattatttagaaaaagtcagaaaaataaagtccccaatacctcgcccttcccagagcatgcacacaacactgaatgaagtcccctttggctcaggatcttcacactccactcctcccctcttcctaccttttatctatcaaattaaaagacaaactatgaataatattgaaaaacccatatttttaagctatacatctaatttctaatctaattgttgctctattaaataattaaaccaacaattcatgatccataatggaacataaaataaaataagagttgtatgaagtaaattagaaaaatagaaaaatgtcaatatggattgaattaaatcaattgggcagaatacaataaatttgtaaaaaatagttattacttttcacaaattggaacaaccaaagtgtatgttccattgccataaccatgtttaagtgattagatgttaatgaccttccatctatgctatatatcatggcattatgagtttctcaatgtattattgcatatataaaacacataattggttaaaaactcatatatgatactattaactttaaatttaggactcatgttgactaggtctttttttagaaaaaacactatagatcacatataatagggaagcgagttgcacaatatgtatgtctcctacgaatttattgacaagttttttttctagaaattgaagaattactgataattgtttatagtaataaattaaatattatatagttcaaaccttacaaatatcatgtaaaataatatctgagcaatgtagatggagaaaatttataaagaaatagtactttttcaagcatgaaatgtgtcatctagtcgatattccatcttacaagttagtcaagcttatccgactttacatttcgcgtgtgctatctttctagttaatcttaacatatatatgtgcaccattcgtaagtcataattgaaatcctaaaatcacgttattgtgcttcctctcaattgtaatattaagaatcaacgtgctcgttaaagatgcaatggaaatggtttaaaatttcatgttcaaaattttcaaaccatacacgatgactttaaaacgatggcaattcatttcgacggctaggggtgcctgtgattttggtggtgtttgaatcccgagactaaattttagccccggtcgcatcggatgtttggacactaattagaagcattaaacatcgattaatgacaaaacccatttcataacctggactaattcacgagacgaatctattgagcctaattaatccatgattagcatatgtggtgctaaagtaaacatgtgctaaaaaaactaattgcacagtttgcatgtaaattgcgagacggatcttttaagcctaattacgctatgatttgataatatggtactacagtaaacatttgcttatgacggattaattaggcttaatagattcgtctcgcagttttacatgtggaatctataatttgttttgttattagtctatatttaatacttcaaatgtgtgtccttatacatgaaaacgaaatttgaaaagcaactaaacatggcctttctctgagaacagaggataagcctcctctacaactgacgagacaatacgagaggtgagtatataaagtactgaacaagtgtacggaacaatccactatatgatagaacaaagaaaggctaaggatcattttgcataaattgcattttattactacaaacttataatacgagggcagtaaaaatagaatttaaataccagaaagtaaatacataaacgaagttatgaaatttagataaaatccaacaaacccaacatattaatttatcctgcacacacagatcactcccaaaaaaaaaattcacaaatctatctctcatgtgaaatcctgagtatgtccataaccgaagacgcggctattcgaatggattgacgccctacagaggttatacaactttatctacatgatacagtttggtgccactaaacacctaagagtaaaaattccgctacctcaccctaaacactggcttctctcacggacggtccagtttttgaaacatcggtatacctcgtggtaaccgcacagttttcacaataaccgtgaaaccgtgggctggcggtaaccctcccaaaaatggtctggagaaccttgcttggcatgcgcttatgtttcgttgttgatgatcaacgaatgattaaattcatggtggatgaaaagagtaaataatatgggattaaaaggccgatgctggcattgatcgggagatgtaaagactgatgattgatttgctctcacttttttcttaactgctggtggatgggattgaagcagcaggtatggcagccgttgggtggcatgtgcgcgtgaagggaaggcgcaaggtcaaaaaaatattgttttatgtgtaaatttctaatatcacaagatttttactcatattaacatgcaacattcgtaagttataattgaaatcctaagattggaatcatgtttagattgtgctttctctcgattataatattaaaaatcgacgcgctcggtaaagatggaatgagaatggtttgaaattacacaatggctttaaaaagatcgcaattcattgcaattcatttcgacggctagggtgcctgtgatttgagatgaattttgattttcgaacaccactaatgacaaaaaaaaaaaaccaaacgaatctcattgttataccaaaagttttgcacttgcggagttgcagtgggcactgggcagtgccatcgtcctctccgataaaccctagagcgagatttttgccaaaaatccccaaatgcccctcctcgtcccctaaaccccgccccgccgccttcctctctccgccatgcttctcctatgccccctcctctccccctccgccgccgcctcctccccgacccacccctccccgccgccgcccgcctttcccgctccgaaccctttgtctcctcctcctccgatgacgacgacgacgactcccccctctccgcagatctcttcccgcgcgccggcgcgcccaccctcctcaccgtcgcgcgggggctcgccgccgccgacgacccggtcccctccgcgtccaccgtgctcgccttcctccgccgccttccccacgacgcctcgccgcacctcttcccccacctcgtcgccgccctctcccgctcccgggggggcgggggcgggggcgggggccccctcctcgcgctccgcctcttcctcgccccgctccacccggccgccgtcacccaccactccttcaactccgcgctcctccgcttcccgctcccgccgcacctcctcccgcccttcttctcccgctccctccgacgcttccccggccgcctcgcgcccacgctgctctccttcaacctcctcctcaagtgcgtctgctcctctctcgtcccgagggatcccggccgctacctcgacgtcgcgctgcggatcctccacgagatcatcccggggtgggatctcgcgccggataagttcacctactcgacggtggtgtccgcgctcgccgatgcgggccgggtggatgacgcggtggcgctggtgcacgagatggtggcggatggggtggttgcggccgaggcgtttaaccccgttctgagggcgatgctgcgcgccggggatgtcaagggagcagccaagctgtttgggtttatgcagctgaaggggtgcgtgccgaccaccgcgacatacaatgtgctggtgcatggtctgctggtgtgcgggagggccggggcggcaatgggggtgatgagaaggatggagagggagggggtggtgccaggggtgatgacgtacggggcagtggtggatggactggtgagatgcgggagagtgaaggatgcgtggaaggtcgcggaggagatggagaggaacggtcttgcatggaatgaatttgtgtactcaactgtcataacaggattttgcaagtctggggaaattgactgtgcgttgaaggtgtgggaggcgatggtggcaagtccggtaaggccaaatgttgttttatattcagcaatgattggtggccttgccaattttgggaagatgacggaggctgaattgttatttcgagagatgattcattcaaaatgtgcgccaaatatcattacttatgggtcgattattcaaggatatttcaaaattggagatacgtctcgggctctttctgtctgggaggagatgataggggctgggtgcgtgccaaatgctgttagttacagcatattgatcaatggactctgcaatgtagggagattgaaggatgctatgatggtctggaagcacatgcttgaccgtggctgtgcacctgacacaattgcttatacttcaatgatcaagggcttatgtgtttccggaatggtggatggtggtcttcgattattttatgacatgctggcaagtggtcatgctgatccagatgtcatcagttataatgtcctgctggatgggctgctcctggccaaggacctcccacgggcaatggacttgctgaacaggatgcttgaccaggggtgtgatccagacacggtgacatgcaatattttcttgagggagtttggagctggagagaggaaggggagggagttcttggaaggcctggttgtgaggctatgcgacagaagaaggaatatggcagctggagaggttttaatggtaatgctggctaagtacattgtgccagaggctcccatttgggagatggtggtcagagatgtttgtcggaggaagagggtttggagagtgattgacaaatgttgggatgagatttgggggccttgatgatttcttcctttatgatttttcattcttgataccaaaggagcatggagctcacatactggaggttcttgacactccatttgttgtaagttgtaatttgtaacactgactcatttatttctaacaagattttgactaaataaattgatttctatacaccattgtgcttgtcgttgagcatcgaacttcccttttgtcctgatctaaatggtgtaaagtgtatacattgctgtatgggaatgcctttggtggaactttatgagtctgtcacttttttctctctctgattggcctcgccgcctactttatgatttatatcccttcttcatagaagaaacgggttgcttgggagttataacaaaaatatcatgttaaaaaattcagcgcaactattatttgttttgtctaccaaataaatttgtaaaatataagttagttctatgtgtaacaactttgtaatgtccatgcttttgttatagtaggctttgtaattttcttgtcaattctctactgcaagatatggtgccttcagcttattttgacatgccaattgattggaatgggtaaacaaaggtggcaaatatattatcattattcatatgttttttcaggagttgcactttggcagtatgggttttatcatattctggatttcatcctacaagtaagttatctatttttgtttattctgcctcattcaatcagcataagtaatgccctgtagtttggattcaaacgtttcgccttaatccatgcgtttctttcctcagacctgtgcactgtttctcaccttttttgacagttactacattccaaagaaagacatgtgggtgcttcagttgcattgccctggattccatcttgctgatggtcgaaaatcatacaagtgaagtgtttttagagcttgctgttttacctatttgaaattctgaaaggttttatcccttagttacttatgtaattcctatcaatggtaaatttcttactcatggtttacaggattttacattggactggttgcagacagtgactcagtgagccagtgatgcgaggagcattcctgaaccttctagttgctctttttgccttggaacgtgacaatgtgtcagaacctgaaatatataactgaatttcttagttcatagtactataaaagaactacaccttgtgctttgtatggccaattcattatgacagcattttaggagtatagctatggcttctccagcattcttggtttcagagataactatacagtgtctctttttcattgacatgggtcttcatacatttgtttttggataccagagacatgggtcttcatgatcagatcctcatatttttacttaatatttcaaaatgttagtggaagaactgctcatgtgcaagaattattctgaatatctatatggatgtaactagttattgtaagatgtaagtacttacctgaggaatagtgttattggagataaattgttcattattacagatcctagctgcaatatagatttcgcacggaaacacagtgtggtacaaagatttattttgtatgcttcagtacttcctaaatatcaaatgattttggattgcagtgatttcgaacttgcttgcctctgttatttgtttcgttgttaacaacatgcttgaaatttgttttgtggttcttataatattcccaatatattgaaatttgtgctaccctgacatgcccttttgtggtaattcatcaactttttacagagaattctcatctttaaataagaggataatttctgtttgtgaaactttttgcatccatagattattaatttctgcttgatatatatgagaacagcatcagataaaacaacaaagtcggtagtatctgctgaattttgatatctgaagtagatcaaatttatctactgctgtattgcgtgcttgcctagattagtttaaagcaccatttggtgcgtgcagatctctattctcgctaatcgctatctttcattgctttagcagaacatttattttactataaataggctgctctggcagttttgcatatatgctagaattaccaagacattgctgtgatccagtactagttctaacatactacttaattagagcctgatccttctgcatcactagccttcattgagaaatcatcttttgtgctatgccaaactattgaccgttaatgagattgtagtttcttgttttcacatagtagatattctttctgaaaacttgaaaatgtaccaattatttataggtatttattgagttgtttgtgcagggtgaaaataacatgaactgctttattgtgtgtatatgattctttcctttaatcatgtgctcgtgatttgatgtggtcgacactgattgtagaatggctcaaaaagatggcctgagcgatcttagaaatttgtctcctcatgttcttgtgagaggcagttttccttctgtgcaaaacatgattgcttcatatttccaacacgctgctctgtctttgcaggccatacttaacatgtgtgacaatattggcggtaccttaatcgacatgaatggacctctgcctatggcatactaaatggtaacttgccaatgcccttccattttttaagctgataaaatcacagaacttctcttttttgcttttctccgagatggatttcttgatttgagatatggtgctgcattcactaatgtccagatcatggtggcactgcacataatgaactgccacggtttgccttcagcggcgtcgtctactcatctgtgtgcttcttgtgagttgtgaagcatccatcctgacattgcgccatatttcgcattgtggttattagtaatatagaagaaaaaaggtaagtgaatcgatgaggatacggattgtttctggaaaaattttacactgtagcatgttcagccattcaggatcattccgagttatatcatcttccaaatgtacccacatctgttgtaggaattttacaggattatgttcaattcctccaaaaatcattttgagtgtccctttgattcgtaggaaaagtgtaggaattttagaagattccaatcctatggaaataattcttatgaaggcctttgaaacaaatgattgaatcatatcctatcatttaaaatttctatggaaatatggaatgagtaatcctatagagattttggaagaaagttagcaagaggtttaatttcttggaaaaaaaatcattcgagtttatctctctcatccgattcttatatttttcctgtggtctaatcgaacggtcattcttgtgttttctctgttactctattttaccaatcgtgcatgaattcaaagggtccctaaggttccaccatccaaaggaagtccttaattgattctcttttatcgtaacctttctgttaaacctcttaaaagttttatcctcattttcattcgttctgctgcaggggtcgcagctcgtgcatacagcattcggaggagcaaggttaaaccgttcgatggaatcatcatggaaattaccagctttctgtatcatcatggaaattaccagctttctgaataagcagaacatgaagtctacagttgtacggtgtacttcataaagtcagaagctgcgtatcgtttgttaggtacagtgccatgtcgaggcatttactaagaagtggcccaggtcaacactgatgagagctttcttgaaaagtggaaacgcgatggttactccttggccaaaggaccgttcttccatttccatcacaagaacggcgccaaccatggagatttagctctcgagtcatgtggactgccgtccattttacaatggacggcgagcccttcgtcgatgccttctgtggtctgaaatacttcatgccctgtcaggttccccaaattatctgaattttggctgtgtacgatccgttttggatgtagagaccggtttaacccatttctttaaaaaaactgaattttgattactttcttttgggttcaaattatggtttatatcatctagcttttctttattgcttttgagttaatactgattggcttagatttttttttttcttattactcatgacacgtgattgatgtaacaaaagaaagccaacgctaaagaattagaaaacgattaaagaaacacctagacaaattttaaaatgagttatagaattcaaatatgattctggcttataggttggcgagctgacaataatggagagcgtatttcaggtcacatttttggatggccattatattctttccatgtcgaaggtgaagataaaagctcctgaccattccaaacaaatccagcgaggcatccaaatccaaccagtcaatcgattgtcccccactgcaagtactcataccagtacactacaagctgacctaatgaccatgacttgctccttcacttgtgcttgagtcaaaccatcctgcacctgcaatgcaatttccacggcagttacacgatggagacaggccaaaccgaacatgccagcctaggcacgtagtagaagaacaacggttctttggccgtgtttagtttcccccatattcccaacttttcatcacatcatatcacatcaaaaacttttctacacacataaacttttaactttttttttctaaactctcaacttttttcaaacttctaactttttttcaagga

SEQ ID NO: 17374 - DNA, 4871 bp, Oryza sativa
ggttgggctctgttttttttctccttttttagcagaagtagatgttggtggttatgactgaagattcaacgagtatgtacttaaaaaaaatcatattcttgcaaagcaccacctcctagatgcagcaattatctgtttgtttgcatcccaagccataaaatattttccaaatagaatttctcagaggcagtgatgagaaaaaagaaaccatttcttccatgaagcaggggatctgccctaatttgatattgccatcaaagtaacttgccatgttcctgaagatgatctcctacaaaagatggcaatggaatctttgttggtaggtagggctccttttttttttccttagcagaagtagaatttggtggtggtgactgaagaagattcagagagcgtgtgatcctaactcctaagcatgcaatgatgcacgtgtttggtgagatacataattagtaaagagatgttggttatcacctaactgaagcgggtaatgaccgtcgtgttttgtaattgactgccttgactaggaaatcctgagattatgcgtgatgctcccagctgctgaattttggcttgaaatgttgagacaacctactctgatggatggagcattttgtttgtcttttcagtgcatccattcaacggatttcatcctgactgaaatagttggaccaactaattcaacagcaagcataagtatgaaagtaagggaatggacttcgcaatttatgaggtttatgtctatagatgtctcacaaacaagacacatcttgttttcttggacaaaatggcttgaaacaaatacacatcttgtttcatgcagaagcagaaactacctaagcataccctgaactgagaaataattttccttacaagcaaatcatcaatttacatactaactctcatactaactctcagttacattagatccttgcattgctaatgaattcataattttgtaaccaatcaattttcagaattattatcaggttgaaaaccttagattcatttggatcgggcgatgtcgtcgttctgtcggtgtgtacttcttgaaggctttgtttttaagagtttttcccttgttgaactgctgttctttagttcagtgtgtccggttttcctttaattaaccgtgccgttttgaggtttttggattcggtttttcttataaactagatcaactctcttcttctatagtgaaatagcatgagctccctgcctgttcctcgatttttttttcagaattaacacatgacatttttgtgggttttcagttcaccagcagacaggcctgcatcacttgcgagctaactgaagttcaggttggtaggatacttcattaagattcaaagatatcaacttgacagataaaatggaactccaaacttatctggagcaatacatatcgcacgatttcttacctgaaccccgtgtccaacaactcatagatttggtcaggtctctgatgtgcacagaattgaaaatcaactctcccaaatgtcaaatgacatcactgatcaagactgttcctggttaagcctgatgcacgccgcaaaccaaaatgccatatcctaattaggagttccattggtccaagcaataccagaaagcgacagaaatgtaagccgactagttaatttctatcgagacaatcgaggtaagcataagatatgatttcatctagcaaagtttaaaatcatgatgataataagtattatcatagttttactaggattttaataaggttagagatttggctctggcatttatccctcggagtttatgtttgttgaacgtactaatgagtatatatatggtttcgtttggtggaaaacttttatagtagctgcagttttttttcagaattttaagctctctcaaataattaacaatccagattcttattcatattctgacagtacgtagttatagaagtcaaaagaagttagaaaatccagcttcttaccatctctcttttgtcccctaatcttgagctctcgaaacagggcctaacatactcatgtgatgcatgtaacggcgaaaactgttctcaagcaggccggacgttcacctagctctctgtcattgtgcctccaatgtaccgtcgatgtctgaaaaaagtggtcgactgctagctccgtcaagagacgcgtgcatgtattaattccatgtactcgaaaaaatgaaaacgaaggacgaagaagcgaagcatgttcagatttcttatgggttttaggccttcaccgttttgttgacggcttcttgctcttcaaaagggtcgtatttacgcgcgtcagaactgcataaaaacgcagctgacgtatatatatctggccattcatggccatgcgtggccgattgcccatcgacacgagagatatggatcgatgtaatatatttatcggatcataaataaacactaatatctcgagaggacgttaactcattattatatgccatctaaatgttataaaatataatatacgatatatcgttcttcaaattcgatctttacaagtttaataataataatagatttaactgaaacactttatatttaaatttgttgttttaattgtgaaatataaatttaaacttgcatgttgtgaagtgatatatcatatattaatttatcttgctaaaaaaattttaaggacacgaggaaaaatgaagggaaaccctatctctaggattaaaaagtctctcattagagatgttatcaaaatattggtcgtgattcaatgacgggctaaaaatggccgccacaggtcagccgccatgggggccgtacatcgaggaattaataaacagcaacgtgatcaataattcgttagtcaattaacttgatggtattttccgagtgacagtgcattaatttgtttgtacagttatcgccgtgcagagtcttagtacggactccctccgtcaacaaatggatgtcatgttaaggtccgtgcgtccagtagatcgatcatctaaagctatttatattttggtgctccgtatatggaaaaatgagtgctggtttaatatatttgaaattatcatgagatttaaatttgtcgtagagaaaaacattggatataatataaactttatgagtgaattttcacaaaactgcatatatttgataaagctgttatgtgcattaaagctttgttttgcgaaactatagatttaacacggaacatgaaaaattttgaatttagttacaaggttgatccttgtcttatgttcagttttttttttttagttttgtagtatataaaactgccactaaatttagttttgccataacatggttataggatctgcattggtgcagagtatatcatagagtaaatttggcaaactacatatccttatcaaactattccataactacgtatttaagtcggtgtgtcataaatcaatatttttataataaatttaatattaaatttatagttttgtgatacaacgtattaaatcagtagtatcatgattgtttggtcaaaatatctataatattattctattctatcttcgttattaagtttcatgaagaaaattgactaaaagagcaaaatattttaatcattcctctgaggctctcaccatgtaggctccccgaggccaaagcattttgagccgcaacaaaccaacagttaagttttaatagtggaaaaggcaagtccttgactccttgtgcttatgatctcttctggacctttgttcagtttatgtggcttccggttcacccaaaagcccattttttaggttaaactccaagaagcaaaagatgtctttattaatgatattttacttcgacactatattgatcgagcttggcttagatacagtaaaaaaattgctccacctccatatatgctccgtccatgcctagagacatgaaatcgacatggaccacattttttaaagttgtatgagtataaacaaaatgagcatacgtctagtacgtcgacacatgcatggttttatatataaaaacagttgactccaattaaatcacataattatatataaaatggtgttctttcattacaagtaaaatcctcaaaagttgtttccaaatttcatgtttcattactacctacttcctccgtttcacaatgtaagccattctatcatttcccacatttatattaatgttaatgaatttagatagatatatatgtctagattcattaacatcaatatgaatatgtaaaatgttagaatgacttacattgtgaaacgaagggagtaatttgaaaagaaaatcgaaatgtcgctaccacaaatgaaagacttatcaccaccgccactgctataacgatgttcatgatccaattagactctcctaccgctatctctatcatcttatttacgtcaatttaccgcgtggatacacttgagccaacttttagaggtaaaaaagacccatttgcattagattacaattacattagatcagactttaatttgcagtgctaattaatcaggcaaatctttccatgaccccacaaattaagtctgactttccccccatccacggctatatatggcgcgaaatcaatcaaacccgccgcctccaaagcagaaaggaaaccccgcgaaaggaaaagcctcacaaattaagctggaagccaacaaggagaaggcgacgacggcggcggcgagcgatcgcaaggttatggccggcggcgcgagcctcctgcacgcggtggcggcgctgatgagcacgtgcacgcgccggctgcagcgcgcggcgaggcgggtgtcgtccgccgccgcgggggcggggaagcagggggcgtcgtcccgcgccgtggtgccgtggaggaaggcgctgtcgctgcccgccgcggcgacggcgaaggtgaaggcgg

SEQ ID NO: 17375 - DNA, 9691 bp, Oryza sativa
cgccgcgctccccgatgcgcagccctctcccggtctccggcaagctcgccgccaacgcccgcgccgcgtactagctagcccgcgccgtgttcttgggcagggcagcctctccgcggatgagcggcggtggtcgccggcggcgaagcttgctcgcggctgctctgttcttcttgtgggtgctcgtgttgtgtacatgtagctgatcatcactagattaatttaattaatggtgttcttgctgcctgcccttctcttaatctctccttgtgtcttctctaatggtcatgtgtaatgatagatttattatgcagggattttattgataattatatatattgcaagtcgatcagcaagatttggtcatttggagttgtgtttgcggtttttcttcttgtttgaattacgttacgcacttacgctgatggggtttatcagtggtgcaaattgatctgatcttcaccgcaatatatttatttcattttgcaattattttgctcgcacaatataatttcttagcattgttgtacgtcaacaagtcttaaataaaagtactcctacaggccacttgcagggaaaaaacatctttttactggagtgaaaaaaaaatattgggagtaaaattctggtgatttttactgacgcacacatgctcgccttcaaaagtgaacctgggtaaaaaaaaataaaaatagaaataaaattccatgtcactgtactttgtgattaatggtagagtgttatgttttattagttcctttctgattgtacctgcagtatgtatcatttctgtgctcatcaagcagaattttttttttacagaattaatgtatgtaaaatacagtttgatttccttcattatctattattccgtggtttgtgacgcgggcaaagtggtacaagcgcggactttgcaggtaaacgagaaaaagaaaacaccaatagcatgtcaattgggacttgtcttagtcacagtctcgcagatgatcaaacttgtttgaagatattcaattgtggacgacagagcttagatattttaagcaggtcataagggagaaaattgtttgtaaaataaacccaaaataaatggtgtatttcttattgtttgtcaagaccattaattatattcctgtcagattttggctcccaagtattacctttggacatagagggaggttcttggctgtctactatttgacagagctgcattgacaatttggggtatctaatgacatcatgtgcttgatcaaaatgattaatccagcttcttataatgtgcaatcatgtgccaaataatacacagattgtgtacatttgaggggcagaattcatataatctgcaacatcatgtcccatgcaatgatatcccaactgaaaacggtgtatcactagatctccaataaaatggttgcacttggcacttggaagagggccagccaaacttatacaatccaagcaacaatattattatgcgtgtacggatgcattatgctggcttccacgagtccaaaggcataacactgaaagtgaaatcctcatagagacatcactccctaactcccctattcttgtagcctcaacgaaccctatatcttgcttcttggacactttaggaccattttgttttgatgaattcgatgagtaattgactgttcgatcctataacttgtttggtttgatgaacatggagtattacctcttcatagcattatcagaaaaatgcacctgcttaatttatccaaaaatagagaatatagtcatctcaccaaaatcatgcatgggatgatatctgaagattgatctacccgtcctagatagtttgattcctcgatctaaacaacccataaagttacaaatcgtccatcttcagttactgaatatttttgttgctgtaagtgttgtaccatttattgtgttgctacaatgaaccacagcaggtagcatatcgcttaacttaaacaggaagagttgtccatgcatagagagatttggtgagaccactcatggtcatggataatatctaacagtgtgcatatcaatgtgatgagtgttacttgtggttcaagacatgttttgcccaatttaccaagaaaaatgaacacgtatatctaacaagcagacaggcaccaaccaaccagtgaccaaacatgaacaggaagctcatggtgtgatcatttcatgccatgatatgatcaatataatcaagttcggttctatatagatcaatcagatatgcatcatatccaagagtcccagaagcaaacatcaattgctaccggtttgcccatggcgcaatcgatggcaaaacagctaagaaaccatgagaccacaccaccggctggtgcccacaaggctgtaatggtctgaaactctgaatttcttataacaattgcagtcagatgggtctcagcaataagaatttcttgcaatcatgtccgtccatttttatatccaaccgtgtacaaaccctttcgcatctttgcgtacatcagatcaaaaatagacggctcggattgaaatccaccggatagatttgaggaaagagggtgcaccacatgccatttttcaggccatgccatgttgccatgcacatgcgccccacagtgccacacaaaacaccccaaggaaatgtgctgatgccaccaccctcaaggatcatcaaagagcatccccattggcaaatgcatgattgcagcggattgttcacaagggccccactcgggagagggaaacgtcagaggggaagtgtaggaaaccgggaaagaaattgaaggcattaatcgaacaaccaccaactatttcaggcttgccaatgagcgagcagtggacgtgccctacaccatgtttgcctctgaattttgcgtgtgaaggaactccagctccataacagcaacttcattcagtgtctgagcttgtgtacgtgctctttcagaaagagaaagaagatgggttacttgacgttttgtagctagcgacagggcgtcaatcagctcagctaccctgttgctgcacctgatccatcctgaagctcacccatttctagtactccatgagttagcacagtgtctacatggctcaggattagcaaaaaagtactccagaaaccattgaaacctacaatcacggaattgggtcacggctaagtgtaaaggaaaacacatgcttcacttcatgtttattactcaaatggaatggtgtacaccagtgtgaaagataactgtccaggtgaaacagcatccttggaggaaggcaacatcaatatctacatagatcatggtaaatgaaactatgaacaaaccagggttttaccggtgacactaaaaggcaggaagtcacgaggaagcacaaaatgaaaataatgattctgggcccaaggcaacatgcactgactttaccctactacggacaaggaattgtttataactgacagccgaagccctgataccacagaacataaaaatgttaagagaaaagctgacatacaacaatgcaagggcaggttagtttgcaggcttagtcagctgggactcgccatctccttacagccctctcaagtacttcagctcgttcatgtacacgtgctgcttcttcttccacccaagacctgatatcatttggccagtgtaaaaaattcatgggttaaacttgttacaaaattcatgggttaaacagtgttaaaatacatatttgagcatccaaggtgtacacttgtttaacaagacctgatatcaccttgggttaaacttgttaaacaagtgtacaccagtgttcttaaagcgacaaggcgaggcaaggcaacgccttacacacaagcacaagaggcatactagagatatacgaggcagaaaagagaggaagaacatgaaggggcgaggaagagcagggagacagatccattggcgatgaagggagcagcaggagggagacaaccatctcctctttccatcttcccctcttatctttccatcttcccatgtcgctatgtttccaatctctgcccgccctattctctattctctttccatctttcacccttccctctccctaaatcgtcgcacacgagatttccatcctatcttcacgcgatttccttcccagcatgcgcaattcactacagcgcatgcgcccttgaccccaccttgcccatgtctacctgatttcatgagatattaggatccaagacgtgtggaagggtaggcggtggcgacgctctgatccctgatggtgctcagatgcctaggcgacgcttttaaaaccatggtgtacgccactgttaaacaagtttaccccctccgtcccaaaaaaaaaaaacacaatcctagctaggaagctagacacatgcatgtccaggttcattgctagaattggtcttttgttgggacagagtagtacttaccaaaatactcaaataccatggctacaagaattggcctgatccataagtataaattttgtgggttagtctgtctttgggctttgaactcttctagaagccactgtccatctggaacttaaaaaccagtttttttcacccttaactttcagaacctgacaaacaacaccctagagcctatattctacagcagtttggtttgaaatagcagtgggtttctctaacatgaactttctattggacaagtaccactgatgcagagctaagtgatgtgcaaaagcaaccattctttcaaacaaaaccactatagaataggttccagggtgtttattgtctggttttagaagttgagggtgaaacaacccttttttttagttcaggctgaaaaatagacttcaaaaagagttcaagactccaaaatgacctttcttaaattttattctgatgactgatcttcagcatttcttcaaaaccatcaaatatagtagaattttagagcgttcatgttaaaagttcagtaaagggttactttattgttcggaatctaagatatgcaaactaaatcaaatctaagagttgggtacatagttcacatcagattaaccagctaccaaactacttgcatgtgtttgcaaaagatcatacagatagcagcaacatctatgaagatatatccagaaaaatattttcaagtgaaagagttgggtttaaaccacagcatctaaactaccagctcctttaaaggagtaaagaaagcatctagttctgaactactgcgcattacattacatgtattcatacaagtgcaggcgctaatagttttcaaatatgaaaatatcaggtaataattaaaaggaaaatgtaaagactgtataaagacagaccttagcatagtaagagcttccttctcagcttcaagataagatttggattcagagacagcttgatgcttcctattcacatcaagtgagagcttttccaggttttgttcctcagtcatgacctctagactttccatggctagtctatcatacatcccatcaatctctgacctcaaattcataagttcctgattctgatgttctagagctgttctctctttcagtaagaccgcaagttccttttctctatctgttttctcatttgcaagctcttgcagcacatgttgaagctgcttatcaactgcaacctcacggatttcctccactttcatcttgtcctcccaatatctttttatatctcctctattaattaactcttccattatttcacccataacagaaagctgggattgattctctgcttctagtctgttcaattcatcacgtattacttcttccattcggccactggtcagtgcagcagctgcttgtgcttttgtaacaggtttatgtggttgaaggcatcttgtgtttcctacaaaatgtaattattgttcaagtcagctgaagtacattgaaacaggatagctatgaccttttctttggtcacgggacacaaggatatggataacaaaatcagtcacaaaaaaggcagaagaaagaaaggtttagaatcagactgaactacatcttatactgatgggaaacatgtccatgcacgaaaatcagcatagacaatgttcttccataagctctattttcataacagttaaattgaaacaaattacggaatggcaagcatcatattttttttataactttttgaacctttaatttttaataattttgaaaataaacccttccaaaacttattttcaagatttgaacctttggccaagccaatcaggctggcgtggcaaaacaatactgccacgccggtctggctgccgtggcagcattgtctgtcttgccacgccactctagctggcgtggcagaacaaaactatcacgcctgctctgggtggcatggcagcgttgtctggtgtggtaggacaaaaatatcacacctgctgtggttggcgtgtcagtgttgttttgccatgccatgcgggctggcatggttaaaaggttcagaattctgaaaataagttttggaggggttcattttcaaaatcaaaatttaagaaggttcaaaaaaagtaacaaaacaaaacgaatattcaaaccactagtataagcacacaatgctttagggaataataggtcttgctatgcctaagttagcataacagaataaccataatcttagtaaattaagaatcattcggtcaaaacatcaacacaaaataaagactactaacaaatcataccaaaaactttgctgatgatgctctgttcaccacccatcaaatctacaagtatagatgatggtacatcaggccaagccctcaaatccaaaatgcgaacatttttactcagcatctggactgtaaccagagtcaggatttacaaaagaatgaaaccaagtaatattatagaaacattgcagaatatcataagaacaaaagatatatgtaccttctggtctagttcagttgcaaatggatgctccactagtgctttccaattaacaagatcaaaacgtgatagataactaaaaccaccacacacaaaagaaaagaacataacaagtaagaaaaatgtattagctgtcaataaagggataacagaaatttcatacgtacctgttgggtaggaagtttgaatttccactgtcactagaagaaccacttgttgatgttcccaggaagttcgataacttgctagatacaatgcctgattctcctaaagcttttttttttttgtaatggacaaaattagagtttataatcacatgctattaaattataggcatctggaaatccaatggagtactccttaacaagaaaatcatggccaaagtagcgtagagaaggcaggcaaatgaagacaggctccgatatctaagagcattgttgagtgagttcagtaaccatcagtataataacaacttacattggatgtacaagaaatctgggtcatcagcatctatatcgtcgaaggcacttctgactgatccaaaagttaatctattagggatgatcctatgcatctttttcctgcaaaacaatatcataaagaaggcaatactaaaatatcaagcaaaaaatatatatggctttgttttgctacctttctaattttgagtgtaacttaatgaaccatcttgcgaattcccttcgagaacaaaagtcgctggagctagcatctttttcaattatctgatcaagcacagaagttgatgagaatatctttggataacatttgtaagaattaaatcacttggtcatatgttgaaagtaatggtatcattaaaaataatccaagcggtcaagcttatttattgtgttttgatcaatcactagtcaaatgatactccacaagaatggaccaattattattcaatgaaactgcagatcaaacttaaagacaaaatttacaaatgtacttcctccgtttcacaatgtaagtcattctagcatttcctatattcatattcatgttaatgaatctagatagatatatatgtctagattcattaacattaatatgaatgtgaaaaatgctagaatgacttacattgtgaaacggagggagtaagagcaatatcacatttctaaaaatcgaccctatgcacctattaggcgcgagacaccaagtagccacccagattaggcattagatggtgcactaggtggctaactaaccttggggtctcttgtcctgctattttagtggtcaatggttaacttttatgtaattttatcgctaattgcttggtatttacaagccatgttggtcctaggtgccagagctgctgaccctctagcgcctagtgccttcttgaaccatgacatcagatatcatatgaaactggagttgataaattaatagaaggtagctagaaggataaataaaactttaaattaaattcatcctagcaaactatgtggagtattgagatttaagaattatagcaacttctgttgaaagaactacagaccttcaaattaatacaaaaatagcagttgtctcagtagcatgcaagtgcataatgtatcctacctagctaatcattttcagaatatactgtgtaagacccaaaaaaaagagaacacaaggtaaggtaaatgagcagcttattcaccaacgaagtcaaaaaacaatgcttcaacaatacagagtaggtagcaggacatttatgatttgatatatttcaacaagctacaaacaagtctggcatacctgtagcttcttcaatatagagaaagcctcctcgtgcatgggatctacaggagctctaaatagaacatgtacaccaccagctggcatgtggttttggcttgaatcatcagtttttgtatcaaccctctcgtcattagctgtctttgaaacatcaatattatcccactccttgtcacctgcatcctcctcgggagtctcttttgactccagtgttgataacttctcttgaacatagtgtaatggggcatgtacaaattgctgcaaacctgaacacagcattattttttacaatttatttaagtgttcgaaaacaatgtcaagcaatcgtgtgttcacatattgcattgaggatctccaacacaatgcactgaacaaagcatattcagtatttacaaagcaaaaggtaactgaactcttaacaccagaatgaacatagcagattccaacctaatttagcaccggctgattttgtacaaaagtagacagttcgcaacaaggcaacaaccgaaagtaagaaaatacaacaagcagcaaaacataagcagcagggatgacgattgagaataatttatgcactaaggtaacatgaattaagacaatctaatctataatgctcaactgcattctcctttccccttgtaactagcggcagcagcagccagcagattctcttaccctgtcatagctaagcgtcccactggaatggataactgaagctcctcaatccatcccatacatttagcattcaaacacacagtgaaataggcaacaccaccgaagtatggtgttcataatcaaaatggagataaaccagtgagcaactcacacttcctcgacgacggcaagtgccacatcatccccaccaatgcgatcgccgccgaagcccccagcccgaccgcgagagctcttcgggaacccgcaatcccaatccccactgcagaaacaaaagagaagagatccgctcaaagccctcatcgagcgatcgaatcggacagaagagatccgcccccaccttccctcccgcgctccgccggctgcttctgctgctgctgtgctcggggactgggagccacca

SEQ ID NO: 17376 - DNA, 10612 bp, Oryza sativa
ggggagggggagggagagggcgagagctagggtttttgcggcggtggcctcatcggacggcgtccattttgggccgtgcgcatcgcattcgcatcgaccgaagagctttgttttatcctcctcctcgacgcacgtaggcgctgctaattgagctgttcacagatgatggacgacaaaaatcaaacgcatcaatttcgaaagtaaatttcacgaaacttcggaatatccggtcatacttaccaatttactatacttttaatcgggcattttacaaggttataacaatattaaactattttatctgggactataatgcgtgtttaatatgtagactcaacttagacccaacttataacaatgtattctctccatttcataatataataatctagtagcactggaacgtgtcttatccgatactaggttcctatatttgcaatgaaggaagttagtaagagtaatactttatcttaaaaaacaatgtattatatgtgtacctgcagactggtggatcagatcttagttgaacaaaagttctattttgtaaagttctctgataaaatcacaagcactgttggagttctatttaaagttgcagcaaatcgttttgacgtaatagtttcactatgagagtaaaaaatcattcgctcattaaaaaatatacacctcgatgttgatatatcgcagtccaaataaaatctagttgaaactttgacctatagataaatctacatggaagaatgttgagtatgatctttttgataataagcaaaagctgtttcgttggtatctaagtttcccacgcctaacgaagtgtggcatggcacaaaagtacggtcatgaaatctatctttcaagtttatggtggttaataattaatttctcgtttcgtttgcgctgaaagtctttctccaaaccaaaaaaacgaatgcagcctaagttgtgaccgtgaaataaatatttacataacagactgtggcataactaaggtgtgacttgacaaggtgaagtaatgaatcaaacgaccccttggtaccattgatactgtgagttgtggtgtatggttccatccaaattagtcacgcacaatggtggtgttctttttctcctgaatatatgaagatgaagtttttacgcaaaacgaggtggtattaacatatgattaattgagttttaattattacaaactaaaaaatagattaatatgatattttagagcaacttttatataaaaagttttctcacgaaacacaccatttagcagtttgaaaagcgtgccatgaaaatcttaatcttcatccaactcttgttgaagaaaagaacgagaccaatgtgtttttactgtggtaagccgacattacgtgaatgaagcaaccagtcaatttgatggtatataaagtcaattcgaggaaatagacaataaatccctaaattaactctaaaattaagtttaaaagtttaaattttggctacgcctgatagcaaacaaattttaaaggcctataaatttggttagggcatgaatttattgctagtttctactatctctaaagcatataatgtgggtcttgcatgccaataaggaaaaaaaaagaggtaactccttatgataatgatatatgatttatgtagatatttgatgaaactcgtgtagtattgaaaagttccaagtttcaatcaactcccacatttcattgacagttatattttttctgttcatacttcatagtgtagcaagtaacttctttaacaaattgatcacaccactatatcagatttcataggatgaaagggaaagatggacttccaacattcctcctatagaattgtctcgttgcagtcgtcttatcaacccgatcaaaacatagacgattcacatcaatgcaatggagaactggagaggatagtgagcttacaaaagagctattcccctttcaactggatctttgtcttcggggcttcaacttaggcttgaatcaaaccatacactgctttgacaaagattaacagacagtttccagtaatcgttcccagaaaaagacaaacatagccagttcagaatatgtgctcggactaagaaatactccatccatttttaataagtttttagagaaatatagcaattgttataacatcaaattagttttattaaatgctaacattcacaaaacaatatgtttatttggtgttgaacatgttgctttgtttttctattaacttggtaaatttaataagtttgattaagaaaaaagttcatcttataatatgatatgaaatggagcgagtaataaacaaggaatatataaaactttcatcgatgcctattgctacaaaacaaatgtttccattccaagtaaacattctcacacaaagattacctattacactcaggggctgcctctcgctaaagaaattcaagaactattcttttaacaacatatgtatgcttctactttctatcctgaaaatgatttctcattgatcaacttgaaaaatatgtttcctagtgagtcatgtgtcaactatatgagcacctccacatcatcctcggcgctttcttccaaaaggagatcatctctttgctcagccttcttccttctctcattcttcttcctggtctcctcacctatagcattggcgatggcgatgggtagccaaaatccaggcctttcgaggaactgagctcggtgaagaatcatcgcatcacgccgtgtcacatcaatgccatcgaaagtccacaccgcaactgtggcatttcctttcaggcccaaggaataccagcctaaccccgaaatagcaatatccatactgttcacatcccaactgacccccgacacatcaatctgtctttccgtccagtgacctaattcggcaactcgctctggcctgatcggtggctgaataacaacagcatataaatcagtttgacaaagatggaaaaagtatgtttatttttgttccaatgcttctcttgtcagtgataataacccaactacataaacacttataatagagcagtggtagcaccggcagtgctcttcaaaaaattaacagaactttgtctgtgcaacaggtgtttaacccttagattttagacaaccagaatttcacatgtgcttgtttattcgactagcatgtgggatacactaccgttccatagaatagccttactttgatgtaatcttcaagtattatgttcccattaaatatagtactatattctataattaaatgtactgttgggcatacctgaagtctgatgccaaaatgtttgtcccgcagttcttcagcattttcagtcttccccagatggagggacacactaggagatgcccaaacagttatgtagatagtttggactgaagcttttaacacatcaagtcgtgttaaacctccaatatgtacagattgtcctgcctgaaacattttacaaccattggagggatcaacggaatctcacagatcatgacacaacatagaagtatggacaaccataatgtttgaaactttgatagtacgagttgaggactgatagaggctgctaatgtgtgaagtgtttgatagtacaagtttaggtcactaaaccatccaagggatactcagtgcaaagtgtttcaaaagtcaaaatatagtactacctctgaccgacactgtttaatgtgtgattaactatactatcactagtacacaatttcatcaatattaataagttactacaaaaggaacctaggagtaactacaagtacgacattaagccttaaagtgatacagagtggagaacttgcacatgttcagattttgtcatgtgtctatatttatacatttcaagcttgagcagtgaccacaaagctaataaaggactaacaaaagcttgaggatactgtttcgcttcaaacaaaatgagactattggcacaacagattgaatgagataagtcatttctagctatgaaccccagtagataaactgttctatataggcaatagttagtcattaataggtcaagtacttttacaaggaaataacatgattagtagaaatgtaatagactaaaaaactaccttcaccctgaagcaccttggccggagttctttccgaatttcaaccatcttgcgttcctcactgtttaatctcattgacattatatatggatgcaataagccaggagtgtcatacattttagcctttgctggcaaaacacctgttattctcaagattcctaatgtagttcctggcacagcagcctcagtcaaccttgtgattttgacaccttgtttctttgcaaatgcattaattagagtggatttcccagcattctgtgcaccaatcacccaaacattgctacggggcccagctagttccttgacatatgagatcaagtttctgacagacaaatccttatgaacactgatcaagaaaacagcatccagctttggtgctccgaaagccttagctcggcctctcacccacttctccagcctcactcccatttgctgccatggcagcaaatccaccttcgttccaacaagaacaagccttggcgtttcactcaacttagaagttccccgcccctcgagcgccttgaacagcgacttggcagccctctttgggaatgagccgtcaaagtccgcgcaatccgctaccatgacgataaccggtgtgccagctgaacgtttcatcagacgggacgatatgaaccgatcgaaatcgaagtccgggatcaaattctcagccttgtcattcttcacatgcccataattcctcagtgagtggcaccgggcacagaccacggcggcgtcctcctcggcctcggccttcttggcttcccgtgcccggcgtttcctctcggacttggacagcttctccttcttccatctctcgagtgtctcctcagtgatctttccatacccaactcccggtggggtgaaaccatccagttctttcctccatttctcctcctcgtcttccatctcctcatcccaatccgagtcccagtcgctcgagaagccatcgatcttggcatctatgtcagccttcatctccgccccatcctctccattctcatcctcttcttcaagaaattcatccaaatcgctgtccagaccgtccaattcggcggcaagatcagattccgacggcgcaccgtcctcctcgtcgtctccaagaaatccatcaggctcggcggcaagaggaggcgacccgtcttcccccatctcgtcgtcggagaggcgggaggggttcttgaagaagccgggcaggttggggtcggcgtcctgcatgaacacgccgcagccggggcagacggggcggccgacggcggcgtcctcgtcatccctgccctcgctgatgaccgggctcggcggcggcggcggcgacctgccgcgcttgccggccgtggacacggcggagacgggggagaaggagaggctgcggctctgaggcggcgggcagaggaagaaggggaggacgcggaatggcggggccgcgccgacggcgaggcgggaggggaggcgagctgctgctgccgccgcgacggtagcggggaggaggaggggtttagccattggaggcggcaggcagcgcccagcgccccagcggcgagaggataggggacaagggagcgagtgatcgtttccagtccaaattgcggggagatctccgaaatttggagaaattgtgaaacaaccctccacaaataacaattgatgccttacaggcctgtttggcacagctctagctctagctccacctctcttggagctggagctcagccaaataattttagctccacctaaaatcttatataccgatttctgggttacagctccgtcttgtgattgggccacgtggcaccacgattataactcagcctagattctcgactggaaaagtgtgccacgtattcccactcattcgcagccatccgatgacatattaatggtgacaaaacgtccagcggatctaaatgtaaattgcaaattttaagagggattttttctcaaatgagaaatctcatctagaacaaccaggagcagaggaaaacatactaggaaaaaaaagaatccaacaaaaaaaaagtctggcaagaataagatttctcctctccgaatcaccatgccatcgtctagctaacaatgacagcgacgatgaccttaagcttgatgtacctccgggagcttcttggtgccgccctgccttgatctacaccaccataacctgcttcgggtgacctacctccacctagacatgagccagataaggaggatgcgagagacgagaggcgagaagtggagctggcggagggagatggaggtcccctgcgcctggtcgcctcgatctgatcgtctctccacctaaaataggagctgaagctgggtggagcgctatcacaaaatgaactagagatttgaagttgggttttagctttccacaactccactccaaatccaactcctaaagctaaattttggggttggagttgtgccaaacaggccatgaatttaggctactccacaactccactctagatttaacttctggagataaatttaagagttgcagctctaccaaataggcactctaaaaatatacatatcatctaaaaatgtatcatttatatccaatttaatagtctgttcatataatagttacatataaatatatactttatcattaaaatctagtcacacatctcatacaaacatacaaccataaatctatatctccttgacatgtgcttatagttggcttaggacatgtacaataaccccatcccagtcaactaatagccaagccacgtcaccatacatgttggtatttcttaaccttacagataaaatccgcaagcggacgaaaaataccgatgtagcacttcatctgggagtattcttaggtatcgatttccatagggaacatgtgtgttaactccggtttaagttcatccaaggacacgaagctaaagataggccaaggatagagagatttcaccggtggagaacagtgtctacggaaagcttaactttaatcctaatgaggtacttcgggcactgtccagctcgctgctcccagatatcgctctactgcacacccgggaggacttcagtgtcgtgaggactgtcaccacctctatacccacctcacacctattgtgagatgcagagcaaacaccagaaattaattacctagacaccacgtctaagcagattaattacttactttaatgttagctacacaccaaagtaaatcactatattttagttgattatagtgaacgatgatcccgtactctaaataggaactaaccaagagataattctcaccaagcaaaactaaattactcaaaagataattctattataactagagtaattaacagagcgtaaagaaatagggagaggattaccgacaactccggaattcctccgacttctactctactctcttcccaatctagtatacagtatagtacagtagagcctcttataatttagcttgtgtattggagtgagtgaggtgaggtctttatataggggcaggtatgacggttatggaacgtgaaaagacacttctgccctccaaccgtcattcaggagctcatctggaccgtccacgcgaagccccagatcgaacggccgtgggagtgaacccaggtctggcccgacagagcccatcttcggcctgttactccttctctgcctcctctatccatttctgctagtggaaagcccaattaatgatgctcttcggtagtttctggcccactcgtagtatggataggaattattcttcactcaagtctatttttggtccaactctggtggtttattacctgcatacaaatatacgccaatactcgtggaatatgtcagaatttaacattttcactatgttggatgttttatttttatggttttatgcaagtattggtggcataaaatttgtcattaacaaccgccaacaatacacctacgtggaagagagaggacatgagagagggagagagagagaggagtagacgcttaatctggtgctagcagaacacgagtttctagattagttttacctcctgtgaaaaaaaatactggcttatgaacgaataaagaaaggcatctccggtgtcataaaatgtgcatagagatggcttgtgtatgtgtcggttgtagaccctgctctagctgatttggacagagttcagagtaatcaaccatcttttttattgctcttgcccttataacctactctctccgtcccaaaataaaccaacatcgtacgggatgtgacacatcctaatacgatgaatctggacactcctgtataaggtttgtttattttgggatggatggagtactattgtacttgttctacaaagaactttggaagtttatagaaagtttcactattgatagtgaaaattttccatttcagtcagagcttaagatcatgggatttagtaattattttgcgctgaatggttgaatggattcatgctttcaaatgagttaattaactattataaagttgaaaatagaattaaaacgatattttaagaaattcagatatcattatttgaaaaatatattcatatgtagaatattttttgcaaagatctcacagtttatgaggtcaggaaggggtgcatattcatcgttttatctagtcgttggaagcaaatgggtacatttacaaactgagatgaaatgaatttgattgccacaaaaaaattgaagctcacaatagaaaaacaatagaaagtacctccatatgtgttcaactatatgtgcaatagcaaaacaaattgaaaaataacaaaagaacaaattgaatacaaaattccaatcttgccatgtgttgacatttatacatctgatattttttgtgccggactttcttccatacttttatgtcccacttcataacccaaaatgatgttgatttttaagtgaaattttgactagtactttgaaactttgaattcttacctaaaaatatttcaatagaggataaaaggtaaacccggttatcgcaataagggaaaccctgcatccattccacaatgttagtgcttcatcacatcattactaggtatttttgttgtattgctccagtagtaattcagtcggagaaataaaataagcatgggacaaaagggttagatctcaaatatttaaactactaaatcatgccccaatcttagcgcttcattacattgccaccaggtgtacttgttgtattgttctagtagtaatctagttggagaaataaaataagcataggacagaaaagagttagatttcaaacattaaaactgctcaatcatgaaaaatcaaacaataaatattcaaaacaaacattgaggatcaactactaccttgtatttggaaatttcaaaattttcaattgttaatgttgaaataattacaattatttttgaaaaagtaggatctaaataaaaatagtaaacattgcctataaaaaaaatagtaaacattaatgttggaagtataaaaatataaaatttgaaaattattaattcagatttaaatcaatttttaacaaagagtaaaaatacatcgtcgatccccaaacttgtcccaagataccatccagatccaaaaacatggaaaacgaacaaattgacttagagacaaatatgtcttttgattcaaactaaatcttggtacagattatagctggtaattatcattaggaaaatgttgtctctcatctctactcttgatttaatttccatcctactcctaaattgggaaatttgatcattgtactttgaacattggggatacatccatccacccatttaacatgctttgtcattgatctacaagatatccaagttgatatatttaacatagcatcgggtaggacccacacgcactattatagctgatagtggaaccgatgatttcctctcaatttctctcctcaataataagtgaagtaggtcttatcacaagctcaaatccaacttggccttgccacactttgtcatctctactcaatttatccctaactatttagaatggagaattgaatgtgcttggaaactttgtaatatctaaaatgacctaggatagaatagaagcgccacctacacgcgaattagcttccgaggtcgagcagtctcaatttcactacaggatttgcgaatgaatgctaggctgggccagattatatatattaatcttgttttgggaagctacataatatatgttagctttttgttgttcaaagctacattttttatggtatattggaacatatgatatgtagataagcacaaaccataaagaaaagctacccaccttcaaataatcaacttgcaccatatgtccatgcttagcattttgtactaattcaactaaatctcaattcatatctaagttcatttatttgcagttctacgcactacacagaaatgaatagtatttattgtgttgaggaaaatttgggaaaatcatcactgaataacaaataacaacaatgcaacaatgaatagttgttgcatacagtttagtgattgttgtgtattttgttgtttgcaattttattcatgaaggcttataaaaaatgttattcactagttaaaatgtggcct

SEQ ID NO: 17377 - DNA, 2688 bp, Oryza sativa
aggaaaaaaaaactttccatcttctttaccggtacatatatgttaaacaaaagcaacaaaacttcaacttcacgtttgaagatagctttgccacaaagcgaagctaatttaacttccggttcatcttctccgcttacgaaaagcaattacgtaccactgtttcagcctattttgctacttcctagctttagttttcttaaaagtagttttatctggtatctagatgcagttcctgaagtttcttggctagtaagcgcaggaaaaagaacaacttatatatgatgatctcttaactaactcattctagcctaaacaacttattgctgatgttgaaaggtccccacaacaacagcattccccatacctagcgtccacagtatgcagggacaatataatttattgatgtaaaatcctctgtagacaaattgactagggaagttataatgtttaaaagcgattaaaaaaattctccttgctttaactggcatataacttccacacccacatctctaacctatagctaaaataaactatatatttttttttgcaaacatgcaaaagttttaggtgtcgaattatattaggtggaagcaacatagtacacaatgcaaactgtagatcagtagcaggagagttatatggattgagagattacaccattgaacatgtaaatttgtagacaatttcagcagggggagaaatagggacccaaagaacaaaacgtcataataagtcaaaatcgagcaatccctcacaaatgtcaagcaactaaagcctagtcgctcgcaacatgtgcatcatctagctactttagaaggaaagaggatcgtggctagagagaaactaagtactccatatttttttttgacatgaattactgtcaggcattagcccaacagtatagcttttataaaaaaaatggaaaatatttacatctaagtactccatattcatatctaagttcacttgtttgtgtttctaccatgtgaaataaaattatttgtatgagaattcgaggacatactaggaaattcatcactcgataaaaagaatgacacatatataattagcatgccattcatcacccgataccaaatatataattagcatgccattcatactcgcatttgaatgttaaaattctaacaaatatttaatatgcaaaatctatcacttgttctctttctttttcttttccattacctttctctcctttttcctatgacatggcaagtttcagtgggcccaaggactacatatagcaacatgataaactgtagattgcagaggttctattcttgtattgttatcttgatggatcttttaaaatagatgtagctttgtgataaactttatgctaaatatgcagttttacaataccatactgtgatgatttcagtattaaatttgtagttttgtgatatggcatattaagtctatcgatttgttattgttttatcaatttatctctagtttttttaaggtttactagctccagtttcaatatatatctcatcacagcaaaacaaatggagtaaatgaattctttgccaagattgatggtccccgcagaaaaaaggcactccttgtgcctcacacctataatgccgagacaatattttgttgtaataattattgatgaacaaactaaaataatcaagctacagggactaaaatgtttttataaaaaactctacgctttaaccgacatagaatttccacactccaatctttactctccagctccagaaaaaaaaaagaaataaatgatataactctatattcttttatctgtacacgcaaaaattttaattatgtcttgaattatattagaagaaaacggcatagtacacacaacggtagctttagtcaataaagtgagcagttcacaaattaagagattacataatatagaattccaaactatttaggcagttttagcatgtaaaagtgggaaaagaaaagaaaagaaaagaaaagaaaaaaagaaacagaggccggccgggaccaaagcgtagacatcttgaatcgaatgcaagtgtactaattcctcaggcgtgtcgaacaaccaaagcccctcggcaacatacggaacatcaagctatggcacaccaactttagaaagaaggaagattaaaccaggagctagctagacacagcagacaagttaagtagatattaatccccacacaatctccaaattaaaaccatgcatgcttatcatcatcaccatcaccaccaacaagaatgtccatgtcatccttccaccatcgatctctccatctctttcatcccccctccacctataaatactgctaattagctccctctcttcttcatccaagctagctatagctagtatatatctgacaaattcagagaaattcagagagtcaccgcgagagcttaagctagctagctagccggccatggcatcgcatgtggacccgctggtggtggggagggtgatcggcgacgtggtggacctgttcgtgccgacgacggccatgtcggtgcggttcgggaccaaggacctcaccaacggctgcgagatcaagccgtccgtcgccgccgcgccgcccgccgtgcagatcgccggcagggtcaacgagctcttcgctctggtcagcacacacacacacgcacatgtgcagcagaattatacttgtgttaattactagtcccttt

SEQ ID NO: 17378 - DNA, 31548 bp, Oryza sativa
aagttaccgttgcggttttcttttttttttaactgttctattgttttggaccaggctggtggttaacataccaggtggaacagatccttctcaaggtaaataatcatgcaagcatgctagtaccttataatttcctaaacaagcttaagtgatatatatagtacagtattacttcctaattgacactctttcttccatgcatcttcacttttactatatatagtcaaatatatcatgtattagagtgtgtttagttcacgctaaaactgaaagtttggttgaaattggaacgatgtgatggaaaagttgtaagtttatgtgtataggaaagttttgatgtgatggaaaagttgaaagtttgaagaaaaagtttggaactggccgtgtttagttcacccccaactaccccaaacttccaatttttcatcacatcacattacatccaaaactttcctacacacataaacttttaactttttttccgaactttcaactttctccaaacttccaatattttttaggaactaaacacagcctaaacaaggccttaattccccacaatgcaattaaccgagttgcatgcactgattttgccctgtgcaaggaaggtcgctagcaagcgctagtagtagcagtaagcaagtagcaaccgaccggctagattcggcgtagctatgcagagcctgtgtccatttcagccagctatagctgcaggctgcgcacagtaggtgccagccggcgagcggccacctgtcggccgccacgagcaacatgtggcggggctgcgggccccgccggtggtacacgtgtaagcccacctccgcactccgcgccgccacgtgtcgcacgccggacgacgacgtcggccgccaccgtcgtcatcgtcatccggccggtcgtctcacatcgctagctggatttaattagtttaattcgttggattaattaaacagggaggaggctaatctagtctagctacacggttgttttggctctcatcgaccctgatccaacgacaaaaaagacgtcgcctagctttttttgagttcgtcctggtagggtgggtggtgtgacctgctggcgtgatctttttcatctggcgactcttggaagcttttggccaaggacacgtagtcgcttatccatgatgattaattcacactgtacatttggtatcttcgtagtcaagagtaagattgctagctagctaattcaacccaagatcacccgtcaagagttatagtggagttggttcgcacgcgcacggttgatcttgtaacagcgaccgtcgtcttatcgttgattaaagctgcatcataatttgatttgataattaacacatgaattatattactccgtaggcaagcagcagccagaagctgtttaattactgattttgatgtgttcgtttaatttgtggatcgatgcaggggatgtggtggtgccgtacatggggccacggccgccggtggggatccaccgctacgtgatggtgctgttccagcagaaggcgcgcgtggcggcgccgccgcccgacgaggacgccgcgcgcgccaggttcagcacgcgcgccttcgccgaccgccacgacctcggcctccccgtcgccgccctctacttcaacgcccagaaggagcccgccaaccgccgccgccgctactagcctccctcccctcgctcggcgtcgcccatccatccatccatggacggcgacggcgacctagctagctaataagccatcggtcggccatgctcgccgtccaaactatcatgcaccatatcatgtcgtcgtttatgtggttaattaattatttccggcgttttattactgtgtggtgattaattagctgaactattgttttgatgatggtgattgttttagtacactacggacacacgcatatacaacactacacgcacaaccacactcacatcctgtgaatgcacccctaacatacgcgttctaagcgacggaaacctaagacacattcagtaccccgggtcaagtcatctctgtcggacctaatctatcacctctaataggttcggtcctcgcaagatattaatcatcagtgatgactcccctcatatatggcgggtgaagacccatcagtgacgataaacatctccgataggccgcatatagaagaggcccaccatatgtaaggttgaccaccttgactaggtagtgtttgctaactgttacaggtaattgtgacggatctatcacaggtaattgtgacttctcatatgtaatggcttgacaacgtagtgtaaaagataagtcattgatgagttaattggaaaaaaataaattttaaatattggctagcctcaggattgctagcaatgctctcaaaaaaacaaatcatatcacaatcacatatattcccagccgttctccccaataggcaataactcccgaccaacaacccaaaatatgtacaaaaacatacaattcaaactcccaagttacatattcacaatgcaaatgtcttcctcatatatttattttaactcttaaagccaaaaatttacactgttatatacttgacgcccatggtttcaaacaatgacatgtcatgttaataactagaaaaggaattgaataatacgtaatacaaaatgatgattggatgtaaatgttgaaaatattatgataatttagtaacctatcctaaattaccaaaaatgacaaaatgtgaggagttcggggtgccaaggtgttttagtctctaacaaaccaacttggcacccatagcactccccattttgtgatgatttgataatcaaagaactaaaaataaattaacattgcatatatatgattaaataacattgtcaaccacaccgaataatacttgtatgttacataaccaagattgtttaatatattgaccacaactagcactttgatcatctacttctcacgaaatactcctttctacttcatgatttccgcgagcatgaaagcagcaatttcccatcttatagaagatgggttgatggggctaatttttcacatagtattacgttgaataagacctaagtatgtattgaggaataatatcggtttatataaacaaaacatgattttgagcacaaacctcagggtcggagtcattcacttgtttcattattgttgacatgttgtggcacacgtggagaaccacactagtccccgatctgtgatgcacatttgaattcggtgttgatgatggtatcactagctcggatatgaccctgattaccttatatattcatcaaccaaatatggattctttctatgtgagagttatgtgttatatatttgaacaagtattattgcattatgaattttgtgtagtctcatttgcagatgtacttgcttggataaagggaaagaaaccgagtgcaagaagtaaagaagttgattggggatcaaactaagaccttccaaagtttactctaacattaccacatcacttttggtctatagaaggcaagagatgaagttttgtacgttttggattcgtatctaggtctccttacaacataaacttcaaacggatctagccgctgatctagaatgaatctcaaggcccatgagttcttgttgtaaaacaatccacgtacctcatttagttcgagtttgatttggaccttgggccttataattgcgtcatgggctaagcccaggggtggacgccctagggctaacactaggacgtccctaattatatttattcagtagccacatagtatagactggggggttttgcttagattatttctaccattgcagtttcatcgctagtacggtttgtggaatcccatctttgagatcttaatcattcatctacgaattgagctgcaatataccttgttcttgcttgtgtttttcgattcgcatgtagggattagccttctccgcgaggtcaactgggcagcgcattgttgataaccaaaggagacatggcgctatgatctagaatgaatctcgaggcccataagtacttattgtaaaacaatcagcatacatcatctagtccgaatttgatttggaccttaggccttataattgtgtcataggctaagcccaaggggtggacgtcctggggctaacactaggacatccctaattatatttattcagtagccacatagtttagattgggttttttcttagattatttctaccattacagtttcatcgctagtacggtttgcggaatcccatctttgagatcttaatcattcatctacaaattgagttgtaatataccttgttcttgcttgtgttttgtgattcgcatgtagggattagccttctcggcgaggtcaactgggcagtgcactgttgataaccaaaggggacatggtgctatgattgtagggttcggatcatattgatcggaagtcagatcatgtctgtcaagtttctgccaggtcaagaattatcaatacctatcagaagatcggggtccagtttctcattagttgatatcaaagtgccagattgtctgttaggtacaccctgtatcttttaggctaatattttttatacctatagccaaaatattgtcacataaaaatattgcatccattatattacctagccaatttgagacgttggattttttgtttagattttgctttgttgaattataggttgcattgttgtgtcaagtgtcggtttagttttagacttaattgtttatttgagtcttgtatctatcgtcactttggtctagggtgtgtgtttgtcgcagtgagttttggtccaattttgcatctcatcattttttttgggaccttgaaaaattgaaccctatcgtcatgggatttccttttatagtttgcggaagtttgtgtcatttagttctggagtacattgctagggttcttgtgcctttatggtgcttgtttgtgcatctagattagattggagaagatatcctccaccacgtcaaggttgaccctgctccacttagttggaccaagtaagtgttcattcgaagttggttatgattagggccttcagtccttcactttctatagtgatcaaattttggtttgcataaacggtactttgcatttgattctctatagtttttgacttttacatttgagtccctataatatttatatttactttttagtccctagtcgaagttcattcctattacaaaataaataaaaaagcaaaagaaaaaaaagaaaaggtagaaaggtgctaaaaaagaaaaaaaaaatgaagttgtacctaaaaaaaaggcatagacatagagaatgggcagcggggaaacaggtgccccacatcttctttttcgtgtaggcatatctcacacatcacggactagacatttcttttcaaaaagaattcactacgccgaatcaggtcacatttgacgggtttagccctagtcagagattagtggtcactgatgattaaactcattttgacgggtaaatgcccgtcactgttatggatcacctctaacggattgcaaattacaaccagtcacaggtaatgttcaccccctttgactggtcacatcgcaagcacgatgcgcccgtcaaaggtgctggttaccggtgaaaaaaaacaaaatataatatgttgttttgctagttgtagttgcattcatctcacaaattcacacacaaaggacgaaagaaatgccgcaaaataggtttacatgtaaattaacttgcactggcaatagttctaagcacatcatgaaatcaaacaatctgggcagcacaaaatcaatagaggacaacataatcgatcaaactgaatcatcacaaaatatgaatctagcaaaggaggagagaaagacctcctgagcaccaccgtcgcacccacctccacctcccaagcgccatcatttgctcccaccggaactgaccgctgcaaggtcaagggcagtcagatctaatgacccccgaccttgggtaggctggatctggaggcggaggggccaatggcattaggacctcaagaggcggcctccaccccgagcttatttcagcgtcgacatcgccttcgatcccgagctccgccaccaatcttccaccgccttcgccttcgcctccgcgctcgacctccaaacacacattcacatccaaacacacgtctgggcatcacgaaatcaatataaaatgcgccagaaaattaatgagaatgaaacaaagacttgccattgacgatgaaatcctaaagctgctgttgccaagctcaacgctggaggaggatgtcaacgctgatggtgcttcggcatcatcgtcgcttgagcggatctgcaggaggcggctgctgatgaccttggagcagaggacgaaggaggaggtggccggagcatggggccatccagatctggtggtctccaaccaccttgagacttgatttggtgccaaggagcatggggcggcggagagatggtggtcggcgaccttgggcggtggtgggcgaaggaggcggcggcctcgagctcctggaggctagtggcgagcgaacgtgacagtgacgcggtcgtgggaaggaagccgcaacaaccggtggttggcgggctggtggaggaagcgagaagagaggaggaagagagagtggaggagatggggagggagtaggggtggaggagaggaggagaaggggcaaattggtgggtggtaggccccctgggtgggggggtgggggttttcttttttttaagtcaccaccgacggtataaaaattgaacatgtttgaggtgagatatctcaactgtgacgggtgcaaacataaaacccgtcacaggtaagaggtcatcagtgacgggtctatatgtggacacatcaaagacgttatgtgttgggtccttgtatagatccgtcaaaggtgagtacttacctgtgacatgttattttcctaagccccatctacgacgagatttattttaacctatcagagatgatatctgtcggtgacatgggaccgggagtatcgtgactagaggcttgggcagccgcgctcacccacgtggcctgaccccctcgggggggggggggtcgggcccgagggtgacgtggccacccctccctctgtctccccgaggggtcgggccgctcccgtttcggccccgagggctggggcgccccgaccccctgtggtgttggcgccacgtgtgtgggttaggtgagcacagcggcgctcacctaaccgtatttattgcgggttggacgagcgcgccacgccgcatttaatgcagcgcagcgcgctcgcttatccggtccgtgaccggtcgcagtatgtgaccggtcacagaccggtcagattgcgggttaggtggcagcaggcggcctgtcacacgcctcgccccgtcccgtcggaatgatgagagcctccaggcactcgtccctagccggagccggcgtgctaactcctggagttggcacgtctgtcccggccagattcatgccaggcttcatcgcaaccattacaaggaagtcattgtatgaagaagggcagatgtgcggcatgctaaactgacgcatggtggacaagaatgaccggtctgtaactggtctgacgccggtcatgtcatcggcagacaaaccgtactcccacgttgcatctgcttccggcgaagtggaggtaggtatgacccatcccatcggagggtcattcggacagtggccatcgcaaatctccgcccattaatgaaggaatgacagggtgatcccctgtgtcaggcgagtgacggcgctgggcctcactcaaggacaagctgtgatttagcttccaagcgaaggcgcgagccaagtgctggtcaagatagggtgggtccccacccaaaagaagggtaggtagaagtggtgcatgtggtatccccttgagatataaaaggaggaccttgcccaccgaagaagggggatcgagatccaaaacaaaaataggagggacgactctgagaatacctgagctcgtagaggagagaaagatgaagaggggttctagagcctgaactctcttgctctccagctctctgtaactccttcacacacagatccaccataacacaggagtagggtattacgcttctcagcggcccgaacctgtctacatcgcccgtgtctcgtgcatttgctctctcgcgaacattccacagatcgagggtgaagaacctcacttcgcgcccccggccgaaccggcaaaggggggcctgcgcggtctcccggtgaggagccccacgctccgtcaatatcaatcatgatgagacatcactactactacagaatcccaagtcggtgccagttaggaaacccccttaggtgccggttttcccatccggcaccatggaggcggcacagataatggaagattaaaggtgccggtttcaaaaccggcacctttgaagcgcacatgagccaaaaaaaaaaatcagctcgatgcatcgagccgtcaagccgatcccacaaatgacaaatgacaaatgacaaatgacaaatgacaaatcacaaatcatcacatcatcaaatcatcacatcaacaaataatcacaagtcaaaacatcttccgggctatcggaccaccgccgcctcctcccctcccaccgctgccgcatccccttccgccgccacctcccctcccgccagatctggtggaggggagggcgccgccgccacctcccgggccaccgagtcaccgccgccacatccccttcagccgccgagccgtcgccactgcatccctttccaccgccacctcccgggctgccgtgccgccgccaccgcctcccctcccgccaccgagccgccgccgccgcatccccttccaccgccgagccgccgctgtgtggtggagagagagggagcgtgagagagagagagagagctgagagaggggaggatgcggagagaagggggtgagaggataagggaagagaggctgaggataaggctgaatgccaaaggagagagagaagccaggtatttaaaaggtgtcagtcagcttggctcagttggctccgccgggttctctaaataggtgtcggttacctataatataaatatgggtgtcggttcttccaaaaaaaaccgatactaatctagaagttgtcgatttttatttagaaccgacacctatctcttcacaaaggtgccggttctagccaatggtgtcctgtggatgcgcttttttggtgggaaaagcattataagtaccggttttagctgttccggcacctataatggtgacacctatttgatgttttgtaatagtgcattttggtccgtcacaggtaggccatcacagatgggctgatttggcatagtgattggtttttatgggcacaaacgcatttgggtaatttgagtcatttgatgtgaagatcgaatgactgtggaatgaaaagtgaatttatgtgtattttctactagctaggtggatgtagcaaataatataactacttctttttatatatattagtacaaacctatagatagatacaacgacattccgattctcatcgtttcatcctggaacaaaagtgaaaaatgacattcaggaactttctctaaatggaggctgcaatggctcctttgctatgtctctccacgcgcgtgcagttataaaaaaacttaacttgcatatcattcatctttcagttgtgcatgcatgatatgtaaccacttggagagttaaagtgcttatgacgtacagcatcagagtgcttattagacaacctaaccccattcgcatgtcaggaaaaagatcgatctaattaattaacagtaatataattaagagaaaaggtaagagaaatagcggctattggaaaagtaaaaagatcgatctaattaatgaaaacatgcccatacgttgagatacaagtgtataatctaattggtttggatatatatgtccgaatgaattgaaggctatggcaagaaaagtacctcatctgaatagaaaagggatcagagaaaaggtaagagaaatagtggctgttggaattggatgctcagtcgttgctgattcattgggttctttctcatcataaggtatctgtcattctcaccgtggattcttcgtctcccacacaggtggccaagttcggtaagcatccttattttaatggagctaggcagaaatttagtaaccacaaatgcaacaaaaaaaaagggaagcattgttagtagaagagtgattttattgttattattttaagaggtactaggaggcagtggtggaaccacaatcttcctaagcctactgctcaattagtacaatttacataattttacttttattttatttttttttaaaaaatgtagcataatttgagtaggtattttgagtcaggagtaacttagctaccctactccgtattatcctaccttaaatcttaaatattaagatacattagaaaatattgtatttctggcatcttcttaagacctaaatgtccagaaggttaattcgtaagctgtatttcaaataggagaaatacattagtttacttatataactctggccatcaacatttttttaatatttatgattgttctaaaaatataggcattttttcttaaaaatacatgtggttagtggttacagtactccctcttcttcaaaatataatgtgtatgaatctaaagaagttatattttgtaacggagatattgtatagagccccactacagtgctctttactcgtagtagaaatcaatctgaaccgttgatctcatttgatcgaagggtttagatatatttatactatcatcctagttagctgtagtagaaatatggaggggcattattgtaaaaaaatatgtagaggggtataatcatcatttagctatgagtaaactttttttccttcttttttagctttttcgatggaatatatgagtaatatcaggacaatggatgagcacatatcgatttagtcggggaaaaacataaatgacaaagttagccataatcactgtattagtaaattattgatttaaccttaattcaactagtagtattatattactagtagagagagctggagaatcgctctatagtatattatacaatgcaaataggtgagtgaagaagttagtatgaaggctagctagttcgttggagtatgtatgtattttattggacacattatagtgcgccacctttttttttttgttaggggccactcaagatgcacgcgaactatctatcacgcgtacaaattaaaggcgacagaggtgatatcagtctcaacctaggaagcacagattctccatctatatggtctcttttcttctctttctttctttctttttttctccaggtatatggccacttctttgtactgtcaaaccataaaatgccacgatcggagtagccagactaggagctactacttcatactcatgaagtttaggataatacttaagtcaaaccttgggaatataaatcataaataatttttaagttgttgaatttaaaaatgtaaaaaatatatgcatagatttgtcttgaaaaatacttttataaaaatatacatatcacttttcaataattatttttataaaaataagaagttaaaattgtgttttggagaccgtgtcgctgtcctaaacgacttttttacgagtataggggagtataagtgagagatcgctagccctacctaataatttcactccgatgagaccggaggtatatgacacgtgttaattaaggacatatggatcaacattcatggattgtttggtcggagaaaaagtgaaatattcatgtgtgtttttttttctaataatttcgctccgacaaggaaggaggcatggacacgtccaagaatcgatcgagcatggattctttggtcggaaaataaagtaaaatatattcgtccatcaaatcaaatatcgatagcttcgaataggttttgtggtccttcaacgtttgcatgcatgagagggctgcattaatttcgaatggtttttgtgagacactaaggaagaacgttttaacaatacctgttagagtttgtgttaaatatatacgttatcggttacagtttaaaatttggaattgtactaagtgttagaaatagagtaaggtactaccacagaacagcacatcagtgcccccatcatcagtgccggttcaagaaaacccgacactgatgatagtttgtccaaaagtaagcttgcactatgcatatctttcactgggcattgatgaggagacatcagtgcggtcttataaccaactgatacggattgttttgcaataattagtgttgggtcttaccagttgaagcgagatgactacacttttggtgggaaaagacatcagtgccaggtattcttaatacatcagtgtcgaactttcatcagtgtcgggtttttagaatacccgacacgggtgaccttaatcatactaatacttattttagatacatgaacttaactttttcatacgaacttggattgtgacaaagtttacatagaaattgtagctctcgacgagatctacggttttgtagttgaaaatttttttatttgaatttttcaaatagtcaaatacatgattcaaatctcggttaggatggctcaaaggaaaaatatccatttgctgataggattgatgtgtatgtaagttggtaaaaataggtgcatgtgaggagagattgtgggttcaaatctccatcgtgacaaaattacatttgatttgaaaaaaaatataaaatagtggttgcattttcctatatacacacctaaggatggtaggagtataaatttttatgtaggccaaattttaaatttggatccgtatcatcaatgccggttgtagccatgaaccggcactgatcagtcctcatcaatgccggcaggggcggatctatccattaggcagggtgagtcgaccgtcccagctacgacccgtgtcgccctacacccctaagaccctccctactctcttataatagtcataggccattaaatttaggtataacaaggtgtgaacgtccaacagattagtctctttcttcacaacgcatgcacgtcgcaaagaatgatcgagacagttatgcgattgaactataaatatgatatgtgttgtgtttgattgctcttatcgagtaaacatcttctttctctgccccatctatatttaaagctgtatccatcactgaacgccggtccttaacccggcactgatgaccccccttccccctccctcatcagtgtcaaaagtttagtgccggtttgattttttgcactgatgaggggttacgacctgacactgaagctattatctgtagtagtgagggtcagactctattctaaactctctcctaataaagggggcggacatattgtaatcgcataatgacttagcataggcgagagatagtagctacatacgacatctagctgaggaccgttgtaactctgatatattgtaattatactagatcgggaacgagcgactgtaatcagttctccggaaatataggcttcggctaaactccattatcatatattatctcagtggctccaacaattttggatctcctataacgcttttccgcatttggttactgatggtaatttcggactggttttataacaagtagtatcagagtcagatttggaacccgaaactatttccatgggtcacatggtggagagacacggtaaacaactcttcggggttacatgggttaatgtgacggggaagattgatgggtctgatgtgacgagggagattgttgggtttagtgtcatatcggcacgacttaaaagataggtgtagtcctcactcatcagattatttttttgggttgcgtaggtttttttctgaacgactggttgcgtaggttcaagatataaaattatgattctggttagacctgtggtagagaagactccatacaacttgaatgacccacgattgatgagccgcactaagcactctaaccataatgttaataacaatataccatagcattttgaactgattcacggtttgtcaagtagcattgtactggctgctcttgccatctgtgctacgtactgtcaaaaatatggcagtttagtgtaatggtgttaaaaggaaacattaatatattccttcctagcgttttgaactagaagaaatattgacacccattatgggcctccatactagtaaagaaaatcgtttaggataatgtttaagttaaaccttgaaaatatagatcatgaataactctcaagttattaagtttaaaaatgttaaaattatataaatagattttcttaaaaatactttcatatatatatatatatatatatatatatatatatatatatcactttgtttacacccaaatttggcacctatggacgaaatagaggaaaattgccaaagtttggaaagtgacgggttttcttcacagggccggtcagaccacaggtgtgtgggcagtctgaccggcttgtagggccggtctgaccgcaggtatgtggacagtcagaccgtcagggtccgagtccgagtctgttttcgtcgggtctcaggtttccttgctcaggaaggcaggtttcgtgtttcctttggtttctatcccgagttagacgtggagaagggcctatatagggcaagaccaacccatatttaatggataaggccggttcattgtaaaacccctgaatacaacctacttgtatcgtttttttaccgtgttttctattttaccctagtttagtccatctttgtcggtttgcgccgtaaactgtccgccgccgctgcgagaatgcgacacctctttgtaggtttgtcctgaaaatcttccgttttgcccacgagacgggtagttatcctcatatcgatctaaatcggctccgctagccggtttagctagttttatacaaaacccattttgatttggcattttggctagatcgaggtggttggcgacttcatatcactgcaaggcgtttaggtgttgcgattgtgcttgtcgacttgtcacaaaaagttgccaacacgatttttggcgactccactgggaacgatctaatcggccatatcctcgtttaatctagtaattactgttcattaaatcaggagtttcggctaaatagccgaaatcaatctacactgtaattgctatcgctacgcactggtttcatcgccggattaatctgttcggcggcgaagttaattatctggtcgtcactgaatccatctgaatacttgccgttcagcacgccgcgtataccgaggatcatcgtcaggaggcagaggccggctcgacggcctcgtttctttttgtttcatacggcaaacagagaaaagatcaggctactagagccgatctaccggcagacaagcagcaggagctttgtttctttttattactgtgcacgtgctaaaacaaagatcaggctatccaagccgatctacttctgttcacataaaaaaaaaacaacaaagccgattcctactgtatcggttatttctgtgaagcttcaatttctccaattttttgctaggaacagtaacataagaagaaacattaagaccgtatattaatctattcggtcaacgattttggctataagctatatggccggatttaatcaagaaatttcttcatcaactataacaagcgggaacggattcaacaatattactgcacaatatattaggaccgatcaaggcgtcgtgagagtaaacatcccgctacctcaagttgtagtttcaccaaaggtaacctccgattcgcccaacccatactttactaatcaaaaggttaatgatcgttgtgtagatgcatatactatttctagttttactcctatacaatatgcttatagtgctatggggggatcaacgggtgtttatacaggcgattacacaggaatcggctatatgcaaaacctagctaacggtatgactggtcgtgacactagtctaaccgcaccctaggccggtcaaaccgtgcctactattttggccagatcgggcctcttgtggccggtctgaccgcaccacttaccaccggtcagaccgggtcatcggtcggtaagaccgggtgcttggccggtcaaaccgggctatctatagccggtcagaccggttccctgagaatttctctaggtttccataccacgactagcagtactgattttaaatattattcatcacctgttaatactgttagtcatgctattccacatgtccctaatgcctacaatagggatatcctcccgatactaggtatggctaatataattatattgcgccgcaacaaccacctcttaggccaccaaatacaccaccagatccacatagacctaaaaatatggaggagttaattagtaccattattaggaatacatttgggattgaagcggaggatcgtgctagggagtaccaaaagccgtatccagatttttatgacatgatcccacatcctcgtggttatagaattcctgaatttaccaagtttagtggtgtggatagtaggaccacatgggagcatgtagatcaattcttagcgcaatgtggtgagactagtaatatggatacatgtaaattgcgcttgtttcctttatctttgtctagtgctgcttttacatggtttacttctttaccggcaaattatatttttacctgggctcatttagaacaaaaatttcatgattatttccacactagtgaaactgagcttagattggatgatttaacatcggttaggcataaatacaatgaatctgttgctgattatattgaaaggcttagagatgttaaaaaccgatgtttcaatttgaaaataactgacaaatatttggccgacattgcatatgatggattacttgattctattaaagagaggttgaatggccaaatatttcttaatgttgatcatgtgttgcatgaagctctagctcaggaaagccgagtggatgacaatagcttacatgccaatttagatgatagtgcaatatcatgtatagccgaaccaagcgatggttcgggttgtgctaataatttgtgcaatgatgtcgtgacaagtatagccgaatcaaatgttggttcggattatcttactagcttggatgataatacaacaaccattatagccgaaccaagtgttggttaggattgtgttactagtttaaacgatgatagaatagctgaatcaagtagtggttcggattgtgttgctagtttagacaatgacatcattgaaaatatagccgaactaagtgacggtttggattatatcacaagtgaaagtgaaatagcattgtcacctaagaccgaatcaaaaatcggtcatgtggatgttggaaaaaataatgataatgtcttgcgggatagtatgtgagatagaatctaaaatagttatgcatacatatcaaaggctgtatcctgaacatgtagattcggtcccatacccgcaaggttttgaggtgcccaacttcacaaaattcacaggtgaggatgctagaacaacaatggagcatatcggccaatttattgatcaatgaggtaaggccggtagtaatgatttgcatctatatggtttagttcgcttgctcctaattcaatttctacatggtcacaaatggagcatgagtttcatggttatttcaaagatgcaagcttgatggagcaaagaccgattgatacttcatcggtcacttgtgaaactatttcggttacatctatccctaagaccggaattgttagtgatcttgtccctgttagttctattgatgttggcaaaaagaaagggaaaagtgttattattggggatcctccgcccaagaataggatcaaaaatgcgaaggccgaagatcataaagttgcaaagaatgagtcatctagttcccaaaagaccaaaaagccgaagctcacttttgagatgcttatggctaagtacaagaaaggattagccggtcaacgatttgataatcaaactagtgattcaaaaagaccaagatcatctcgtagggagagatttgatcaaacaccaaagaaatcggagccatcaactataccaactccatacaaacctccggttgtgatgccatggtattcacatccaatgtcgccatttggttatccttttatgtattacatgccatggatgcctcaaccacctatgccgtgtcatcaagcatggaagcaatcacctaggatagtaccaagtcattctaacttaagacaagaccgtttcccacaaaagaatcggtctggtggatcaaaggtgaaaaaggtgaagaaggtgtgggtgaggaaagaagccaaagctccggaggtcgttactatcaatgaggaatctcaagatgttcatgtacctactggagatgtgttgaaaactatacaagcggagaagactgaggccgatgctgttgctgtcgacatcggctgtctgaccgagatagctgtccggtctaaccgccagactacggccggtctgaccgaccctcctggccggtctgaccgacggcttgcggccggtcagaccaggtctagagaccggtcggaccggggggcattagagaagagtgggaaaattgagaacaacataggagcttccacttcgaccaaaaatatcaagaatcattgcttagctcctggaaaacaaccatagccgaagtggataccttctggcttatctcgctctcaaaataggaggctacaacatcttcgggccataggtaaaaaagaaaagaaggccgaagatgtggagaacaaaacatctaataatttagagcctcaaacaacacctaagcgagtgtggagacctaaagtagtaaaagttaagagatcggtgatttcccatagaagtaacaaatccaatttgatgagagaagaatcatcggtcattagagataagtctcctccacatgatgctatggggattagtgcggtatccatcttgccttcgaaatcatgcaatctagaaagccgattttgcttggggggcaagacattaatatgctcataaaggaatcaagagagatgaacagcgatggatacgacatcagatctttgagccgccgttcgttggatgctaaggcaaggtatgagtttattgtgtttactgttatatgcctatgccatgttaagaacattgcttgctatctagcacatgtgtgtttttgcttatcaaattgatattatacatacatgttgcaaatgccagttctaagtagtggaattggtaagttggcatatattttatttgaagtatgatttggctcatgagtctttaatatttcttaaaagccaaatcatacatgtttttatggatcaccatataatatatagatttcatgtttatcgcgtcatgaaaatttttcttattagtaattcggctaatgtcaatggtcaatgtgatgatttgttctagagttgttttatttaggaacattggcattgttaatattttgcatacatgctcaagccgattacttacatttgtagtttattggaatctatgtatgtgacacatatgactttggtgattcattattgatcatacttcaattggctaagtgttttaatgccatgatgattattgtttcaaaagccacttgaattagtattcatctaaacatgttagttggatattataattatttatatgtctagagaaggaattttggtccaataatttgatacaccaagcatctggctataattaatgtgaaggaaaaattatatactaaaggccgatgtttaacttcaaatgtttggacgaaattggcgaagtcacagaccaggggcggtctgaccggcattgcacggccggtctgaccagtggtggacttgtggtctgaccggctctgcttggccggtctgaccaggtagacagggcggtctgaccggcattgcatggccggtctgaccgatcccgggcagagagttgggtgcacgttacaattgattaaaatgccgaattaattgtgaattcggatatttgtgcccatgagttagaaatagcttggagaattcctttgattagatatttgaaagatactacacttaagattgatcggaagattcggcggcaagcgctcaaatattatatcgccgaaaaatagatggagtattacttagatatctaaagttgctaggagagtagtgcatgaagggatttgtgagattcatcaatcggcccgtaagataaattagttgcttaggagagtggggtttcattgaccgaaaataattgatgattgtttcaaatgctatagagggagtgaagcttgttaacggaccggcaatgttcaattagcacctaccgctgtgttggatcctatcattaaactatagccgttctgaggttgggctttggatttcattggtcaaatttatccttcgtcatcaaaagggcattggtccgtgctagttgcaatggattacttaactaagtgggccgaagccgtgccgctcgagaatattacttgtacggagataattgactttatttttaagcatattgttcatagattcggttttcctcagacgttaaaggagcttcttttatgtctaaggaagtgagaagttttgccgaatcttatgatattaagttgttgagttcttctccttactacgctcaggctaatggataagccgagtcgagtaataaaacattgttgaaattgccgttttgccaattgaggtaaatcttggctctcttcggtatttcaagcaagacgacttgtcagttgaagattacaagaccttgatgggaagcaattttgaagacgtcatcgacaagtgtttgaagaatttgaaggagatgaagacacttcaagacggtgtttccagagagcaattaatgggaaatacttgaagaaatacttcccgagcatttggcaagatgcttaggaagtcctatgaccaataattggattatcgcgctgagataacatgttctatgcttttacgttcacgtatgttcactaaaaaggcaggggggcatgtgtttacacccaaatttggcacctatggacgaaataagggaaaattgccaaagtttggaaagtgacgggtttccttcacatggccggtcagaccacaggtgtgtgggcggtctgaccggctagtagggccggtctgactgcaggtatgtgggcggtcagactgtcagggtccgagttcaagtctgttttcgtcgggtctcagatttccttgctcgggaaggtaggtttcgtgtttcctttggtttctatcccgagttggacgcggagaagggcctgtagagggcaagaccaacccctatttaagggacaaggctagttcattgtaaaacccctgaatacaatctacttgaatcgttcttttaccgtgttttctattttaccctagtttagtccatctttgtcggtttgcgtcgtaaaccgtccgccgctgctgcgagagtgcgacacctctttgtaggtttgtcctgaaaaccttccgttttgcccacgagacgggtagttatcctcgtatcgatctaaatcggcctagaggctgattttgatctccaaatcggctccgctagcccatttagctatttttctacaaaacccatcttgatttggccttttggctagatcgaggtggttggcaacttcatatcaccgtatgacatttaggtgttgtgatcgtgcttatcgacttgtcacaaaaagttgccaacacacttttcaatatatatttttatagaaacaagaagtcaaagttgtgttttggagatcattcgctgtacaaaatgattttctttacgagtacatcggagggaatactaaaattgtccctaaatatataaacactaaacacttctggaaaaagtacgaattaccccctgaactatcgcggtcgaccgaattacctcccctagaccacaaaacctgacattcttcacccccaactatgcaaaccagacgaattacccccctcgaccaaatccgtggtggttttggtctacgtggcgtacacgtggcagtccagtcaacattctatttattaaaaagtatgggacccacttatcatactcctcttccattcttcctctctctcactcttcctctctctcttctctctctctcactctcgatgatcccgtcgaggttgtcgttgatatcaatggcggtggtggcgccgccgttgcgttagcagcacgaggacaacacaacgatctccctgatgatgaccaccgcctggagcctcctctgcaggtcgtcgtgcttggcgacgttggcgagcagcgccaccgacgcggtcgatgagccgatggccatgatggccttctcgtcgagcggcatgacgagcaccagcgacgcctggacgtcgttgagcagaccgacgacgctgacgagtcactcactgcggcgaacgatgcgaccgccgcggcgagtgcgctggcggcgccagatgacgcgaggcaccaccggtccctatcggactcccgcgcgaggcggccgacctcgcgcaccgccgcgccgcacctcgccgcgtcgcccgcccgcgcggcggcctcgacctcgcccaagctcaacacctcgcccgcctgtgccagcgtgacaggcacccgcggcgtggggatccgctcgacgccacggcagtggttggcgacgcaccacgcctggatgatgcagcggagggcgtggttggggatgaggtcgtcgacgcggaggtcacctttggtaaccgggcacatcgacgacgccgtcgctgccgtcttccccgctccggcggcgagcagccacgcctcaatgccggcctgggcttcatgcgcatgcgcgttgggagagagatagagagagagccctcatgcgcgtgcgggcacgccgtcgggcgttgggacagagagtctcgccgacctgggcttcatgtgcgtgcgcgtcgtcgggccgctggcgccgtagcccgacgcgtccggcaaccacggcgatgagaccgccgtggccgcgtcagatctctgtgcctggctcgaccagttcgctgacggtgccgctatgccagctctcctgacggcgccagagagagagagagagagagggggggagggggaagccacgccgagggggcggctgctcgtcgtggccgcagccgccgccgcctcctccttatcccctgctgccactacttccgcgtcaccccacgccgccgctgctgccgccgctctgtgttccccgcccgcagccgcagagaggaagagtgagacagagagtgagaaggagaggaagaatggaagaggaatatgataggtgggtcccacattttttaataaatagaatgctgactggactgccacgtgtatgctatatagactaaaactaccgcgatttggtcgaggggggtaatttatccggtttgcatagttgggggtgaagaatgtccgattttgtggttcaggggggtaattcggtcgaccgcgatagttcgggggggtaattcgtactttttcctgtataatactcctcaagttgttaagtttaaaaatgtaaaaattatatcaatagatttatcttaaaaatactttcttaaaagtatacatatgtcacttttcaatatatatttttgtagaaacaagaagtcaaagttgtattttgaagaccgtgtcgctgtataaaacgactttcttgatgagtacgaagggagtactaaaattgtccctaaatatataaacactaaacacttctggactttaacggggattaattaacaagagaggtgaaaccaaattagaaataataatttgtccacgatatgatattttcaattgttgacaaaatgctacttccactttttattaataaaactcaatattatttttacaattttgtacgactaggattcattacacattgtttgctaatactattttttatttaacagtgttgtcaaatataagaacgaattattggtctgacagtgcatcgccaccatcttacgattgtcgattctcccggttaattaatttatacgaacttggagctatctgagctagatactgatgaacggtggtgatttggctgtgtacatccgtttagatgtagaggccggtttaatccattatcttaaaaaaaaaactgatgaacggtgacatcatgatccacaaataccctgaggaacaaaatcgaattcttccaaagatggtaacaccagagcaaaacacatttagggtgtgttcgccagaaccggttaccagctggtacagtaaatacggaaaacggagcgatccattaacgcgtgattaattaattattagttattttttttcaaaaatagattaatttgattttttaaagcaactttcatatagaaactttttgcaaaaaatgtaccatttagcagtttagtaagtgttgttgacgagacacgtatggctcaaacatttagtagctagctagctagattaattaagaagaataaacaattcatactaaattcatcatggcaaaatgatgacgccaatgaaccagatttctctatcatggatatcagtatcaagtttgatcagtttagcacaataatgcacctctgattattagcggcatgcaatatatgcttttttaataattctaacaatgtctgcgattaaaaatttgttgccagctttgtgacgcatatataccagggcagcaaaatccttctttcgggatcggtaaataaaaaatggcaaaaatttttgacgtggaatgtatatataaacctatctttgtaagactacactctagtttggtggtacgtaatttgctgaaaaacattatgaccattattttattcaattggatggataaaatttataggaatgaacatttttaccctgtgacaagttgatgttagaatatgtgtcgaatatactagtcctatttgattacgattgaacttggagttgtaatagttggtagggatggagttagagtcagactctataacccggcatctcttttaaatagagaggggggcaccacaatgtaaccatagtgactacaatgcaacgtagacacgcatagagatgatggcggcgaagccatagtctcgtacggctaggagctatattggttgcggaggagcactcataatcagagccccggggttgtaggattcggctgaacctcgttaacaaatatcgtgtgttcatgtgtcgttatttgacgtgtcttgggtaatcaatggcttaagcgatcaagaaggatagtcgtcgttccgctgtattaactaacttttataacaagtggtacaagagcagaaggttttagtattggatcaagaagacatgtggaggaggaaacatgaggtggtgatagcgcatcgacaggagatcgtcagtagtggcgatgagatcgatggcgacaacgaggacgttgcggaggcgacgatctcgctcacgatcagaccggtgatggcggaacgtgaccggaagacgaggccgggcatggccgaaggcgttcagagagataggaggggtagcgccacggactgcacgcccgacgcacgcggcgatcatggatccgtggcggcagggaggctagtgtcggaagggcaaagccggcgagcgttcgaacaaatattattacactataagttttgtgtgttctcatttatagagatacttgccttggtaaagggaaaatatatggatgaccaaagaagttgattggggaccaaagcaagactttccccaagtctactccaacattaccacatcatttttgatccatagaaggcaagagatgaagttctgtacgttttggattcgtattcgttcagacctcctaacagcatcaacttcaaacaaatatagccactgatccagaaggactctcggggcccatgagtacttgttggaaagcttatggagtctactttgatatggttctagtcctacatcaaaattctttccaaggagttaggaaactacaaaacaagctatataccttatccagtcggagtctgatttgggctttgggctttgtaattgtttcgtgggctaaaccctatccctaatcatatttattcagtagtcgtcatagttcagagtgaggttttgcttagattatcttatctaatgtagtttcgctactagttcggtttgtggaacccaaaattcaagtgctaaatcattcatatgtaattgagttgtaatctaccttgtttttggttctgttcttcaattcacatgtttggattagccttgtcagtgaggtcaatcggaccgcgcactgttgataaaaggagacatggtgctgtggttgcaggttcgaatcgtgtttattggaaactggattgtgtgtgtcaagtttccaccaaatcgagagttgtcagtacctatcggaatatgattttaggtttatttttaatgtagtatttacagtgctatataatatataaaataatatttacaacttgtttcaattgtaactttgattgtaatttctatctttattaagtgcaaatatttgaaatttgtttgttttccttcataatgtaatatatttttttggtgaagtcatatatatgctttttctgattaagtgacatcccacaaactttcttcggcatatatgtagaatgaaggagcctttaaaacaaatagtttttattggatacaaactttgtaattctttataagctcctttttttcttcctgtaactttgtacatattctgttttaataaaaatacactgctaggcaaagccctggtagtttttcggtaaaaaaaaaaatgacatcccacaaatgttccatgaaaaagatagacaaataaatgaaaattttgattggcccattaaggaattgacgtgggctccgtcatgacccttacaacaggcaggcccattaaaggccgaaacaactcagcaaacctatatgagtggcatacatctgttgttggaataagttcacatgagtccctcaatttgtcaccgagttcaagattcgtcccttgagcgcaaaaccaggtacaacgcatcccccaacttacaaaaccacgcaaataaggtccgagagaaagaaatagaaactaatcctatcctaccctaacaaaacggatacaatacgatcttatccacatactctaatagtccttggcgggcctcgcctcggggctccccgtctccccagcatgatgtacgtcaggcaccctgccagcgccgtgatcgacgacccacagtccgacgatggcccggagctccggccgccgctccctcctctcccgtctcccgtctgtcgcggcgcacagctcctctgttatcagctaccacacgccactcctcaaccgcctctccgcccaatggctgtcgccccctgcgcttctcccgccgaccggcctccccgctcgattgttgtcgtgccctgcccttctccccgccgaccggcagccgccacccttctccctctcggcgtgcctggagagaggagaggggagagaaaggaagagaggggagatgggggagaggggaggaagaagaggatgggtgagaatgacatgtggggccccatcattttttattaatttgtgtgtgaaactgacatgtgggttccatggggtttattattttttcccggatcaaattgccacgtaagcgtcacgtcaatgccacgtcaaatgaagactgagtcaaattaaccacgtaggcgccacgtcagccaaaaccgccgtccaaaccgctgagagacctcatctgcactggttttgacaattgagggacccattgtatctggttttctggttgaaggacgaaaatcagattcgtaacaaattaagggacctcagatgaacttattcatatgttgttttactacttaatctaacggtgcaaatatttgggtgattttacgttgaaaatctgtcgacacatatgtagcccctcccaattgttaagttacaaatttgatatattttagcagaaacgaaatatgcagaatgcgagttttccatttttgagatattttaatttgtatctgcattttcatttgagtacctgtaatattcacatttatattttagtccctaatcaggtcagtagtcggttcccgttgaaaaaagtaagacagaaaggtgctgaaaaaagaaaaagaaaatcagtgatccttttgatatgttttgaaagtgtagaattatgttttgaattgtggctttgttcgttactggaggttcccattcagaacagtgcgcatggaaaacggaacggtccattagcgcgtgattaattaagtattagctaatttctttttcaaaaatagatcaatatgattttcttaagcaactttcgtatataaacttttttgcaaaaaaaacacaccgtttagcagtttgggaagcgtgcacatggaaaatgaggcagatggagctgggaacttgattcgaacacactagcgaagggtggcccgatcttcacgacagtaggtagaaaccaatgataacttgctgtagaaacagtgggtaactagctttatacctgccaaggttggatgcgaccaagcgacggggagagagacaccgaaaccgtgaggacttcgactcgatctccgaacgaccgcaaaaccacaatccggtactaatcctcacaatacggtgcagctgaactggaagccgtagagcacgaactaggggacctcaaagagatcttcctcacaagtccaagaagaactcgcaagaacaaaggggtgtaagatactcaagcagctcggctgcaaaaaccattcaggttatcaaatcatcaaaagctgttttctggaagcacataggagatatttctactaggaacaaccctcctagataggtatgaaacgtcctgaaagtttgaaggacataggctagcccaaaggtctcaacaagcgaattcccgagaatactcgcgcgtctgtttggatagtgagcagccttcagtaaaaatgtcattactccttattgggaagtccaaatgacatggggtaggttgcgttggaaagctaacttaataagatttcacaccatgtgcataatgcactgcgaaatattgtagattgatacagttttgcatggaaagttggaagtcttggcaaactgttggccttcaaagcagtgtccactaatatggccataactctttagtgggaaatccaatggacgagcggtttgttgggtgtgaaaatagactcaataagctttccagaaagtgctcattcaccttcatagcttttgagaatcaaaagttatgacgatttcttgaactagtccgttttgaagctgaactggtccgtttttactggtcctttttcaccgtccgattcagcttcctcttgttgcatattcataagcacaaccaaagtagaacgtttaggtagtataacattctcatctatagatgcatctaatcagtccttccattacttgatcacgtgtagcagtagttgaacttggtatagtcataactgggatgtcctcaacagaactactccctccgtcccaaaaatactccctccgtcccaaaaatactcaacctagtattagataaagttttctagtacaacgaatctggacatactcttatctatgttcattaaacttttttggacgaagggagtagaactatagaaacacagccttagtgtggttaggtgtttgcttaatccgtttccgagtcgtttgcgtccctaattataaatatatgtcaattgagatgttaggtgaataatgatacaaatctatatacctcaataaaagataacagtgatagttatgctacctgcattcgcatgttttataaattagttcccagtatgtcctccattatgcaatagtctaatatatgtttaaatatgaaaaacatatattcaaataaatgtgtactttaacatagcaaaacatggatattttgctagtggacagtaaaacctactatttttccccctttctgcgcgagcaccctacaccttgcgactaccaatctgtagttttgcataggggatggcattgttcatgcataacaatatatatagataacacaagcatgccactgttatatcttgtacagcggcagcaaacttgttagcctggttaggtccaggcaacaagaataaaaggacatgtcaggaaatagaacgagcttaaaaagaaatgcttggaactgcaaatgtgttacacccaaaagctacgataagctacaaagtgggtatggcaaaattgttcattctgcacacctttggtccctggtgtgcaaaaatttcccccaaacgcagcacaacttaagcccttgaaacctttttcttaacagcctttgatttcctgcttttcttctgcttcttgtattccttgtacaagttgatggatgacaacgtgtggttcagctcagctctcaatctctcattctctgagatacctcttagtaccgcaaaatgattttttaacttctctttgagttcatctccacccgcaacgcaatctgatccctcgagcgctgcagggcttagggcaacaaactccttaccacgcctcttctttctgcagtttagtggcaacaatttattcgctggtttagacaatttccgttccattgacaagtctctatatgcttctagagggcttgcatttgaaattggaacaggattctgtgtaggattcaaattggccatgctcaagatatttgaggccattgaggaaacagaggaatcgtaatgcttctgcagaaggctaagctcccataggactgaggcaagtgccccactcagataaggatctttagcttctgggtcatatttctgcacaaatgaaaggtagcattattaggtaaacacaagctgtaattgatgttgatgaattgcacaacacaagggtagacaaataccgcaactaagcaagacagggagccaccaccagaatcattttccaacatgtttctgcacttgctattcttttgaagaagatgcttcagtgtgattaatgctgaaatattgttcaaatatgtcagcaattatgtcaaaggaaatgaaacagatgtttgtacttaatacatattatgtactgtccaggaaggaaaaacaaacgtaccccaatggatctaatatttggactacaatcaaggtagaaagactgggaaagtgcaaggcaaaacaaacacaaacctgccatggcttctgcagaaccaaaggacaaagcaaaggttgctaggcgtttaatgaaagcagctgctcttatcatatcctgctgtttgccttcccagagaagtgtcttcagagcatcagctaatacctcaccacgatctctggatagagacagaaatcaggttgtgttcttaagttacttgaaaactttgcaacagctatcttagacataaccaccattcgatttaccaaaaaatgacaacacgaaaacattctgaaagtgtattgttgatggaagacacaaagtggaccgccataagccatgaattaaacatgttggtcactgctgcctccacattaataaaatggtgcttaccatatgcaagactgtataatgttcttctattatacattataatcggcattggagtacatgataaaatgcattgtcagtaatcagcatggttatgtggtatagctgtacataactacttcctccgtt

SEQ ID NO: 17379 - DNA, 655 bp, Oryza sativa
ttacctttttagccaactgttccatttaatgttgtcctcacattcttgcatttcccccaattctttgtaggaaaatgtgttgtgaaacgataaggtctctatttgtagatgaaggaaagcatcgtggtgaggcaactgttgaagctgtgagattgattgctgatcatgtgaagctaaacgattgccagcttcatcctgatagcattgaggtatgtgccaatatttgtatttattacatgtgatatgtggttattatttgtcttgtcgcatcttcaccatgcaattaatatgttaatggacttacttcaccagcttgggccctatgggcagcagctcattcctagctgctgaccactgccccatttcatccaacatagctgaaaatcaactccatgtgctaatcgtggccacttttttctgtaaggtcttcctatctttgagatttgatgatgatcttggaaaagatgacacagaggaagaaaagggaaaaccaaagaagaacaaacgacgacaaaaccaggaagtcccaaagcaattgccagtgagtgataataagaaagccaaacaggaattgatctcaaaggctagagaagaggtaacatttgttgcataatttgataggtatagctcaaactgtataagaaattcacttatt

SEQ ID NO: 17380 - DNA, 1605 bp, Oryza sativa
tccatgcagcaacaatcccctagcatgagccaacgaggctccttgcggcaatgcctcagtcatccttgcccttacacccctaggcatgcctacaccgaatctaggggtcaccactggagacccctgtcgctaccgccgtcctaactcgctgcacagttttttcaatagcttattctagtggaggcgaggcaaagaaggaggtgggtgtctcgatgatggctagggtttgccccacctagaccactcaatgcaatggacgacgcagaggttttctagctaataaagtatcgatggcctttaatatcggttttattttaactagtaatatcttttaaataatcaaattatttagcatctctagattaacttgtaatagaaagtactttactaatatactacattcaaatccattcgctttgacatcgcttaaaaattataataattactgttcatatactacttttgattaaaatcaataagtactccaaacggcttagtaagtccaactagaaaagcatgccctttgcccgtcttttgtacctgcctaaacgaagaaataaatgggaaagctctttatacctaactagcagacatttaatgatccgaatttatcaaatcagccaattgggatatgaatacgatgaacatgtactgtagtacaacttacaagcttgatcttagtttgaaaaaaataaagttttactcatatctctctctctcttaaaacagaggaatttccaattacaaacctatgtcactctttataagttacggatacaatacatgtactcagtactcatatttacattcgatgcgatttcgccaaaccgaaaatttccaaagcaaataagtaagaaacttatatttgcatttcctttggtgaaaccaaatttacagccgctttcgtgctgtgcttttccagatcttctgtaaatgctgtaatttccattccacgtcagcagccaaagccagagtagatagaatccatcaccagtgaccgctgatgacgtcatcattgaccaagtcaacctaccaactactcccacctcctcctcctcctcactggctcactccttccttccgttgaccgccgttgactcctcctcctcctccggcggcggcggccgccgccgctggtccaccggcaaccggccgtcacctccctctccggcgacggcgccgtcgccgtcgcggaacctcgcgtagatgtcccccttgtagaatctccacgtcctccagaccagcacgagcgagacgagcgcgccgaacacggtggcagccgtgatgatgaggaaggacttcttgaagcagtcgacgccgaggcacaccttgtcgcggccggcgccggcggcgaggccggcgccgggctgcctgcccgcctccgcgtcgtagagcctcccggcgacgaggacgttgaggatgtaggagccgacggggctcgccatgccgccgaagttgtagagcgtggagtagtacttgaggccgaacacctcggagatgatggcgaacacgagcggccactgcgcgccaaagcagaagccgatgatgacggaggcggcgtagagcgcgcgcgggacgccgagcgcgatgaggaggtggccggcg

SEQ ID NO: 17381 - DNA, 5691 bp, Oryza sativa
agcccattccactccccttttaggtggagctgaaactgtttcgttgggctccaggtctaggaaaggtggagctggatatatatattagggggttaagagctccagagaaatagtttagagtagagtggatttctttcttcacttgctaaacccttcctcatcttttggtgttcatatatatattgtactgaaaagtgtatatgaaatgtgaagcctactcaaaagcaattctattaacttttgatggtggattccatggacatgtagcttgaggtcatgaatttctttcagagcgtgtgggggttggggtgtgtagagtactatcaccgccatgtccacgctcaccagcgcctgcagtatcgtgtagtcctcccccctcgccggcggccggaacatgcccttcacccacgacgtctccgccggcgccggggatgaaggccgcggcgaccgctccgtctctttcgacatttcgaggacggtgatggtgtgcggcggcggggcggcggcggcgagctcgaggcgctcgcggtggatcttgaactcctgcttgatgacgacgcagagcgggaggaagaggacgatgaggagcgcggcggcggcgcaggagtaggcggtgcgggagaaggcgaactgccgctgcacgacgatcatgacgaggaggtaggcggcgaggccgatggagatgtagaggaagcagaagaaggggtcgacgctggtctcctgcccgccgcggcggcgcgggtacggcatgatccgcaccgtgtggacgaacaccaccgacaccgccgccggcagccacgcgatgagcaggatcagcgacttggcgtcgtcgccgtagaacgccaggtacagctgcgtgtacacggcgccgctgagccccacgaaccccttgagtatcccgagcacgacgccgcggctctccgggaagttcttgacgcaggtgacgagcgcgccggtgttggcgaacgactgcgagttggcgccgacgaacacgtacaggcacaccagccacacgggcggcgccgccgtgcgcccggccacggcgaggtagaccatgaggtagccggagaggttcatggcggcgccgatggcgagcaccacccacggcggcgtgacctcgttgatgaggccggagagcacgccgaggttggcgccgaggtccttgaagaaggagacggtgttgagcgtgtgctggtcgtagccgagcgacgccttgagcgccggcgagtagatgccgaagatgtacgtcgcgcccgacgccgtcaggatcagcaggctcgcgaacaccgtgaaccaccgccccaccgccacctgccgcgcgaacgccgccgtcaggatcacgcggagagggttctgccacggcggcggcggggagggcgccgccggcgagccgccgccactgctgccggtgcccgcgtcgaacaccatggctgcgcttggggggctcgggttgggttggtgtgtgtttggttagcgaggtggtactattatttatttatagagaagtaaggagggtgaaaagagtgtggagagtcagggggctttttgaggctgcatctctatacacattgctttcttggaatggacttaacatgtgtgattttcatactaggctgcgtcgttctatcacctctcttttggatccatttttttagcgcacgtaaaataaaaaattattatcatataattaattaaggattaataattataaacttaaaaatggatttattcaaaatttttaaataacttttatatagaatttattttggcaaaaaaaatcttttctctttttttcttttttagaaaaacaatataaacacaggtgctcacaacatacgcacacacgcacgtcctattcatgtaagcatctccagaaaattgagccggcatcataaaattgacgaaatcaccattggtgccttattgtcgatagatatgtcatctgccataaagaataattagccgtaaatgcgagtattggtgtcaagtctaggacttagagtcaagtgggcttgttttatcacaagaaacctaatcagttaagttacgctcgcgttctaccaaaactctttttaactgaattgtaatgtatctttcgcaaagatattttaaaaaaagaaagtttaccgaggaaataggctacatattaggctcatgtttttccatctttatgtacctctatttctccgggaaagaaataaataacacaatggagatcacacataaaagtgttttcatccctcaaacaggcgtcgctcatctcttatatgtcacctaaatagatatcaatatttttaaagaaattaacaagatagatgaatatgagatatatcactccacaaatatgcatattcaaattcgacttctataggttataatattaattagtttcagtttaatttagtttttataacttgtagaagtcgaatttaataatgtacattgtaaagcgatatatcccatattaatgtgttctataaataaatttaaaaaaatctatttaggtgaatatactcgcgagaaataaaaatccatctccgagatcacacaacatggcaacattgtcgtacgtcaatggaccccccacctcttgttgtttcttgtgtaatggtcatcacacccttgtccccatgattgatcaatgacgcacaagcttgaccatatagtggcgtaacacaagatgatggcgagggagtggtgccggtgccatcacggttctttaatttactcgtcaaattaaacctataggaagttatattattaaatccgtcttcatttaccttatcactactgactcttactgttttcacttggaccattaataacttttaaatggttaaagtgaagtggatgtcaactgagtctagggatgaaaaagaatacggattacctttcggagtggataattatcatataattaggatatggatacgaatacggatattttctcttggatacgaatacggatattttctcttggatacgaatatgaatatggtatcagggtttctaacggatatccgcctaagtcataaaacatacccaatttgtttataactctatgacctttaatggtagtagtctcttaacactagttcacactattaatattattttaatttttaaatatttttataaattatactatattttatataaaacgagctaattatatatggagatatttgtttctattagaggttgaggtggttttcgtgttccaagaaaaaaatatttccgtattcgtgtccgatcatagtcagtccttattcatattcaagataattcgtatttgtttccgtatcagagctattcgtatgtatttgtttttgtatctggcaaaaaaaaatgaaaacgaatatggtatgagcattattcgtccgtatccactctatttcatccctaactgagcctacttgggttcaagttcttatcgggtgcttgtatttatggctaattattatttcagtagcaagacgtatacaataatgtcgtcaatattaagatatgttggactagttttttgaaaagtactcataggaatagcctaataggatgcatgtacgtatgtgcgttcataaatgagtgcgcccgttgtaagcatctgcgtttgtactatgcattcttaggaaaaaatactttttttggaaaggtaggaaatttgtttaaaatggttaaatagctaaatggaagttccgtgcttatgtttaagatacaacacacttcaaaaacacgacgcccttctaagcagttataaatttttaattaaataaaaaaaacatgagtgatactttgaaaatacgacgtccttttaagcggatatttgtaatcgaggtagtaaaacagtacacttttcacatacttagctgtacgttttcaccaatatatgtctcactgacacatggatccaaaacatcacatgccactctcacaagagcgacataaattgtcaacataaattagctagttattctctcctatctctttcagtgttttcattattattattagggaagaaagctacctatgaagcatgatgggccctaatatatggacgtgcaaagatgagcagctgcttgggcgtatggacacagtagggaggcgtcggcaggaggaaagcgcacgcattgtgtgtgaaccgggatacccggtcgtctttggttatatctggagactgaagagtagttttaatcagtgaaaatcttaaaagaaaattgtgtttgtgagtttttactcttccttttattaattagtagatctgttccaaaatgttgttatgtatagaatgagacataacttagtatctagatttgagtattctctgttcagattcgtaattaatactaggtgatgtctcatcaacaatattttaggacaggtagtatatataactatatacttttgttagaatagaaacaccaggttacctgtttatatttggggaacttgtgatcctgataaataggctaaccaatgaaaatctttagaaaattgtgttatgtcagtttttcctccggtttatttttttatttattagacagctacgtagtttctttaaaaatataaactgtttagagagttggagtcttggagattttaaaagaaactatagccgtaagatataagcttctcaaacaggatccggttacttggatgagccgtcgagaaacgttgggtctcgcccggttacttggatgagccaccaagaaatgttaagggatcttccaactagcttcataaggtgatgggctggatgatttgggtttaaagcctcacctcttctaattagttgatattaggtcctatcctgatattcacgtttacttggatgagccgtcggtcacttggctttgatgtgattttgtcatgtggtaattgccaaggttagcgagtgatttgagggcgtatgggtcatagtcaattccagtccaaacgagggcagcatgatagggatgattaggtgtccagtaggaagggttaattaataagctacctaactattccggactagctacagatcaagacggcagtgtctacactctacaggtggttaattggtcctttttattctgtagatagagatttcaggaccattatctaattaatcgactggccatcttgtgatttattacatttctttttcttttagatctttattgatgtgttgcattcaggtgggttcatcctgtttgatttccaatttaattagagaatttgtttccatgtacactgatgtagttgatgtgtgcgtcatacatgcatagaccttatcaggttatgatgtaatgtttacttcatctactaaaagtgagatcatgggtttaaatccccacataattaaccgcagtagatacctagcaaactaacgaattcctaggttttacttttcttcgcagcaagttaaaaacgagtcgtttcttatcatttgcttgttagtttattagccataattaaaatataaattttaaaacttaaattatgagttgattttaagtttttttcattgtagtctattttctaaccttaaatttttaaaccgccaatagtgcatataaacaagtttaagttttacttataaattatctttgttgcttggtttatttttcacggcttatcaaccatagtccaaacagcttatcactcagcatttcaactgtagatttggaggatacattataaccatgtgattaa
